United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 12

SEQ ID NO: 174753 - DNA, 20 bp, Artificial Sequence
  Description of Artificial Sequence: Synthetic oligonucleotide
  Target: ATXN1; (-) strand; PAM type: YTN; PAM sequence: CTG
agcagtctggttacatgctt

SEQ ID NO: 174754 - DNA, 20 bp, Artificial Sequence
  Description of Artificial Sequence: Synthetic oligonucleotide
  Target: ATXN1; (-) strand; PAM type: YTN; PAM sequence: TTA
gtatagtatgaatctgagca

SEQ ID NO: 174755 - DNA, 20 bp, Artificial Sequence
  Description of Artificial Sequence: Synthetic oligonucleotide
  Target: ATXN1; (-) strand; PAM type: YTN; PAM sequence: TTG
gaaagagaaaattagtatag

SEQ ID NO: 174756 - DNA, 20 bp, Artificial Sequence
  Description of Artificial Sequence: Synthetic oligonucleotide
  Target: ATXN1; (-) strand; PAM type: YTN; PAM sequence: TTT
ggaaagagaaaattagtata

SEQ ID NO: 174757 - DNA, 20 bp, Artificial Sequence
  Description of Artificial Sequence: Synthetic oligonucleotide
  Target: ATXN1; (-) strand; PAM type: YTN; PAM sequence: TTT
tggaaagagaaaattagtat

SEQ ID NO: 174758 - DNA, 20 bp, Artificial Sequence
  Description of Artificial Sequence: Synthetic oligonucleotide
  Target: ATXN1; (-) strand; PAM type: YTN; PAM sequence: CTT
ttggaaagagaaaattagta

SEQ ID NO: 174759 - DNA, 20 bp, Artificial Sequence
  Description of Artificial Sequence: Synthetic oligonucleotide
  Target: ATXN1; (-) strand; PAM type: YTN; PAM sequence: TTC
ttttggaaagagaaaattag

SEQ ID NO: 174760 - DNA, 20 bp, Artificial Sequence
  Description of Artificial Sequence: Synthetic oligonucleotide
  Target: ATXN1; (-) strand; PAM type: YTN; PAM sequence: TTT
cttttggaaagagaaaatta

SEQ ID NO: 174761 - DNA, 20 bp, Artificial Sequence
  Description of Artificial Sequence: Synthetic oligonucleotide
  Target: ATXN1; (-) strand; PAM type: YTN; PAM sequence: TTG
gtttcttttggaaagagaaa

SEQ ID NO: 174762 - DNA, 20 bp, Artificial Sequence
  Description of Artificial Sequence: Synthetic oligonucleotide
  Target: ATXN1; (-) strand; PAM type: YTN; PAM sequence: TTT
ggtttcttttggaaagagaa

SEQ ID NO: 174763 - DNA, 20 bp, Artificial Sequence
  Description of Artificial Sequence: Synthetic oligonucleotide
  Target: ATXN1; (-) strand; PAM type: YTN; PAM sequence: TTG
tttggtttcttttggaaaga

SEQ ID NO: 174764 - DNA, 20 bp, Artificial Sequence
  Description of Artificial Sequence: Synthetic oligonucleotide
  Target: ATXN1; (-) strand; PAM type: YTN; PAM sequence: TTG
ttgtttggtttcttttggaa

SEQ ID NO: 174765 - DNA, 20 bp, Artificial Sequence
  Description of Artificial Sequence: Synthetic oligonucleotide
  Target: ATXN1; (-) strand; PAM type: YTN; PAM sequence: TTT
gttgtttggtttcttttgga

SEQ ID NO: 174766 - DNA, 20 bp, Artificial Sequence
  Description of Artificial Sequence: Synthetic oligonucleotide
  Target: ATXN1; (-) strand; PAM type: YTN; PAM sequence: TTT
tgttgtttggtttcttttgg

SEQ ID NO: 174767 - DNA, 20 bp, Artificial Sequence
  Description of Artificial Sequence: Synthetic oligonucleotide
  Target: ATXN1; (-) strand; PAM type: YTN; PAM sequence: TTA
ttttgttgtttggtttcttt

SEQ ID NO: 174768 - DNA, 20 bp, Artificial Sequence
  Description of Artificial Sequence: Synthetic oligonucleotide
  Target: ATXN1; (-) strand; PAM type: YTN; PAM sequence: TTT
attttgttgtttggtttctt

SEQ ID NO: 174769 - DNA, 20 bp, Artificial Sequence
  Description of Artificial Sequence: Synthetic oligonucleotide
  Target: ATXN1; (-) strand; PAM type: YTN; PAM sequence: TTT
tattttgttgtttggtttct

SEQ ID NO: 174770 - DNA, 20 bp, Artificial Sequence
  Description of Artificial Sequence: Synthetic oligonucleotide
  Target: ATXN1; (-) strand; PAM type: YTN; PAM sequence: TTG
gtggagttttattttgttgt

SEQ ID NO: 174771 - DNA, 20 bp, Artificial Sequence
  Description of Artificial Sequence: Synthetic oligonucleotide
  Target: ATXN1; (-) strand; PAM type: YTN; PAM sequence: CTT
ggtggagttttattttgttg

SEQ ID NO: 174772 - DNA, 20 bp, Artificial Sequence
  Description of Artificial Sequence: Synthetic oligonucleotide
  Target: ATXN1; (-) strand; PAM type: YTN; PAM sequence: TTA
gtcacttggtggagttttat

SEQ ID NO: 174773 - DNA, 20 bp, Artificial Sequence
  Description of Artificial Sequence: Synthetic oligonucleotide
  Target: ATXN1; (-) strand; PAM type: YTN; PAM sequence: TTT
agtcacttggtggagtttta

SEQ ID NO: 174774 - DNA, 20 bp, Artificial Sequence
  Description of Artificial Sequence: Synthetic oligonucleotide
  Target: ATXN1; (-) strand; PAM type: YTN; PAM sequence: TTA
gtttagtcacttggtggagt

SEQ ID NO: 174775 - DNA, 20 bp, Artificial Sequence
  Description of Artificial Sequence: Synthetic oligonucleotide
  Target: ATXN1; (-) strand; PAM type: YTN; PAM sequence: TTT
agtttagtcacttggtggag

SEQ ID NO: 174776 - DNA, 20 bp, Artificial Sequence
  Description of Artificial Sequence: Synthetic oligonucleotide
  Target: ATXN1; (-) strand; PAM type: YTN; PAM sequence: TTG
aatttagtttagtcacttgg

SEQ ID NO: 174777 - DNA, 20 bp, Artificial Sequence
  Description of Artificial Sequence: Synthetic oligonucleotide
  Target: ATXN1; (-) strand; PAM type: YTN; PAM sequence: TTT
gaatttagtttagtcacttg

SEQ ID NO: 174778 - DNA, 20 bp, Artificial Sequence
  Description of Artificial Sequence: Synthetic oligonucleotide
  Target: ATXN1; (-) strand; PAM type: YTN; PAM sequence: TTG
tatggatatttgaatttagt

SEQ ID NO: 174779 - DNA, 20 bp, Artificial Sequence
  Description of Artificial Sequence: Synthetic oligonucleotide
  Target: ATXN1; (-) strand; PAM type: YTN; PAM sequence: TTG
ccgtggatagaattgtatgg

SEQ ID NO: 174780 - DNA, 20 bp, Artificial Sequence
  Description of Artificial Sequence: Synthetic oligonucleotide
  Target: ATXN1; (-) strand; PAM type: YTN; PAM sequence: CTG
ttgccgtggatagaattgta

SEQ ID NO: 174781 - DNA, 20 bp, Artificial Sequence
  Description of Artificial Sequence: Synthetic oligonucleotide
  Target: ATXN1; (-) strand; PAM type: YTN; PAM sequence: CTG
acgctgttgccgtggataga

SEQ ID NO: 174782 - DNA, 20 bp, Artificial Sequence
  Description of Artificial Sequence: Synthetic oligonucleotide
  Target: ATXN1; (-) strand; PAM type: YTN; PAM sequence: CTG
agaaactgacgctgttgccg

SEQ ID NO: 174783 - DNA, 20 bp, Artificial Sequence
  Description of Artificial Sequence: Synthetic oligonucleotide
  Target: ATXN1; (-) strand; PAM type: YTN; PAM sequence: TTC
tgagaaactgacgctgttgc

SEQ ID NO: 174784 - DNA, 20 bp, Artificial Sequence
  Description of Artificial Sequence: Synthetic oligonucleotide
  Target: ATXN1; (-) strand; PAM type: YTN; PAM sequence: TTT
ctgagaaactgacgctgttg

SEQ ID NO: 174785 - DNA, 20 bp, Artificial Sequence
  Description of Artificial Sequence: Synthetic oligonucleotide
  Target: ATXN1; (-) strand; PAM type: YTN; PAM sequence: CTG
gcaatgaaatttctgagaaa

SEQ ID NO: 174786 - DNA, 20 bp, Artificial Sequence
  Description of Artificial Sequence: Synthetic oligonucleotide
  Target: ATXN1; (-) strand; PAM type: YTN; PAM sequence: TTG
aagtgggggagcctggcaat

SEQ ID NO: 174787 - DNA, 20 bp, Artificial Sequence
  Description of Artificial Sequence: Synthetic oligonucleotide
  Target: ATXN1; (-) strand; PAM type: YTN; PAM sequence: TTG
tccattgaagtgggggagcc

SEQ ID NO: 174788 - DNA, 20 bp, Artificial Sequence
  Description of Artificial Sequence: Synthetic oligonucleotide
  Target: ATXN1; (-) strand; PAM type: YTN; PAM sequence: CTA
ttgtccattgaagtggggga

SEQ ID NO: 174789 - DNA, 20 bp, Artificial Sequence
  Description of Artificial Sequence: Synthetic oligonucleotide
  Target: ATXN1; (-) strand; PAM type: YTN; PAM sequence: TTC
tattgtccattgaagtgggg

SEQ ID NO: 174790 - DNA, 20 bp, Artificial Sequence
  Description of Artificial Sequence: Synthetic oligonucleotide
  Target: ATXN1; (-) strand; PAM type: YTN; PAM sequence: CTT
ctattgtccattgaagtggg

SEQ ID NO: 174791 - DNA, 20 bp, Artificial Sequence
  Description of Artificial Sequence: Synthetic oligonucleotide
  Target: ATXN1; (-) strand; PAM type: YTN; PAM sequence: TTC
ttctattgtccattgaagtg

SEQ ID NO: 174792 - DNA, 20 bp, Artificial Sequence
  Description of Artificial Sequence: Synthetic oligonucleotide
  Target: ATXN1; (-) strand; PAM type: YTN; PAM sequence: TTT
cttctattgtccattgaagt

SEQ ID NO: 174793 - DNA, 20 bp, Artificial Sequence
  Description of Artificial Sequence: Synthetic oligonucleotide
  Target: ATXN1; (-) strand; PAM type: YTN; PAM sequence: TTT
tcttctattgtccattgaag

SEQ ID NO: 174794 - DNA, 20 bp, Artificial Sequence
  Description of Artificial Sequence: Synthetic oligonucleotide
  Target: ATXN1; (-) strand; PAM type: YTN; PAM sequence: TTG
aggcacattttcttctattg

SEQ ID NO: 174795 - DNA, 20 bp, Artificial Sequence
  Description of Artificial Sequence: Synthetic oligonucleotide
  Target: ATXN1; (-) strand; PAM type: YTN; PAM sequence: TTG
cgacattgaggcacattttc

SEQ ID NO: 174796 - DNA, 20 bp, Artificial Sequence
  Description of Artificial Sequence: Synthetic oligonucleotide
  Target: ATXN1; (-) strand; PAM type: YTN; PAM sequence: TTT
gcgacattgaggcacatttt

SEQ ID NO: 174797 - DNA, 20 bp, Artificial Sequence
  Description of Artificial Sequence: Synthetic oligonucleotide
  Target: ATXN1; (-) strand; PAM type: YTN; PAM sequence: CTG
aagtttgcgacattgaggca

SEQ ID NO: 174798 - DNA, 20 bp, Artificial Sequence
  Description of Artificial Sequence: Synthetic oligonucleotide
  Target: ATXN1; (-) strand; PAM type: YTN; PAM sequence: TTG
agcggcactgaagtttgcga

SEQ ID NO: 174799 - DNA, 20 bp, Artificial Sequence
  Description of Artificial Sequence: Synthetic oligonucleotide
  Target: ATXN1; (-) strand; PAM type: YTN; PAM sequence: CTT
gagcggcactgaagtttgcg

SEQ ID NO: 174800 - DNA, 20 bp, Artificial Sequence
  Description of Artificial Sequence: Synthetic oligonucleotide
  Target: ATXN1; (-) strand; PAM type: YTN; PAM sequence: CTC
cttgagcggcactgaagttt

SEQ ID NO: 174801 - DNA, 20 bp, Artificial Sequence
  Description of Artificial Sequence: Synthetic oligonucleotide
  Target: ATXN1; (-) strand; PAM type: YTN; PAM sequence: TTA
gctccttgagcggcactgaa

SEQ ID NO: 174802 - DNA, 20 bp, Artificial Sequence
  Description of Artificial Sequence: Synthetic oligonucleotide
  Target: ATXN1; (-) strand; PAM type: YTN; PAM sequence: TTA
attagctccttgagcggcac

SEQ ID NO: 174803 - DNA, 20 bp, Artificial Sequence
  Description of Artificial Sequence: Synthetic oligonucleotide
  Target: ATXN1; (-) strand; PAM type: YTN; PAM sequence: TTT
aattagctccttgagcggca

SEQ ID NO: 174804 - DNA, 20 bp, Artificial Sequence
  Description of Artificial Sequence: Synthetic oligonucleotide
  Target: ATXN1; (-) strand; PAM type: YTN; PAM sequence: CTA
ggagatttaattagctcctt

SEQ ID NO: 174805 - DNA, 20 bp, Artificial Sequence
  Description of Artificial Sequence: Synthetic oligonucleotide
  Target: ATXN1; (-) strand; PAM type: YTN; PAM sequence: TTA
gggtgtgggtgagggcatcc

SEQ ID NO: 174806 - DNA, 20 bp, Artificial Sequence
  Description of Artificial Sequence: Synthetic oligonucleotide
  Target: ATXN1; (-) strand; PAM type: YTN; PAM sequence: CTT
agggtgtgggtgagggcatc

SEQ ID NO: 174807 - DNA, 20 bp, Artificial Sequence
  Description of Artificial Sequence: Synthetic oligonucleotide
  Target: ATXN1; (-) strand; PAM type: YTN; PAM sequence: TTC
ttagggtgtgggtgagggca

SEQ ID NO: 174808 - DNA, 20 bp, Artificial Sequence
  Description of Artificial Sequence: Synthetic oligonucleotide
  Target: ATXN1; (-) strand; PAM type: YTN; PAM sequence: TTT
cttagggtgtgggtgagggc

SEQ ID NO: 174809 - DNA, 20 bp, Artificial Sequence
  Description of Artificial Sequence: Synthetic oligonucleotide
  Target: ATXN1; (-) strand; PAM type: YTN; PAM sequence: TTC
aaatttcttagggtgtgggt

SEQ ID NO: 174810 - DNA, 20 bp, Artificial Sequence
  Description of Artificial Sequence: Synthetic oligonucleotide
  Target: ATXN1; (-) strand; PAM type: YTN; PAM sequence: CTT
caaatttcttagggtgtggg

SEQ ID NO: 174811 - DNA, 20 bp, Artificial Sequence
  Description of Artificial Sequence: Synthetic oligonucleotide
  Target: ATXN1; (-) strand; PAM type: YTN; PAM sequence: TTG
cgtacccttcaaatttctta

SEQ ID NO: 174812 - DNA, 20 bp, Artificial Sequence
  Description of Artificial Sequence: Synthetic oligonucleotide
  Target: ATXN1; (-) strand; PAM type: YTN; PAM sequence: TTT
gcgtacccttcaaatttctt

SEQ ID NO: 174813 - DNA, 20 bp, Artificial Sequence
  Description of Artificial Sequence: Synthetic oligonucleotide
  Target: ATXN1; (-) strand; PAM type: YTN; PAM sequence: TTT
tgcgtacccttcaaatttct

SEQ ID NO: 174814 - DNA, 20 bp, Artificial Sequence
  Description of Artificial Sequence: Synthetic oligonucleotide
  Target: ATXN1; (-) strand; PAM type: YTN; PAM sequence: TTG
gattttgcgtacccttcaaa

SEQ ID NO: 174815 - DNA, 20 bp, Artificial Sequence
  Description of Artificial Sequence: Synthetic oligonucleotide
  Target: ATXN1; (-) strand; PAM type: YTN; PAM sequence: TTT
ggattttgcgtacccttcaa

SEQ ID NO: 174816 - DNA, 20 bp, Artificial Sequence
  Description of Artificial Sequence: Synthetic oligonucleotide
  Target: ATXN1; (-) strand; PAM type: YTN; PAM sequence: TTG
agtttggattttgcgtaccc

SEQ ID NO: 174817 - DNA, 20 bp, Artificial Sequence
  Description of Artificial Sequence: Synthetic oligonucleotide
  Target: ATXN1; (-) strand; PAM type: YTN; PAM sequence: TTG
aattgagtttggattttgcg

SEQ ID NO: 174818 - DNA, 20 bp, Artificial Sequence
  Description of Artificial Sequence: Synthetic oligonucleotide
  Target: ATXN1; (-) strand; PAM type: YTN; PAM sequence: TTA
atggtgttgaattgagtttg

SEQ ID NO: 174819 - DNA, 20 bp, Artificial Sequence
  Description of Artificial Sequence: Synthetic oligonucleotide
  Target: ATXN1; (-) strand; PAM type: YTN; PAM sequence: TTT
aatggtgttgaattgagttt

SEQ ID NO: 174820 - DNA, 20 bp, Artificial Sequence
  Description of Artificial Sequence: Synthetic oligonucleotide
  Target: ATXN1; (-) strand; PAM type: YTN; PAM sequence: TTT
taatggtgttgaattgagtt

SEQ ID NO: 174821 - DNA, 20 bp, Artificial Sequence
  Description of Artificial Sequence: Synthetic oligonucleotide
  Target: ATXN1; (-) strand; PAM type: YTN; PAM sequence: TTA
ttttaatggtgttgaattga

SEQ ID NO: 174822 - DNA, 20 bp, Artificial Sequence
  Description of Artificial Sequence: Synthetic oligonucleotide
  Target: ATXN1; (-) strand; PAM type: YTN; PAM sequence: TTT
attttaatggtgttgaattg

SEQ ID NO: 174823 - DNA, 20 bp, Artificial Sequence
  Description of Artificial Sequence: Synthetic oligonucleotide
  Target: ATXN1; (-) strand; PAM type: YTN; PAM sequence: TTT
tattttaatggtgttgaatt

SEQ ID NO: 174824 - DNA, 20 bp, Artificial Sequence
  Description of Artificial Sequence: Synthetic oligonucleotide
  Target: ATXN1; (-) strand; PAM type: YTN; PAM sequence: CTT
ttattttaatggtgttgaat

SEQ ID NO: 174825 - DNA, 20 bp, Artificial Sequence
  Description of Artificial Sequence: Synthetic oligonucleotide
  Target: ATXN1; (-) strand; PAM type: YTN; PAM sequence: TTA
tatgtaaaggccttttattt

SEQ ID NO: 174826 - DNA, 20 bp, Artificial Sequence
  Description of Artificial Sequence: Synthetic oligonucleotide
  Target: ATXN1; (-) strand; PAM type: YTN; PAM sequence: TTT
atatgtaaaggccttttatt

SEQ ID NO: 174827 - DNA, 20 bp, Artificial Sequence
  Description of Artificial Sequence: Synthetic oligonucleotide
  Target: ATXN1; (-) strand; PAM type: YTN; PAM sequence: CTT
tatatgtaaaggccttttat

SEQ ID NO: 174828 - DNA, 20 bp, Artificial Sequence
  Description of Artificial Sequence: Synthetic oligonucleotide
  Target: ATXN1; (-) strand; PAM type: YTN; PAM sequence: TTA
agctttatatgtaaaggcct

SEQ ID NO: 174829 - DNA, 20 bp, Artificial Sequence
  Description of Artificial Sequence: Synthetic oligonucleotide
  Target: ATXN1; (-) strand; PAM type: YTN; PAM sequence: TTG
tggggagaaaaggacaaaga

SEQ ID NO: 174830 - DNA, 20 bp, Artificial Sequence
  Description of Artificial Sequence: Synthetic oligonucleotide
  Target: ATXN1; (-) strand; PAM type: YTN; PAM sequence: TTT
gtggggagaaaaggacaaag

SEQ ID NO: 174831 - DNA, 20 bp, Artificial Sequence
  Description of Artificial Sequence: Synthetic oligonucleotide
  Target: ATXN1; (-) strand; PAM type: YTN; PAM sequence: CTT
tgtggggagaaaaggacaaa

SEQ ID NO: 174832 - DNA, 20 bp, Artificial Sequence
  Description of Artificial Sequence: Synthetic oligonucleotide
  Target: ATXN1; (-) strand; PAM type: YTN; PAM sequence: CTA
ctttgtggggagaaaaggac

SEQ ID NO: 174833 - DNA, 20 bp, Artificial Sequence
  Description of Artificial Sequence: Synthetic oligonucleotide
  Target: ATXN1; (-) strand; PAM type: YTN; PAM sequence: CTA
ctactttgtggggagaaaag

SEQ ID NO: 174834 - DNA, 20 bp, Artificial Sequence
  Description of Artificial Sequence: Synthetic oligonucleotide
  Target: ATXN1; (-) strand; PAM type: YTN; PAM sequence: TTG
gaaatctactactttgtggg

SEQ ID NO: 174835 - DNA, 20 bp, Artificial Sequence
  Description of Artificial Sequence: Synthetic oligonucleotide
  Target: ATXN1; (-) strand; PAM type: YTN; PAM sequence: TTT
ggaaatctactactttgtgg

SEQ ID NO: 174836 - DNA, 20 bp, Artificial Sequence
  Description of Artificial Sequence: Synthetic oligonucleotide
  Target: ATXN1; (-) strand; PAM type: YTN; PAM sequence: TTG
gggaatttggaaatctacta

SEQ ID NO: 174837 - DNA, 20 bp, Artificial Sequence
  Description of Artificial Sequence: Synthetic oligonucleotide
  Target: ATXN1; (-) strand; PAM type: YTN; PAM sequence: TTT
ggggaatttggaaatctact

SEQ ID NO: 174838 - DNA, 20 bp, Artificial Sequence
  Description of Artificial Sequence: Synthetic oligonucleotide
  Target: ATXN1; (-) strand; PAM type: YTN; PAM sequence: CTT
tggggaatttggaaatctac

SEQ ID NO: 174839 - DNA, 20 bp, Artificial Sequence
  Description of Artificial Sequence: Synthetic oligonucleotide
  Target: ATXN1; (-) strand; PAM type: YTN; PAM sequence: CTC
atgacctttggggaatttgg

SEQ ID NO: 174840 - DNA, 20 bp, Artificial Sequence
  Description of Artificial Sequence: Synthetic oligonucleotide
  Target: ATXN1; (-) strand; PAM type: YTN; PAM sequence: TTG
ccaaactcatgacctttggg

SEQ ID NO: 174841 - DNA, 20 bp, Artificial Sequence
  Description of Artificial Sequence: Synthetic oligonucleotide
  Target: ATXN1; (-) strand; PAM type: YTN; PAM sequence: TTC
cattgccaaactcatgacct

SEQ ID NO: 174842 - DNA, 20 bp, Artificial Sequence
  Description of Artificial Sequence: Synthetic oligonucleotide
  Target: ATXN1; (-) strand; PAM type: YTN; PAM sequence: TTG
ttccattgccaaactcatga

SEQ ID NO: 174843 - DNA, 20 bp, Artificial Sequence
  Description of Artificial Sequence: Synthetic oligonucleotide
  Target: ATXN1; (-) strand; PAM type: YTN; PAM sequence: CTG
gggatgccattgttccattg

SEQ ID NO: 174844 - DNA, 20 bp, Artificial Sequence
  Description of Artificial Sequence: Synthetic oligonucleotide
  Target: ATXN1; (-) strand; PAM type: YTN; PAM sequence: CTC
tggggatgccattgttccat

SEQ ID NO: 174845 - DNA, 20 bp, Artificial Sequence
  Description of Artificial Sequence: Synthetic oligonucleotide
  Target: ATXN1; (-) strand; PAM type: YTN; PAM sequence: CTC
cccaaggcagtcactctggg

SEQ ID NO: 174846 - DNA, 20 bp, Artificial Sequence
  Description of Artificial Sequence: Synthetic oligonucleotide
  Target: ATXN1; (-) strand; PAM type: YTN; PAM sequence: CTC
tccccaaggcagtcactctg

SEQ ID NO: 174847 - DNA, 20 bp, Artificial Sequence
  Description of Artificial Sequence: Synthetic oligonucleotide
  Target: ATXN1; (-) strand; PAM type: YTN; PAM sequence: CTC
tctccccaaggcagtcactc

SEQ ID NO: 174848 - DNA, 20 bp, Artificial Sequence
  Description of Artificial Sequence: Synthetic oligonucleotide
  Target: ATXN1; (-) strand; PAM type: YTN; PAM sequence: CTC
ccaagagagacaacagcccc

SEQ ID NO: 174849 - DNA, 20 bp, Artificial Sequence
  Description of Artificial Sequence: Synthetic oligonucleotide
  Target: ATXN1; (-) strand; PAM type: YTN; PAM sequence: TTG
cagctcccaagagagacaac

SEQ ID NO: 174850 - DNA, 20 bp, Artificial Sequence
  Description of Artificial Sequence: Synthetic oligonucleotide
  Target: ATXN1; (-) strand; PAM type: YTN; PAM sequence: CTT
gcagctcccaagagagacaa

SEQ ID NO: 174851 - DNA, 20 bp, Artificial Sequence
  Description of Artificial Sequence: Synthetic oligonucleotide
  Target: ATXN1; (-) strand; PAM type: YTN; PAM sequence: TTG
atgatgcttgcagctcccaa

SEQ ID NO: 174852 - DNA, 20 bp, Artificial Sequence
  Description of Artificial Sequence: Synthetic oligonucleotide
  Target: ATXN1; (-) strand; PAM type: YTN; PAM sequence: TTT
gatgatgcttgcagctccca

SEQ ID NO: 174853 - DNA, 20 bp, Artificial Sequence
  Description of Artificial Sequence: Synthetic oligonucleotide
  Target: ATXN1; (-) strand; PAM type: YTN; PAM sequence: CTT
tgatgatgcttgcagctccc

SEQ ID NO: 174854 - DNA, 20 bp, Artificial Sequence
  Description of Artificial Sequence: Synthetic oligonucleotide
  Target: ATXN1; (-) strand; PAM type: YTN; PAM sequence: CTC
atccactttgatgatgcttg

SEQ ID NO: 174855 - DNA, 20 bp, Artificial Sequence
  Description of Artificial Sequence: Synthetic oligonucleotide
  Target: ATXN1; (-) strand; PAM type: YTN; PAM sequence: CTG
tggccagccctcatccactt

SEQ ID NO: 174856 - DNA, 20 bp, Artificial Sequence
  Description of Artificial Sequence: Synthetic oligonucleotide
  Target: ATXN1; (-) strand; PAM type: YTN; PAM sequence: TTG
ctgtggccagccctcatcca

SEQ ID NO: 174857 - DNA, 20 bp, Artificial Sequence
  Description of Artificial Sequence: Synthetic oligonucleotide
  Target: ATXN1; (-) strand; PAM type: YTN; PAM sequence: CTT
gctgtggccagccctcatcc

SEQ ID NO: 174858 - DNA, 20 bp, Artificial Sequence
  Description of Artificial Sequence: Synthetic oligonucleotide
  Target: ATXN1; (-) strand; PAM type: YTN; PAM sequence: TTC
ttgctgtggccagccctcat

SEQ ID NO: 174859 - DNA, 20 bp, Artificial Sequence
  Description of Artificial Sequence: Synthetic oligonucleotide
  Target: ATXN1; (-) strand; PAM type: YTN; PAM sequence: CTT
cttgctgtggccagccctca

SEQ ID NO: 174860 - DNA, 20 bp, Artificial Sequence
  Description of Artificial Sequence: Synthetic oligonucleotide
  Target: ATXN1; (-) strand; PAM type: YTN; PAM sequence: CTA
taggacagagaccatacttc

SEQ ID NO: 174861 - DNA, 20 bp, Artificial Sequence
  Description of Artificial Sequence: Synthetic oligonucleotide
  Target: ATXN1; (-) strand; PAM type: YTN; PAM sequence: CTA
gaaaactataggacagagac

SEQ ID NO: 174862 - DNA, 20 bp, Artificial Sequence
  Description of Artificial Sequence: Synthetic oligonucleotide
  Target: ATXN1; (-) strand; PAM type: YTN; PAM sequence: CTA
acactagaaaactataggac

SEQ ID NO: 174863 - DNA, 20 bp, Artificial Sequence
  Description of Artificial Sequence: Synthetic oligonucleotide
  Target: ATXN1; (-) strand; PAM type: YTN; PAM sequence: CTC
atcaccctaacactagaaaa

SEQ ID NO: 174864 - DNA, 20 bp, Artificial Sequence
  Description of Artificial Sequence: Synthetic oligonucleotide
  Target: ATXN1; (-) strand; PAM type: YTN; PAM sequence: TTG
tgaatagatagagacctcat

SEQ ID NO: 174865 - DNA, 20 bp, Artificial Sequence
  Description of Artificial Sequence: Synthetic oligonucleotide
  Target: ATXN1; (-) strand; PAM type: YTN; PAM sequence: CTT
gtgaatagatagagacctca

SEQ ID NO: 174866 - DNA, 20 bp, Artificial Sequence
  Description of Artificial Sequence: Synthetic oligonucleotide
  Target: ATXN1; (-) strand; PAM type: YTN; PAM sequence: TTC
ttgtgaatagatagagacct

SEQ ID NO: 174867 - DNA, 20 bp, Artificial Sequence
  Description of Artificial Sequence: Synthetic oligonucleotide
  Target: ATXN1; (-) strand; PAM type: YTN; PAM sequence: CTT
cttgtgaatagatagagacc

SEQ ID NO: 174868 - DNA, 20 bp, Artificial Sequence
  Description of Artificial Sequence: Synthetic oligonucleotide
  Target: ATXN1; (-) strand; PAM type: YTN; PAM sequence: TTC
ttcttgtgaatagatagaga

SEQ ID NO: 174869 - DNA, 20 bp, Artificial Sequence
  Description of Artificial Sequence: Synthetic oligonucleotide
  Target: ATXN1; (-) strand; PAM type: YTN; PAM sequence: TTT
cttcttgtgaatagatagag

SEQ ID NO: 174870 - DNA, 20 bp, Artificial Sequence
  Description of Artificial Sequence: Synthetic oligonucleotide
  Target: ATXN1; (-) strand; PAM type: YTN; PAM sequence: TTT
tcttcttgtgaatagataga

SEQ ID NO: 174871 - DNA, 20 bp, Artificial Sequence
  Description of Artificial Sequence: Synthetic oligonucleotide
  Target: ATXN1; (-) strand; PAM type: YTN; PAM sequence: TTT
ttcttcttgtgaatagatag

SEQ ID NO: 174872 - DNA, 20 bp, Artificial Sequence
  Description of Artificial Sequence: Synthetic oligonucleotide
  Target: ATXN1; (-) strand; PAM type: YTN; PAM sequence: CTT
tttcttcttgtgaatagata

SEQ ID NO: 174873 - DNA, 20 bp, Artificial Sequence
  Description of Artificial Sequence: Synthetic oligonucleotide
  Target: ATXN1; (-) strand; PAM type: YTN; PAM sequence: CTC
tttttcttcttgtgaataga

SEQ ID NO: 174874 - DNA, 20 bp, Artificial Sequence
  Description of Artificial Sequence: Synthetic oligonucleotide
  Target: ATXN1; (-) strand; PAM type: YTN; PAM sequence: TTA
ggatgactctttttcttctt

SEQ ID NO: 174875 - DNA, 20 bp, Artificial Sequence
  Description of Artificial Sequence: Synthetic oligonucleotide
  Target: ATXN1; (-) strand; PAM type: YTN; PAM sequence: TTT
aggatgactctttttcttct

SEQ ID NO: 174876 - DNA, 20 bp, Artificial Sequence
  Description of Artificial Sequence: Synthetic oligonucleotide
  Target: ATXN1; (-) strand; PAM type: YTN; PAM sequence: TTG
ggaatggtttaggatgactc

SEQ ID NO: 174877 - DNA, 20 bp, Artificial Sequence
  Description of Artificial Sequence: Synthetic oligonucleotide
  Target: ATXN1; (-) strand; PAM type: YTN; PAM sequence: TTT
gggaatggtttaggatgact

SEQ ID NO: 174878 - DNA, 20 bp, Artificial Sequence
  Description of Artificial Sequence: Synthetic oligonucleotide
  Target: ATXN1; (-) strand; PAM type: YTN; PAM sequence: CTA
acatagtttgggaatggttt

SEQ ID NO: 174879 - DNA, 20 bp, Artificial Sequence
  Description of Artificial Sequence: Synthetic oligonucleotide
  Target: ATXN1; (-) strand; PAM type: YTN; PAM sequence: TTC
taacatagtttgggaatggt

SEQ ID NO: 174880 - DNA, 20 bp, Artificial Sequence
  Description of Artificial Sequence: Synthetic oligonucleotide
  Target: ATXN1; (-) strand; PAM type: YTN; PAM sequence: TTT
ctaacatagtttgggaatgg

SEQ ID NO: 174881 - DNA, 20 bp, Artificial Sequence
  Description of Artificial Sequence: Synthetic oligonucleotide
  Target: ATXN1; (-) strand; PAM type: YTN; PAM sequence: TTC
atttctaacatagtttggga

SEQ ID NO: 174882 - DNA, 20 bp, Artificial Sequence
  Description of Artificial Sequence: Synthetic oligonucleotide
  Target: ATXN1; (-) strand; PAM type: YTN; PAM sequence: CTT
catttctaacatagtttggg

SEQ ID NO: 174883 - DNA, 20 bp, Artificial Sequence
  Description of Artificial Sequence: Synthetic oligonucleotide
  Target: ATXN1; (-) strand; PAM type: YTN; PAM sequence: TTC
ttcatttctaacatagtttg

SEQ ID NO: 174884 - DNA, 20 bp, Artificial Sequence
  Description of Artificial Sequence: Synthetic oligonucleotide
  Target: ATXN1; (-) strand; PAM type: YTN; PAM sequence: TTT
cttcatttctaacatagttt

SEQ ID NO: 174885 - DNA, 20 bp, Artificial Sequence
  Description of Artificial Sequence: Synthetic oligonucleotide
  Target: ATXN1; (-) strand; PAM type: YTN; PAM sequence: CTT
tcttcatttctaacatagtt

SEQ ID NO: 174886 - DNA, 20 bp, Artificial Sequence
  Description of Artificial Sequence: Synthetic oligonucleotide
  Target: ATXN1; (-) strand; PAM type: YTN; PAM sequence: TTC
ccctttcttcatttctaaca

SEQ ID NO: 174887 - DNA, 20 bp, Artificial Sequence
  Description of Artificial Sequence: Synthetic oligonucleotide
  Target: ATXN1; (-) strand; PAM type: YTN; PAM sequence: CTT
cccctttcttcatttctaac

SEQ ID NO: 174888 - DNA, 20 bp, Artificial Sequence
  Description of Artificial Sequence: Synthetic oligonucleotide
  Target: ATXN1; (-) strand; PAM type: YTN; PAM sequence: TTC
ccttcccctttcttcatttc

SEQ ID NO: 174889 - DNA, 20 bp, Artificial Sequence
  Description of Artificial Sequence: Synthetic oligonucleotide
  Target: ATXN1; (-) strand; PAM type: YTN; PAM sequence: TTT
cccttcccctttcttcattt

SEQ ID NO: 174890 - DNA, 20 bp, Artificial Sequence
  Description of Artificial Sequence: Synthetic oligonucleotide
  Target: ATXN1; (-) strand; PAM type: YTN; PAM sequence: CTA
tttcccttcccctttcttca

SEQ ID NO: 174891 - DNA, 20 bp, Artificial Sequence
  Description of Artificial Sequence: Synthetic oligonucleotide
  Target: ATXN1; (-) strand; PAM type: YTN; PAM sequence: CTC
agcaagtgctatttcccttc

SEQ ID NO: 174892 - DNA, 20 bp, Artificial Sequence
  Description of Artificial Sequence: Synthetic oligonucleotide
  Target: ATXN1; (-) strand; PAM type: YTN; PAM sequence: TTA
aacgaagtgctcagcaagtg

SEQ ID NO: 174893 - DNA, 20 bp, Artificial Sequence
  Description of Artificial Sequence: Synthetic oligonucleotide
  Target: ATXN1; (-) strand; PAM type: YTN; PAM sequence: TTT
aaacgaagtgctcagcaagt

SEQ ID NO: 174894 - DNA, 20 bp, Artificial Sequence
  Description of Artificial Sequence: Synthetic oligonucleotide
  Target: ATXN1; (-) strand; PAM type: YTN; PAM sequence: CTG
gcacatttaaacgaagtgct

SEQ ID NO: 174895 - DNA, 20 bp, Artificial Sequence
  Description of Artificial Sequence: Synthetic oligonucleotide
  Target: ATXN1; (-) strand; PAM type: YTN; PAM sequence: TTA
aatataaaatatgcagcata

SEQ ID NO: 174896 - DNA, 20 bp, Artificial Sequence
  Description of Artificial Sequence: Synthetic oligonucleotide
  Target: ATXN1; (-) strand; PAM type: YTN; PAM sequence: TTG
tgtgaggattaaatataaaa

SEQ ID NO: 174897 - DNA, 20 bp, Artificial Sequence
  Description of Artificial Sequence: Synthetic oligonucleotide
  Target: ATXN1; (-) strand; PAM type: YTN; PAM sequence: TTG
tagggttgtgtgaggattaa

SEQ ID NO: 174898 - DNA, 20 bp, Artificial Sequence
  Description of Artificial Sequence: Synthetic oligonucleotide
  Target: ATXN1; (-) strand; PAM type: YTN; PAM sequence: TTT
gtagggttgtgtgaggatta

SEQ ID NO: 174899 - DNA, 20 bp, Artificial Sequence
  Description of Artificial Sequence: Synthetic oligonucleotide
  Target: ATXN1; (-) strand; PAM type: YTN; PAM sequence: CTT
tgtagggttgtgtgaggatt

SEQ ID NO: 174900 - DNA, 20 bp, Artificial Sequence
  Description of Artificial Sequence: Synthetic oligonucleotide
  Target: ATXN1; (-) strand; PAM type: YTN; PAM sequence: CTA
ctttgtagggttgtgtgagg

SEQ ID NO: 174901 - DNA, 20 bp, Artificial Sequence
  Description of Artificial Sequence: Synthetic oligonucleotide
  Target: ATXN1; (-) strand; PAM type: YTN; PAM sequence: TTC
tactttgtagggttgtgtga

SEQ ID NO: 174902 - DNA, 20 bp, Artificial Sequence
  Description of Artificial Sequence: Synthetic oligonucleotide
  Target: ATXN1; (-) strand; PAM type: YTN; PAM sequence: TTT
ctactttgtagggttgtgtg

SEQ ID NO: 174903 - DNA, 20 bp, Artificial Sequence
  Description of Artificial Sequence: Synthetic oligonucleotide
  Target: ATXN1; (-) strand; PAM type: YTN; PAM sequence: TTA
aatagagtcatcatttctac

SEQ ID NO: 174904 - DNA, 20 bp, Artificial Sequence
  Description of Artificial Sequence: Synthetic oligonucleotide
  Target: ATXN1; (-) strand; PAM type: YTN; PAM sequence: TTT
aaatagagtcatcatttcta

SEQ ID NO: 174905 - DNA, 20 bp, Artificial Sequence
  Description of Artificial Sequence: Synthetic oligonucleotide
  Target: ATXN1; (-) strand; PAM type: YTN; PAM sequence: CTT
taaatagagtcatcatttct

SEQ ID NO: 174906 - DNA, 20 bp, Artificial Sequence
  Description of Artificial Sequence: Synthetic oligonucleotide
  Target: ATXN1; (-) strand; PAM type: YTN; PAM sequence: TTG
tctttaaatagagtcatcat

SEQ ID NO: 174907 - DNA, 20 bp, Artificial Sequence
  Description of Artificial Sequence: Synthetic oligonucleotide
  Target: ATXN1; (-) strand; PAM type: YTN; PAM sequence: TTT
gtctttaaatagagtcatca

SEQ ID NO: 174908 - DNA, 20 bp, Artificial Sequence
  Description of Artificial Sequence: Synthetic oligonucleotide
  Target: ATXN1; (-) strand; PAM type: YTN; PAM sequence: TTC
agtttgtctttaaatagagt

SEQ ID NO: 174909 - DNA, 20 bp, Artificial Sequence
  Description of Artificial Sequence: Synthetic oligonucleotide
  Target: ATXN1; (-) strand; PAM type: YTN; PAM sequence: TTT
cagtttgtctttaaatagag

SEQ ID NO: 174910 - DNA, 20 bp, Artificial Sequence
  Description of Artificial Sequence: Synthetic oligonucleotide
  Target: ATXN1; (-) strand; PAM type: YTN; PAM sequence: TTG
agtttcagtttgtctttaaa

SEQ ID NO: 174911 - DNA, 20 bp, Artificial Sequence
  Description of Artificial Sequence: Synthetic oligonucleotide
  Target: ATXN1; (-) strand; PAM type: YTN; PAM sequence: TTT
gagtttcagtttgtctttaa

SEQ ID NO: 174912 - DNA, 20 bp, Artificial Sequence
  Description of Artificial Sequence: Synthetic oligonucleotide
  Target: ATXN1; (-) strand; PAM type: YTN; PAM sequence: TTT
tgagtttcagtttgtcttta

SEQ ID NO: 174913 - DNA, 20 bp, Artificial Sequence
  Description of Artificial Sequence: Synthetic oligonucleotide
  Target: ATXN1; (-) strand; PAM type: YTN; PAM sequence: CTT
ttgagtttcagtttgtcttt

SEQ ID NO: 174914 - DNA, 20 bp, Artificial Sequence
  Description of Artificial Sequence: Synthetic oligonucleotide
  Target: ATXN1; (-) strand; PAM type: YTN; PAM sequence: TTC
ttttgagtttcagtttgtct

SEQ ID NO: 174915 - DNA, 20 bp, Artificial Sequence
  Description of Artificial Sequence: Synthetic oligonucleotide
  Target: ATXN1; (-) strand; PAM type: YTN; PAM sequence: TTC
gaggaagttcttttgagttt

SEQ ID NO: 174916 - DNA, 20 bp, Artificial Sequence
  Description of Artificial Sequence: Synthetic oligonucleotide
  Target: ATXN1; (-) strand; PAM type: YTN; PAM sequence: TTT
cgaggaagttcttttgagtt

SEQ ID NO: 174917 - DNA, 20 bp, Artificial Sequence
  Description of Artificial Sequence: Synthetic oligonucleotide
  Target: ATXN1; (-) strand; PAM type: YTN; PAM sequence: CTG
tatcatttcgaggaagttct

SEQ ID NO: 174918 - DNA, 20 bp, Artificial Sequence
  Description of Artificial Sequence: Synthetic oligonucleotide
  Target: ATXN1; (-) strand; PAM type: YTN; PAM sequence: CTA
actgtatcatttcgaggaag

SEQ ID NO: 174919 - DNA, 20 bp, Artificial Sequence
  Description of Artificial Sequence: Synthetic oligonucleotide
  Target: ATXN1; (-) strand; PAM type: YTN; PAM sequence: CTG
catccataatgtgctaactg

SEQ ID NO: 174920 - DNA, 20 bp, Artificial Sequence
  Description of Artificial Sequence: Synthetic oligonucleotide
  Target: ATXN1; (-) strand; PAM type: YTN; PAM sequence: TTC
tgcatccataatgtgctaac

SEQ ID NO: 174921 - DNA, 20 bp, Artificial Sequence
  Description of Artificial Sequence: Synthetic oligonucleotide
  Target: ATXN1; (-) strand; PAM type: YTN; PAM sequence: TTG
aattctgcatccataatgtg

SEQ ID NO: 174922 - DNA, 20 bp, Artificial Sequence
  Description of Artificial Sequence: Synthetic oligonucleotide
  Target: ATXN1; (-) strand; PAM type: YTN; PAM sequence: TTT
gaattctgcatccataatgt

SEQ ID NO: 174923 - DNA, 20 bp, Artificial Sequence
  Description of Artificial Sequence: Synthetic oligonucleotide
  Target: ATXN1; (-) strand; PAM type: YTN; PAM sequence: CTG
ggtttgaattctgcatccat

SEQ ID NO: 174924 - DNA, 20 bp, Artificial Sequence
  Description of Artificial Sequence: Synthetic oligonucleotide
  Target: ATXN1; (-) strand; PAM type: YTN; PAM sequence: CTA
gacaggcctgggtttgaatt

SEQ ID NO: 174925 - DNA, 20 bp, Artificial Sequence
  Description of Artificial Sequence: Synthetic oligonucleotide
  Target: ATXN1; (-) strand; PAM type: YTN; PAM sequence: TTA
agaactagacaggcctgggt

SEQ ID NO: 174926 - DNA, 20 bp, Artificial Sequence
  Description of Artificial Sequence: Synthetic oligonucleotide
  Target: ATXN1; (-) strand; PAM type: YTN; PAM sequence: TTT
aagaactagacaggcctggg

SEQ ID NO: 174927 - DNA, 20 bp, Artificial Sequence
  Description of Artificial Sequence: Synthetic oligonucleotide
  Target: ATXN1; (-) strand; PAM type: YTN; PAM sequence: TTG
agaggcagcatggtatatgg

SEQ ID NO: 174928 - DNA, 20 bp, Artificial Sequence
  Description of Artificial Sequence: Synthetic oligonucleotide
  Target: ATXN1; (-) strand; PAM type: YTN; PAM sequence: TTT
gagaggcagcatggtatatg

SEQ ID NO: 174929 - DNA, 20 bp, Artificial Sequence
  Description of Artificial Sequence: Synthetic oligonucleotide
  Target: ATXN1; (-) strand; PAM type: YTN; PAM sequence: TTT
tgagaggcagcatggtatat

SEQ ID NO: 174930 - DNA, 20 bp, Artificial Sequence
  Description of Artificial Sequence: Synthetic oligonucleotide
  Target: ATXN1; (-) strand; PAM type: YTN; PAM sequence: CTT
ttgagaggcagcatggtata

SEQ ID NO: 174931 - DNA, 20 bp, Artificial Sequence
  Description of Artificial Sequence: Synthetic oligonucleotide
  Target: ATXN1; (-) strand; PAM type: YTN; PAM sequence: TTC
cttttgagaggcagcatggt

SEQ ID NO: 174932 - DNA, 20 bp, Artificial Sequence
  Description of Artificial Sequence: Synthetic oligonucleotide
  Target: ATXN1; (-) strand; PAM type: YTN; PAM sequence: TTT
ccttttgagaggcagcatgg

SEQ ID NO: 174933 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaacaaaaacagtg

SEQ ID NO: 174934 - DNA, 20 bp, Artificial Sequence
  Description of Artificial Sequence: Synthetic oligonucleotide
  Target: ATXN1; (-) strand; PAM type: YTN; PAM sequence: CTT
aaaaaaaaaacaaaaacagt

SEQ ID NO: 174935 - DNA, 20 bp, Artificial Sequence
  Description of Artificial Sequence: Synthetic oligonucleotide
  Target: ATXN1; (-) strand; PAM type: YTN; PAM sequence: TTG
taccttaaaaaaaaaacaaa

SEQ ID NO: 174936 - DNA, 20 bp, Artificial Sequence
  Description of Artificial Sequence: Synthetic oligonucleotide
  Target: ATXN1; (-) strand; PAM type: YTN; PAM sequence: TTT
gtaccttaaaaaaaaaacaa

SEQ ID NO: 174937 - DNA, 20 bp, Artificial Sequence
  Description of Artificial Sequence: Synthetic oligonucleotide
  Target: ATXN1; (-) strand; PAM type: YTN; PAM sequence: CTA
tatttgtaccttaaaaaaaa

SEQ ID NO: 174938 - DNA, 20 bp, Artificial Sequence
  Description of Artificial Sequence: Synthetic oligonucleotide
  Target: ATXN1; (-) strand; PAM type: YTN; PAM sequence: TTC
caaatgcacaaactatattt

SEQ ID NO: 174939 - DNA, 20 bp, Artificial Sequence
  Description of Artificial Sequence: Synthetic oligonucleotide
  Target: ATXN1; (-) strand; PAM type: YTN; PAM sequence: CTT
ccaaatgcacaaactatatt

SEQ ID NO: 174940 - DNA, 20 bp, Artificial Sequence
  Description of Artificial Sequence: Synthetic oligonucleotide
  Target: ATXN1; (-) strand; PAM type: YTN; PAM sequence: TTC
ttccaaatgcacaaactata

SEQ ID NO: 174941 - DNA, 20 bp, Artificial Sequence
  Description of Artificial Sequence: Synthetic oligonucleotide
  Target: ATXN1; (-) strand; PAM type: YTN; PAM sequence: CTT
cttccaaatgcacaaactat

SEQ ID NO: 174942 - DNA, 20 bp, Artificial Sequence
  Description of Artificial Sequence: Synthetic oligonucleotide
  Target: ATXN1; (-) strand; PAM type: YTN; PAM sequence: CTA
taacaaaaagaatgggtccc

SEQ ID NO: 174943 - DNA, 20 bp, Artificial Sequence
  Description of Artificial Sequence: Synthetic oligonucleotide
  Target: ATXN1; (-) strand; PAM type: YTN; PAM sequence: TTA
tagcacaagcctataacaaa

SEQ ID NO: 174944 - DNA, 20 bp, Artificial Sequence
  Description of Artificial Sequence: Synthetic oligonucleotide
  Target: ATXN1; (-) strand; PAM type: YTN; PAM sequence: TTT
atagcacaagcctataacaa

SEQ ID NO: 174945 - DNA, 20 bp, Artificial Sequence
  Description of Artificial Sequence: Synthetic oligonucleotide
  Target: ATXN1; (-) strand; PAM type: YTN; PAM sequence: CTA
agagtaagatggatgtttat

SEQ ID NO: 174946 - DNA, 20 bp, Artificial Sequence
  Description of Artificial Sequence: Synthetic oligonucleotide
  Target: ATXN1; (-) strand; PAM type: YTN; PAM sequence: TTA
cagacatgagcccacggcac

SEQ ID NO: 174947 - DNA, 20 bp, Artificial Sequence
  Description of Artificial Sequence: Synthetic oligonucleotide
  Target: ATXN1; (-) strand; PAM type: YTN; PAM sequence: CTG
tattacagacatgagcccac

SEQ ID NO: 174948 - DNA, 20 bp, Artificial Sequence
  Description of Artificial Sequence: Synthetic oligonucleotide
  Target: ATXN1; (-) strand; PAM type: YTN; PAM sequence: TTC
ctgtattacagacatgagcc

SEQ ID NO: 174949 - DNA, 20 bp, Artificial Sequence
  Description of Artificial Sequence: Synthetic oligonucleotide
  Target: ATXN1; (-) strand; PAM type: YTN; PAM sequence: TTG
ggttcctgtattacagacat

SEQ ID NO: 174950 - DNA, 20 bp, Artificial Sequence
  Description of Artificial Sequence: Synthetic oligonucleotide
  Target: ATXN1; (-) strand; PAM type: YTN; PAM sequence: TTC
agaaatgattgggttcctgt

SEQ ID NO: 174951 - DNA, 20 bp, Artificial Sequence
  Description of Artificial Sequence: Synthetic oligonucleotide
  Target: ATXN1; (-) strand; PAM type: YTN; PAM sequence: TTT
cagaaatgattgggttcctg

SEQ ID NO: 174952 - DNA, 20 bp, Artificial Sequence
  Description of Artificial Sequence: Synthetic oligonucleotide
  Target: ATXN1; (-) strand; PAM type: YTN; PAM sequence: CTT
tcagaaatgattgggttcct

SEQ ID NO: 174953 - DNA, 20 bp, Artificial Sequence
  Description of Artificial Sequence: Synthetic oligonucleotide
  Target: ATXN1; (-) strand; PAM type: YTN; PAM sequence: TTA
gacagactttcagaaatgat

SEQ ID NO: 174954 - DNA, 20 bp, Artificial Sequence
  Description of Artificial Sequence: Synthetic oligonucleotide
  Target: ATXN1; (-) strand; PAM type: YTN; PAM sequence: CTG
ttagacagactttcagaaat

SEQ ID NO: 174955 - DNA, 20 bp, Artificial Sequence
  Description of Artificial Sequence: Synthetic oligonucleotide
  Target: ATXN1; (-) strand; PAM type: YTN; PAM sequence: CTG
cacacaatatcactgttaga

SEQ ID NO: 174956 - DNA, 20 bp, Artificial Sequence
  Description of Artificial Sequence: Synthetic oligonucleotide
  Target: ATXN1; (-) strand; PAM type: YTN; PAM sequence: TTG
ctgcacacaatatcactgtt

SEQ ID NO: 174957 - DNA, 20 bp, Artificial Sequence
  Description of Artificial Sequence: Synthetic oligonucleotide
  Target: ATXN1; (-) strand; PAM type: YTN; PAM sequence: TTT
gctgcacacaatatcactgt

SEQ ID NO: 174958 - DNA, 20 bp, Artificial Sequence
  Description of Artificial Sequence: Synthetic oligonucleotide
  Target: ATXN1; (-) strand; PAM type: YTN; PAM sequence: TTA
aacatttgctgcacacaata

SEQ ID NO: 174959 - DNA, 20 bp, Artificial Sequence
  Description of Artificial Sequence: Synthetic oligonucleotide
  Target: ATXN1; (-) strand; PAM type: YTN; PAM sequence: TTC
attaaacatttgctgcacac

SEQ ID NO: 174960 - DNA, 20 bp, Artificial Sequence
  Description of Artificial Sequence: Synthetic oligonucleotide
  Target: ATXN1; (-) strand; PAM type: YTN; PAM sequence: CTC
atccattcattaaacatttg

SEQ ID NO: 174961 - DNA, 20 bp, Artificial Sequence
  Description of Artificial Sequence: Synthetic oligonucleotide
  Target: ATXN1; (-) strand; PAM type: YTN; PAM sequence: TTC
actcatccattcattaaaca

SEQ ID NO: 174962 - DNA, 20 bp, Artificial Sequence
  Description of Artificial Sequence: Synthetic oligonucleotide
  Target: ATXN1; (-) strand; PAM type: YTN; PAM sequence: TTC
acattcactcatccattcat

SEQ ID NO: 174963 - DNA, 20 bp, Artificial Sequence
  Description of Artificial Sequence: Synthetic oligonucleotide
  Target: ATXN1; (-) strand; PAM type: YTN; PAM sequence: TTG
attcacattcactcatccat

SEQ ID NO: 174964 - DNA, 20 bp, Artificial Sequence
  Description of Artificial Sequence: Synthetic oligonucleotide
  Target: ATXN1; (-) strand; PAM type: YTN; PAM sequence: TTC
ccccacccattgattcacat

SEQ ID NO: 174965 - DNA, 20 bp, Artificial Sequence
  Description of Artificial Sequence: Synthetic oligonucleotide
  Target: ATXN1; (-) strand; PAM type: YTN; PAM sequence: TTA
ttcccccacccattgattca

SEQ ID NO: 174966 - DNA, 20 bp, Artificial Sequence
  Description of Artificial Sequence: Synthetic oligonucleotide
  Target: ATXN1; (-) strand; PAM type: YTN; PAM sequence: TTT
attcccccacccattgattc

SEQ ID NO: 174967 - DNA, 20 bp, Artificial Sequence
  Description of Artificial Sequence: Synthetic oligonucleotide
  Target: ATXN1; (-) strand; PAM type: YTN; PAM sequence: TTA
tttattcccccacccattga

SEQ ID NO: 174968 - DNA, 20 bp, Artificial Sequence
  Description of Artificial Sequence: Synthetic oligonucleotide
  Target: ATXN1; (-) strand; PAM type: YTN; PAM sequence: TTT
atttattcccccacccattg

SEQ ID NO: 174969 - DNA, 20 bp, Artificial Sequence
  Description of Artificial Sequence: Synthetic oligonucleotide
  Target: ATXN1; (-) strand; PAM type: YTN; PAM sequence: TTA
tttatttattcccccaccca

SEQ ID NO: 174970 - DNA, 20 bp, Artificial Sequence
  Description of Artificial Sequence: Synthetic oligonucleotide
  Target: ATXN1; (-) strand; PAM type: YTN; PAM sequence: TTT
atttatttattcccccaccc

SEQ ID NO: 174971 - DNA, 20 bp, Artificial Sequence
  Description of Artificial Sequence: Synthetic oligonucleotide
  Target: ATXN1; (-) strand; PAM type: YTN; PAM sequence: TTC
atttatttatttattccccc

SEQ ID NO: 174972 - DNA, 20 bp, Artificial Sequence
  Description of Artificial Sequence: Synthetic oligonucleotide
  Target: ATXN1; (-) strand; PAM type: YTN; PAM sequence: TTC
attcatttatttatttattc

SEQ ID NO: 174973 - DNA, 20 bp, Artificial Sequence
  Description of Artificial Sequence: Synthetic oligonucleotide
  Target: ATXN1; (-) strand; PAM type: YTN; PAM sequence: TTC
attcattcatttatttattt

SEQ ID NO: 174974 - DNA, 20 bp, Artificial Sequence
  Description of Artificial Sequence: Synthetic oligonucleotide
  Target: ATXN1; (-) strand; PAM type: YTN; PAM sequence: TTT
cattcattcatttatttatt

SEQ ID NO: 174975 - DNA, 20 bp, Artificial Sequence
  Description of Artificial Sequence: Synthetic oligonucleotide
  Target: ATXN1; (-) strand; PAM type: YTN; PAM sequence: CTT
tcattcattcatttatttat

SEQ ID NO: 174976 - DNA, 20 bp, Artificial Sequence
  Description of Artificial Sequence: Synthetic oligonucleotide
  Target: ATXN1; (-) strand; PAM type: YTN; PAM sequence: TTC
actttcattcattcatttat

SEQ ID NO: 174977 - DNA, 20 bp, Artificial Sequence
  Description of Artificial Sequence: Synthetic oligonucleotide
  Target: ATXN1; (-) strand; PAM type: YTN; PAM sequence: TTT
cactttcattcattcattta

SEQ ID NO: 174978 - DNA, 20 bp, Artificial Sequence
  Description of Artificial Sequence: Synthetic oligonucleotide
  Target: ATXN1; (-) strand; PAM type: YTN; PAM sequence: CTC
gtcagtttcactttcattca

SEQ ID NO: 174979 - DNA, 20 bp, Artificial Sequence
  Description of Artificial Sequence: Synthetic oligonucleotide
  Target: ATXN1; (-) strand; PAM type: YTN; PAM sequence: TTC
agtcccagtatgggctcgtc

SEQ ID NO: 174980 - DNA, 20 bp, Artificial Sequence
  Description of Artificial Sequence: Synthetic oligonucleotide
  Target: ATXN1; (-) strand; PAM type: YTN; PAM sequence: TTG
ccgattcagtcccagtatgg

SEQ ID NO: 174981 - DNA, 20 bp, Artificial Sequence
  Description of Artificial Sequence: Synthetic oligonucleotide
  Target: ATXN1; (-) strand; PAM type: YTN; PAM sequence: TTC
aggaggcccacattgccgat

SEQ ID NO: 174982 - DNA, 20 bp, Artificial Sequence
  Description of Artificial Sequence: Synthetic oligonucleotide
  Target: ATXN1; (-) strand; PAM type: YTN; PAM sequence: TTT
caggaggcccacattgccga

SEQ ID NO: 174983 - DNA, 20 bp, Artificial Sequence
  Description of Artificial Sequence: Synthetic oligonucleotide
  Target: ATXN1; (-) strand; PAM type: YTN; PAM sequence: CTT
tcaggaggcccacattgccg

SEQ ID NO: 174984 - DNA, 20 bp, Artificial Sequence
  Description of Artificial Sequence: Synthetic oligonucleotide
  Target: ATXN1; (-) strand; PAM type: YTN; PAM sequence: TTA
acatgcagtgctttcaggag

SEQ ID NO: 174985 - DNA, 20 bp, Artificial Sequence
  Description of Artificial Sequence: Synthetic oligonucleotide
  Target: ATXN1; (-) strand; PAM type: YTN; PAM sequence: CTC
aaaaaagtagtgattaacat

SEQ ID NO: 174986 - DNA, 20 bp, Artificial Sequence
  Description of Artificial Sequence: Synthetic oligonucleotide
  Target: ATXN1; (-) strand; PAM type: YTN; PAM sequence: CTC
cagacacccaaacatcatgt

SEQ ID NO: 174987 - DNA, 20 bp, Artificial Sequence
  Description of Artificial Sequence: Synthetic oligonucleotide
  Target: ATXN1; (-) strand; PAM type: YTN; PAM sequence: TTC
tccagacacccaaacatcat

SEQ ID NO: 174988 - DNA, 20 bp, Artificial Sequence
  Description of Artificial Sequence: Synthetic oligonucleotide
  Target: ATXN1; (-) strand; PAM type: YTN; PAM sequence: TTT
ctccagacacccaaacatca

SEQ ID NO: 174989 - DNA, 20 bp, Artificial Sequence
  Description of Artificial Sequence: Synthetic oligonucleotide
  Target: ATXN1; (-) strand; PAM type: YTN; PAM sequence: TTT
tctccagacacccaaacatc

SEQ ID NO: 174990 - DNA, 20 bp, Artificial Sequence
  Description of Artificial Sequence: Synthetic oligonucleotide
  Target: ATXN1; (-) strand; PAM type: YTN; PAM sequence: TTT
ttctccagacacccaaacat

SEQ ID NO: 174991 - DNA, 20 bp, Artificial Sequence
  Description of Artificial Sequence: Synthetic oligonucleotide
  Target: ATXN1; (-) strand; PAM type: YTN; PAM sequence: TTG
cgtcagtaaaaaagcccaga

SEQ ID NO: 174992 - DNA, 20 bp, Artificial Sequence
  Description of Artificial Sequence: Synthetic oligonucleotide
  Target: ATXN1; (-) strand; PAM type: YTN; PAM sequence: TTA
tatcaggtgggccattgcgt

SEQ ID NO: 174993 - DNA, 20 bp, Artificial Sequence
  Description of Artificial Sequence: Synthetic oligonucleotide
  Target: ATXN1; (-) strand; PAM type: YTN; PAM sequence: CTG
atggaaatcaaaattatatc

SEQ ID NO: 174994 - DNA, 20 bp, Artificial Sequence
  Description of Artificial Sequence: Synthetic oligonucleotide
  Target: ATXN1; (-) strand; PAM type: YTN; PAM sequence: TTA
gtggctgatggaaatcaaaa

SEQ ID NO: 174995 - DNA, 20 bp, Artificial Sequence
  Description of Artificial Sequence: Synthetic oligonucleotide
  Target: ATXN1; (-) strand; PAM type: YTN; PAM sequence: TTT
agtggctgatggaaatcaaa

SEQ ID NO: 174996 - DNA, 20 bp, Artificial Sequence
  Description of Artificial Sequence: Synthetic oligonucleotide
  Target: ATXN1; (-) strand; PAM type: YTN; PAM sequence: CTA
agtttagtggctgatggaaa

SEQ ID NO: 174997 - DNA, 20 bp, Artificial Sequence
  Description of Artificial Sequence: Synthetic oligonucleotide
  Target: ATXN1; (-) strand; PAM type: YTN; PAM sequence: TTC
aggctaagtttagtggctga

SEQ ID NO: 174998 - DNA, 20 bp, Artificial Sequence
  Description of Artificial Sequence: Synthetic oligonucleotide
  Target: ATXN1; (-) strand; PAM type: YTN; PAM sequence: CTT
caggctaagtttagtggctg

SEQ ID NO: 174999 - DNA, 20 bp, Artificial Sequence
  Description of Artificial Sequence: Synthetic oligonucleotide
  Target: ATXN1; (-) strand; PAM type: YTN; PAM sequence: TTG
tcttcaggctaagtttagtg

SEQ ID NO: 175000 - DNA, 20 bp, Artificial Sequence
  Description of Artificial Sequence: Synthetic oligonucleotide
  Target: ATXN1; (-) strand; PAM type: YTN; PAM sequence: TTT
gtcttcaggctaagtttagt

SEQ ID NO: 175001 - DNA, 20 bp, Artificial Sequence
  Description of Artificial Sequence: Synthetic oligonucleotide
  Target: ATXN1; (-) strand; PAM type: YTN; PAM sequence: TTT
tgtcttcaggctaagtttag

SEQ ID NO: 175002 - DNA, 20 bp, Artificial Sequence
  Description of Artificial Sequence: Synthetic oligonucleotide
  Target: ATXN1; (-) strand; PAM type: YTN; PAM sequence: TTC
aaaggaaattttgtcttcag

SEQ ID NO: 175003 - DNA, 20 bp, Artificial Sequence
  Description of Artificial Sequence: Synthetic oligonucleotide
  Target: ATXN1; (-) strand; PAM type: YTN; PAM sequence: TTT
caaaggaaattttgtcttca

SEQ ID NO: 175004 - DNA, 20 bp, Artificial Sequence
  Description of Artificial Sequence: Synthetic oligonucleotide
  Target: ATXN1; (-) strand; PAM type: YTN; PAM sequence: CTT
tcaaaggaaattttgtcttc

SEQ ID NO: 175005 - DNA, 20 bp, Artificial Sequence
  Description of Artificial Sequence: Synthetic oligonucleotide
  Target: ATXN1; (-) strand; PAM type: YTN; PAM sequence: CTG
aatcctttcaaaggaaattt

SEQ ID NO: 175006 - DNA, 20 bp, Artificial Sequence
  Description of Artificial Sequence: Synthetic oligonucleotide
  Target: ATXN1; (-) strand; PAM type: YTN; PAM sequence: CTA
agctgaatcctttcaaagga

SEQ ID NO: 175007 - DNA, 20 bp, Artificial Sequence
  Description of Artificial Sequence: Synthetic oligonucleotide
  Target: ATXN1; (-) strand; PAM type: YTN; PAM sequence: TTC
ccctaagctgaatcctttca

SEQ ID NO: 175008 - DNA, 20 bp, Artificial Sequence
  Description of Artificial Sequence: Synthetic oligonucleotide
  Target: ATXN1; (-) strand; PAM type: YTN; PAM sequence: CTG
ttcccctaagctgaatcctt

SEQ ID NO: 175009 - DNA, 20 bp, Artificial Sequence
  Description of Artificial Sequence: Synthetic oligonucleotide
  Target: ATXN1; (-) strand; PAM type: YTN; PAM sequence: TTA
tctgttcccctaagctgaat

SEQ ID NO: 175010 - DNA, 20 bp, Artificial Sequence
  Description of Artificial Sequence: Synthetic oligonucleotide
  Target: ATXN1; (-) strand; PAM type: YTN; PAM sequence: TTA
ttatctgttcccctaagctg

SEQ ID NO: 175011 - DNA, 20 bp, Artificial Sequence
  Description of Artificial Sequence: Synthetic oligonucleotide
  Target: ATXN1; (-) strand; PAM type: YTN; PAM sequence: CTT
attatctgttcccctaagct

SEQ ID NO: 175012 - DNA, 20 bp, Artificial Sequence
  Description of Artificial Sequence: Synthetic oligonucleotide
  Target: ATXN1; (-) strand; PAM type: YTN; PAM sequence: CTC
cttattatctgttcccctaa

SEQ ID NO: 175013 - DNA, 20 bp, Artificial Sequence
  Description of Artificial Sequence: Synthetic oligonucleotide
  Target: ATXN1; (-) strand; PAM type: YTN; PAM sequence: TTC
cccaaataaccacctcctta

SEQ ID NO: 175014 - DNA, 20 bp, Artificial Sequence
  Description of Artificial Sequence: Synthetic oligonucleotide
  Target: ATXN1; (-) strand; PAM type: YTN; PAM sequence: TTT
ccccaaataaccacctcctt

SEQ ID NO: 175015 - DNA, 20 bp, Artificial Sequence
  Description of Artificial Sequence: Synthetic oligonucleotide
  Target: ATXN1; (-) strand; PAM type: YTN; PAM sequence: TTG
tttccccaaataaccacctc

SEQ ID NO: 175016 - DNA, 20 bp, Artificial Sequence
  Description of Artificial Sequence: Synthetic oligonucleotide
  Target: ATXN1; (-) strand; PAM type: YTN; PAM sequence: CTT
gtttccccaaataaccacct

SEQ ID NO: 175017 - DNA, 20 bp, Artificial Sequence
  Description of Artificial Sequence: Synthetic oligonucleotide
  Target: ATXN1; (-) strand; PAM type: YTN; PAM sequence: CTC
ttgtttccccaaataaccac

SEQ ID NO: 175018 - DNA, 20 bp, Artificial Sequence
  Description of Artificial Sequence: Synthetic oligonucleotide
  Target: ATXN1; (-) strand; PAM type: YTN; PAM sequence: TTA
taggaatgtaaagtaactct

SEQ ID NO: 175019 - DNA, 20 bp, Artificial Sequence
  Description of Artificial Sequence: Synthetic oligonucleotide
  Target: ATXN1; (-) strand; PAM type: YTN; PAM sequence: TTA
gaaatatgttataggaatgt

SEQ ID NO: 175020 - DNA, 20 bp, Artificial Sequence
  Description of Artificial Sequence: Synthetic oligonucleotide
  Target: ATXN1; (-) strand; PAM type: YTN; PAM sequence: TTT
agaaatatgttataggaatg

SEQ ID NO: 175021 - DNA, 20 bp, Artificial Sequence
  Description of Artificial Sequence: Synthetic oligonucleotide
  Target: ATXN1; (-) strand; PAM type: YTN; PAM sequence: TTT
tagaaatatgttataggaat

SEQ ID NO: 175022 - DNA, 20 bp, Artificial Sequence
  Description of Artificial Sequence: Synthetic oligonucleotide
  Target: ATXN1; (-) strand; PAM type: YTN; PAM sequence: TTT
ttagaaatatgttataggaa

SEQ ID NO: 175023 - DNA, 20 bp, Artificial Sequence
  Description of Artificial Sequence: Synthetic oligonucleotide
  Target: ATXN1; (-) strand; PAM type: YTN; PAM sequence: TTC
atttttagaaatatgttata

SEQ ID NO: 175024 - DNA, 20 bp, Artificial Sequence
  Description of Artificial Sequence: Synthetic oligonucleotide
  Target: ATXN1; (-) strand; PAM type: YTN; PAM sequence: TTT
catttttagaaatatgttat

SEQ ID NO: 175025 - DNA, 20 bp, Artificial Sequence
  Description of Artificial Sequence: Synthetic oligonucleotide
  Target: ATXN1; (-) strand; PAM type: YTN; PAM sequence: TTG
agaatgtttcatttttagaa

SEQ ID NO: 175026 - DNA, 20 bp, Artificial Sequence
  Description of Artificial Sequence: Synthetic oligonucleotide
  Target: ATXN1; (-) strand; PAM type: YTN; PAM sequence: TTT
gagaatgtttcatttttaga

SEQ ID NO: 175027 - DNA, 20 bp, Artificial Sequence
  Description of Artificial Sequence: Synthetic oligonucleotide
  Target: ATXN1; (-) strand; PAM type: YTN; PAM sequence: CTT
tgagaatgtttcatttttag

SEQ ID NO: 175028 - DNA, 20 bp, Artificial Sequence
  Description of Artificial Sequence: Synthetic oligonucleotide
  Target: ATXN1; (-) strand; PAM type: YTN; PAM sequence: TTC
cagctttgagaatgtttcat

SEQ ID NO: 175029 - DNA, 20 bp, Artificial Sequence
  Description of Artificial Sequence: Synthetic oligonucleotide
  Target: ATXN1; (-) strand; PAM type: YTN; PAM sequence: TTT
ccagctttgagaatgtttca

SEQ ID NO: 175030 - DNA, 20 bp, Artificial Sequence
  Description of Artificial Sequence: Synthetic oligonucleotide
  Target: ATXN1; (-) strand; PAM type: YTN; PAM sequence: CTT
tccagctttgagaatgtttc

SEQ ID NO: 175031 - DNA, 20 bp, Artificial Sequence
  Description of Artificial Sequence: Synthetic oligonucleotide
  Target: ATXN1; (-) strand; PAM type: YTN; PAM sequence: TTA
ctttccagctttgagaatgt

SEQ ID NO: 175032 - DNA, 20 bp, Artificial Sequence
  Description of Artificial Sequence: Synthetic oligonucleotide
  Target: ATXN1; (-) strand; PAM type: YTN; PAM sequence: CTT
actttccagctttgagaatg

SEQ ID NO: 175033 - DNA, 20 bp, Artificial Sequence
  Description of Artificial Sequence: Synthetic oligonucleotide
  Target: ATXN1; (-) strand; PAM type: YTN; PAM sequence: TTC
cttactttccagctttgaga

SEQ ID NO: 175034 - DNA, 20 bp, Artificial Sequence
  Description of Artificial Sequence: Synthetic oligonucleotide
  Target: ATXN1; (-) strand; PAM type: YTN; PAM sequence: TTT
ccttactttccagctttgag

SEQ ID NO: 175035 - DNA, 20 bp, Artificial Sequence
  Description of Artificial Sequence: Synthetic oligonucleotide
  Target: ATXN1; (-) strand; PAM type: YTN; PAM sequence: TTT
tccttactttccagctttga

SEQ ID NO: 175036 - DNA, 20 bp, Artificial Sequence
  Description of Artificial Sequence: Synthetic oligonucleotide
  Target: ATXN1; (-) strand; PAM type: YTN; PAM sequence: TTG
attttccttactttccagct

SEQ ID NO: 175037 - DNA, 20 bp, Artificial Sequence
  Description of Artificial Sequence: Synthetic oligonucleotide
  Target: ATXN1; (-) strand; PAM type: YTN; PAM sequence: TTT
gattttccttactttccagc

SEQ ID NO: 175038 - DNA, 20 bp, Artificial Sequence
  Description of Artificial Sequence: Synthetic oligonucleotide
  Target: ATXN1; (-) strand; PAM type: YTN; PAM sequence: TTC
aaaaccccaagtagagcaat

SEQ ID NO: 175039 - DNA, 20 bp, Artificial Sequence
  Description of Artificial Sequence: Synthetic oligonucleotide
  Target: ATXN1; (-) strand; PAM type: YTN; PAM sequence: TTT
caaaaccccaagtagagcaa

SEQ ID NO: 175040 - DNA, 20 bp, Artificial Sequence
  Description of Artificial Sequence: Synthetic oligonucleotide
  Target: ATXN1; (-) strand; PAM type: YTN; PAM sequence: TTT
tcaaaaccccaagtagagca

SEQ ID NO: 175041 - DNA, 20 bp, Artificial Sequence
  Description of Artificial Sequence: Synthetic oligonucleotide
  Target: ATXN1; (-) strand; PAM type: YTN; PAM sequence: TTC
cattttcaaaaccccaagta

SEQ ID NO: 175042 - DNA, 20 bp, Artificial Sequence
  Description of Artificial Sequence: Synthetic oligonucleotide
  Target: ATXN1; (-) strand; PAM type: YTN; PAM sequence: TTA
caaacaatcaatgttccatt

SEQ ID NO: 175043 - DNA, 20 bp, Artificial Sequence
  Description of Artificial Sequence: Synthetic oligonucleotide
  Target: ATXN1; (-) strand; PAM type: YTN; PAM sequence: TTT
acaaacaatcaatgttccat

SEQ ID NO: 175044 - DNA, 20 bp, Artificial Sequence
  Description of Artificial Sequence: Synthetic oligonucleotide
  Target: ATXN1; (-) strand; PAM type: YTN; PAM sequence: TTT
tacaaacaatcaatgttcca

SEQ ID NO: 175045 - DNA, 20 bp, Artificial Sequence
  Description of Artificial Sequence: Synthetic oligonucleotide
  Target: ATXN1; (-) strand; PAM type: YTN; PAM sequence: CTT
ttacaaacaatcaatgttcc

SEQ ID NO: 175046 - DNA, 20 bp, Artificial Sequence
  Description of Artificial Sequence: Synthetic oligonucleotide
  Target: ATXN1; (-) strand; PAM type: YTN; PAM sequence: TTA
agcatcacttttacaaacaa

SEQ ID NO: 175047 - DNA, 20 bp, Artificial Sequence
  Description of Artificial Sequence: Synthetic oligonucleotide
  Target: ATXN1; (-) strand; PAM type: YTN; PAM sequence: CTC
caaattaagcatcactttta

SEQ ID NO: 175048 - DNA, 20 bp, Artificial Sequence
  Description of Artificial Sequence: Synthetic oligonucleotide
  Target: ATXN1; (-) strand; PAM type: YTN; PAM sequence: TTA
tcctccaaattaagcatcac

SEQ ID NO: 175049 - DNA, 20 bp, Artificial Sequence
  Description of Artificial Sequence: Synthetic oligonucleotide
  Target: ATXN1; (-) strand; PAM type: YTN; PAM sequence: CTT
atcctccaaattaagcatca

SEQ ID NO: 175050 - DNA, 20 bp, Artificial Sequence
  Description of Artificial Sequence: Synthetic oligonucleotide
  Target: ATXN1; (-) strand; PAM type: YTN; PAM sequence: TTC
ttatcctccaaattaagcat

SEQ ID NO: 175051 - DNA, 20 bp, Artificial Sequence
  Description of Artificial Sequence: Synthetic oligonucleotide
  Target: ATXN1; (-) strand; PAM type: YTN; PAM sequence: CTT
cttatcctccaaattaagca

SEQ ID NO: 175052 - DNA, 20 bp, Artificial Sequence
  Description of Artificial Sequence: Synthetic oligonucleotide
  Target: ATXN1; (-) strand; PAM type: YTN; PAM sequence: TTC
gcttcttatcctccaaatta

SEQ ID NO: 175053 - DNA, 20 bp, Artificial Sequence
  Description of Artificial Sequence: Synthetic oligonucleotide
  Target: ATXN1; (-) strand; PAM type: YTN; PAM sequence: CTA
tagaaagaagttcgcttctt

SEQ ID NO: 175054 - DNA, 20 bp, Artificial Sequence
  Description of Artificial Sequence: Synthetic oligonucleotide
  Target: ATXN1; (-) strand; PAM type: YTN; PAM sequence: TTG
aggctatagaaagaagttcg

SEQ ID NO: 175055 - DNA, 20 bp, Artificial Sequence
  Description of Artificial Sequence: Synthetic oligonucleotide
  Target: ATXN1; (-) strand; PAM type: YTN; PAM sequence: CTT
gaggctatagaaagaagttc

SEQ ID NO: 175056 - DNA, 20 bp, Artificial Sequence
  Description of Artificial Sequence: Synthetic oligonucleotide
  Target: ATXN1; (-) strand; PAM type: YTN; PAM sequence: CTC
cttgaggctatagaaagaag

SEQ ID NO: 175057 - DNA, 20 bp, Artificial Sequence
  Description of Artificial Sequence: Synthetic oligonucleotide
  Target: ATXN1; (-) strand; PAM type: YTN; PAM sequence: TTA
gctccttgaggctatagaaa

SEQ ID NO: 175058 - DNA, 20 bp, Artificial Sequence
  Description of Artificial Sequence: Synthetic oligonucleotide
  Target: ATXN1; (-) strand; PAM type: YTN; PAM sequence: TTA
attagctccttgaggctata

SEQ ID NO: 175059 - DNA, 20 bp, Artificial Sequence
  Description of Artificial Sequence: Synthetic oligonucleotide
  Target: ATXN1; (-) strand; PAM type: YTN; PAM sequence: TTT
aattagctccttgaggctat

SEQ ID NO: 175060 - DNA, 20 bp, Artificial Sequence
  Description of Artificial Sequence: Synthetic oligonucleotide
  Target: ATXN1; (-) strand; PAM type: YTN; PAM sequence: TTT
taattagctccttgaggcta

SEQ ID NO: 175061 - DNA, 20 bp, Artificial Sequence
  Description of Artificial Sequence: Synthetic oligonucleotide
  Target: ATXN1; (-) strand; PAM type: YTN; PAM sequence: CTG
ccgtgtcacattttaattag

SEQ ID NO: 175062 - DNA, 20 bp, Artificial Sequence
  Description of Artificial Sequence: Synthetic oligonucleotide
  Target: ATXN1; (-) strand; PAM type: YTN; PAM sequence: CTA
agtatataatcactgccgtg

SEQ ID NO: 175063 - DNA, 20 bp, Artificial Sequence
  Description of Artificial Sequence: Synthetic oligonucleotide
  Target: ATXN1; (-) strand; PAM type: YTN; PAM sequence: CTC
taagtatataatcactgccg

SEQ ID NO: 175064 - DNA, 20 bp, Artificial Sequence
  Description of Artificial Sequence: Synthetic oligonucleotide
  Target: ATXN1; (-) strand; PAM type: YTN; PAM sequence: CTA
tcgatacctctaagtatata

SEQ ID NO: 175065 - DNA, 20 bp, Artificial Sequence
  Description of Artificial Sequence: Synthetic oligonucleotide
  Target: ATXN1; (-) strand; PAM type: YTN; PAM sequence: CTG
tggaaaaatgaggacctatc

SEQ ID NO: 175066 - DNA, 20 bp, Artificial Sequence
  Description of Artificial Sequence: Synthetic oligonucleotide
  Target: ATXN1; (-) strand; PAM type: YTN; PAM sequence: CTG
tgctgtggaaaaatgaggac

SEQ ID NO: 175067 - DNA, 20 bp, Artificial Sequence
  Description of Artificial Sequence: Synthetic oligonucleotide
  Target: ATXN1; (-) strand; PAM type: YTN; PAM sequence: TTA
tctgtgctgtggaaaaatga

SEQ ID NO: 175068 - DNA, 20 bp, Artificial Sequence
  Description of Artificial Sequence: Synthetic oligonucleotide
  Target: ATXN1; (-) strand; PAM type: YTN; PAM sequence: CTG
gcgtgagattatctgtgctg

SEQ ID NO: 175069 - DNA, 20 bp, Artificial Sequence
  Description of Artificial Sequence: Synthetic oligonucleotide
  Target: ATXN1; (-) strand; PAM type: YTN; PAM sequence: TTA
atataggtgagagctggcgt

SEQ ID NO: 175070 - DNA, 20 bp, Artificial Sequence
  Description of Artificial Sequence: Synthetic oligonucleotide
  Target: ATXN1; (-) strand; PAM type: YTN; PAM sequence: CTT
aatataggtgagagctggcg

SEQ ID NO: 175071 - DNA, 20 bp, Artificial Sequence
  Description of Artificial Sequence: Synthetic oligonucleotide
  Target: ATXN1; (-) strand; PAM type: YTN; PAM sequence: CTA
acacttaatataggtgagag

SEQ ID NO: 175072 - DNA, 20 bp, Artificial Sequence
  Description of Artificial Sequence: Synthetic oligonucleotide
  Target: ATXN1; (-) strand; PAM type: YTN; PAM sequence: CTG
taccaagtgtctaacactta

SEQ ID NO: 175073 - DNA, 20 bp, Artificial Sequence
  Description of Artificial Sequence: Synthetic oligonucleotide
  Target: ATXN1; (-) strand; PAM type: YTN; PAM sequence: TTC
ctgtaccaagtgtctaacac

SEQ ID NO: 175074 - DNA, 20 bp, Artificial Sequence
  Description of Artificial Sequence: Synthetic oligonucleotide
  Target: ATXN1; (-) strand; PAM type: YTN; PAM sequence: CTG
aacagtgagagatagggaag

SEQ ID NO: 175075 - DNA, 20 bp, Artificial Sequence
  Description of Artificial Sequence: Synthetic oligonucleotide
  Target: ATXN1; (-) strand; PAM type: YTN; PAM sequence: CTG
accaaaggtccctgaacagt

SEQ ID NO: 175076 - DNA, 20 bp, Artificial Sequence
  Description of Artificial Sequence: Synthetic oligonucleotide
  Target: ATXN1; (-) strand; PAM type: YTN; PAM sequence: CTG
aggaactgaccaaaggtccc

SEQ ID NO: 175077 - DNA, 20 bp, Artificial Sequence
  Description of Artificial Sequence: Synthetic oligonucleotide
  Target: ATXN1; (-) strand; PAM type: YTN; PAM sequence: TTA
gggtacaatatgctgaggaa

SEQ ID NO: 175078 - DNA, 20 bp, Artificial Sequence
  Description of Artificial Sequence: Synthetic oligonucleotide
  Target: ATXN1; (-) strand; PAM type: YTN; PAM sequence: TTT
agggtacaatatgctgagga

SEQ ID NO: 175079 - DNA, 20 bp, Artificial Sequence
  Description of Artificial Sequence: Synthetic oligonucleotide
  Target: ATXN1; (-) strand; PAM type: YTN; PAM sequence: CTC
atttagggtacaatatgctg

SEQ ID NO: 175080 - DNA, 20 bp, Artificial Sequence
  Description of Artificial Sequence: Synthetic oligonucleotide
  Target: ATXN1; (-) strand; PAM type: YTN; PAM sequence: CTC
atcacctcatttagggtaca

SEQ ID NO: 175081 - DNA, 20 bp, Artificial Sequence
  Description of Artificial Sequence: Synthetic oligonucleotide
  Target: ATXN1; (-) strand; PAM type: YTN; PAM sequence: CTG
tctcatcacctcatttaggg

SEQ ID NO: 175082 - DNA, 20 bp, Artificial Sequence
  Description of Artificial Sequence: Synthetic oligonucleotide
  Target: ATXN1; (-) strand; PAM type: YTN; PAM sequence: CTC
gatgctgtctcatcacctca

SEQ ID NO: 175083 - DNA, 20 bp, Artificial Sequence
  Description of Artificial Sequence: Synthetic oligonucleotide
  Target: ATXN1; (-) strand; PAM type: YTN; PAM sequence: TTG
gctcgatgctgtctcatcac

SEQ ID NO: 175084 - DNA, 20 bp, Artificial Sequence
  Description of Artificial Sequence: Synthetic oligonucleotide
  Target: ATXN1; (-) strand; PAM type: YTN; PAM sequence: TTC
agttggctcgatgctgtctc

SEQ ID NO: 175085 - DNA, 20 bp, Artificial Sequence
  Description of Artificial Sequence: Synthetic oligonucleotide
  Target: ATXN1; (-) strand; PAM type: YTN; PAM sequence: CTG
atagttcagttggctcgatg

SEQ ID NO: 175086 - DNA, 20 bp, Artificial Sequence
  Description of Artificial Sequence: Synthetic oligonucleotide
  Target: ATXN1; (-) strand; PAM type: YTN; PAM sequence: CTC
tgatagttcagttggctcga

SEQ ID NO: 175087 - DNA, 20 bp, Artificial Sequence
  Description of Artificial Sequence: Synthetic oligonucleotide
  Target: ATXN1; (-) strand; PAM type: YTN; PAM sequence: CTC
tctgatagttcagttggctc

SEQ ID NO: 175088 - DNA, 20 bp, Artificial Sequence
  Description of Artificial Sequence: Synthetic oligonucleotide
  Target: ATXN1; (-) strand; PAM type: YTN; PAM sequence: CTC
actctctgatagttcagttg

SEQ ID NO: 175089 - DNA, 20 bp, Artificial Sequence
  Description of Artificial Sequence: Synthetic oligonucleotide
  Target: ATXN1; (-) strand; PAM type: YTN; PAM sequence: TTA
cgacctcactctctgatagt

SEQ ID NO: 175090 - DNA, 20 bp, Artificial Sequence
  Description of Artificial Sequence: Synthetic oligonucleotide
  Target: ATXN1; (-) strand; PAM type: YTN; PAM sequence: TTA
acagtgaccgataagcatta

SEQ ID NO: 175091 - DNA, 20 bp, Artificial Sequence
  Description of Artificial Sequence: Synthetic oligonucleotide
  Target: ATXN1; (-) strand; PAM type: YTN; PAM sequence: TTT
aacagtgaccgataagcatt

SEQ ID NO: 175092 - DNA, 20 bp, Artificial Sequence
  Description of Artificial Sequence: Synthetic oligonucleotide
  Target: ATXN1; (-) strand; PAM type: YTN; PAM sequence: TTT
taacagtgaccgataagcat

SEQ ID NO: 175093 - DNA, 20 bp, Artificial Sequence
  Description of Artificial Sequence: Synthetic oligonucleotide
  Target: ATXN1; (-) strand; PAM type: YTN; PAM sequence: TTG
gatgggttttaacagtgacc

SEQ ID NO: 175094 - DNA, 20 bp, Artificial Sequence
  Description of Artificial Sequence: Synthetic oligonucleotide
  Target: ATXN1; (-) strand; PAM type: YTN; PAM sequence: CTG
caagaatcataccaaaatgg

SEQ ID NO: 175095 - DNA, 20 bp, Artificial Sequence
  Description of Artificial Sequence: Synthetic oligonucleotide
  Target: ATXN1; (-) strand; PAM type: YTN; PAM sequence: TTA
gtaactgcaagaatcatacc

SEQ ID NO: 175096 - DNA, 20 bp, Artificial Sequence
  Description of Artificial Sequence: Synthetic oligonucleotide
  Target: ATXN1; (-) strand; PAM type: YTN; PAM sequence: CTT
agtaactgcaagaatcatac

SEQ ID NO: 175097 - DNA, 20 bp, Artificial Sequence
  Description of Artificial Sequence: Synthetic oligonucleotide
  Target: ATXN1; (-) strand; PAM type: YTN; PAM sequence: CTG
agtggagagagaatgaaggc

SEQ ID NO: 175098 - DNA, 20 bp, Artificial Sequence
  Description of Artificial Sequence: Synthetic oligonucleotide
  Target: ATXN1; (-) strand; PAM type: YTN; PAM sequence: TTC
tgagtggagagagaatgaag

SEQ ID NO: 175099 - DNA, 20 bp, Artificial Sequence
  Description of Artificial Sequence: Synthetic oligonucleotide
  Target: ATXN1; (-) strand; PAM type: YTN; PAM sequence: TTA
aagtgaattctgagtggaga

SEQ ID NO: 175100 - DNA, 20 bp, Artificial Sequence
  Description of Artificial Sequence: Synthetic oligonucleotide
  Target: ATXN1; (-) strand; PAM type: YTN; PAM sequence: CTT
aaagtgaattctgagtggag

SEQ ID NO: 175101 - DNA, 20 bp, Artificial Sequence
  Description of Artificial Sequence: Synthetic oligonucleotide
  Target: ATXN1; (-) strand; PAM type: YTN; PAM sequence: TTA
taatagcttaaagtgaattc

SEQ ID NO: 175102 - DNA, 20 bp, Artificial Sequence
  Description of Artificial Sequence: Synthetic oligonucleotide
  Target: ATXN1; (-) strand; PAM type: YTN; PAM sequence: CTT
ataatagcttaaagtgaatt

SEQ ID NO: 175103 - DNA, 20 bp, Artificial Sequence
  Description of Artificial Sequence: Synthetic oligonucleotide
  Target: ATXN1; (-) strand; PAM type: YTN; PAM sequence: TTC
ttataatagcttaaagtgaa

SEQ ID NO: 175104 - DNA, 20 bp, Artificial Sequence
  Description of Artificial Sequence: Synthetic oligonucleotide
  Target: ATXN1; (-) strand; PAM type: YTN; PAM sequence: TTT
cttataatagcttaaagtga

SEQ ID NO: 175105 - DNA, 20 bp, Artificial Sequence
  Description of Artificial Sequence: Synthetic oligonucleotide
  Target: ATXN1; (-) strand; PAM type: YTN; PAM sequence: CTT
tcttataatagcttaaagtg

SEQ ID NO: 175106 - DNA, 20 bp, Artificial Sequence
  Description of Artificial Sequence: Synthetic oligonucleotide
  Target: ATXN1; (-) strand; PAM type: YTN; PAM sequence: TTA
gctttcttataatagcttaa

SEQ ID NO: 175107 - DNA, 20 bp, Artificial Sequence
  Description of Artificial Sequence: Synthetic oligonucleotide
  Target: ATXN1; (-) strand; PAM type: YTN; PAM sequence: TTT
agctttcttataatagctta

SEQ ID NO: 175108 - DNA, 20 bp, Artificial Sequence
  Description of Artificial Sequence: Synthetic oligonucleotide
  Target: ATXN1; (-) strand; PAM type: YTN; PAM sequence: CTT
tagctttcttataatagctt

SEQ ID NO: 175109 - DNA, 20 bp, Artificial Sequence
  Description of Artificial Sequence: Synthetic oligonucleotide
  Target: ATXN1; (-) strand; PAM type: YTN; PAM sequence: TTA
tctttagctttcttataata

SEQ ID NO: 175110 - DNA, 20 bp, Artificial Sequence
  Description of Artificial Sequence: Synthetic oligonucleotide
  Target: ATXN1; (-) strand; PAM type: YTN; PAM sequence: TTT
atctttagctttcttataat

SEQ ID NO: 175111 - DNA, 20 bp, Artificial Sequence
  Description of Artificial Sequence: Synthetic oligonucleotide
  Target: ATXN1; (-) strand; PAM type: YTN; PAM sequence: TTT
tatctttagctttcttataa

SEQ ID NO: 175112 - DNA, 20 bp, Artificial Sequence
  Description of Artificial Sequence: Synthetic oligonucleotide
  Target: ATXN1; (-) strand; PAM type: YTN; PAM sequence: CTG
ttttatctttagctttctta

SEQ ID NO: 175113 - DNA, 20 bp, Artificial Sequence
  Description of Artificial Sequence: Synthetic oligonucleotide
  Target: ATXN1; (-) strand; PAM type: YTN; PAM sequence: TTA
tgcagaagctgttttatctt

SEQ ID NO: 175114 - DNA, 20 bp, Artificial Sequence
  Description of Artificial Sequence: Synthetic oligonucleotide
  Target: ATXN1; (-) strand; PAM type: YTN; PAM sequence: TTC
attatgcagaagctgtttta

SEQ ID NO: 175115 - DNA, 20 bp, Artificial Sequence
  Description of Artificial Sequence: Synthetic oligonucleotide
  Target: ATXN1; (-) strand; PAM type: YTN; PAM sequence: TTT
cattatgcagaagctgtttt

SEQ ID NO: 175116 - DNA, 20 bp, Artificial Sequence
  Description of Artificial Sequence: Synthetic oligonucleotide
  Target: ATXN1; (-) strand; PAM type: YTN; PAM sequence: TTA
gtgtttcattatgcagaagc

SEQ ID NO: 175117 - DNA, 20 bp, Artificial Sequence
  Description of Artificial Sequence: Synthetic oligonucleotide
  Target: ATXN1; (-) strand; PAM type: YTN; PAM sequence: CTG
gggattagtgtttcattatg

SEQ ID NO: 175118 - DNA, 20 bp, Artificial Sequence
  Description of Artificial Sequence: Synthetic oligonucleotide
  Target: ATXN1; (-) strand; PAM type: YTN; PAM sequence: CTC
tggggattagtgtttcatta

SEQ ID NO: 175119 - DNA, 20 bp, Artificial Sequence
  Description of Artificial Sequence: Synthetic oligonucleotide
  Target: ATXN1; (-) strand; PAM type: YTN; PAM sequence: TTG
tgtcgtgggcgtcacactct

SEQ ID NO: 175120 - DNA, 20 bp, Artificial Sequence
  Description of Artificial Sequence: Synthetic oligonucleotide
  Target: ATXN1; (-) strand; PAM type: YTN; PAM sequence: TTT
gtgtcgtgggcgtcacactc

SEQ ID NO: 175121 - DNA, 20 bp, Artificial Sequence
  Description of Artificial Sequence: Synthetic oligonucleotide
  Target: ATXN1; (-) strand; PAM type: YTN; PAM sequence: TTC
atttgtgtcgtgggcgtcac

SEQ ID NO: 175122 - DNA, 20 bp, Artificial Sequence
  Description of Artificial Sequence: Synthetic oligonucleotide
  Target: ATXN1; (-) strand; PAM type: YTN; PAM sequence: CTA
gcattcatttgtgtcgtggg

SEQ ID NO: 175123 - DNA, 20 bp, Artificial Sequence
  Description of Artificial Sequence: Synthetic oligonucleotide
  Target: ATXN1; (-) strand; PAM type: YTN; PAM sequence: CTG
tctagcattcatttgtgtcg

SEQ ID NO: 175124 - DNA, 20 bp, Artificial Sequence
  Description of Artificial Sequence: Synthetic oligonucleotide
  Target: ATXN1; (-) strand; PAM type: YTN; PAM sequence: TTC
tgtctagcattcatttgtgt

SEQ ID NO: 175125 - DNA, 20 bp, Artificial Sequence
  Description of Artificial Sequence: Synthetic oligonucleotide
  Target: ATXN1; (-) strand; PAM type: YTN; PAM sequence: CTT
ctgtctagcattcatttgtg

SEQ ID NO: 175126 - DNA, 20 bp, Artificial Sequence
  Description of Artificial Sequence: Synthetic oligonucleotide
  Target: ATXN1; (-) strand; PAM type: YTN; PAM sequence: TTA
tcttctgtctagcattcatt

SEQ ID NO: 175127 - DNA, 20 bp, Artificial Sequence
  Description of Artificial Sequence: Synthetic oligonucleotide
  Target: ATXN1; (-) strand; PAM type: YTN; PAM sequence: TTG
gttatcttctgtctagcatt

SEQ ID NO: 175128 - DNA, 20 bp, Artificial Sequence
  Description of Artificial Sequence: Synthetic oligonucleotide
  Target: ATXN1; (-) strand; PAM type: YTN; PAM sequence: TTT
ggttatcttctgtctagcat

SEQ ID NO: 175129 - DNA, 20 bp, Artificial Sequence
  Description of Artificial Sequence: Synthetic oligonucleotide
  Target: ATXN1; (-) strand; PAM type: YTN; PAM sequence: CTA
gacatttggttatcttctgt

SEQ ID NO: 175130 - DNA, 20 bp, Artificial Sequence
  Description of Artificial Sequence: Synthetic oligonucleotide
  Target: ATXN1; (-) strand; PAM type: YTN; PAM sequence: TTG
aataagtctagacatttggt

SEQ ID NO: 175131 - DNA, 20 bp, Artificial Sequence
  Description of Artificial Sequence: Synthetic oligonucleotide
  Target: ATXN1; (-) strand; PAM type: YTN; PAM sequence: TTT
gaataagtctagacatttgg

SEQ ID NO: 175132 - DNA, 20 bp, Artificial Sequence
  Description of Artificial Sequence: Synthetic oligonucleotide
  Target: ATXN1; (-) strand; PAM type: YTN; PAM sequence: CTA
tgagaagcaggtttgaataa

SEQ ID NO: 175133 - DNA, 20 bp, Artificial Sequence
  Description of Artificial Sequence: Synthetic oligonucleotide
  Target: ATXN1; (-) strand; PAM type: YTN; PAM sequence: TTG
aactatgagaagcaggtttg

SEQ ID NO: 175134 - DNA, 20 bp, Artificial Sequence
  Description of Artificial Sequence: Synthetic oligonucleotide
  Target: ATXN1; (-) strand; PAM type: YTN; PAM sequence: TTT
gaactatgagaagcaggttt

SEQ ID NO: 175135 - DNA, 20 bp, Artificial Sequence
  Description of Artificial Sequence: Synthetic oligonucleotide
  Target: ATXN1; (-) strand; PAM type: YTN; PAM sequence: CTG
atgaagcagtgagtacaagt

SEQ ID NO: 175136 - DNA, 20 bp, Artificial Sequence
  Description of Artificial Sequence: Synthetic oligonucleotide
  Target: ATXN1; (-) strand; PAM type: YTN; PAM sequence: TTC
ataagctgatgaagcagtga

SEQ ID NO: 175137 - DNA, 20 bp, Artificial Sequence
  Description of Artificial Sequence: Synthetic oligonucleotide
  Target: ATXN1; (-) strand; PAM type: YTN; PAM sequence: TTA
tggttcataagctgatgaag

SEQ ID NO: 175138 - DNA, 20 bp, Artificial Sequence
  Description of Artificial Sequence: Synthetic oligonucleotide
  Target: ATXN1; (-) strand; PAM type: YTN; PAM sequence: TTT
atggttcataagctgatgaa

SEQ ID NO: 175139 - DNA, 20 bp, Artificial Sequence
  Description of Artificial Sequence: Synthetic oligonucleotide
  Target: ATXN1; (-) strand; PAM type: YTN; PAM sequence: TTA
aatcagtttatggttcataa

SEQ ID NO: 175140 - DNA, 20 bp, Artificial Sequence
  Description of Artificial Sequence: Synthetic oligonucleotide
  Target: ATXN1; (-) strand; PAM type: YTN; PAM sequence: TTT
aaatcagtttatggttcata

SEQ ID NO: 175141 - DNA, 20 bp, Artificial Sequence
  Description of Artificial Sequence: Synthetic oligonucleotide
  Target: ATXN1; (-) strand; PAM type: YTN; PAM sequence: TTT
taaatcagtttatggttcat

SEQ ID NO: 175142 - DNA, 20 bp, Artificial Sequence
  Description of Artificial Sequence: Synthetic oligonucleotide
  Target: ATXN1; (-) strand; PAM type: YTN; PAM sequence: TTT
ttaaatcagtttatggttca

SEQ ID NO: 175143 - DNA, 20 bp, Artificial Sequence
  Description of Artificial Sequence: Synthetic oligonucleotide
  Target: ATXN1; (-) strand; PAM type: YTN; PAM sequence: TTG
catgtgtgtttttaaatcag

SEQ ID NO: 175144 - DNA, 20 bp, Artificial Sequence
  Description of Artificial Sequence: Synthetic oligonucleotide
  Target: ATXN1; (-) strand; PAM type: YTN; PAM sequence: TTT
gcatgtgtgtttttaaatca

SEQ ID NO: 175145 - DNA, 20 bp, Artificial Sequence
  Description of Artificial Sequence: Synthetic oligonucleotide
  Target: ATXN1; (-) strand; PAM type: YTN; PAM sequence: TTT
tgcatgtgtgtttttaaatc

SEQ ID NO: 175146 - DNA, 20 bp, Artificial Sequence
  Description of Artificial Sequence: Synthetic oligonucleotide
  Target: ATXN1; (-) strand; PAM type: YTN; PAM sequence: TTC
agttttgcatgtgtgttttt

SEQ ID NO: 175147 - DNA, 20 bp, Artificial Sequence
  Description of Artificial Sequence: Synthetic oligonucleotide
  Target: ATXN1; (-) strand; PAM type: YTN; PAM sequence: TTG
ttcagttttgcatgtgtgtt

SEQ ID NO: 175148 - DNA, 20 bp, Artificial Sequence
  Description of Artificial Sequence: Synthetic oligonucleotide
  Target: ATXN1; (-) strand; PAM type: YTN; PAM sequence: TTG
ttgttcagttttgcatgtgt

SEQ ID NO: 175149 - DNA, 20 bp, Artificial Sequence
  Description of Artificial Sequence: Synthetic oligonucleotide
  Target: ATXN1; (-) strand; PAM type: YTN; PAM sequence: TTG
ttgttgttcagttttgcatg

SEQ ID NO: 175150 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttcagttttgc

SEQ ID NO: 175151 - DNA, 20 bp, Artificial Sequence
  Description of Artificial Sequence: Synthetic oligonucleotide
  Target: ATXN1; (-) strand; PAM type: YTN; PAM sequence: TTT
gttgttgttgttcagttttg

SEQ ID NO: 175152 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttgttcagtttt

SEQ ID NO: 175153 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttgttcagttt

SEQ ID NO: 175154 - DNA, 20 bp, Artificial Sequence
  Description of Artificial Sequence: Synthetic oligonucleotide
  Target: ATXN1; (-) strand; PAM type: YTN; PAM sequence: TTT
tttgttgttgttgttcagtt

SEQ ID NO: 175155 - DNA, 20 bp, Artificial Sequence
  Description of Artificial Sequence: Synthetic oligonucleotide
  Target: ATXN1; (-) strand; PAM type: YTN; PAM sequence: TTT
ttttgttgttgttgttcagt

SEQ ID NO: 175156 - DNA, 20 bp, Artificial Sequence
  Description of Artificial Sequence: Synthetic oligonucleotide
  Target: ATXN1; (-) strand; PAM type: YTN; PAM sequence: TTA
gcgtttttttgttgttgttg

SEQ ID NO: 175157 - DNA, 20 bp, Artificial Sequence
  Description of Artificial Sequence: Synthetic oligonucleotide
  Target: ATXN1; (-) strand; PAM type: YTN; PAM sequence: TTT
agcgtttttttgttgttgtt

SEQ ID NO: 175158 - DNA, 20 bp, Artificial Sequence
  Description of Artificial Sequence: Synthetic oligonucleotide
  Target: ATXN1; (-) strand; PAM type: YTN; PAM sequence: CTG
ggtttagcgtttttttgttg

SEQ ID NO: 175159 - DNA, 20 bp, Artificial Sequence
  Description of Artificial Sequence: Synthetic oligonucleotide
  Target: ATXN1; (-) strand; PAM type: YTN; PAM sequence: CTA
ctgggtttagcgtttttttg

SEQ ID NO: 175160 - DNA, 20 bp, Artificial Sequence
  Description of Artificial Sequence: Synthetic oligonucleotide
  Target: ATXN1; (-) strand; PAM type: YTN; PAM sequence: CTC
tactgggtttagcgtttttt

SEQ ID NO: 175161 - DNA, 20 bp, Artificial Sequence
  Description of Artificial Sequence: Synthetic oligonucleotide
  Target: ATXN1; (-) strand; PAM type: YTN; PAM sequence: CTG
agtgaagaggctctactggg

SEQ ID NO: 175162 - DNA, 20 bp, Artificial Sequence
  Description of Artificial Sequence: Synthetic oligonucleotide
  Target: ATXN1; (-) strand; PAM type: YTN; PAM sequence: CTC
aaataaaaaggcctgagtga

SEQ ID NO: 175163 - DNA, 20 bp, Artificial Sequence
  Description of Artificial Sequence: Synthetic oligonucleotide
  Target: ATXN1; (-) strand; PAM type: YTN; PAM sequence: TTC
ggatagataaactcaaataa

SEQ ID NO: 175164 - DNA, 20 bp, Artificial Sequence
  Description of Artificial Sequence: Synthetic oligonucleotide
  Target: ATXN1; (-) strand; PAM type: YTN; PAM sequence: CTG
cattcggatagataaactca

SEQ ID NO: 175165 - DNA, 20 bp, Artificial Sequence
  Description of Artificial Sequence: Synthetic oligonucleotide
  Target: ATXN1; (-) strand; PAM type: YTN; PAM sequence: TTA
ctgcattcggatagataaac

SEQ ID NO: 175166 - DNA, 20 bp, Artificial Sequence
  Description of Artificial Sequence: Synthetic oligonucleotide
  Target: ATXN1; (-) strand; PAM type: YTN; PAM sequence: TTA
aggaggcattactgcattcg

SEQ ID NO: 175167 - DNA, 20 bp, Artificial Sequence
  Description of Artificial Sequence: Synthetic oligonucleotide
  Target: ATXN1; (-) strand; PAM type: YTN; PAM sequence: CTT
aaggaggcattactgcattc

SEQ ID NO: 175168 - DNA, 20 bp, Artificial Sequence
  Description of Artificial Sequence: Synthetic oligonucleotide
  Target: ATXN1; (-) strand; PAM type: YTN; PAM sequence: CTG
cttaaggaggcattactgca

SEQ ID NO: 175169 - DNA, 20 bp, Artificial Sequence
  Description of Artificial Sequence: Synthetic oligonucleotide
  Target: ATXN1; (-) strand; PAM type: YTN; PAM sequence: CTG
tgtctgcttaaggaggcatt

SEQ ID NO: 175170 - DNA, 20 bp, Artificial Sequence
  Description of Artificial Sequence: Synthetic oligonucleotide
  Target: ATXN1; (-) strand; PAM type: YTN; PAM sequence: TTC
agtaagctgtgtctgcttaa

SEQ ID NO: 175171 - DNA, 20 bp, Artificial Sequence
  Description of Artificial Sequence: Synthetic oligonucleotide
  Target: ATXN1; (-) strand; PAM type: YTN; PAM sequence: TTT
cagtaagctgtgtctgctta

SEQ ID NO: 175172 - DNA, 20 bp, Artificial Sequence
  Description of Artificial Sequence: Synthetic oligonucleotide
  Target: ATXN1; (-) strand; PAM type: YTN; PAM sequence: TTT
tcagtaagctgtgtctgctt

SEQ ID NO: 175173 - DNA, 20 bp, Artificial Sequence
  Description of Artificial Sequence: Synthetic oligonucleotide
  Target: ATXN1; (-) strand; PAM type: YTN; PAM sequence: TTG
tgtatattttcagtaagctg

SEQ ID NO: 175174 - DNA, 20 bp, Artificial Sequence
  Description of Artificial Sequence: Synthetic oligonucleotide
  Target: ATXN1; (-) strand; PAM type: YTN; PAM sequence: CTA
caaattgtgtatattttcag

SEQ ID NO: 175175 - DNA, 20 bp, Artificial Sequence
  Description of Artificial Sequence: Synthetic oligonucleotide
  Target: ATXN1; (-) strand; PAM type: YTN; PAM sequence: TTC
agatgctacaaattgtgtat

SEQ ID NO: 175176 - DNA, 20 bp, Artificial Sequence
  Description of Artificial Sequence: Synthetic oligonucleotide
  Target: ATXN1; (-) strand; PAM type: YTN; PAM sequence: TTT
cagatgctacaaattgtgta

SEQ ID NO: 175177 - DNA, 20 bp, Artificial Sequence
  Description of Artificial Sequence: Synthetic oligonucleotide
  Target: ATXN1; (-) strand; PAM type: YTN; PAM sequence: CTT
tcagatgctacaaattgtgt

SEQ ID NO: 175178 - DNA, 20 bp, Artificial Sequence
  Description of Artificial Sequence: Synthetic oligonucleotide
  Target: ATXN1; (-) strand; PAM type: YTN; PAM sequence: CTC
tttcagatgctacaaattgt

SEQ ID NO: 175179 - DNA, 20 bp, Artificial Sequence
  Description of Artificial Sequence: Synthetic oligonucleotide
  Target: ATXN1; (-) strand; PAM type: YTN; PAM sequence: TTC
tctttcagatgctacaaatt

SEQ ID NO: 175180 - DNA, 20 bp, Artificial Sequence
  Description of Artificial Sequence: Synthetic oligonucleotide
  Target: ATXN1; (-) strand; PAM type: YTN; PAM sequence: TTG
agtagaaagaaggacaaagg

SEQ ID NO: 175181 - DNA, 20 bp, Artificial Sequence
  Description of Artificial Sequence: Synthetic oligonucleotide
  Target: ATXN1; (-) strand; PAM type: YTN; PAM sequence: TTC
cagtccaccaacatattgag

SEQ ID NO: 175182 - DNA, 20 bp, Artificial Sequence
  Description of Artificial Sequence: Synthetic oligonucleotide
  Target: ATXN1; (-) strand; PAM type: YTN; PAM sequence: TTG
gaaacattccagtccaccaa

SEQ ID NO: 175183 - DNA, 20 bp, Artificial Sequence
  Description of Artificial Sequence: Synthetic oligonucleotide
  Target: ATXN1; (-) strand; PAM type: YTN; PAM sequence: CTA
cattggaaacattccagtcc

SEQ ID NO: 175184 - DNA, 20 bp, Artificial Sequence
  Description of Artificial Sequence: Synthetic oligonucleotide
  Target: ATXN1; (-) strand; PAM type: YTN; PAM sequence: TTG
actacattggaaacattcca

SEQ ID NO: 175185 - DNA, 20 bp, Artificial Sequence
  Description of Artificial Sequence: Synthetic oligonucleotide
  Target: ATXN1; (-) strand; PAM type: YTN; PAM sequence: TTA
aagagccagaaaaattgact

SEQ ID NO: 175186 - DNA, 20 bp, Artificial Sequence
  Description of Artificial Sequence: Synthetic oligonucleotide
  Target: ATXN1; (-) strand; PAM type: YTN; PAM sequence: TTT
aaagagccagaaaaattgac

SEQ ID NO: 175187 - DNA, 20 bp, Artificial Sequence
  Description of Artificial Sequence: Synthetic oligonucleotide
  Target: ATXN1; (-) strand; PAM type: YTN; PAM sequence: TTT
taaagagccagaaaaattga

SEQ ID NO: 175188 - DNA, 20 bp, Artificial Sequence
  Description of Artificial Sequence: Synthetic oligonucleotide
  Target: ATXN1; (-) strand; PAM type: YTN; PAM sequence: TTA
attttaaagagccagaaaaa

SEQ ID NO: 175189 - DNA, 20 bp, Artificial Sequence
  Description of Artificial Sequence: Synthetic oligonucleotide
  Target: ATXN1; (-) strand; PAM type: YTN; PAM sequence: TTT
aattttaaagagccagaaaa

SEQ ID NO: 175190 - DNA, 20 bp, Artificial Sequence
  Description of Artificial Sequence: Synthetic oligonucleotide
  Target: ATXN1; (-) strand; PAM type: YTN; PAM sequence: TTA
atttaattttaaagagccag

SEQ ID NO: 175191 - DNA, 20 bp, Artificial Sequence
  Description of Artificial Sequence: Synthetic oligonucleotide
  Target: ATXN1; (-) strand; PAM type: YTN; PAM sequence: TTA
ttaatttaattttaaagagc

SEQ ID NO: 175192 - DNA, 20 bp, Artificial Sequence
  Description of Artificial Sequence: Synthetic oligonucleotide
  Target: ATXN1; (-) strand; PAM type: YTN; PAM sequence: TTT
attaatttaattttaaagag

SEQ ID NO: 175193 - DNA, 20 bp, Artificial Sequence
  Description of Artificial Sequence: Synthetic oligonucleotide
  Target: ATXN1; (-) strand; PAM type: YTN; PAM sequence: TTT
tattaatttaattttaaaga

SEQ ID NO: 175194 - DNA, 20 bp, Artificial Sequence
  Description of Artificial Sequence: Synthetic oligonucleotide
  Target: ATXN1; (-) strand; PAM type: YTN; PAM sequence: CTT
ttattaatttaattttaaag

SEQ ID NO: 175195 - DNA, 20 bp, Artificial Sequence
  Description of Artificial Sequence: Synthetic oligonucleotide
  Target: ATXN1; (-) strand; PAM type: YTN; PAM sequence: TTG
tatacttttattaatttaat

SEQ ID NO: 175196 - DNA, 20 bp, Artificial Sequence
  Description of Artificial Sequence: Synthetic oligonucleotide
  Target: ATXN1; (-) strand; PAM type: YTN; PAM sequence: TTA
aattgtatacttttattaat

SEQ ID NO: 175197 - DNA, 20 bp, Artificial Sequence
  Description of Artificial Sequence: Synthetic oligonucleotide
  Target: ATXN1; (-) strand; PAM type: YTN; PAM sequence: CTT
aaattgtatacttttattaa

SEQ ID NO: 175198 - DNA, 20 bp, Artificial Sequence
  Description of Artificial Sequence: Synthetic oligonucleotide
  Target: ATXN1; (-) strand; PAM type: YTN; PAM sequence: CTA
tagatccttaaattgtatac

SEQ ID NO: 175199 - DNA, 20 bp, Artificial Sequence
  Description of Artificial Sequence: Synthetic oligonucleotide
  Target: ATXN1; (-) strand; PAM type: YTN; PAM sequence: CTG
aacacaaatctatagatcct

SEQ ID NO: 175200 - DNA, 20 bp, Artificial Sequence
  Description of Artificial Sequence: Synthetic oligonucleotide
  Target: ATXN1; (-) strand; PAM type: YTN; PAM sequence: TTG
tgctgaacacaaatctatag

SEQ ID NO: 175201 - DNA, 20 bp, Artificial Sequence
  Description of Artificial Sequence: Synthetic oligonucleotide
  Target: ATXN1; (-) strand; PAM type: YTN; PAM sequence: TTA
gtccattgtgctgaacacaa

SEQ ID NO: 175202 - DNA, 20 bp, Artificial Sequence
  Description of Artificial Sequence: Synthetic oligonucleotide
  Target: ATXN1; (-) strand; PAM type: YTN; PAM sequence: TTT
agtccattgtgctgaacaca

SEQ ID NO: 175203 - DNA, 20 bp, Artificial Sequence
  Description of Artificial Sequence: Synthetic oligonucleotide
  Target: ATXN1; (-) strand; PAM type: YTN; PAM sequence: TTT
tagtccattgtgctgaacac

SEQ ID NO: 175204 - DNA, 20 bp, Artificial Sequence
  Description of Artificial Sequence: Synthetic oligonucleotide
  Target: ATXN1; (-) strand; PAM type: YTN; PAM sequence: CTT
ttagtccattgtgctgaaca

SEQ ID NO: 175205 - DNA, 20 bp, Artificial Sequence
  Description of Artificial Sequence: Synthetic oligonucleotide
  Target: ATXN1; (-) strand; PAM type: YTN; PAM sequence: CTC
aacttttagtccattgtgct

SEQ ID NO: 175206 - DNA, 20 bp, Artificial Sequence
  Description of Artificial Sequence: Synthetic oligonucleotide
  Target: ATXN1; (-) strand; PAM type: YTN; PAM sequence: CTA
gaatccagtagctcaacttt

SEQ ID NO: 175207 - DNA, 20 bp, Artificial Sequence
  Description of Artificial Sequence: Synthetic oligonucleotide
  Target: ATXN1; (-) strand; PAM type: YTN; PAM sequence: TTC
tagaatccagtagctcaact

SEQ ID NO: 175208 - DNA, 20 bp, Artificial Sequence
  Description of Artificial Sequence: Synthetic oligonucleotide
  Target: ATXN1; (-) strand; PAM type: YTN; PAM sequence: TTG
ttctagaatccagtagctca

SEQ ID NO: 175209 - DNA, 20 bp, Artificial Sequence
  Description of Artificial Sequence: Synthetic oligonucleotide
  Target: ATXN1; (-) strand; PAM type: YTN; PAM sequence: TTT
gttctagaatccagtagctc

SEQ ID NO: 175210 - DNA, 20 bp, Artificial Sequence
  Description of Artificial Sequence: Synthetic oligonucleotide
  Target: ATXN1; (-) strand; PAM type: YTN; PAM sequence: TTT
tgttctagaatccagtagct

SEQ ID NO: 175211 - DNA, 20 bp, Artificial Sequence
  Description of Artificial Sequence: Synthetic oligonucleotide
  Target: ATXN1; (-) strand; PAM type: YTN; PAM sequence: TTA
taagtgacattttgttctag

SEQ ID NO: 175212 - DNA, 20 bp, Artificial Sequence
  Description of Artificial Sequence: Synthetic oligonucleotide
  Target: ATXN1; (-) strand; PAM type: YTN; PAM sequence: CTA
attataagtgacattttgtt

SEQ ID NO: 175213 - DNA, 20 bp, Artificial Sequence
  Description of Artificial Sequence: Synthetic oligonucleotide
  Target: ATXN1; (-) strand; PAM type: YTN; PAM sequence: CTC
agctaattataagtgacatt

SEQ ID NO: 175214 - DNA, 20 bp, Artificial Sequence
  Description of Artificial Sequence: Synthetic oligonucleotide
  Target: ATXN1; (-) strand; PAM type: YTN; PAM sequence: CTG
agatgtcatatatactcagc

SEQ ID NO: 175215 - DNA, 20 bp, Artificial Sequence
  Description of Artificial Sequence: Synthetic oligonucleotide
  Target: ATXN1; (-) strand; PAM type: YTN; PAM sequence: TTG
gtacaatgcctgagatgtca

SEQ ID NO: 175216 - DNA, 20 bp, Artificial Sequence
  Description of Artificial Sequence: Synthetic oligonucleotide
  Target: ATXN1; (-) strand; PAM type: YTN; PAM sequence: CTT
ggtacaatgcctgagatgtc

SEQ ID NO: 175217 - DNA, 20 bp, Artificial Sequence
  Description of Artificial Sequence: Synthetic oligonucleotide
  Target: ATXN1; (-) strand; PAM type: YTN; PAM sequence: CTG
ggcccttggtacaatgcctg

SEQ ID NO: 175218 - DNA, 20 bp, Artificial Sequence
  Description of Artificial Sequence: Synthetic oligonucleotide
  Target: ATXN1; (-) strand; PAM type: YTN; PAM sequence: TTC
tgggcccttggtacaatgcc

SEQ ID NO: 175219 - DNA, 20 bp, Artificial Sequence
  Description of Artificial Sequence: Synthetic oligonucleotide
  Target: ATXN1; (-) strand; PAM type: YTN; PAM sequence: TTT
ctgggcccttggtacaatgc

SEQ ID NO: 175220 - DNA, 20 bp, Artificial Sequence
  Description of Artificial Sequence: Synthetic oligonucleotide
  Target: ATXN1; (-) strand; PAM type: YTN; PAM sequence: TTT
tctgggcccttggtacaatg

SEQ ID NO: 175221 - DNA, 20 bp, Artificial Sequence
  Description of Artificial Sequence: Synthetic oligonucleotide
  Target: ATXN1; (-) strand; PAM type: YTN; PAM sequence: TTA
taaaaatgaaatgaggtaat

SEQ ID NO: 175222 - DNA, 20 bp, Artificial Sequence
  Description of Artificial Sequence: Synthetic oligonucleotide
  Target: ATXN1; (-) strand; PAM type: YTN; PAM sequence: CTG
aaaattataaaaatgaaatg

SEQ ID NO: 175223 - DNA, 20 bp, Artificial Sequence
  Description of Artificial Sequence: Synthetic oligonucleotide
  Target: ATXN1; (-) strand; PAM type: YTN; PAM sequence: TTC
tgaaaattataaaaatgaaa

SEQ ID NO: 175224 - DNA, 20 bp, Artificial Sequence
  Description of Artificial Sequence: Synthetic oligonucleotide
  Target: ATXN1; (-) strand; PAM type: YTN; PAM sequence: CTT
ctgaaaattataaaaatgaa

SEQ ID NO: 175225 - DNA, 20 bp, Artificial Sequence
  Description of Artificial Sequence: Synthetic oligonucleotide
  Target: ATXN1; (-) strand; PAM type: YTN; PAM sequence: CTA
ggaaagtgggtgcttctgaa

SEQ ID NO: 175226 - DNA, 20 bp, Artificial Sequence
  Description of Artificial Sequence: Synthetic oligonucleotide
  Target: ATXN1; (-) strand; PAM type: YTN; PAM sequence: CTA
gctaggaaagtgggtgcttc

SEQ ID NO: 175227 - DNA, 20 bp, Artificial Sequence
  Description of Artificial Sequence: Synthetic oligonucleotide
  Target: ATXN1; (-) strand; PAM type: YTN; PAM sequence: TTG
gtaggtatcctagctaggaa

SEQ ID NO: 175228 - DNA, 20 bp, Artificial Sequence
  Description of Artificial Sequence: Synthetic oligonucleotide
  Target: ATXN1; (-) strand; PAM type: YTN; PAM sequence: TTG
cccaagaacacaattggtag

SEQ ID NO: 175229 - DNA, 20 bp, Artificial Sequence
  Description of Artificial Sequence: Synthetic oligonucleotide
  Target: ATXN1; (-) strand; PAM type: YTN; PAM sequence: TTT
gcccaagaacacaattggta

SEQ ID NO: 175230 - DNA, 20 bp, Artificial Sequence
  Description of Artificial Sequence: Synthetic oligonucleotide
  Target: ATXN1; (-) strand; PAM type: YTN; PAM sequence: TTG
tacaaaccaagatagaagat

SEQ ID NO: 175231 - DNA, 20 bp, Artificial Sequence
  Description of Artificial Sequence: Synthetic oligonucleotide
  Target: ATXN1; (-) strand; PAM type: YTN; PAM sequence: CTG
ttgtacaaaccaagatagaa

SEQ ID NO: 175232 - DNA, 20 bp, Artificial Sequence
  Description of Artificial Sequence: Synthetic oligonucleotide
  Target: ATXN1; (-) strand; PAM type: YTN; PAM sequence: TTC
tgttgtacaaaccaagatag

SEQ ID NO: 175233 - DNA, 20 bp, Artificial Sequence
  Description of Artificial Sequence: Synthetic oligonucleotide
  Target: ATXN1; (-) strand; PAM type: YTN; PAM sequence: CTT
ctgttgtacaaaccaagata

SEQ ID NO: 175234 - DNA, 20 bp, Artificial Sequence
  Description of Artificial Sequence: Synthetic oligonucleotide
  Target: ATXN1; (-) strand; PAM type: YTN; PAM sequence: TTC
ttctgttgtacaaaccaaga

SEQ ID NO: 175235 - DNA, 20 bp, Artificial Sequence
  Description of Artificial Sequence: Synthetic oligonucleotide
  Target: ATXN1; (-) strand; PAM type: YTN; PAM sequence: CTT
cttctgttgtacaaaccaag

SEQ ID NO: 175236 - DNA, 20 bp, Artificial Sequence
  Description of Artificial Sequence: Synthetic oligonucleotide
  Target: ATXN1; (-) strand; PAM type: YTN; PAM sequence: TTC
ttcttctgttgtacaaacca

SEQ ID NO: 175237 - DNA, 20 bp, Artificial Sequence
  Description of Artificial Sequence: Synthetic oligonucleotide
  Target: ATXN1; (-) strand; PAM type: YTN; PAM sequence: TTT
cttcttctgttgtacaaacc

SEQ ID NO: 175238 - DNA, 20 bp, Artificial Sequence
  Description of Artificial Sequence: Synthetic oligonucleotide
  Target: ATXN1; (-) strand; PAM type: YTN; PAM sequence: TTA
aaataatttcttcttctgtt

SEQ ID NO: 175239 - DNA, 20 bp, Artificial Sequence
  Description of Artificial Sequence: Synthetic oligonucleotide
  Target: ATXN1; (-) strand; PAM type: YTN; PAM sequence: TTT
aaaataatttcttcttctgt

SEQ ID NO: 175240 - DNA, 20 bp, Artificial Sequence
  Description of Artificial Sequence: Synthetic oligonucleotide
  Target: ATXN1; (-) strand; PAM type: YTN; PAM sequence: TTT
taaaataatttcttcttctg

SEQ ID NO: 175241 - DNA, 20 bp, Artificial Sequence
  Description of Artificial Sequence: Synthetic oligonucleotide
  Target: ATXN1; (-) strand; PAM type: YTN; PAM sequence: TTC
catatattttaaaataattt

SEQ ID NO: 175242 - DNA, 20 bp, Artificial Sequence
  Description of Artificial Sequence: Synthetic oligonucleotide
  Target: ATXN1; (-) strand; PAM type: YTN; PAM sequence: TTA
tattccatatattttaaaat

SEQ ID NO: 175243 - DNA, 20 bp, Artificial Sequence
  Description of Artificial Sequence: Synthetic oligonucleotide
  Target: ATXN1; (-) strand; PAM type: YTN; PAM sequence: TTA
ttatattccatatattttaa

SEQ ID NO: 175244 - DNA, 20 bp, Artificial Sequence
  Description of Artificial Sequence: Synthetic oligonucleotide
  Target: ATXN1; (-) strand; PAM type: YTN; PAM sequence: TTT
attatattccatatatttta

SEQ ID NO: 175245 - DNA, 20 bp, Artificial Sequence
  Description of Artificial Sequence: Synthetic oligonucleotide
  Target: ATXN1; (-) strand; PAM type: YTN; PAM sequence: TTT
tattatattccatatatttt

SEQ ID NO: 175246 - DNA, 20 bp, Artificial Sequence
  Description of Artificial Sequence: Synthetic oligonucleotide
  Target: ATXN1; (-) strand; PAM type: YTN; PAM sequence: CTA
ttttattatattccatatat

SEQ ID NO: 175247 - DNA, 20 bp, Artificial Sequence
  Description of Artificial Sequence: Synthetic oligonucleotide
  Target: ATXN1; (-) strand; PAM type: YTN; PAM sequence: TTC
tattttattatattccatat

SEQ ID NO: 175248 - DNA, 20 bp, Artificial Sequence
  Description of Artificial Sequence: Synthetic oligonucleotide
  Target: ATXN1; (-) strand; PAM type: YTN; PAM sequence: TTT
ctattttattatattccata

SEQ ID NO: 175249 - DNA, 20 bp, Artificial Sequence
  Description of Artificial Sequence: Synthetic oligonucleotide
  Target: ATXN1; (-) strand; PAM type: YTN; PAM sequence: TTG
gccaaatttctattttatta

SEQ ID NO: 175250 - DNA, 20 bp, Artificial Sequence
  Description of Artificial Sequence: Synthetic oligonucleotide
  Target: ATXN1; (-) strand; PAM type: YTN; PAM sequence: TTA
attggccaaatttctatttt

SEQ ID NO: 175251 - DNA, 20 bp, Artificial Sequence
  Description of Artificial Sequence: Synthetic oligonucleotide
  Target: ATXN1; (-) strand; PAM type: YTN; PAM sequence: TTA
attaattggccaaatttcta

SEQ ID NO: 175252 - DNA, 20 bp, Artificial Sequence
  Description of Artificial Sequence: Synthetic oligonucleotide
  Target: ATXN1; (-) strand; PAM type: YTN; PAM sequence: CTA
atattaattaattggccaaa

SEQ ID NO: 175253 - DNA, 20 bp, Artificial Sequence
  Description of Artificial Sequence: Synthetic oligonucleotide
  Target: ATXN1; (-) strand; PAM type: YTN; PAM sequence: CTG
cctaatattaattaattggc

SEQ ID NO: 175254 - DNA, 20 bp, Artificial Sequence
  Description of Artificial Sequence: Synthetic oligonucleotide
  Target: ATXN1; (-) strand; PAM type: YTN; PAM sequence: TTC
actgcctaatattaattaat

SEQ ID NO: 175255 - DNA, 20 bp, Artificial Sequence
  Description of Artificial Sequence: Synthetic oligonucleotide
  Target: ATXN1; (-) strand; PAM type: YTN; PAM sequence: TTT
cactgcctaatattaattaa

SEQ ID NO: 175256 - DNA, 20 bp, Artificial Sequence
  Description of Artificial Sequence: Synthetic oligonucleotide
  Target: ATXN1; (-) strand; PAM type: YTN; PAM sequence: TTG
tttcactgcctaatattaat

SEQ ID NO: 175257 - DNA, 20 bp, Artificial Sequence
  Description of Artificial Sequence: Synthetic oligonucleotide
  Target: ATXN1; (-) strand; PAM type: YTN; PAM sequence: TTA
ttgtttcactgcctaatatt

SEQ ID NO: 175258 - DNA, 20 bp, Artificial Sequence
  Description of Artificial Sequence: Synthetic oligonucleotide
  Target: ATXN1; (-) strand; PAM type: YTN; PAM sequence: CTT
attgtttcactgcctaatat

SEQ ID NO: 175259 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaccaaaaacaaaca

SEQ ID NO: 175260 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaccaaaaaca

SEQ ID NO: 175261 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagtgagaccctg

SEQ ID NO: 175262 - DNA, 20 bp, Artificial Sequence
  Description of Artificial Sequence: Synthetic oligonucleotide
  Target: ATXN1; (-) strand; PAM type: YTN; PAM sequence: CTC
cagtctgggcgacagagtga

SEQ ID NO: 175263 - DNA, 20 bp, Artificial Sequence
  Description of Artificial Sequence: Synthetic oligonucleotide
  Target: ATXN1; (-) strand; PAM type: YTN; PAM sequence: TTC
actccagtctgggcgacaga

SEQ ID NO: 175264 - DNA, 20 bp, Artificial Sequence
  Description of Artificial Sequence: Synthetic oligonucleotide
  Target: ATXN1; (-) strand; PAM type: YTN; PAM sequence: TTT
cactccagtctgggcgacag

SEQ ID NO: 175265 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcgcacc

SEQ ID NO: 175266 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcagaggttg

SEQ ID NO: 175267 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcagaggtt

SEQ ID NO: 175268 - DNA, 20 bp, Artificial Sequence
  Description of Artificial Sequence: Synthetic oligonucleotide
  Target: ATXN1; (-) strand; PAM type: YTN; PAM sequence: CTC
ttgaacccaggaggcagagg

SEQ ID NO: 175269 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatctcttgaa

SEQ ID NO: 175270 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 175271 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaggcagga

SEQ ID NO: 175272 - DNA, 20 bp, Artificial Sequence
  Description of Artificial Sequence: Synthetic oligonucleotide
  Target: ATXN1; (-) strand; PAM type: YTN; PAM sequence: TTC
cagctactcgggaggctgag

SEQ ID NO: 175273 - DNA, 20 bp, Artificial Sequence
  Description of Artificial Sequence: Synthetic oligonucleotide
  Target: ATXN1; (-) strand; PAM type: YTN; PAM sequence: TTA
gccgggcatggtggcaggtg

SEQ ID NO: 175274 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagccg

SEQ ID NO: 175275 - DNA, 20 bp, Artificial Sequence
  Description of Artificial Sequence: Synthetic oligonucleotide
  Target: ATXN1; (-) strand; PAM type: YTN; PAM sequence: CTC
ctaaaaatacaaaaaattag

SEQ ID NO: 175276 - DNA, 20 bp, Artificial Sequence
  Description of Artificial Sequence: Synthetic oligonucleotide
  Target: ATXN1; (-) strand; PAM type: YTN; PAM sequence: CTC
tcctaaaaatacaaaaaatt

SEQ ID NO: 175277 - DNA, 20 bp, Artificial Sequence
  Description of Artificial Sequence: Synthetic oligonucleotide
  Target: ATXN1; (-) strand; PAM type: YTN; PAM sequence: CTG
gccaacatggccaaacccca

SEQ ID NO: 175278 - DNA, 20 bp, Artificial Sequence
  Description of Artificial Sequence: Synthetic oligonucleotide
  Target: ATXN1; (-) strand; PAM type: YTN; PAM sequence: TTC
gagaccatcctggccaacat

SEQ ID NO: 175279 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 175280 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggagggtggag

SEQ ID NO: 175281 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaggagggtgga

SEQ ID NO: 175282 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaggagggtgg

SEQ ID NO: 175283 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 175284 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 175285 - DNA, 20 bp, Artificial Sequence
  Description of Artificial Sequence: Synthetic oligonucleotide
  Target: ATXN1; (-) strand; PAM type: YTN; PAM sequence: CTG
ggcgcggtggctcacgcctg

SEQ ID NO: 175286 - DNA, 20 bp, Artificial Sequence
  Description of Artificial Sequence: Synthetic oligonucleotide
  Target: ATXN1; (-) strand; PAM type: YTN; PAM sequence: TTG
ggctgggcgcggtggctcac

SEQ ID NO: 175287 - DNA, 20 bp, Artificial Sequence
  Description of Artificial Sequence: Synthetic oligonucleotide
  Target: ATXN1; (-) strand; PAM type: YTN; PAM sequence: CTT
gggctgggcgcggtggctca

SEQ ID NO: 175288 - DNA, 20 bp, Artificial Sequence
  Description of Artificial Sequence: Synthetic oligonucleotide
  Target: ATXN1; (-) strand; PAM type: YTN; PAM sequence: TTG
aaataataaccacttgggct

SEQ ID NO: 175289 - DNA, 20 bp, Artificial Sequence
  Description of Artificial Sequence: Synthetic oligonucleotide
  Target: ATXN1; (-) strand; PAM type: YTN; PAM sequence: CTG
tgttgaaataataaccactt

SEQ ID NO: 175290 - DNA, 20 bp, Artificial Sequence
  Description of Artificial Sequence: Synthetic oligonucleotide
  Target: ATXN1; (-) strand; PAM type: YTN; PAM sequence: TTC
tgtgttgaaataataaccac

SEQ ID NO: 175291 - DNA, 20 bp, Artificial Sequence
  Description of Artificial Sequence: Synthetic oligonucleotide
  Target: ATXN1; (-) strand; PAM type: YTN; PAM sequence: CTT
ctgtgttgaaataataacca

SEQ ID NO: 175292 - DNA, 20 bp, Artificial Sequence
  Description of Artificial Sequence: Synthetic oligonucleotide
  Target: ATXN1; (-) strand; PAM type: YTN; PAM sequence: TTC
gggtaaacaaggacttctgt

SEQ ID NO: 175293 - DNA, 20 bp, Artificial Sequence
  Description of Artificial Sequence: Synthetic oligonucleotide
  Target: ATXN1; (-) strand; PAM type: YTN; PAM sequence: CTT
cgggtaaacaaggacttctg

SEQ ID NO: 175294 - DNA, 20 bp, Artificial Sequence
  Description of Artificial Sequence: Synthetic oligonucleotide
  Target: ATXN1; (-) strand; PAM type: YTN; PAM sequence: CTG
cttcgggtaaacaaggactt

SEQ ID NO: 175295 - DNA, 20 bp, Artificial Sequence
  Description of Artificial Sequence: Synthetic oligonucleotide
  Target: ATXN1; (-) strand; PAM type: YTN; PAM sequence: TTC
ccagctgcttcgggtaaaca

SEQ ID NO: 175296 - DNA, 20 bp, Artificial Sequence
  Description of Artificial Sequence: Synthetic oligonucleotide
  Target: ATXN1; (-) strand; PAM type: YTN; PAM sequence: TTT
cccagctgcttcgggtaaac

SEQ ID NO: 175297 - DNA, 20 bp, Artificial Sequence
  Description of Artificial Sequence: Synthetic oligonucleotide
  Target: ATXN1; (-) strand; PAM type: YTN; PAM sequence: CTA
tttcccagctgcttcgggta

SEQ ID NO: 175298 - DNA, 20 bp, Artificial Sequence
  Description of Artificial Sequence: Synthetic oligonucleotide
  Target: ATXN1; (-) strand; PAM type: YTN; PAM sequence: TTA
tgcgaagccctatttcccag

SEQ ID NO: 175299 - DNA, 20 bp, Artificial Sequence
  Description of Artificial Sequence: Synthetic oligonucleotide
  Target: ATXN1; (-) strand; PAM type: YTN; PAM sequence: TTT
atgcgaagccctatttccca

SEQ ID NO: 175300 - DNA, 20 bp, Artificial Sequence
  Description of Artificial Sequence: Synthetic oligonucleotide
  Target: ATXN1; (-) strand; PAM type: YTN; PAM sequence: TTT
tatgcgaagccctatttccc

SEQ ID NO: 175301 - DNA, 20 bp, Artificial Sequence
  Description of Artificial Sequence: Synthetic oligonucleotide
  Target: ATXN1; (-) strand; PAM type: YTN; PAM sequence: CTG
gttttatgcgaagccctatt

SEQ ID NO: 175302 - DNA, 20 bp, Artificial Sequence
  Description of Artificial Sequence: Synthetic oligonucleotide
  Target: ATXN1; (-) strand; PAM type: YTN; PAM sequence: CTC
tggttttatgcgaagcccta

SEQ ID NO: 175303 - DNA, 20 bp, Artificial Sequence
  Description of Artificial Sequence: Synthetic oligonucleotide
  Target: ATXN1; (-) strand; PAM type: YTN; PAM sequence: CTG
ctctggttttatgcgaagcc

SEQ ID NO: 175304 - DNA, 20 bp, Artificial Sequence
  Description of Artificial Sequence: Synthetic oligonucleotide
  Target: ATXN1; (-) strand; PAM type: YTN; PAM sequence: TTC
tgctctggttttatgcgaag

SEQ ID NO: 175305 - DNA, 20 bp, Artificial Sequence
  Description of Artificial Sequence: Synthetic oligonucleotide
  Target: ATXN1; (-) strand; PAM type: YTN; PAM sequence: CTT
ctgctctggttttatgcgaa

SEQ ID NO: 175306 - DNA, 20 bp, Artificial Sequence
  Description of Artificial Sequence: Synthetic oligonucleotide
  Target: ATXN1; (-) strand; PAM type: YTN; PAM sequence: CTA
cttctgctctggttttatgc

SEQ ID NO: 175307 - DNA, 20 bp, Artificial Sequence
  Description of Artificial Sequence: Synthetic oligonucleotide
  Target: ATXN1; (-) strand; PAM type: YTN; PAM sequence: CTG
ctacttctgctctggtttta

SEQ ID NO: 175308 - DNA, 20 bp, Artificial Sequence
  Description of Artificial Sequence: Synthetic oligonucleotide
  Target: ATXN1; (-) strand; PAM type: YTN; PAM sequence: CTC
tgctacttctgctctggttt

SEQ ID NO: 175309 - DNA, 20 bp, Artificial Sequence
  Description of Artificial Sequence: Synthetic oligonucleotide
  Target: ATXN1; (-) strand; PAM type: YTN; PAM sequence: TTC
tctgctacttctgctctggt

SEQ ID NO: 175310 - DNA, 20 bp, Artificial Sequence
  Description of Artificial Sequence: Synthetic oligonucleotide
  Target: ATXN1; (-) strand; PAM type: YTN; PAM sequence: TTT
ctctgctacttctgctctgg

SEQ ID NO: 175311 - DNA, 20 bp, Artificial Sequence
  Description of Artificial Sequence: Synthetic oligonucleotide
  Target: ATXN1; (-) strand; PAM type: YTN; PAM sequence: CTT
tctctgctacttctgctctg

SEQ ID NO: 175312 - DNA, 20 bp, Artificial Sequence
  Description of Artificial Sequence: Synthetic oligonucleotide
  Target: ATXN1; (-) strand; PAM type: YTN; PAM sequence: CTC
acaggtccctttctctgcta

SEQ ID NO: 175313 - DNA, 20 bp, Artificial Sequence
  Description of Artificial Sequence: Synthetic oligonucleotide
  Target: ATXN1; (-) strand; PAM type: YTN; PAM sequence: CTC
actcacaggtccctttctct

SEQ ID NO: 175314 - DNA, 20 bp, Artificial Sequence
  Description of Artificial Sequence: Synthetic oligonucleotide
  Target: ATXN1; (-) strand; PAM type: YTN; PAM sequence: CTA
gtgtgagccgagaaccaggc

SEQ ID NO: 175315 - DNA, 20 bp, Artificial Sequence
  Description of Artificial Sequence: Synthetic oligonucleotide
  Target: ATXN1; (-) strand; PAM type: YTN; PAM sequence: CTG
gactagtgtgagccgagaac

SEQ ID NO: 175316 - DNA, 20 bp, Artificial Sequence
  Description of Artificial Sequence: Synthetic oligonucleotide
  Target: ATXN1; (-) strand; PAM type: YTN; PAM sequence: TTC
ccaaggctggactagtgtga

SEQ ID NO: 175317 - DNA, 20 bp, Artificial Sequence
  Description of Artificial Sequence: Synthetic oligonucleotide
  Target: ATXN1; (-) strand; PAM type: YTN; PAM sequence: TTT
cccaaggctggactagtgtg

SEQ ID NO: 175318 - DNA, 20 bp, Artificial Sequence
  Description of Artificial Sequence: Synthetic oligonucleotide
  Target: ATXN1; (-) strand; PAM type: YTN; PAM sequence: CTT
tcccaaggctggactagtgt

SEQ ID NO: 175319 - DNA, 20 bp, Artificial Sequence
  Description of Artificial Sequence: Synthetic oligonucleotide
  Target: ATXN1; (-) strand; PAM type: YTN; PAM sequence: CTC
tttcccaaggctggactagt

SEQ ID NO: 175320 - DNA, 20 bp, Artificial Sequence
  Description of Artificial Sequence: Synthetic oligonucleotide
  Target: ATXN1; (-) strand; PAM type: YTN; PAM sequence: CTG
tggtgtcccagctctttccc

SEQ ID NO: 175321 - DNA, 20 bp, Artificial Sequence
  Description of Artificial Sequence: Synthetic oligonucleotide
  Target: ATXN1; (-) strand; PAM type: YTN; PAM sequence: TTA
cctgtggtgtcccagctctt

SEQ ID NO: 175322 - DNA, 20 bp, Artificial Sequence
  Description of Artificial Sequence: Synthetic oligonucleotide
  Target: ATXN1; (-) strand; PAM type: YTN; PAM sequence: TTA
aggtggttacctgtggtgtc

SEQ ID NO: 175323 - DNA, 20 bp, Artificial Sequence
  Description of Artificial Sequence: Synthetic oligonucleotide
  Target: ATXN1; (-) strand; PAM type: YTN; PAM sequence: TTC
gccagacaggcaaagggtaa

SEQ ID NO: 175324 - DNA, 20 bp, Artificial Sequence
  Description of Artificial Sequence: Synthetic oligonucleotide
  Target: ATXN1; (-) strand; PAM type: YTN; PAM sequence: CTT
cgccagacaggcaaagggta

SEQ ID NO: 175325 - DNA, 20 bp, Artificial Sequence
  Description of Artificial Sequence: Synthetic oligonucleotide
  Target: ATXN1; (-) strand; PAM type: YTN; PAM sequence: TTG
tcttcgccagacaggcaaag

SEQ ID NO: 175326 - DNA, 20 bp, Artificial Sequence
  Description of Artificial Sequence: Synthetic oligonucleotide
  Target: ATXN1; (-) strand; PAM type: YTN; PAM sequence: TTT
gtcttcgccagacaggcaaa

SEQ ID NO: 175327 - DNA, 20 bp, Artificial Sequence
  Description of Artificial Sequence: Synthetic oligonucleotide
  Target: ATXN1; (-) strand; PAM type: YTN; PAM sequence: CTT
tgtcttcgccagacaggcaa

SEQ ID NO: 175328 - DNA, 20 bp, Artificial Sequence
  Description of Artificial Sequence: Synthetic oligonucleotide
  Target: ATXN1; (-) strand; PAM type: YTN; PAM sequence: TTA
ctttgtcttcgccagacagg

SEQ ID NO: 175329 - DNA, 20 bp, Artificial Sequence
  Description of Artificial Sequence: Synthetic oligonucleotide
  Target: ATXN1; (-) strand; PAM type: YTN; PAM sequence: TTT
actttgtcttcgccagacag

SEQ ID NO: 175330 - DNA, 20 bp, Artificial Sequence
  Description of Artificial Sequence: Synthetic oligonucleotide
  Target: ATXN1; (-) strand; PAM type: YTN; PAM sequence: CTC
agtttactttgtcttcgcca

SEQ ID NO: 175331 - DNA, 20 bp, Artificial Sequence
  Description of Artificial Sequence: Synthetic oligonucleotide
  Target: ATXN1; (-) strand; PAM type: YTN; PAM sequence: TTA
ataaaagtggcactcagttt

SEQ ID NO: 175332 - DNA, 20 bp, Artificial Sequence
  Description of Artificial Sequence: Synthetic oligonucleotide
  Target: ATXN1; (-) strand; PAM type: YTN; PAM sequence: TTC
ccattaataaaagtggcact

SEQ ID NO: 175333 - DNA, 20 bp, Artificial Sequence
  Description of Artificial Sequence: Synthetic oligonucleotide
  Target: ATXN1; (-) strand; PAM type: YTN; PAM sequence: TTT
cccattaataaaagtggcac

SEQ ID NO: 175334 - DNA, 20 bp, Artificial Sequence
  Description of Artificial Sequence: Synthetic oligonucleotide
  Target: ATXN1; (-) strand; PAM type: YTN; PAM sequence: CTA
taagtaagatggtttcccat

SEQ ID NO: 175335 - DNA, 20 bp, Artificial Sequence
  Description of Artificial Sequence: Synthetic oligonucleotide
  Target: ATXN1; (-) strand; PAM type: YTN; PAM sequence: TTG
ctataagtaagatggtttcc

SEQ ID NO: 175336 - DNA, 20 bp, Artificial Sequence
  Description of Artificial Sequence: Synthetic oligonucleotide
  Target: ATXN1; (-) strand; PAM type: YTN; PAM sequence: TTT
gctataagtaagatggtttc

SEQ ID NO: 175337 - DNA, 20 bp, Artificial Sequence
  Description of Artificial Sequence: Synthetic oligonucleotide
  Target: ATXN1; (-) strand; PAM type: YTN; PAM sequence: TTT
tgctataagtaagatggttt

SEQ ID NO: 175338 - DNA, 20 bp, Artificial Sequence
  Description of Artificial Sequence: Synthetic oligonucleotide
  Target: ATXN1; (-) strand; PAM type: YTN; PAM sequence: TTT
ttgctataagtaagatggtt

SEQ ID NO: 175339 - DNA, 20 bp, Artificial Sequence
  Description of Artificial Sequence: Synthetic oligonucleotide
  Target: ATXN1; (-) strand; PAM type: YTN; PAM sequence: TTG
tttttgctataagtaagatg

SEQ ID NO: 175340 - DNA, 20 bp, Artificial Sequence
  Description of Artificial Sequence: Synthetic oligonucleotide
  Target: ATXN1; (-) strand; PAM type: YTN; PAM sequence: TTT
gtttttgctataagtaagat

SEQ ID NO: 175341 - DNA, 20 bp, Artificial Sequence
  Description of Artificial Sequence: Synthetic oligonucleotide
  Target: ATXN1; (-) strand; PAM type: YTN; PAM sequence: TTG
agcatttgtttttgctataa

SEQ ID NO: 175342 - DNA, 20 bp, Artificial Sequence
  Description of Artificial Sequence: Synthetic oligonucleotide
  Target: ATXN1; (-) strand; PAM type: YTN; PAM sequence: TTT
gagcatttgtttttgctata

SEQ ID NO: 175343 - DNA, 20 bp, Artificial Sequence
  Description of Artificial Sequence: Synthetic oligonucleotide
  Target: ATXN1; (-) strand; PAM type: YTN; PAM sequence: CTA
cagcatgaaggatccagata

SEQ ID NO: 175344 - DNA, 20 bp, Artificial Sequence
  Description of Artificial Sequence: Synthetic oligonucleotide
  Target: ATXN1; (-) strand; PAM type: YTN; PAM sequence: CTA
cctacagcatgaaggatcca

SEQ ID NO: 175345 - DNA, 20 bp, Artificial Sequence
  Description of Artificial Sequence: Synthetic oligonucleotide
  Target: ATXN1; (-) strand; PAM type: YTN; PAM sequence: TTC
cctacctacagcatgaagga

SEQ ID NO: 175346 - DNA, 20 bp, Artificial Sequence
  Description of Artificial Sequence: Synthetic oligonucleotide
  Target: ATXN1; (-) strand; PAM type: YTN; PAM sequence: CTG
ttccctacctacagcatgaa

SEQ ID NO: 175347 - DNA, 20 bp, Artificial Sequence
  Description of Artificial Sequence: Synthetic oligonucleotide
  Target: ATXN1; (-) strand; PAM type: YTN; PAM sequence: TTC
tgttccctacctacagcatg

SEQ ID NO: 175348 - DNA, 20 bp, Artificial Sequence
  Description of Artificial Sequence: Synthetic oligonucleotide
  Target: ATXN1; (-) strand; PAM type: YTN; PAM sequence: CTC
agagccccattctgttccct

SEQ ID NO: 175349 - DNA, 20 bp, Artificial Sequence
  Description of Artificial Sequence: Synthetic oligonucleotide
  Target: ATXN1; (-) strand; PAM type: YTN; PAM sequence: CTC
tcagagccccattctgttcc

SEQ ID NO: 175350 - DNA, 20 bp, Artificial Sequence
  Description of Artificial Sequence: Synthetic oligonucleotide
  Target: ATXN1; (-) strand; PAM type: YTN; PAM sequence: CTC
ccagcagaggcgcggaggag

SEQ ID NO: 175351 - DNA, 20 bp, Artificial Sequence
  Description of Artificial Sequence: Synthetic oligonucleotide
  Target: ATXN1; (-) strand; PAM type: YTN; PAM sequence: TTG
ctcccagcagaggcgcggag

SEQ ID NO: 175352 - DNA, 20 bp, Artificial Sequence
  Description of Artificial Sequence: Synthetic oligonucleotide
  Target: ATXN1; (-) strand; PAM type: YTN; PAM sequence: TTT
gctcccagcagaggcgcgga

SEQ ID NO: 175353 - DNA, 20 bp, Artificial Sequence
  Description of Artificial Sequence: Synthetic oligonucleotide
  Target: ATXN1; (-) strand; PAM type: YTN; PAM sequence: TTT
tgctcccagcagaggcgcgg

SEQ ID NO: 175354 - DNA, 20 bp, Artificial Sequence
  Description of Artificial Sequence: Synthetic oligonucleotide
  Target: ATXN1; (-) strand; PAM type: YTN; PAM sequence: TTT
ttgctcccagcagaggcgcg

SEQ ID NO: 175355 - DNA, 20 bp, Artificial Sequence
  Description of Artificial Sequence: Synthetic oligonucleotide
  Target: ATXN1; (-) strand; PAM type: YTN; PAM sequence: TTA
tttttgctcccagcagaggc

SEQ ID NO: 175356 - DNA, 20 bp, Artificial Sequence
  Description of Artificial Sequence: Synthetic oligonucleotide
  Target: ATXN1; (-) strand; PAM type: YTN; PAM sequence: TTG
agattatttttgctcccagc

SEQ ID NO: 175357 - DNA, 20 bp, Artificial Sequence
  Description of Artificial Sequence: Synthetic oligonucleotide
  Target: ATXN1; (-) strand; PAM type: YTN; PAM sequence: TTT
gagattatttttgctcccag

SEQ ID NO: 175358 - DNA, 20 bp, Artificial Sequence
  Description of Artificial Sequence: Synthetic oligonucleotide
  Target: ATXN1; (-) strand; PAM type: YTN; PAM sequence: TTT
tgagattatttttgctccca

SEQ ID NO: 175359 - DNA, 20 bp, Artificial Sequence
  Description of Artificial Sequence: Synthetic oligonucleotide
  Target: ATXN1; (-) strand; PAM type: YTN; PAM sequence: CTG
ttttgagattatttttgctc

SEQ ID NO: 175360 - DNA, 20 bp, Artificial Sequence
  Description of Artificial Sequence: Synthetic oligonucleotide
  Target: ATXN1; (-) strand; PAM type: YTN; PAM sequence: TTC
ctgttttgagattatttttg

SEQ ID NO: 175361 - DNA, 20 bp, Artificial Sequence
  Description of Artificial Sequence: Synthetic oligonucleotide
  Target: ATXN1; (-) strand; PAM type: YTN; PAM sequence: TTT
cctgttttgagattattttt

SEQ ID NO: 175362 - DNA, 20 bp, Artificial Sequence
  Description of Artificial Sequence: Synthetic oligonucleotide
  Target: ATXN1; (-) strand; PAM type: YTN; PAM sequence: TTT
tcctgttttgagattatttt

SEQ ID NO: 175363 - DNA, 20 bp, Artificial Sequence
  Description of Artificial Sequence: Synthetic oligonucleotide
  Target: ATXN1; (-) strand; PAM type: YTN; PAM sequence: TTT
ttcctgttttgagattattt

SEQ ID NO: 175364 - DNA, 20 bp, Artificial Sequence
  Description of Artificial Sequence: Synthetic oligonucleotide
  Target: ATXN1; (-) strand; PAM type: YTN; PAM sequence: CTT
tttcctgttttgagattatt

SEQ ID NO: 175365 - DNA, 20 bp, Artificial Sequence
  Description of Artificial Sequence: Synthetic oligonucleotide
  Target: ATXN1; (-) strand; PAM type: YTN; PAM sequence: TTC
tttttcctgttttgagatta

SEQ ID NO: 175366 - DNA, 20 bp, Artificial Sequence
  Description of Artificial Sequence: Synthetic oligonucleotide
  Target: ATXN1; (-) strand; PAM type: YTN; PAM sequence: CTT
ctttttcctgttttgagatt

SEQ ID NO: 175367 - DNA, 20 bp, Artificial Sequence
  Description of Artificial Sequence: Synthetic oligonucleotide
  Target: ATXN1; (-) strand; PAM type: YTN; PAM sequence: CTC
cttctttttcctgttttgag

SEQ ID NO: 175368 - DNA, 20 bp, Artificial Sequence
  Description of Artificial Sequence: Synthetic oligonucleotide
  Target: ATXN1; (-) strand; PAM type: YTN; PAM sequence: TTC
ccctccttctttttcctgtt

SEQ ID NO: 175369 - DNA, 20 bp, Artificial Sequence
  Description of Artificial Sequence: Synthetic oligonucleotide
  Target: ATXN1; (-) strand; PAM type: YTN; PAM sequence: TTT
cccctccttctttttcctgt

SEQ ID NO: 175370 - DNA, 20 bp, Artificial Sequence
  Description of Artificial Sequence: Synthetic oligonucleotide
  Target: ATXN1; (-) strand; PAM type: YTN; PAM sequence: TTA
aaaatttcccctccttcttt

SEQ ID NO: 175371 - DNA, 20 bp, Artificial Sequence
  Description of Artificial Sequence: Synthetic oligonucleotide
  Target: ATXN1; (-) strand; PAM type: YTN; PAM sequence: CTG
aagggagggaaaaaaacgat

SEQ ID NO: 175372 - DNA, 20 bp, Artificial Sequence
  Description of Artificial Sequence: Synthetic oligonucleotide
  Target: ATXN1; (-) strand; PAM type: YTN; PAM sequence: TTC
tgaagggagggaaaaaaacg

SEQ ID NO: 175373 - DNA, 20 bp, Artificial Sequence
  Description of Artificial Sequence: Synthetic oligonucleotide
  Target: ATXN1; (-) strand; PAM type: YTN; PAM sequence: CTC
attctgaagggagggaaaaa

SEQ ID NO: 175374 - DNA, 20 bp, Artificial Sequence
  Description of Artificial Sequence: Synthetic oligonucleotide
  Target: ATXN1; (-) strand; PAM type: YTN; PAM sequence: CTC
cccactcattctgaagggag

SEQ ID NO: 175375 - DNA, 20 bp, Artificial Sequence
  Description of Artificial Sequence: Synthetic oligonucleotide
  Target: ATXN1; (-) strand; PAM type: YTN; PAM sequence: TTC
tccccactcattctgaaggg

SEQ ID NO: 175376 - DNA, 20 bp, Artificial Sequence
  Description of Artificial Sequence: Synthetic oligonucleotide
  Target: ATXN1; (-) strand; PAM type: YTN; PAM sequence: CTG
cccatgtataattctcccca

SEQ ID NO: 175377 - DNA, 20 bp, Artificial Sequence
  Description of Artificial Sequence: Synthetic oligonucleotide
  Target: ATXN1; (-) strand; PAM type: YTN; PAM sequence: CTC
atatgtagctgcccatgtat

SEQ ID NO: 175378 - DNA, 20 bp, Artificial Sequence
  Description of Artificial Sequence: Synthetic oligonucleotide
  Target: ATXN1; (-) strand; PAM type: YTN; PAM sequence: CTG
gctcatatgtagctgcccat

SEQ ID NO: 175379 - DNA, 20 bp, Artificial Sequence
  Description of Artificial Sequence: Synthetic oligonucleotide
  Target: ATXN1; (-) strand; PAM type: YTN; PAM sequence: TTA
tatgtactggctcatatgta

SEQ ID NO: 175380 - DNA, 20 bp, Artificial Sequence
  Description of Artificial Sequence: Synthetic oligonucleotide
  Target: ATXN1; (-) strand; PAM type: YTN; PAM sequence: CTT
atatgtactggctcatatgt

SEQ ID NO: 175381 - DNA, 20 bp, Artificial Sequence
  Description of Artificial Sequence: Synthetic oligonucleotide
  Target: ATXN1; (-) strand; PAM type: YTN; PAM sequence: TTG
acttatatgtactggctcat

SEQ ID NO: 175382 - DNA, 20 bp, Artificial Sequence
  Description of Artificial Sequence: Synthetic oligonucleotide
  Target: ATXN1; (-) strand; PAM type: YTN; PAM sequence: TTA
ttgacttatatgtactggct

SEQ ID NO: 175383 - DNA, 20 bp, Artificial Sequence
  Description of Artificial Sequence: Synthetic oligonucleotide
  Target: ATXN1; (-) strand; PAM type: YTN; PAM sequence: TTG
cattattgacttatatgtac

SEQ ID NO: 175384 - DNA, 20 bp, Artificial Sequence
  Description of Artificial Sequence: Synthetic oligonucleotide
  Target: ATXN1; (-) strand; PAM type: YTN; PAM sequence: TTT
gcattattgacttatatgta

SEQ ID NO: 175385 - DNA, 20 bp, Artificial Sequence
  Description of Artificial Sequence: Synthetic oligonucleotide
  Target: ATXN1; (-) strand; PAM type: YTN; PAM sequence: CTG
tttgcattattgacttatat

SEQ ID NO: 175386 - DNA, 20 bp, Artificial Sequence
  Description of Artificial Sequence: Synthetic oligonucleotide
  Target: ATXN1; (-) strand; PAM type: YTN; PAM sequence: CTG
acgatcctgtttgcattatt

SEQ ID NO: 175387 - DNA, 20 bp, Artificial Sequence
  Description of Artificial Sequence: Synthetic oligonucleotide
  Target: ATXN1; (-) strand; PAM type: YTN; PAM sequence: TTC
ctgacgatcctgtttgcatt

SEQ ID NO: 175388 - DNA, 20 bp, Artificial Sequence
  Description of Artificial Sequence: Synthetic oligonucleotide
  Target: ATXN1; (-) strand; PAM type: YTN; PAM sequence: TTT
cctgacgatcctgtttgcat

SEQ ID NO: 175389 - DNA, 20 bp, Artificial Sequence
  Description of Artificial Sequence: Synthetic oligonucleotide
  Target: ATXN1; (-) strand; PAM type: YTN; PAM sequence: CTT
tcctgacgatcctgtttgca

SEQ ID NO: 175390 - DNA, 20 bp, Artificial Sequence
  Description of Artificial Sequence: Synthetic oligonucleotide
  Target: ATXN1; (-) strand; PAM type: YTN; PAM sequence: TTA
aacactttcctgacgatcct

SEQ ID NO: 175391 - DNA, 20 bp, Artificial Sequence
  Description of Artificial Sequence: Synthetic oligonucleotide
  Target: ATXN1; (-) strand; PAM type: YTN; PAM sequence: TTG
tgaataaattaaacactttc

SEQ ID NO: 175392 - DNA, 20 bp, Artificial Sequence
  Description of Artificial Sequence: Synthetic oligonucleotide
  Target: ATXN1; (-) strand; PAM type: YTN; PAM sequence: CTT
gtgaataaattaaacacttt

SEQ ID NO: 175393 - DNA, 20 bp, Artificial Sequence
  Description of Artificial Sequence: Synthetic oligonucleotide
  Target: ATXN1; (-) strand; PAM type: YTN; PAM sequence: TTC
ttgtgaataaattaaacact

SEQ ID NO: 175394 - DNA, 20 bp, Artificial Sequence
  Description of Artificial Sequence: Synthetic oligonucleotide
  Target: ATXN1; (-) strand; PAM type: YTN; PAM sequence: CTT
cttgtgaataaattaaacac

SEQ ID NO: 175395 - DNA, 20 bp, Artificial Sequence
  Description of Artificial Sequence: Synthetic oligonucleotide
  Target: ATXN1; (-) strand; PAM type: YTN; PAM sequence: TTC
ttcttgtgaataaattaaac

SEQ ID NO: 175396 - DNA, 20 bp, Artificial Sequence
  Description of Artificial Sequence: Synthetic oligonucleotide
  Target: ATXN1; (-) strand; PAM type: YTN; PAM sequence: TTG
gtagttcttcttgtgaataa

SEQ ID NO: 175397 - DNA, 20 bp, Artificial Sequence
  Description of Artificial Sequence: Synthetic oligonucleotide
  Target: ATXN1; (-) strand; PAM type: YTN; PAM sequence: CTT
ggtagttcttcttgtgaata

SEQ ID NO: 175398 - DNA, 20 bp, Artificial Sequence
  Description of Artificial Sequence: Synthetic oligonucleotide
  Target: ATXN1; (-) strand; PAM type: YTN; PAM sequence: TTG
aaagcttggtagttcttctt

SEQ ID NO: 175399 - DNA, 20 bp, Artificial Sequence
  Description of Artificial Sequence: Synthetic oligonucleotide
  Target: ATXN1; (-) strand; PAM type: YTN; PAM sequence: TTT
gaaagcttggtagttcttct

SEQ ID NO: 175400 - DNA, 20 bp, Artificial Sequence
  Description of Artificial Sequence: Synthetic oligonucleotide
  Target: ATXN1; (-) strand; PAM type: YTN; PAM sequence: TTT
tgaaagcttggtagttcttc

SEQ ID NO: 175401 - DNA, 20 bp, Artificial Sequence
  Description of Artificial Sequence: Synthetic oligonucleotide
  Target: ATXN1; (-) strand; PAM type: YTN; PAM sequence: TTT
ttgaaagcttggtagttctt

SEQ ID NO: 175402 - DNA, 20 bp, Artificial Sequence
  Description of Artificial Sequence: Synthetic oligonucleotide
  Target: ATXN1; (-) strand; PAM type: YTN; PAM sequence: TTT
tttgaaagcttggtagttct

SEQ ID NO: 175403 - DNA, 20 bp, Artificial Sequence
  Description of Artificial Sequence: Synthetic oligonucleotide
  Target: ATXN1; (-) strand; PAM type: YTN; PAM sequence: TTT
ttttgaaagcttggtagttc

SEQ ID NO: 175404 - DNA, 20 bp, Artificial Sequence
  Description of Artificial Sequence: Synthetic oligonucleotide
  Target: ATXN1; (-) strand; PAM type: YTN; PAM sequence: TTT
tttttgaaagcttggtagtt

SEQ ID NO: 175405 - DNA, 20 bp, Artificial Sequence
  Description of Artificial Sequence: Synthetic oligonucleotide
  Target: ATXN1; (-) strand; PAM type: YTN; PAM sequence: TTT
ttttttgaaagcttggtagt

SEQ ID NO: 175406 - DNA, 20 bp, Artificial Sequence
  Description of Artificial Sequence: Synthetic oligonucleotide
  Target: ATXN1; (-) strand; PAM type: YTN; PAM sequence: TTT
tttttttgaaagcttggtag

SEQ ID NO: 175407 - DNA, 20 bp, Artificial Sequence
  Description of Artificial Sequence: Synthetic oligonucleotide
  Target: ATXN1; (-) strand; PAM type: YTN; PAM sequence: TTT
ttttttttgaaagcttggta

SEQ ID NO: 175408 - DNA, 20 bp, Artificial Sequence
  Description of Artificial Sequence: Synthetic oligonucleotide
  Target: ATXN1; (-) strand; PAM type: YTN; PAM sequence: TTT
tttttttttgaaagcttggt

SEQ ID NO: 175409 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgaaagcttgg

SEQ ID NO: 175410 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgaaagcttg

SEQ ID NO: 175411 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgaaagctt

SEQ ID NO: 175412 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgaaagct

SEQ ID NO: 175413 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgaaagc

SEQ ID NO: 175414 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgaaag

SEQ ID NO: 175415 - DNA, 20 bp, Artificial Sequence
  Description of Artificial Sequence: Synthetic oligonucleotide
  Target: ATXN1; (-) strand; PAM type: YTN; PAM sequence: CTG
ggtttttttttttttttttt

SEQ ID NO: 175416 - DNA, 20 bp, Artificial Sequence
  Description of Artificial Sequence: Synthetic oligonucleotide
  Target: ATXN1; (-) strand; PAM type: YTN; PAM sequence: CTG
caaaatggatgatgaagaaa

SEQ ID NO: 175417 - DNA, 20 bp, Artificial Sequence
  Description of Artificial Sequence: Synthetic oligonucleotide
  Target: ATXN1; (-) strand; PAM type: YTN; PAM sequence: CTG
actgcaaaatggatgatgaa

SEQ ID NO: 175418 - DNA, 20 bp, Artificial Sequence
  Description of Artificial Sequence: Synthetic oligonucleotide
  Target: ATXN1; (-) strand; PAM type: YTN; PAM sequence: TTA
tcagcacactgactgcaaaa

SEQ ID NO: 175419 - DNA, 20 bp, Artificial Sequence
  Description of Artificial Sequence: Synthetic oligonucleotide
  Target: ATXN1; (-) strand; PAM type: YTN; PAM sequence: TTG
ttatcagcacactgactgca

SEQ ID NO: 175420 - DNA, 20 bp, Artificial Sequence
  Description of Artificial Sequence: Synthetic oligonucleotide
  Target: ATXN1; (-) strand; PAM type: YTN; PAM sequence: TTT
gttatcagcacactgactgc

SEQ ID NO: 175421 - DNA, 20 bp, Artificial Sequence
  Description of Artificial Sequence: Synthetic oligonucleotide
  Target: ATXN1; (-) strand; PAM type: YTN; PAM sequence: CTA
gataatgaccatttgttatc

SEQ ID NO: 175422 - DNA, 20 bp, Artificial Sequence
  Description of Artificial Sequence: Synthetic oligonucleotide
  Target: ATXN1; (-) strand; PAM type: YTN; PAM sequence: TTC
cagaaactagataatgacca

SEQ ID NO: 175423 - DNA, 20 bp, Artificial Sequence
  Description of Artificial Sequence: Synthetic oligonucleotide
  Target: ATXN1; (-) strand; PAM type: YTN; PAM sequence: TTT
ccagaaactagataatgacc

SEQ ID NO: 175424 - DNA, 20 bp, Artificial Sequence
  Description of Artificial Sequence: Synthetic oligonucleotide
  Target: ATXN1; (-) strand; PAM type: YTN; PAM sequence: CTT
tccagaaactagataatgac

SEQ ID NO: 175425 - DNA, 20 bp, Artificial Sequence
  Description of Artificial Sequence: Synthetic oligonucleotide
  Target: ATXN1; (-) strand; PAM type: YTN; PAM sequence: TTA
ctttccagaaactagataat

SEQ ID NO: 175426 - DNA, 20 bp, Artificial Sequence
  Description of Artificial Sequence: Synthetic oligonucleotide
  Target: ATXN1; (-) strand; PAM type: YTN; PAM sequence: TTC
atagacattactttccagaa

SEQ ID NO: 175427 - DNA, 20 bp, Artificial Sequence
  Description of Artificial Sequence: Synthetic oligonucleotide
  Target: ATXN1; (-) strand; PAM type: YTN; PAM sequence: TTC
caattcatagacattacttt

SEQ ID NO: 175428 - DNA, 20 bp, Artificial Sequence
  Description of Artificial Sequence: Synthetic oligonucleotide
  Target: ATXN1; (-) strand; PAM type: YTN; PAM sequence: TTT
ccaattcatagacattactt

SEQ ID NO: 175429 - DNA, 20 bp, Artificial Sequence
  Description of Artificial Sequence: Synthetic oligonucleotide
  Target: ATXN1; (-) strand; PAM type: YTN; PAM sequence: TTT
tccaattcatagacattact

SEQ ID NO: 175430 - DNA, 20 bp, Artificial Sequence
  Description of Artificial Sequence: Synthetic oligonucleotide
  Target: ATXN1; (-) strand; PAM type: YTN; PAM sequence: TTT
ttccaattcatagacattac

SEQ ID NO: 175431 - DNA, 20 bp, Artificial Sequence
  Description of Artificial Sequence: Synthetic oligonucleotide
  Target: ATXN1; (-) strand; PAM type: YTN; PAM sequence: TTT
tttccaattcatagacatta

SEQ ID NO: 175432 - DNA, 20 bp, Artificial Sequence
  Description of Artificial Sequence: Synthetic oligonucleotide
  Target: ATXN1; (-) strand; PAM type: YTN; PAM sequence: TTT
ttttccaattcatagacatt

SEQ ID NO: 175433 - DNA, 20 bp, Artificial Sequence
  Description of Artificial Sequence: Synthetic oligonucleotide
  Target: ATXN1; (-) strand; PAM type: YTN; PAM sequence: TTT
tttttccaattcatagacat

SEQ ID NO: 175434 - DNA, 20 bp, Artificial Sequence
  Description of Artificial Sequence: Synthetic oligonucleotide
  Target: ATXN1; (-) strand; PAM type: YTN; PAM sequence: TTT
ttttttccaattcatagaca

SEQ ID NO: 175435 - DNA, 20 bp, Artificial Sequence
  Description of Artificial Sequence: Synthetic oligonucleotide
  Target: ATXN1; (-) strand; PAM type: YTN; PAM sequence: TTT
tttttttccaattcatagac

SEQ ID NO: 175436 - DNA, 20 bp, Artificial Sequence
  Description of Artificial Sequence: Synthetic oligonucleotide
  Target: ATXN1; (-) strand; PAM type: YTN; PAM sequence: TTG
accaattttttttttccaat

SEQ ID NO: 175437 - DNA, 20 bp, Artificial Sequence
  Description of Artificial Sequence: Synthetic oligonucleotide
  Target: ATXN1; (-) strand; PAM type: YTN; PAM sequence: TTA
ttgaccaattttttttttcc

SEQ ID NO: 175438 - DNA, 20 bp, Artificial Sequence
  Description of Artificial Sequence: Synthetic oligonucleotide
  Target: ATXN1; (-) strand; PAM type: YTN; PAM sequence: TTC
aagtatacatagccatataa

SEQ ID NO: 175439 - DNA, 20 bp, Artificial Sequence
  Description of Artificial Sequence: Synthetic oligonucleotide
  Target: ATXN1; (-) strand; PAM type: YTN; PAM sequence: CTT
caagtatacatagccatata

SEQ ID NO: 175440 - DNA, 20 bp, Artificial Sequence
  Description of Artificial Sequence: Synthetic oligonucleotide
  Target: ATXN1; (-) strand; PAM type: YTN; PAM sequence: TTA
cttcaagtatacatagccat

SEQ ID NO: 175441 - DNA, 20 bp, Artificial Sequence
  Description of Artificial Sequence: Synthetic oligonucleotide
  Target: ATXN1; (-) strand; PAM type: YTN; PAM sequence: TTG
cattacttcaagtatacata

SEQ ID NO: 175442 - DNA, 20 bp, Artificial Sequence
  Description of Artificial Sequence: Synthetic oligonucleotide
  Target: ATXN1; (-) strand; PAM type: YTN; PAM sequence: CTA
agaaaataagttgcattact

SEQ ID NO: 175443 - DNA, 20 bp, Artificial Sequence
  Description of Artificial Sequence: Synthetic oligonucleotide
  Target: ATXN1; (-) strand; PAM type: YTN; PAM sequence: TTC
taagaaaataagttgcatta

SEQ ID NO: 175444 - DNA, 20 bp, Artificial Sequence
  Description of Artificial Sequence: Synthetic oligonucleotide
  Target: ATXN1; (-) strand; PAM type: YTN; PAM sequence: CTT
ctaagaaaataagttgcatt

SEQ ID NO: 175445 - DNA, 20 bp, Artificial Sequence
  Description of Artificial Sequence: Synthetic oligonucleotide
  Target: ATXN1; (-) strand; PAM type: YTN; PAM sequence: TTG
agagatccttctaagaaaat

SEQ ID NO: 175446 - DNA, 20 bp, Artificial Sequence
  Description of Artificial Sequence: Synthetic oligonucleotide
  Target: ATXN1; (-) strand; PAM type: YTN; PAM sequence: CTA
tattgagagatccttctaag

SEQ ID NO: 175447 - DNA, 20 bp, Artificial Sequence
  Description of Artificial Sequence: Synthetic oligonucleotide
  Target: ATXN1; (-) strand; PAM type: YTN; PAM sequence: TTA
atctatattgagagatcctt

SEQ ID NO: 175448 - DNA, 20 bp, Artificial Sequence
  Description of Artificial Sequence: Synthetic oligonucleotide
  Target: ATXN1; (-) strand; PAM type: YTN; PAM sequence: TTT
aatctatattgagagatcct

SEQ ID NO: 175449 - DNA, 20 bp, Artificial Sequence
  Description of Artificial Sequence: Synthetic oligonucleotide
  Target: ATXN1; (-) strand; PAM type: YTN; PAM sequence: TTA
atttaatctatattgagaga

SEQ ID NO: 175450 - DNA, 20 bp, Artificial Sequence
  Description of Artificial Sequence: Synthetic oligonucleotide
  Target: ATXN1; (-) strand; PAM type: YTN; PAM sequence: TTA
cattaatttaatctatattg

SEQ ID NO: 175451 - DNA, 20 bp, Artificial Sequence
  Description of Artificial Sequence: Synthetic oligonucleotide
  Target: ATXN1; (-) strand; PAM type: YTN; PAM sequence: TTT
acattaatttaatctatatt

SEQ ID NO: 175452 - DNA, 20 bp, Artificial Sequence
  Description of Artificial Sequence: Synthetic oligonucleotide
  Target: ATXN1; (-) strand; PAM type: YTN; PAM sequence: TTT
tacattaatttaatctatat

SEQ ID NO: 175453 - DNA, 20 bp, Artificial Sequence
  Description of Artificial Sequence: Synthetic oligonucleotide
  Target: ATXN1; (-) strand; PAM type: YTN; PAM sequence: TTA
cattttacattaatttaatc

SEQ ID NO: 175454 - DNA, 20 bp, Artificial Sequence
  Description of Artificial Sequence: Synthetic oligonucleotide
  Target: ATXN1; (-) strand; PAM type: YTN; PAM sequence: TTT
acattttacattaatttaat

SEQ ID NO: 175455 - DNA, 20 bp, Artificial Sequence
  Description of Artificial Sequence: Synthetic oligonucleotide
  Target: ATXN1; (-) strand; PAM type: YTN; PAM sequence: TTT
tacattttacattaatttaa

SEQ ID NO: 175456 - DNA, 20 bp, Artificial Sequence
  Description of Artificial Sequence: Synthetic oligonucleotide
  Target: ATXN1; (-) strand; PAM type: YTN; PAM sequence: TTA
ggaggaagtcattttacatt

SEQ ID NO: 175457 - DNA, 20 bp, Artificial Sequence
  Description of Artificial Sequence: Synthetic oligonucleotide
  Target: ATXN1; (-) strand; PAM type: YTN; PAM sequence: TTT
aggaggaagtcattttacat

SEQ ID NO: 175458 - DNA, 20 bp, Artificial Sequence
  Description of Artificial Sequence: Synthetic oligonucleotide
  Target: ATXN1; (-) strand; PAM type: YTN; PAM sequence: TTT
taggaggaagtcattttaca

SEQ ID NO: 175459 - DNA, 20 bp, Artificial Sequence
  Description of Artificial Sequence: Synthetic oligonucleotide
  Target: ATXN1; (-) strand; PAM type: YTN; PAM sequence: TTT
ttaggaggaagtcattttac

SEQ ID NO: 175460 - DNA, 20 bp, Artificial Sequence
  Description of Artificial Sequence: Synthetic oligonucleotide
  Target: ATXN1; (-) strand; PAM type: YTN; PAM sequence: TTT
tttaggaggaagtcatttta

SEQ ID NO: 175461 - DNA, 20 bp, Artificial Sequence
  Description of Artificial Sequence: Synthetic oligonucleotide
  Target: ATXN1; (-) strand; PAM type: YTN; PAM sequence: TTA
gattttttaggaggaagtca

SEQ ID NO: 175462 - DNA, 20 bp, Artificial Sequence
  Description of Artificial Sequence: Synthetic oligonucleotide
  Target: ATXN1; (-) strand; PAM type: YTN; PAM sequence: TTT
agattttttaggaggaagtc

SEQ ID NO: 175463 - DNA, 20 bp, Artificial Sequence
  Description of Artificial Sequence: Synthetic oligonucleotide
  Target: ATXN1; (-) strand; PAM type: YTN; PAM sequence: CTA
atttagattttttaggagga

SEQ ID NO: 175464 - DNA, 20 bp, Artificial Sequence
  Description of Artificial Sequence: Synthetic oligonucleotide
  Target: ATXN1; (-) strand; PAM type: YTN; PAM sequence: CTC
taatttagattttttaggag

SEQ ID NO: 175465 - DNA, 20 bp, Artificial Sequence
  Description of Artificial Sequence: Synthetic oligonucleotide
  Target: ATXN1; (-) strand; PAM type: YTN; PAM sequence: CTC
tctaatttagattttttagg

SEQ ID NO: 175466 - DNA, 20 bp, Artificial Sequence
  Description of Artificial Sequence: Synthetic oligonucleotide
  Target: ATXN1; (-) strand; PAM type: YTN; PAM sequence: TTG
agccaataaaatctctctaa

SEQ ID NO: 175467 - DNA, 20 bp, Artificial Sequence
  Description of Artificial Sequence: Synthetic oligonucleotide
  Target: ATXN1; (-) strand; PAM type: YTN; PAM sequence: TTA
ttgagccaataaaatctctc

SEQ ID NO: 175468 - DNA, 20 bp, Artificial Sequence
  Description of Artificial Sequence: Synthetic oligonucleotide
  Target: ATXN1; (-) strand; PAM type: YTN; PAM sequence: TTA
attattgagccaataaaatc

SEQ ID NO: 175469 - DNA, 20 bp, Artificial Sequence
  Description of Artificial Sequence: Synthetic oligonucleotide
  Target: ATXN1; (-) strand; PAM type: YTN; PAM sequence: CTG
taaaaggccacagggataga

SEQ ID NO: 175470 - DNA, 20 bp, Artificial Sequence
  Description of Artificial Sequence: Synthetic oligonucleotide
  Target: ATXN1; (-) strand; PAM type: YTN; PAM sequence: TTG
tctgtaaaaggccacaggga

SEQ ID NO: 175471 - DNA, 20 bp, Artificial Sequence
  Description of Artificial Sequence: Synthetic oligonucleotide
  Target: ATXN1; (-) strand; PAM type: YTN; PAM sequence: TTT
gtctgtaaaaggccacaggg

SEQ ID NO: 175472 - DNA, 20 bp, Artificial Sequence
  Description of Artificial Sequence: Synthetic oligonucleotide
  Target: ATXN1; (-) strand; PAM type: YTN; PAM sequence: CTT
tgtctgtaaaaggccacagg

SEQ ID NO: 175473 - DNA, 20 bp, Artificial Sequence
  Description of Artificial Sequence: Synthetic oligonucleotide
  Target: ATXN1; (-) strand; PAM type: YTN; PAM sequence: TTA
tagcaaaagctttgtctgta

SEQ ID NO: 175474 - DNA, 20 bp, Artificial Sequence
  Description of Artificial Sequence: Synthetic oligonucleotide
  Target: ATXN1; (-) strand; PAM type: YTN; PAM sequence: CTC
catggttatagcaaaagctt

SEQ ID NO: 175475 - DNA, 20 bp, Artificial Sequence
  Description of Artificial Sequence: Synthetic oligonucleotide
  Target: ATXN1; (-) strand; PAM type: YTN; PAM sequence: TTG
tgtgctccatggttatagca

SEQ ID NO: 175476 - DNA, 20 bp, Artificial Sequence
  Description of Artificial Sequence: Synthetic oligonucleotide
  Target: ATXN1; (-) strand; PAM type: YTN; PAM sequence: CTA
ttgtgtgctccatggttata

SEQ ID NO: 175477 - DNA, 20 bp, Artificial Sequence
  Description of Artificial Sequence: Synthetic oligonucleotide
  Target: ATXN1; (-) strand; PAM type: YTN; PAM sequence: TTG
cactattgtgtgctccatgg

SEQ ID NO: 175478 - DNA, 20 bp, Artificial Sequence
  Description of Artificial Sequence: Synthetic oligonucleotide
  Target: ATXN1; (-) strand; PAM type: YTN; PAM sequence: TTT
gcactattgtgtgctccatg

SEQ ID NO: 175479 - DNA, 20 bp, Artificial Sequence
  Description of Artificial Sequence: Synthetic oligonucleotide
  Target: ATXN1; (-) strand; PAM type: YTN; PAM sequence: TTA
tagtttgcactattgtgtgc

SEQ ID NO: 175480 - DNA, 20 bp, Artificial Sequence
  Description of Artificial Sequence: Synthetic oligonucleotide
  Target: ATXN1; (-) strand; PAM type: YTN; PAM sequence: TTT
atagtttgcactattgtgtg

SEQ ID NO: 175481 - DNA, 20 bp, Artificial Sequence
  Description of Artificial Sequence: Synthetic oligonucleotide
  Target: ATXN1; (-) strand; PAM type: YTN; PAM sequence: TTT
tatagtttgcactattgtgt

SEQ ID NO: 175482 - DNA, 20 bp, Artificial Sequence
  Description of Artificial Sequence: Synthetic oligonucleotide
  Target: ATXN1; (-) strand; PAM type: YTN; PAM sequence: TTA
tattttatagtttgcactat

SEQ ID NO: 175483 - DNA, 20 bp, Artificial Sequence
  Description of Artificial Sequence: Synthetic oligonucleotide
  Target: ATXN1; (-) strand; PAM type: YTN; PAM sequence: CTT
atattttatagtttgcacta

SEQ ID NO: 175484 - DNA, 20 bp, Artificial Sequence
  Description of Artificial Sequence: Synthetic oligonucleotide
  Target: ATXN1; (-) strand; PAM type: YTN; PAM sequence: TTC
ttatattttatagtttgcac

SEQ ID NO: 175485 - DNA, 20 bp, Artificial Sequence
  Description of Artificial Sequence: Synthetic oligonucleotide
  Target: ATXN1; (-) strand; PAM type: YTN; PAM sequence: TTT
cttatattttatagtttgca

SEQ ID NO: 175486 - DNA, 20 bp, Artificial Sequence
  Description of Artificial Sequence: Synthetic oligonucleotide
  Target: ATXN1; (-) strand; PAM type: YTN; PAM sequence: CTT
tcttatattttatagtttgc

SEQ ID NO: 175487 - DNA, 20 bp, Artificial Sequence
  Description of Artificial Sequence: Synthetic oligonucleotide
  Target: ATXN1; (-) strand; PAM type: YTN; PAM sequence: TTG
tactttcttatattttatag

SEQ ID NO: 175488 - DNA, 20 bp, Artificial Sequence
  Description of Artificial Sequence: Synthetic oligonucleotide
  Target: ATXN1; (-) strand; PAM type: YTN; PAM sequence: CTG
taaggcaggtattgtacttt

SEQ ID NO: 175489 - DNA, 20 bp, Artificial Sequence
  Description of Artificial Sequence: Synthetic oligonucleotide
  Target: ATXN1; (-) strand; PAM type: YTN; PAM sequence: CTC
acaacagccctgtaaggcag

SEQ ID NO: 175490 - DNA, 20 bp, Artificial Sequence
  Description of Artificial Sequence: Synthetic oligonucleotide
  Target: ATXN1; (-) strand; PAM type: YTN; PAM sequence: TTA
ggtcctcacaacagccctgt

SEQ ID NO: 175491 - DNA, 20 bp, Artificial Sequence
  Description of Artificial Sequence: Synthetic oligonucleotide
  Target: ATXN1; (-) strand; PAM type: YTN; PAM sequence: CTG
attaggtcctcacaacagcc

SEQ ID NO: 175492 - DNA, 20 bp, Artificial Sequence
  Description of Artificial Sequence: Synthetic oligonucleotide
  Target: ATXN1; (-) strand; PAM type: YTN; PAM sequence: TTG
tctgattaggtcctcacaac

SEQ ID NO: 175493 - DNA, 20 bp, Artificial Sequence
  Description of Artificial Sequence: Synthetic oligonucleotide
  Target: ATXN1; (-) strand; PAM type: YTN; PAM sequence: TTC
atgcattgtctgattaggtc

SEQ ID NO: 175494 - DNA, 20 bp, Artificial Sequence
  Description of Artificial Sequence: Synthetic oligonucleotide
  Target: ATXN1; (-) strand; PAM type: YTN; PAM sequence: TTT
catgcattgtctgattaggt

SEQ ID NO: 175495 - DNA, 20 bp, Artificial Sequence
  Description of Artificial Sequence: Synthetic oligonucleotide
  Target: ATXN1; (-) strand; PAM type: YTN; PAM sequence: TTT
tcatgcattgtctgattagg

SEQ ID NO: 175496 - DNA, 20 bp, Artificial Sequence
  Description of Artificial Sequence: Synthetic oligonucleotide
  Target: ATXN1; (-) strand; PAM type: YTN; PAM sequence: CTT
ttcatgcattgtctgattag

SEQ ID NO: 175497 - DNA, 20 bp, Artificial Sequence
  Description of Artificial Sequence: Synthetic oligonucleotide
  Target: ATXN1; (-) strand; PAM type: YTN; PAM sequence: TTA
gtacttttcatgcattgtct

SEQ ID NO: 175498 - DNA, 20 bp, Artificial Sequence
  Description of Artificial Sequence: Synthetic oligonucleotide
  Target: ATXN1; (-) strand; PAM type: YTN; PAM sequence: CTT
agtacttttcatgcattgtc

SEQ ID NO: 175499 - DNA, 20 bp, Artificial Sequence
  Description of Artificial Sequence: Synthetic oligonucleotide
  Target: ATXN1; (-) strand; PAM type: YTN; PAM sequence: CTA
tacttagtacttttcatgca

SEQ ID NO: 175500 - DNA, 20 bp, Artificial Sequence
  Description of Artificial Sequence: Synthetic oligonucleotide
  Target: ATXN1; (-) strand; PAM type: YTN; PAM sequence: CTG
ggccagggactatacttagt

SEQ ID NO: 175501 - DNA, 20 bp, Artificial Sequence
  Description of Artificial Sequence: Synthetic oligonucleotide
  Target: ATXN1; (-) strand; PAM type: YTN; PAM sequence: TTA
atctgggccagggactatac

SEQ ID NO: 175502 - DNA, 20 bp, Artificial Sequence
  Description of Artificial Sequence: Synthetic oligonucleotide
  Target: ATXN1; (-) strand; PAM type: YTN; PAM sequence: CTT
aatctgggccagggactata

SEQ ID NO: 175503 - DNA, 20 bp, Artificial Sequence
  Description of Artificial Sequence: Synthetic oligonucleotide
  Target: ATXN1; (-) strand; PAM type: YTN; PAM sequence: TTA
tgaatacttaatctgggcca

SEQ ID NO: 175504 - DNA, 20 bp, Artificial Sequence
  Description of Artificial Sequence: Synthetic oligonucleotide
  Target: ATXN1; (-) strand; PAM type: YTN; PAM sequence: TTT
atgaatacttaatctgggcc

SEQ ID NO: 175505 - DNA, 20 bp, Artificial Sequence
  Description of Artificial Sequence: Synthetic oligonucleotide
  Target: ATXN1; (-) strand; PAM type: YTN; PAM sequence: TTG
atatttatgaatacttaatc

SEQ ID NO: 175506 - DNA, 20 bp, Artificial Sequence
  Description of Artificial Sequence: Synthetic oligonucleotide
  Target: ATXN1; (-) strand; PAM type: YTN; PAM sequence: TTA
cagttgatatttatgaatac

SEQ ID NO: 175507 - DNA, 20 bp, Artificial Sequence
  Description of Artificial Sequence: Synthetic oligonucleotide
  Target: ATXN1; (-) strand; PAM type: YTN; PAM sequence: TTA
tataaaaggaataataatta

SEQ ID NO: 175508 - DNA, 20 bp, Artificial Sequence
  Description of Artificial Sequence: Synthetic oligonucleotide
  Target: ATXN1; (-) strand; PAM type: YTN; PAM sequence: TTT
atataaaaggaataataatt

SEQ ID NO: 175509 - DNA, 20 bp, Artificial Sequence
  Description of Artificial Sequence: Synthetic oligonucleotide
  Target: ATXN1; (-) strand; PAM type: YTN; PAM sequence: CTA
tgaaataaaagtttatataa

SEQ ID NO: 175510 - DNA, 20 bp, Artificial Sequence
  Description of Artificial Sequence: Synthetic oligonucleotide
  Target: ATXN1; (-) strand; PAM type: YTN; PAM sequence: CTC
cctatgaaataaaagtttat

SEQ ID NO: 175511 - DNA, 20 bp, Artificial Sequence
  Description of Artificial Sequence: Synthetic oligonucleotide
  Target: ATXN1; (-) strand; PAM type: YTN; PAM sequence: TTA
ggaaacatctccctatgaaa

SEQ ID NO: 175512 - DNA, 20 bp, Artificial Sequence
  Description of Artificial Sequence: Synthetic oligonucleotide
  Target: ATXN1; (-) strand; PAM type: YTN; PAM sequence: TTT
aggaaacatctccctatgaa

SEQ ID NO: 175513 - DNA, 20 bp, Artificial Sequence
  Description of Artificial Sequence: Synthetic oligonucleotide
  Target: ATXN1; (-) strand; PAM type: YTN; PAM sequence: CTT
taggaaacatctccctatga

SEQ ID NO: 175514 - DNA, 20 bp, Artificial Sequence
  Description of Artificial Sequence: Synthetic oligonucleotide
  Target: ATXN1; (-) strand; PAM type: YTN; PAM sequence: TTC
tttaggaaacatctccctat

SEQ ID NO: 175515 - DNA, 20 bp, Artificial Sequence
  Description of Artificial Sequence: Synthetic oligonucleotide
  Target: ATXN1; (-) strand; PAM type: YTN; PAM sequence: TTT
ctttaggaaacatctcccta

SEQ ID NO: 175516 - DNA, 20 bp, Artificial Sequence
  Description of Artificial Sequence: Synthetic oligonucleotide
  Target: ATXN1; (-) strand; PAM type: YTN; PAM sequence: TTA
gggtgtacgagcaagatgag

SEQ ID NO: 175517 - DNA, 20 bp, Artificial Sequence
  Description of Artificial Sequence: Synthetic oligonucleotide
  Target: ATXN1; (-) strand; PAM type: YTN; PAM sequence: TTT
agggtgtacgagcaagatga

SEQ ID NO: 175518 - DNA, 20 bp, Artificial Sequence
  Description of Artificial Sequence: Synthetic oligonucleotide
  Target: ATXN1; (-) strand; PAM type: YTN; PAM sequence: TTA
aacgtttagggtgtacgagc

SEQ ID NO: 175519 - DNA, 20 bp, Artificial Sequence
  Description of Artificial Sequence: Synthetic oligonucleotide
  Target: ATXN1; (-) strand; PAM type: YTN; PAM sequence: TTT
aaacgtttagggtgtacgag

SEQ ID NO: 175520 - DNA, 20 bp, Artificial Sequence
  Description of Artificial Sequence: Synthetic oligonucleotide
  Target: ATXN1; (-) strand; PAM type: YTN; PAM sequence: TTT
taaacgtttagggtgtacga

SEQ ID NO: 175521 - DNA, 20 bp, Artificial Sequence
  Description of Artificial Sequence: Synthetic oligonucleotide
  Target: ATXN1; (-) strand; PAM type: YTN; PAM sequence: TTA
ttttaaacgtttagggtgta

SEQ ID NO: 175522 - DNA, 20 bp, Artificial Sequence
  Description of Artificial Sequence: Synthetic oligonucleotide
  Target: ATXN1; (-) strand; PAM type: YTN; PAM sequence: TTG
gatacagtgagattatttta

SEQ ID NO: 175523 - DNA, 20 bp, Artificial Sequence
  Description of Artificial Sequence: Synthetic oligonucleotide
  Target: ATXN1; (-) strand; PAM type: YTN; PAM sequence: TTC
agaggggtcagaggtattgg

SEQ ID NO: 175524 - DNA, 20 bp, Artificial Sequence
  Description of Artificial Sequence: Synthetic oligonucleotide
  Target: ATXN1; (-) strand; PAM type: YTN; PAM sequence: CTA
agcggtgaaaatgtgatggg

SEQ ID NO: 175525 - DNA, 20 bp, Artificial Sequence
  Description of Artificial Sequence: Synthetic oligonucleotide
  Target: ATXN1; (-) strand; PAM type: YTN; PAM sequence: CTG
taacacagtgaggaagagat

SEQ ID NO: 175526 - DNA, 20 bp, Artificial Sequence
  Description of Artificial Sequence: Synthetic oligonucleotide
  Target: ATXN1; (-) strand; PAM type: YTN; PAM sequence: CTC
ggctgtaacacagtgaggaa

SEQ ID NO: 175527 - DNA, 20 bp, Artificial Sequence
  Description of Artificial Sequence: Synthetic oligonucleotide
  Target: ATXN1; (-) strand; PAM type: YTN; PAM sequence: TTC
cagtgtgtaccagctcggct

SEQ ID NO: 175528 - DNA, 20 bp, Artificial Sequence
  Description of Artificial Sequence: Synthetic oligonucleotide
  Target: ATXN1; (-) strand; PAM type: YTN; PAM sequence: TTC
aggaattccagtgtgtacca

SEQ ID NO: 175529 - DNA, 20 bp, Artificial Sequence
  Description of Artificial Sequence: Synthetic oligonucleotide
  Target: ATXN1; (-) strand; PAM type: YTN; PAM sequence: CTA
gaggaattcaggaattccag

SEQ ID NO: 175530 - DNA, 20 bp, Artificial Sequence
  Description of Artificial Sequence: Synthetic oligonucleotide
  Target: ATXN1; (-) strand; PAM type: YTN; PAM sequence: CTA
ctagaggaattcaggaattc

SEQ ID NO: 175531 - DNA, 20 bp, Artificial Sequence
  Description of Artificial Sequence: Synthetic oligonucleotide
  Target: ATXN1; (-) strand; PAM type: YTN; PAM sequence: CTA
aaggcctactagaggaattc

SEQ ID NO: 175532 - DNA, 20 bp, Artificial Sequence
  Description of Artificial Sequence: Synthetic oligonucleotide
  Target: ATXN1; (-) strand; PAM type: YTN; PAM sequence: TTA
tggaaactaaaggcctacta

SEQ ID NO: 175533 - DNA, 20 bp, Artificial Sequence
  Description of Artificial Sequence: Synthetic oligonucleotide
  Target: ATXN1; (-) strand; PAM type: YTN; PAM sequence: TTT
atggaaactaaaggcctact

SEQ ID NO: 175534 - DNA, 20 bp, Artificial Sequence
  Description of Artificial Sequence: Synthetic oligonucleotide
  Target: ATXN1; (-) strand; PAM type: YTN; PAM sequence: CTT
tatggaaactaaaggcctac

SEQ ID NO: 175535 - DNA, 20 bp, Artificial Sequence
  Description of Artificial Sequence: Synthetic oligonucleotide
  Target: ATXN1; (-) strand; PAM type: YTN; PAM sequence: CTG
ctttatggaaactaaaggcc

SEQ ID NO: 175536 - DNA, 20 bp, Artificial Sequence
  Description of Artificial Sequence: Synthetic oligonucleotide
  Target: ATXN1; (-) strand; PAM type: YTN; PAM sequence: TTC
tgctttatggaaactaaagg

SEQ ID NO: 175537 - DNA, 20 bp, Artificial Sequence
  Description of Artificial Sequence: Synthetic oligonucleotide
  Target: ATXN1; (-) strand; PAM type: YTN; PAM sequence: TTT
ctgctttatggaaactaaag

SEQ ID NO: 175538 - DNA, 20 bp, Artificial Sequence
  Description of Artificial Sequence: Synthetic oligonucleotide
  Target: ATXN1; (-) strand; PAM type: YTN; PAM sequence: CTG
agtatgcaatgatacacggt

SEQ ID NO: 175539 - DNA, 20 bp, Artificial Sequence
  Description of Artificial Sequence: Synthetic oligonucleotide
  Target: ATXN1; (-) strand; PAM type: YTN; PAM sequence: CTA
ctgagtatgcaatgatacac

SEQ ID NO: 175540 - DNA, 20 bp, Artificial Sequence
  Description of Artificial Sequence: Synthetic oligonucleotide
  Target: ATXN1; (-) strand; PAM type: YTN; PAM sequence: TTC
tactgagtatgcaatgatac

SEQ ID NO: 175541 - DNA, 20 bp, Artificial Sequence
  Description of Artificial Sequence: Synthetic oligonucleotide
  Target: ATXN1; (-) strand; PAM type: YTN; PAM sequence: CTA
caccatgcaagataaaagcc

SEQ ID NO: 175542 - DNA, 20 bp, Artificial Sequence
  Description of Artificial Sequence: Synthetic oligonucleotide
  Target: ATXN1; (-) strand; PAM type: YTN; PAM sequence: TTA
aaagcctacaccatgcaaga

SEQ ID NO: 175543 - DNA, 20 bp, Artificial Sequence
  Description of Artificial Sequence: Synthetic oligonucleotide
  Target: ATXN1; (-) strand; PAM type: YTN; PAM sequence: TTA
ttaaaagcctacaccatgca

SEQ ID NO: 175544 - DNA, 20 bp, Artificial Sequence
  Description of Artificial Sequence: Synthetic oligonucleotide
  Target: ATXN1; (-) strand; PAM type: YTN; PAM sequence: CTT
attaaaagcctacaccatgc

SEQ ID NO: 175545 - DNA, 20 bp, Artificial Sequence
  Description of Artificial Sequence: Synthetic oligonucleotide
  Target: ATXN1; (-) strand; PAM type: YTN; PAM sequence: TTC
aataaatacttattaaaagc

SEQ ID NO: 175546 - DNA, 20 bp, Artificial Sequence
  Description of Artificial Sequence: Synthetic oligonucleotide
  Target: ATXN1; (-) strand; PAM type: YTN; PAM sequence: TTC
atgtatccattcaataaata

SEQ ID NO: 175547 - DNA, 20 bp, Artificial Sequence
  Description of Artificial Sequence: Synthetic oligonucleotide
  Target: ATXN1; (-) strand; PAM type: YTN; PAM sequence: CTT
catgtatccattcaataaat

SEQ ID NO: 175548 - DNA, 20 bp, Artificial Sequence
  Description of Artificial Sequence: Synthetic oligonucleotide
  Target: ATXN1; (-) strand; PAM type: YTN; PAM sequence: CTC
atatcttcatgtatccattc

SEQ ID NO: 175549 - DNA, 20 bp, Artificial Sequence
  Description of Artificial Sequence: Synthetic oligonucleotide
  Target: ATXN1; (-) strand; PAM type: YTN; PAM sequence: TTC
actcatatcttcatgtatcc

SEQ ID NO: 175550 - DNA, 20 bp, Artificial Sequence
  Description of Artificial Sequence: Synthetic oligonucleotide
  Target: ATXN1; (-) strand; PAM type: YTN; PAM sequence: TTA
ttcactcatatcttcatgta

SEQ ID NO: 175551 - DNA, 20 bp, Artificial Sequence
  Description of Artificial Sequence: Synthetic oligonucleotide
  Target: ATXN1; (-) strand; PAM type: YTN; PAM sequence: TTC
cattattcactcatatcttc

SEQ ID NO: 175552 - DNA, 20 bp, Artificial Sequence
  Description of Artificial Sequence: Synthetic oligonucleotide
  Target: ATXN1; (-) strand; PAM type: YTN; PAM sequence: TTA
ttccattattcactcatatc

SEQ ID NO: 175553 - DNA, 20 bp, Artificial Sequence
  Description of Artificial Sequence: Synthetic oligonucleotide
  Target: ATXN1; (-) strand; PAM type: YTN; PAM sequence: TTT
attccattattcactcatat

SEQ ID NO: 175554 - DNA, 20 bp, Artificial Sequence
  Description of Artificial Sequence: Synthetic oligonucleotide
  Target: ATXN1; (-) strand; PAM type: YTN; PAM sequence: TTG
agccccaggatttattccat

SEQ ID NO: 175555 - DNA, 20 bp, Artificial Sequence
  Description of Artificial Sequence: Synthetic oligonucleotide
  Target: ATXN1; (-) strand; PAM type: YTN; PAM sequence: CTG
ttgagccccaggatttattc

SEQ ID NO: 175556 - DNA, 20 bp, Artificial Sequence
  Description of Artificial Sequence: Synthetic oligonucleotide
  Target: ATXN1; (-) strand; PAM type: YTN; PAM sequence: TTA
ggtgcctgttgagccccagg

SEQ ID NO: 175557 - DNA, 20 bp, Artificial Sequence
  Description of Artificial Sequence: Synthetic oligonucleotide
  Target: ATXN1; (-) strand; PAM type: YTN; PAM sequence: TTG
tagggttaggtgcctgttga

SEQ ID NO: 175558 - DNA, 20 bp, Artificial Sequence
  Description of Artificial Sequence: Synthetic oligonucleotide
  Target: ATXN1; (-) strand; PAM type: YTN; PAM sequence: TTA
gaaatattgtagggttaggt

SEQ ID NO: 175559 - DNA, 20 bp, Artificial Sequence
  Description of Artificial Sequence: Synthetic oligonucleotide
  Target: ATXN1; (-) strand; PAM type: YTN; PAM sequence: TTG
acaaaacattagaaatattg

SEQ ID NO: 175560 - DNA, 20 bp, Artificial Sequence
  Description of Artificial Sequence: Synthetic oligonucleotide
  Target: ATXN1; (-) strand; PAM type: YTN; PAM sequence: TTA
ggggaagttgacaaaacatt

SEQ ID NO: 175561 - DNA, 20 bp, Artificial Sequence
  Description of Artificial Sequence: Synthetic oligonucleotide
  Target: ATXN1; (-) strand; PAM type: YTN; PAM sequence: CTT
aggggaagttgacaaaacat

SEQ ID NO: 175562 - DNA, 20 bp, Artificial Sequence
  Description of Artificial Sequence: Synthetic oligonucleotide
  Target: ATXN1; (-) strand; PAM type: YTN; PAM sequence: CTA
aaaaataaataaaataatat

SEQ ID NO: 175563 - DNA, 20 bp, Artificial Sequence
  Description of Artificial Sequence: Synthetic oligonucleotide
  Target: ATXN1; (-) strand; PAM type: YTN; PAM sequence: CTC
taaaaaataaataaaataat

SEQ ID NO: 175564 - DNA, 20 bp, Artificial Sequence
  Description of Artificial Sequence: Synthetic oligonucleotide
  Target: ATXN1; (-) strand; PAM type: YTN; PAM sequence: CTC
atctctaaaaaataaataaa

SEQ ID NO: 175565 - DNA, 20 bp, Artificial Sequence
  Description of Artificial Sequence: Synthetic oligonucleotide
  Target: ATXN1; (-) strand; PAM type: YTN; PAM sequence: CTC
ggcaacagagcaaaacctca

SEQ ID NO: 175566 - DNA, 20 bp, Artificial Sequence
  Description of Artificial Sequence: Synthetic oligonucleotide
  Target: ATXN1; (-) strand; PAM type: YTN; PAM sequence: CTC
cagcctcggcaacagagcaa

SEQ ID NO: 175567 - DNA, 20 bp, Artificial Sequence
  Description of Artificial Sequence: Synthetic oligonucleotide
  Target: ATXN1; (-) strand; PAM type: YTN; PAM sequence: CTG
ccctccagcctcggcaacag

SEQ ID NO: 175568 - DNA, 20 bp, Artificial Sequence
  Description of Artificial Sequence: Synthetic oligonucleotide
  Target: ATXN1; (-) strand; PAM type: YTN; PAM sequence: TTA
caccactgccctccagcctc

SEQ ID NO: 175569 - DNA, 20 bp, Artificial Sequence
  Description of Artificial Sequence: Synthetic oligonucleotide
  Target: ATXN1; (-) strand; PAM type: YTN; PAM sequence: CTA
tgattacaccactgccctcc

SEQ ID NO: 175570 - DNA, 20 bp, Artificial Sequence
  Description of Artificial Sequence: Synthetic oligonucleotide
  Target: ATXN1; (-) strand; PAM type: YTN; PAM sequence: CTG
cagtgatctatgattacacc

SEQ ID NO: 175571 - DNA, 20 bp, Artificial Sequence
  Description of Artificial Sequence: Synthetic oligonucleotide
  Target: ATXN1; (-) strand; PAM type: YTN; PAM sequence: TTC
aaggctgcagtgatctatga

SEQ ID NO: 175572 - DNA, 20 bp, Artificial Sequence
  Description of Artificial Sequence: Synthetic oligonucleotide
  Target: ATXN1; (-) strand; PAM type: YTN; PAM sequence: TTG
agcccagcagttcaaggctg

SEQ ID NO: 175573 - DNA, 20 bp, Artificial Sequence
  Description of Artificial Sequence: Synthetic oligonucleotide
  Target: ATXN1; (-) strand; PAM type: YTN; PAM sequence: CTT
gagcccagcagttcaaggct

SEQ ID NO: 175574 - DNA, 20 bp, Artificial Sequence
  Description of Artificial Sequence: Synthetic oligonucleotide
  Target: ATXN1; (-) strand; PAM type: YTN; PAM sequence: CTG
aggtgggagaatcacttgag

SEQ ID NO: 175575 - DNA, 20 bp, Artificial Sequence
  Description of Artificial Sequence: Synthetic oligonucleotide
  Target: ATXN1; (-) strand; PAM type: YTN; PAM sequence: CTG
gggaagctgaggtgggagaa

SEQ ID NO: 175576 - DNA, 20 bp, Artificial Sequence
  Description of Artificial Sequence: Synthetic oligonucleotide
  Target: ATXN1; (-) strand; PAM type: YTN; PAM sequence: CTG
tagtcccaggtactggggaa

SEQ ID NO: 175577 - DNA, 20 bp, Artificial Sequence
  Description of Artificial Sequence: Synthetic oligonucleotide
  Target: ATXN1; (-) strand; PAM type: YTN; PAM sequence: CTA
gcatggtgatgcatacctgt

SEQ ID NO: 175578 - DNA, 20 bp, Artificial Sequence
  Description of Artificial Sequence: Synthetic oligonucleotide
  Target: ATXN1; (-) strand; PAM type: YTN; PAM sequence: TTA
agtagcctagcatggtgatg

SEQ ID NO: 175579 - DNA, 20 bp, Artificial Sequence
  Description of Artificial Sequence: Synthetic oligonucleotide
  Target: ATXN1; (-) strand; PAM type: YTN; PAM sequence: TTT
aagtagcctagcatggtgat

SEQ ID NO: 175580 - DNA, 20 bp, Artificial Sequence
  Description of Artificial Sequence: Synthetic oligonucleotide
  Target: ATXN1; (-) strand; PAM type: YTN; PAM sequence: TTT
taagtagcctagcatggtga

SEQ ID NO: 175581 - DNA, 20 bp, Artificial Sequence
  Description of Artificial Sequence: Synthetic oligonucleotide
  Target: ATXN1; (-) strand; PAM type: YTN; PAM sequence: TTT
ttaagtagcctagcatggtg

SEQ ID NO: 175582 - DNA, 20 bp, Artificial Sequence
  Description of Artificial Sequence: Synthetic oligonucleotide
  Target: ATXN1; (-) strand; PAM type: YTN; PAM sequence: TTT
tttaagtagcctagcatggt

SEQ ID NO: 175583 - DNA, 20 bp, Artificial Sequence
  Description of Artificial Sequence: Synthetic oligonucleotide
  Target: ATXN1; (-) strand; PAM type: YTN; PAM sequence: TTT
ttttaagtagcctagcatgg

SEQ ID NO: 175584 - DNA, 20 bp, Artificial Sequence
  Description of Artificial Sequence: Synthetic oligonucleotide
  Target: ATXN1; (-) strand; PAM type: YTN; PAM sequence: TTT
tttttaagtagcctagcatg

SEQ ID NO: 175585 - DNA, 20 bp, Artificial Sequence
  Description of Artificial Sequence: Synthetic oligonucleotide
  Target: ATXN1; (-) strand; PAM type: YTN; PAM sequence: TTT
ttttttaagtagcctagcat

SEQ ID NO: 175586 - DNA, 20 bp, Artificial Sequence
  Description of Artificial Sequence: Synthetic oligonucleotide
  Target: ATXN1; (-) strand; PAM type: YTN; PAM sequence: CTC
aaaagaaaatttttttttaa

SEQ ID NO: 175587 - DNA, 20 bp, Artificial Sequence
  Description of Artificial Sequence: Synthetic oligonucleotide
  Target: ATXN1; (-) strand; PAM type: YTN; PAM sequence: CTG
tctcaaaagaaaattttttt

SEQ ID NO: 175588 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagtgagaccctg

SEQ ID NO: 175589 - DNA, 20 bp, Artificial Sequence
  Description of Artificial Sequence: Synthetic oligonucleotide
  Target: ATXN1; (-) strand; PAM type: YTN; PAM sequence: TTA
aagaccagcctgggcaacat

SEQ ID NO: 175590 - DNA, 20 bp, Artificial Sequence
  Description of Artificial Sequence: Synthetic oligonucleotide
  Target: ATXN1; (-) strand; PAM type: YTN; PAM sequence: CTA
aggtcagaagttaaagacca

SEQ ID NO: 175591 - DNA, 20 bp, Artificial Sequence
  Description of Artificial Sequence: Synthetic oligonucleotide
  Target: ATXN1; (-) strand; PAM type: YTN; PAM sequence: TTG
cctaaggtcagaagttaaag

SEQ ID NO: 175592 - DNA, 20 bp, Artificial Sequence
  Description of Artificial Sequence: Synthetic oligonucleotide
  Target: ATXN1; (-) strand; PAM type: YTN; PAM sequence: CTG
aggcaggaggattgcctaag

SEQ ID NO: 175593 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggaggat

SEQ ID NO: 175594 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagga

SEQ ID NO: 175595 - DNA, 20 bp, Artificial Sequence
  Description of Artificial Sequence: Synthetic oligonucleotide
  Target: ATXN1; (-) strand; PAM type: YTN; PAM sequence: CTG
taatcccagtgacttgggag

SEQ ID NO: 175596 - DNA, 20 bp, Artificial Sequence
  Description of Artificial Sequence: Synthetic oligonucleotide
  Target: ATXN1; (-) strand; PAM type: YTN; PAM sequence: TTG
cgcctgtaatcccagtgact

SEQ ID NO: 175597 - DNA, 20 bp, Artificial Sequence
  Description of Artificial Sequence: Synthetic oligonucleotide
  Target: ATXN1; (-) strand; PAM type: YTN; PAM sequence: CTT
gcgcctgtaatcccagtgac

SEQ ID NO: 175598 - DNA, 20 bp, Artificial Sequence
  Description of Artificial Sequence: Synthetic oligonucleotide
  Target: ATXN1; (-) strand; PAM type: YTN; PAM sequence: TTG
gtgtggtggcttgcgcctgt

SEQ ID NO: 175599 - DNA, 20 bp, Artificial Sequence
  Description of Artificial Sequence: Synthetic oligonucleotide
  Target: ATXN1; (-) strand; PAM type: YTN; PAM sequence: CTT
ggtgtggtggcttgcgcctg

SEQ ID NO: 175600 - DNA, 20 bp, Artificial Sequence
  Description of Artificial Sequence: Synthetic oligonucleotide
  Target: ATXN1; (-) strand; PAM type: YTN; PAM sequence: TTG
ggcttggtgtggtggcttgc

SEQ ID NO: 175601 - DNA, 20 bp, Artificial Sequence
  Description of Artificial Sequence: Synthetic oligonucleotide
  Target: ATXN1; (-) strand; PAM type: YTN; PAM sequence: TTG
attgggcttggtgtggtggc

SEQ ID NO: 175602 - DNA, 20 bp, Artificial Sequence
  Description of Artificial Sequence: Synthetic oligonucleotide
  Target: ATXN1; (-) strand; PAM type: YTN; PAM sequence: TTA
ttgattgggcttggtgtggt

SEQ ID NO: 175603 - DNA, 20 bp, Artificial Sequence
  Description of Artificial Sequence: Synthetic oligonucleotide
  Target: ATXN1; (-) strand; PAM type: YTN; PAM sequence: TTA
ttattgattgggcttggtgt

SEQ ID NO: 175604 - DNA, 20 bp, Artificial Sequence
  Description of Artificial Sequence: Synthetic oligonucleotide
  Target: ATXN1; (-) strand; PAM type: YTN; PAM sequence: TTG
gaaattattattgattgggc

SEQ ID NO: 175605 - DNA, 20 bp, Artificial Sequence
  Description of Artificial Sequence: Synthetic oligonucleotide
  Target: ATXN1; (-) strand; PAM type: YTN; PAM sequence: CTT
ggaaattattattgattggg

SEQ ID NO: 175606 - DNA, 20 bp, Artificial Sequence
  Description of Artificial Sequence: Synthetic oligonucleotide
  Target: ATXN1; (-) strand; PAM type: YTN; PAM sequence: TTA
aaagccataacttggaaatt

SEQ ID NO: 175607 - DNA, 20 bp, Artificial Sequence
  Description of Artificial Sequence: Synthetic oligonucleotide
  Target: ATXN1; (-) strand; PAM type: YTN; PAM sequence: TTC
cattaaaagccataacttgg

SEQ ID NO: 175608 - DNA, 20 bp, Artificial Sequence
  Description of Artificial Sequence: Synthetic oligonucleotide
  Target: ATXN1; (-) strand; PAM type: YTN; PAM sequence: TTT
ccattaaaagccataacttg

SEQ ID NO: 175609 - DNA, 20 bp, Artificial Sequence
  Description of Artificial Sequence: Synthetic oligonucleotide
  Target: ATXN1; (-) strand; PAM type: YTN; PAM sequence: CTT
tccattaaaagccataactt

SEQ ID NO: 175610 - DNA, 20 bp, Artificial Sequence
  Description of Artificial Sequence: Synthetic oligonucleotide
  Target: ATXN1; (-) strand; PAM type: YTN; PAM sequence: CTG
ctttccattaaaagccataa

SEQ ID NO: 175611 - DNA, 20 bp, Artificial Sequence
  Description of Artificial Sequence: Synthetic oligonucleotide
  Target: ATXN1; (-) strand; PAM type: YTN; PAM sequence: TTC
tgctttccattaaaagccat

SEQ ID NO: 175612 - DNA, 20 bp, Artificial Sequence
  Description of Artificial Sequence: Synthetic oligonucleotide
  Target: ATXN1; (-) strand; PAM type: YTN; PAM sequence: TTA
ttctgctttccattaaaagc

SEQ ID NO: 175613 - DNA, 20 bp, Artificial Sequence
  Description of Artificial Sequence: Synthetic oligonucleotide
  Target: ATXN1; (-) strand; PAM type: YTN; PAM sequence: CTT
attctgctttccattaaaag

SEQ ID NO: 175614 - DNA, 20 bp, Artificial Sequence
  Description of Artificial Sequence: Synthetic oligonucleotide
  Target: ATXN1; (-) strand; PAM type: YTN; PAM sequence: TTC
ttattctgctttccattaaa

SEQ ID NO: 175615 - DNA, 20 bp, Artificial Sequence
  Description of Artificial Sequence: Synthetic oligonucleotide
  Target: ATXN1; (-) strand; PAM type: YTN; PAM sequence: TTT
cttattctgctttccattaa

SEQ ID NO: 175616 - DNA, 20 bp, Artificial Sequence
  Description of Artificial Sequence: Synthetic oligonucleotide
  Target: ATXN1; (-) strand; PAM type: YTN; PAM sequence: CTT
tcttattctgctttccatta

SEQ ID NO: 175617 - DNA, 20 bp, Artificial Sequence
  Description of Artificial Sequence: Synthetic oligonucleotide
  Target: ATXN1; (-) strand; PAM type: YTN; PAM sequence: TTG
atgaagtagacatcaggaaa

SEQ ID NO: 175618 - DNA, 20 bp, Artificial Sequence
  Description of Artificial Sequence: Synthetic oligonucleotide
  Target: ATXN1; (-) strand; PAM type: YTN; PAM sequence: CTT
gatgaagtagacatcaggaa

SEQ ID NO: 175619 - DNA, 20 bp, Artificial Sequence
  Description of Artificial Sequence: Synthetic oligonucleotide
  Target: ATXN1; (-) strand; PAM type: YTN; PAM sequence: CTA
cttgatgaagtagacatcag

SEQ ID NO: 175620 - DNA, 20 bp, Artificial Sequence
  Description of Artificial Sequence: Synthetic oligonucleotide
  Target: ATXN1; (-) strand; PAM type: YTN; PAM sequence: CTC
tacttgatgaagtagacatc

SEQ ID NO: 175621 - DNA, 20 bp, Artificial Sequence
  Description of Artificial Sequence: Synthetic oligonucleotide
  Target: ATXN1; (-) strand; PAM type: YTN; PAM sequence: CTC
tctacttgatgaagtagaca

SEQ ID NO: 175622 - DNA, 20 bp, Artificial Sequence
  Description of Artificial Sequence: Synthetic oligonucleotide
  Target: ATXN1; (-) strand; PAM type: YTN; PAM sequence: CTC
tctctacttgatgaagtaga

SEQ ID NO: 175623 - DNA, 20 bp, Artificial Sequence
  Description of Artificial Sequence: Synthetic oligonucleotide
  Target: ATXN1; (-) strand; PAM type: YTN; PAM sequence: CTC
cctctctctacttgatgaag

SEQ ID NO: 175624 - DNA, 20 bp, Artificial Sequence
  Description of Artificial Sequence: Synthetic oligonucleotide
  Target: ATXN1; (-) strand; PAM type: YTN; PAM sequence: TTG
taactccctctctctacttg

SEQ ID NO: 175625 - DNA, 20 bp, Artificial Sequence
  Description of Artificial Sequence: Synthetic oligonucleotide
  Target: ATXN1; (-) strand; PAM type: YTN; PAM sequence: CTT
gtaactccctctctctactt

SEQ ID NO: 175626 - DNA, 20 bp, Artificial Sequence
  Description of Artificial Sequence: Synthetic oligonucleotide
  Target: ATXN1; (-) strand; PAM type: YTN; PAM sequence: CTC
aagaaaaaaaaaaaataaga

SEQ ID NO: 175627 - DNA, 20 bp, Artificial Sequence
  Description of Artificial Sequence: Synthetic oligonucleotide
  Target: ATXN1; (-) strand; PAM type: YTN; PAM sequence: CTC
cgtctcaagaaaaaaaaaaa

SEQ ID NO: 175628 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcaagactccg

SEQ ID NO: 175629 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagcaa

SEQ ID NO: 175630 - DNA, 20 bp, Artificial Sequence
  Description of Artificial Sequence: Synthetic oligonucleotide
  Target: ATXN1; (-) strand; PAM type: YTN; PAM sequence: CTC
tccagcctgggtgacagagc

SEQ ID NO: 175631 - DNA, 20 bp, Artificial Sequence
  Description of Artificial Sequence: Synthetic oligonucleotide
  Target: ATXN1; (-) strand; PAM type: YTN; PAM sequence: CTG
ctctccagcctgggtgacag

SEQ ID NO: 175632 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcgtgcc

SEQ ID NO: 175633 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccgagatcgtgc

SEQ ID NO: 175634 - DNA, 20 bp, Artificial Sequence
  Description of Artificial Sequence: Synthetic oligonucleotide
  Target: ATXN1; (-) strand; PAM type: YTN; PAM sequence: CTG
ggaggcggagcttgcagtga

SEQ ID NO: 175635 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcggagcttg

SEQ ID NO: 175636 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcggagctt

SEQ ID NO: 175637 - DNA, 20 bp, Artificial Sequence
  Description of Artificial Sequence: Synthetic oligonucleotide
  Target: ATXN1; (-) strand; PAM type: YTN; PAM sequence: CTG
aggcaggacaatcgcttgaa

SEQ ID NO: 175638 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggacaa

SEQ ID NO: 175639 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaggcagga

SEQ ID NO: 175640 - DNA, 20 bp, Artificial Sequence
  Description of Artificial Sequence: Synthetic oligonucleotide
  Target: ATXN1; (-) strand; PAM type: YTN; PAM sequence: CTA
gctactcgggaggctgaggc

SEQ ID NO: 175641 - DNA, 20 bp, Artificial Sequence
  Description of Artificial Sequence: Synthetic oligonucleotide
  Target: ATXN1; (-) strand; PAM type: YTN; PAM sequence: CTG
tagtcctagctactcgggag

SEQ ID NO: 175642 - DNA, 20 bp, Artificial Sequence
  Description of Artificial Sequence: Synthetic oligonucleotide
  Target: ATXN1; (-) strand; PAM type: YTN; PAM sequence: TTA
gccaggtatggtggtgggcg

SEQ ID NO: 175643 - DNA, 20 bp, Artificial Sequence
  Description of Artificial Sequence: Synthetic oligonucleotide
  Target: ATXN1; (-) strand; PAM type: YTN; PAM sequence: CTA
gtaaatatacaaaaaattag

SEQ ID NO: 175644 - DNA, 20 bp, Artificial Sequence
  Description of Artificial Sequence: Synthetic oligonucleotide
  Target: ATXN1; (-) strand; PAM type: YTN; PAM sequence: CTC
tagtaaatatacaaaaaatt

SEQ ID NO: 175645 - DNA, 20 bp, Artificial Sequence
  Description of Artificial Sequence: Synthetic oligonucleotide
  Target: ATXN1; (-) strand; PAM type: YTN; PAM sequence: CTA
atatggcgaaaccccgtctc

SEQ ID NO: 175646 - DNA, 20 bp, Artificial Sequence
  Description of Artificial Sequence: Synthetic oligonucleotide
  Target: ATXN1; (-) strand; PAM type: YTN; PAM sequence: CTG
gctaatatggcgaaaccccg

SEQ ID NO: 175647 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcagggggat

SEQ ID NO: 175648 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcaggggga

SEQ ID NO: 175649 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcaggggg

SEQ ID NO: 175650 - DNA, 20 bp, Artificial Sequence
  Description of Artificial Sequence: Synthetic oligonucleotide
  Target: ATXN1; (-) strand; PAM type: YTN; PAM sequence: CTA
tagtcccagcactttgggag

SEQ ID NO: 175651 - DNA, 20 bp, Artificial Sequence
  Description of Artificial Sequence: Synthetic oligonucleotide
  Target: ATXN1; (-) strand; PAM type: YTN; PAM sequence: CTC
acgcctatagtcccagcact

SEQ ID NO: 175652 - DNA, 20 bp, Artificial Sequence
  Description of Artificial Sequence: Synthetic oligonucleotide
  Target: ATXN1; (-) strand; PAM type: YTN; PAM sequence: TTG
tggccacgtgtggtggctca

SEQ ID NO: 175653 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaagttgtggccacg

SEQ ID NO: 175654 - DNA, 20 bp, Artificial Sequence
  Description of Artificial Sequence: Synthetic oligonucleotide
  Target: ATXN1; (-) strand; PAM type: YTN; PAM sequence: TTA
ggccattaaaaaaaaagttg

SEQ ID NO: 175655 - DNA, 20 bp, Artificial Sequence
  Description of Artificial Sequence: Synthetic oligonucleotide
  Target: ATXN1; (-) strand; PAM type: YTN; PAM sequence: CTG
agaaacagattaggccatta

SEQ ID NO: 175656 - DNA, 20 bp, Artificial Sequence
  Description of Artificial Sequence: Synthetic oligonucleotide
  Target: ATXN1; (-) strand; PAM type: YTN; PAM sequence: TTC
gtatgctgagaaacagatta

SEQ ID NO: 175657 - DNA, 20 bp, Artificial Sequence
  Description of Artificial Sequence: Synthetic oligonucleotide
  Target: ATXN1; (-) strand; PAM type: YTN; PAM sequence: CTG
ggagtgagatacagtgttcg

SEQ ID NO: 175658 - DNA, 20 bp, Artificial Sequence
  Description of Artificial Sequence: Synthetic oligonucleotide
  Target: ATXN1; (-) strand; PAM type: YTN; PAM sequence: TTG
tctgggagtgagatacagtg

SEQ ID NO: 175659 - DNA, 20 bp, Artificial Sequence
  Description of Artificial Sequence: Synthetic oligonucleotide
  Target: ATXN1; (-) strand; PAM type: YTN; PAM sequence: TTC
aagcatgaatggcatcagtt

SEQ ID NO: 175660 - DNA, 20 bp, Artificial Sequence
  Description of Artificial Sequence: Synthetic oligonucleotide
  Target: ATXN1; (-) strand; PAM type: YTN; PAM sequence: CTT
caagcatgaatggcatcagt

SEQ ID NO: 175661 - DNA, 20 bp, Artificial Sequence
  Description of Artificial Sequence: Synthetic oligonucleotide
  Target: ATXN1; (-) strand; PAM type: YTN; PAM sequence: TTC
ttcaagcatgaatggcatca

SEQ ID NO: 175662 - DNA, 20 bp, Artificial Sequence
  Description of Artificial Sequence: Synthetic oligonucleotide
  Target: ATXN1; (-) strand; PAM type: YTN; PAM sequence: CTT
cttcaagcatgaatggcatc

SEQ ID NO: 175663 - DNA, 20 bp, Artificial Sequence
  Description of Artificial Sequence: Synthetic oligonucleotide
  Target: ATXN1; (-) strand; PAM type: YTN; PAM sequence: TTC
ttcttcaagcatgaatggca

SEQ ID NO: 175664 - DNA, 20 bp, Artificial Sequence
  Description of Artificial Sequence: Synthetic oligonucleotide
  Target: ATXN1; (-) strand; PAM type: YTN; PAM sequence: TTT
cttcttcaagcatgaatggc

SEQ ID NO: 175665 - DNA, 20 bp, Artificial Sequence
  Description of Artificial Sequence: Synthetic oligonucleotide
  Target: ATXN1; (-) strand; PAM type: YTN; PAM sequence: CTG
gtcatggatttcttcttcaa

SEQ ID NO: 175666 - DNA, 20 bp, Artificial Sequence
  Description of Artificial Sequence: Synthetic oligonucleotide
  Target: ATXN1; (-) strand; PAM type: YTN; PAM sequence: TTG
gtacctggtcatggatttct

SEQ ID NO: 175667 - DNA, 20 bp, Artificial Sequence
  Description of Artificial Sequence: Synthetic oligonucleotide
  Target: ATXN1; (-) strand; PAM type: YTN; PAM sequence: TTT
ggtacctggtcatggatttc

SEQ ID NO: 175668 - DNA, 20 bp, Artificial Sequence
  Description of Artificial Sequence: Synthetic oligonucleotide
  Target: ATXN1; (-) strand; PAM type: YTN; PAM sequence: CTT
tggtacctggtcatggattt

SEQ ID NO: 175669 - DNA, 20 bp, Artificial Sequence
  Description of Artificial Sequence: Synthetic oligonucleotide
  Target: ATXN1; (-) strand; PAM type: YTN; PAM sequence: TTC
tttggtacctggtcatggat

SEQ ID NO: 175670 - DNA, 20 bp, Artificial Sequence
  Description of Artificial Sequence: Synthetic oligonucleotide
  Target: ATXN1; (-) strand; PAM type: YTN; PAM sequence: CTT
ctttggtacctggtcatgga

SEQ ID NO: 175671 - DNA, 20 bp, Artificial Sequence
  Description of Artificial Sequence: Synthetic oligonucleotide
  Target: ATXN1; (-) strand; PAM type: YTN; PAM sequence: TTA
gccttctttggtacctggtc

SEQ ID NO: 175672 - DNA, 20 bp, Artificial Sequence
  Description of Artificial Sequence: Synthetic oligonucleotide
  Target: ATXN1; (-) strand; PAM type: YTN; PAM sequence: TTT
agccttctttggtacctggt

SEQ ID NO: 175673 - DNA, 20 bp, Artificial Sequence
  Description of Artificial Sequence: Synthetic oligonucleotide
  Target: ATXN1; (-) strand; PAM type: YTN; PAM sequence: TTA
tatttagccttctttggtac

SEQ ID NO: 175674 - DNA, 20 bp, Artificial Sequence
  Description of Artificial Sequence: Synthetic oligonucleotide
  Target: ATXN1; (-) strand; PAM type: YTN; PAM sequence: TTT
atatttagccttctttggta

SEQ ID NO: 175675 - DNA, 20 bp, Artificial Sequence
  Description of Artificial Sequence: Synthetic oligonucleotide
  Target: ATXN1; (-) strand; PAM type: YTN; PAM sequence: CTT
tatatttagccttctttggt

SEQ ID NO: 175676 - DNA, 20 bp, Artificial Sequence
  Description of Artificial Sequence: Synthetic oligonucleotide
  Target: ATXN1; (-) strand; PAM type: YTN; PAM sequence: CTG
cctttatatttagccttctt

SEQ ID NO: 175677 - DNA, 20 bp, Artificial Sequence
  Description of Artificial Sequence: Synthetic oligonucleotide
  Target: ATXN1; (-) strand; PAM type: YTN; PAM sequence: CTA
gggtagtggcaggtagaaaa

SEQ ID NO: 175678 - DNA, 20 bp, Artificial Sequence
  Description of Artificial Sequence: Synthetic oligonucleotide
  Target: ATXN1; (-) strand; PAM type: YTN; PAM sequence: TTC
gaggatgaactagggtagtg

SEQ ID NO: 175679 - DNA, 20 bp, Artificial Sequence
  Description of Artificial Sequence: Synthetic oligonucleotide
  Target: ATXN1; (-) strand; PAM type: YTN; PAM sequence: CTT
cgaggatgaactagggtagt

SEQ ID NO: 175680 - DNA, 20 bp, Artificial Sequence
  Description of Artificial Sequence: Synthetic oligonucleotide
  Target: ATXN1; (-) strand; PAM type: YTN; PAM sequence: TTG
aaccaaatcttcgaggatga

SEQ ID NO: 175681 - DNA, 20 bp, Artificial Sequence
  Description of Artificial Sequence: Synthetic oligonucleotide
  Target: ATXN1; (-) strand; PAM type: YTN; PAM sequence: TTT
gaaccaaatcttcgaggatg

SEQ ID NO: 175682 - DNA, 20 bp, Artificial Sequence
  Description of Artificial Sequence: Synthetic oligonucleotide
  Target: ATXN1; (-) strand; PAM type: YTN; PAM sequence: TTT
tgaaccaaatcttcgaggat

SEQ ID NO: 175683 - DNA, 20 bp, Artificial Sequence
  Description of Artificial Sequence: Synthetic oligonucleotide
  Target: ATXN1; (-) strand; PAM type: YTN; PAM sequence: CTT
ttgaaccaaatcttcgagga

SEQ ID NO: 175684 - DNA, 20 bp, Artificial Sequence
  Description of Artificial Sequence: Synthetic oligonucleotide
  Target: ATXN1; (-) strand; PAM type: YTN; PAM sequence: CTA
acttttgaaccaaatcttcg

SEQ ID NO: 175685 - DNA, 20 bp, Artificial Sequence
  Description of Artificial Sequence: Synthetic oligonucleotide
  Target: ATXN1; (-) strand; PAM type: YTN; PAM sequence: TTG
agaggctaacttttgaacca

SEQ ID NO: 175686 - DNA, 20 bp, Artificial Sequence
  Description of Artificial Sequence: Synthetic oligonucleotide
  Target: ATXN1; (-) strand; PAM type: YTN; PAM sequence: TTT
gagaggctaacttttgaacc

SEQ ID NO: 175687 - DNA, 20 bp, Artificial Sequence
  Description of Artificial Sequence: Synthetic oligonucleotide
  Target: ATXN1; (-) strand; PAM type: YTN; PAM sequence: CTT
tgagaggctaacttttgaac

SEQ ID NO: 175688 - DNA, 20 bp, Artificial Sequence
  Description of Artificial Sequence: Synthetic oligonucleotide
  Target: ATXN1; (-) strand; PAM type: YTN; PAM sequence: TTC
agggtggaataatatggagg

SEQ ID NO: 175689 - DNA, 20 bp, Artificial Sequence
  Description of Artificial Sequence: Synthetic oligonucleotide
  Target: ATXN1; (-) strand; PAM type: YTN; PAM sequence: CTG
aggttcagggtggaataata

SEQ ID NO: 175690 - DNA, 20 bp, Artificial Sequence
  Description of Artificial Sequence: Synthetic oligonucleotide
  Target: ATXN1; (-) strand; PAM type: YTN; PAM sequence: CTC
tgaggttcagggtggaataa

SEQ ID NO: 175691 - DNA, 20 bp, Artificial Sequence
  Description of Artificial Sequence: Synthetic oligonucleotide
  Target: ATXN1; (-) strand; PAM type: YTN; PAM sequence: CTC
aagagctctgaggttcaggg

SEQ ID NO: 175692 - DNA, 20 bp, Artificial Sequence
  Description of Artificial Sequence: Synthetic oligonucleotide
  Target: ATXN1; (-) strand; PAM type: YTN; PAM sequence: TTA
acctcaagagctctgaggtt

SEQ ID NO: 175693 - DNA, 20 bp, Artificial Sequence
  Description of Artificial Sequence: Synthetic oligonucleotide
  Target: ATXN1; (-) strand; PAM type: YTN; PAM sequence: TTT
aacctcaagagctctgaggt

SEQ ID NO: 175694 - DNA, 20 bp, Artificial Sequence
  Description of Artificial Sequence: Synthetic oligonucleotide
  Target: ATXN1; (-) strand; PAM type: YTN; PAM sequence: TTT
taacctcaagagctctgagg

SEQ ID NO: 175695 - DNA, 20 bp, Artificial Sequence
  Description of Artificial Sequence: Synthetic oligonucleotide
  Target: ATXN1; (-) strand; PAM type: YTN; PAM sequence: TTT
ttaacctcaagagctctgag

SEQ ID NO: 175696 - DNA, 20 bp, Artificial Sequence
  Description of Artificial Sequence: Synthetic oligonucleotide
  Target: ATXN1; (-) strand; PAM type: YTN; PAM sequence: CTC
atagtttttaacctcaagag

SEQ ID NO: 175697 - DNA, 20 bp, Artificial Sequence
  Description of Artificial Sequence: Synthetic oligonucleotide
  Target: ATXN1; (-) strand; PAM type: YTN; PAM sequence: TTC
tcatagtttttaacctcaag

SEQ ID NO: 175698 - DNA, 20 bp, Artificial Sequence
  Description of Artificial Sequence: Synthetic oligonucleotide
  Target: ATXN1; (-) strand; PAM type: YTN; PAM sequence: CTT
ctcatagtttttaacctcaa

SEQ ID NO: 175699 - DNA, 20 bp, Artificial Sequence
  Description of Artificial Sequence: Synthetic oligonucleotide
  Target: ATXN1; (-) strand; PAM type: YTN; PAM sequence: TTC
cttctcatagtttttaacct

SEQ ID NO: 175700 - DNA, 20 bp, Artificial Sequence
  Description of Artificial Sequence: Synthetic oligonucleotide
  Target: ATXN1; (-) strand; PAM type: YTN; PAM sequence: CTC
atccattccttctcatagtt

SEQ ID NO: 175701 - DNA, 20 bp, Artificial Sequence
  Description of Artificial Sequence: Synthetic oligonucleotide
  Target: ATXN1; (-) strand; PAM type: YTN; PAM sequence: TTA
ctcatccattccttctcata

SEQ ID NO: 175702 - DNA, 20 bp, Artificial Sequence
  Description of Artificial Sequence: Synthetic oligonucleotide
  Target: ATXN1; (-) strand; PAM type: YTN; PAM sequence: TTT
actcatccattccttctcat

SEQ ID NO: 175703 - DNA, 20 bp, Artificial Sequence
  Description of Artificial Sequence: Synthetic oligonucleotide
  Target: ATXN1; (-) strand; PAM type: YTN; PAM sequence: TTG
atttactcatccattccttc

SEQ ID NO: 175704 - DNA, 20 bp, Artificial Sequence
  Description of Artificial Sequence: Synthetic oligonucleotide
  Target: ATXN1; (-) strand; PAM type: YTN; PAM sequence: TTC
gttgatttactcatccattc

SEQ ID NO: 175705 - DNA, 20 bp, Artificial Sequence
  Description of Artificial Sequence: Synthetic oligonucleotide
  Target: ATXN1; (-) strand; PAM type: YTN; PAM sequence: TTC
attcgttgatttactcatcc

SEQ ID NO: 175706 - DNA, 20 bp, Artificial Sequence
  Description of Artificial Sequence: Synthetic oligonucleotide
  Target: ATXN1; (-) strand; PAM type: YTN; PAM sequence: CTT
cattcgttgatttactcatc

SEQ ID NO: 175707 - DNA, 20 bp, Artificial Sequence
  Description of Artificial Sequence: Synthetic oligonucleotide
  Target: ATXN1; (-) strand; PAM type: YTN; PAM sequence: TTA
ccttcattcgttgatttact

SEQ ID NO: 175708 - DNA, 20 bp, Artificial Sequence
  Description of Artificial Sequence: Synthetic oligonucleotide
  Target: ATXN1; (-) strand; PAM type: YTN; PAM sequence: TTT
accttcattcgttgatttac

SEQ ID NO: 175709 - DNA, 20 bp, Artificial Sequence
  Description of Artificial Sequence: Synthetic oligonucleotide
  Target: ATXN1; (-) strand; PAM type: YTN; PAM sequence: CTT
taccttcattcgttgattta

SEQ ID NO: 175710 - DNA, 20 bp, Artificial Sequence
  Description of Artificial Sequence: Synthetic oligonucleotide
  Target: ATXN1; (-) strand; PAM type: YTN; PAM sequence: CTC
aaacaacatgctttaccttc

SEQ ID NO: 175711 - DNA, 20 bp, Artificial Sequence
  Description of Artificial Sequence: Synthetic oligonucleotide
  Target: ATXN1; (-) strand; PAM type: YTN; PAM sequence: CTG
tctcaaacaacatgctttac

SEQ ID NO: 175712 - DNA, 20 bp, Artificial Sequence
  Description of Artificial Sequence: Synthetic oligonucleotide
  Target: ATXN1; (-) strand; PAM type: YTN; PAM sequence: TTA
atcaccctgtctcaaacaac

SEQ ID NO: 175713 - DNA, 20 bp, Artificial Sequence
  Description of Artificial Sequence: Synthetic oligonucleotide
  Target: ATXN1; (-) strand; PAM type: YTN; PAM sequence: CTC
ccattaatcaccctgtctca

SEQ ID NO: 175714 - DNA, 20 bp, Artificial Sequence
  Description of Artificial Sequence: Synthetic oligonucleotide
  Target: ATXN1; (-) strand; PAM type: YTN; PAM sequence: TTG
ggaccatgctcccattaatc

SEQ ID NO: 175715 - DNA, 20 bp, Artificial Sequence
  Description of Artificial Sequence: Synthetic oligonucleotide
  Target: ATXN1; (-) strand; PAM type: YTN; PAM sequence: CTA
caccagagcgttgggaccat

SEQ ID NO: 175716 - DNA, 20 bp, Artificial Sequence
  Description of Artificial Sequence: Synthetic oligonucleotide
  Target: ATXN1; (-) strand; PAM type: YTN; PAM sequence: TTG
ctacaccagagcgttgggac

SEQ ID NO: 175717 - DNA, 20 bp, Artificial Sequence
  Description of Artificial Sequence: Synthetic oligonucleotide
  Target: ATXN1; (-) strand; PAM type: YTN; PAM sequence: TTT
gctacaccagagcgttggga

SEQ ID NO: 175718 - DNA, 20 bp, Artificial Sequence
  Description of Artificial Sequence: Synthetic oligonucleotide
  Target: ATXN1; (-) strand; PAM type: YTN; PAM sequence: TTT
tgctacaccagagcgttggg

SEQ ID NO: 175719 - DNA, 20 bp, Artificial Sequence
  Description of Artificial Sequence: Synthetic oligonucleotide
  Target: ATXN1; (-) strand; PAM type: YTN; PAM sequence: CTT
ttgctacaccagagcgttgg

SEQ ID NO: 175720 - DNA, 20 bp, Artificial Sequence
  Description of Artificial Sequence: Synthetic oligonucleotide
  Target: ATXN1; (-) strand; PAM type: YTN; PAM sequence: CTC
aatcttttgctacaccagag

SEQ ID NO: 175721 - DNA, 20 bp, Artificial Sequence
  Description of Artificial Sequence: Synthetic oligonucleotide
  Target: ATXN1; (-) strand; PAM type: YTN; PAM sequence: TTC
tcaatcttttgctacaccag

SEQ ID NO: 175722 - DNA, 20 bp, Artificial Sequence
  Description of Artificial Sequence: Synthetic oligonucleotide
  Target: ATXN1; (-) strand; PAM type: YTN; PAM sequence: CTT
ctcaatcttttgctacacca

SEQ ID NO: 175723 - DNA, 20 bp, Artificial Sequence
  Description of Artificial Sequence: Synthetic oligonucleotide
  Target: ATXN1; (-) strand; PAM type: YTN; PAM sequence: TTC
acttctcaatcttttgctac

SEQ ID NO: 175724 - DNA, 20 bp, Artificial Sequence
  Description of Artificial Sequence: Synthetic oligonucleotide
  Target: ATXN1; (-) strand; PAM type: YTN; PAM sequence: CTA
caacagtgttcacttctcaa

SEQ ID NO: 175725 - DNA, 20 bp, Artificial Sequence
  Description of Artificial Sequence: Synthetic oligonucleotide
  Target: ATXN1; (-) strand; PAM type: YTN; PAM sequence: CTC
tacaacagtgttcacttctc

SEQ ID NO: 175726 - DNA, 20 bp, Artificial Sequence
  Description of Artificial Sequence: Synthetic oligonucleotide
  Target: ATXN1; (-) strand; PAM type: YTN; PAM sequence: TTC
gtagctctacaacagtgttc

SEQ ID NO: 175727 - DNA, 20 bp, Artificial Sequence
  Description of Artificial Sequence: Synthetic oligonucleotide
  Target: ATXN1; (-) strand; PAM type: YTN; PAM sequence: TTT
cgtagctctacaacagtgtt

SEQ ID NO: 175728 - DNA, 20 bp, Artificial Sequence
  Description of Artificial Sequence: Synthetic oligonucleotide
  Target: ATXN1; (-) strand; PAM type: YTN; PAM sequence: TTT
tcgtagctctacaacagtgt

SEQ ID NO: 175729 - DNA, 20 bp, Artificial Sequence
  Description of Artificial Sequence: Synthetic oligonucleotide
  Target: ATXN1; (-) strand; PAM type: YTN; PAM sequence: CTT
ttcgtagctctacaacagtg

SEQ ID NO: 175730 - DNA, 20 bp, Artificial Sequence
  Description of Artificial Sequence: Synthetic oligonucleotide
  Target: ATXN1; (-) strand; PAM type: YTN; PAM sequence: TTA
tgtgccaaatatcttttcgt

SEQ ID NO: 175731 - DNA, 20 bp, Artificial Sequence
  Description of Artificial Sequence: Synthetic oligonucleotide
  Target: ATXN1; (-) strand; PAM type: YTN; PAM sequence: CTA
ttatgtgccaaatatctttt

SEQ ID NO: 175732 - DNA, 20 bp, Artificial Sequence
  Description of Artificial Sequence: Synthetic oligonucleotide
  Target: ATXN1; (-) strand; PAM type: YTN; PAM sequence: TTA
agcacctattatgtgccaaa

SEQ ID NO: 175733 - DNA, 20 bp, Artificial Sequence
  Description of Artificial Sequence: Synthetic oligonucleotide
  Target: ATXN1; (-) strand; PAM type: YTN; PAM sequence: TTT
aagcacctattatgtgccaa

SEQ ID NO: 175734 - DNA, 20 bp, Artificial Sequence
  Description of Artificial Sequence: Synthetic oligonucleotide
  Target: ATXN1; (-) strand; PAM type: YTN; PAM sequence: TTT
taagcacctattatgtgcca

SEQ ID NO: 175735 - DNA, 20 bp, Artificial Sequence
  Description of Artificial Sequence: Synthetic oligonucleotide
  Target: ATXN1; (-) strand; PAM type: YTN; PAM sequence: TTA
atgagcattttaagcaccta

SEQ ID NO: 175736 - DNA, 20 bp, Artificial Sequence
  Description of Artificial Sequence: Synthetic oligonucleotide
  Target: ATXN1; (-) strand; PAM type: YTN; PAM sequence: TTT
aatgagcattttaagcacct

SEQ ID NO: 175737 - DNA, 20 bp, Artificial Sequence
  Description of Artificial Sequence: Synthetic oligonucleotide
  Target: ATXN1; (-) strand; PAM type: YTN; PAM sequence: TTC
atttaatgagcattttaagc

SEQ ID NO: 175738 - DNA, 20 bp, Artificial Sequence
  Description of Artificial Sequence: Synthetic oligonucleotide
  Target: ATXN1; (-) strand; PAM type: YTN; PAM sequence: TTT
catttaatgagcattttaag

SEQ ID NO: 175739 - DNA, 20 bp, Artificial Sequence
  Description of Artificial Sequence: Synthetic oligonucleotide
  Target: ATXN1; (-) strand; PAM type: YTN; PAM sequence: CTT
tcatttaatgagcattttaa

SEQ ID NO: 175740 - DNA, 20 bp, Artificial Sequence
  Description of Artificial Sequence: Synthetic oligonucleotide
  Target: ATXN1; (-) strand; PAM type: YTN; PAM sequence: TTC
tttcatttaatgagcatttt

SEQ ID NO: 175741 - DNA, 20 bp, Artificial Sequence
  Description of Artificial Sequence: Synthetic oligonucleotide
  Target: ATXN1; (-) strand; PAM type: YTN; PAM sequence: TTA
attctttcatttaatgagca

SEQ ID NO: 175742 - DNA, 20 bp, Artificial Sequence
  Description of Artificial Sequence: Synthetic oligonucleotide
  Target: ATXN1; (-) strand; PAM type: YTN; PAM sequence: TTA
tgcattaattctttcattta

SEQ ID NO: 175743 - DNA, 20 bp, Artificial Sequence
  Description of Artificial Sequence: Synthetic oligonucleotide
  Target: ATXN1; (-) strand; PAM type: YTN; PAM sequence: TTC
agtaggaagggttatgcatt

SEQ ID NO: 175744 - DNA, 20 bp, Artificial Sequence
  Description of Artificial Sequence: Synthetic oligonucleotide
  Target: ATXN1; (-) strand; PAM type: YTN; PAM sequence: CTA
gacacaaacattcagtagga

SEQ ID NO: 175745 - DNA, 20 bp, Artificial Sequence
  Description of Artificial Sequence: Synthetic oligonucleotide
  Target: ATXN1; (-) strand; PAM type: YTN; PAM sequence: TTC
tagacacaaacattcagtag

SEQ ID NO: 175746 - DNA, 20 bp, Artificial Sequence
  Description of Artificial Sequence: Synthetic oligonucleotide
  Target: ATXN1; (-) strand; PAM type: YTN; PAM sequence: CTT
ctagacacaaacattcagta

SEQ ID NO: 175747 - DNA, 20 bp, Artificial Sequence
  Description of Artificial Sequence: Synthetic oligonucleotide
  Target: ATXN1; (-) strand; PAM type: YTN; PAM sequence: TTG
agacagtgcatcttctagac

SEQ ID NO: 175748 - DNA, 20 bp, Artificial Sequence
  Description of Artificial Sequence: Synthetic oligonucleotide
  Target: ATXN1; (-) strand; PAM type: YTN; PAM sequence: TTT
gagacagtgcatcttctaga

SEQ ID NO: 175749 - DNA, 20 bp, Artificial Sequence
  Description of Artificial Sequence: Synthetic oligonucleotide
  Target: ATXN1; (-) strand; PAM type: YTN; PAM sequence: TTA
taatgggaatagtttgagac

SEQ ID NO: 175750 - DNA, 20 bp, Artificial Sequence
  Description of Artificial Sequence: Synthetic oligonucleotide
  Target: ATXN1; (-) strand; PAM type: YTN; PAM sequence: TTT
ataatgggaatagtttgaga

SEQ ID NO: 175751 - DNA, 20 bp, Artificial Sequence
  Description of Artificial Sequence: Synthetic oligonucleotide
  Target: ATXN1; (-) strand; PAM type: YTN; PAM sequence: TTT
tataatgggaatagtttgag

SEQ ID NO: 175752 - DNA, 20 bp, Artificial Sequence
  Description of Artificial Sequence: Synthetic oligonucleotide
  Target: ATXN1; (-) strand; PAM type: YTN; PAM sequence: CTT
ttataatgggaatagtttga

SEQ ID NO: 175753 - DNA, 20 bp, Artificial Sequence
  Description of Artificial Sequence: Synthetic oligonucleotide
  Target: ATXN1; (-) strand; PAM type: YTN; PAM sequence: TTA
cttttataatgggaatagtt

SEQ ID NO: 175754 - DNA, 20 bp, Artificial Sequence
  Description of Artificial Sequence: Synthetic oligonucleotide
  Target: ATXN1; (-) strand; PAM type: YTN; PAM sequence: TTT
acttttataatgggaatagt

SEQ ID NO: 175755 - DNA, 20 bp, Artificial Sequence
  Description of Artificial Sequence: Synthetic oligonucleotide
  Target: ATXN1; (-) strand; PAM type: YTN; PAM sequence: TTG
tacacaggaacaatatttac

SEQ ID NO: 175756 - DNA, 20 bp, Artificial Sequence
  Description of Artificial Sequence: Synthetic oligonucleotide
  Target: ATXN1; (-) strand; PAM type: YTN; PAM sequence: CTA
attgtacacaggaacaatat

SEQ ID NO: 175757 - DNA, 20 bp, Artificial Sequence
  Description of Artificial Sequence: Synthetic oligonucleotide
  Target: ATXN1; (-) strand; PAM type: YTN; PAM sequence: CTA
gaggaagggactaattgtac

SEQ ID NO: 175758 - DNA, 20 bp, Artificial Sequence
  Description of Artificial Sequence: Synthetic oligonucleotide
  Target: ATXN1; (-) strand; PAM type: YTN; PAM sequence: TTA
atagtctagaggaagggact

SEQ ID NO: 175759 - DNA, 20 bp, Artificial Sequence
  Description of Artificial Sequence: Synthetic oligonucleotide
  Target: ATXN1; (-) strand; PAM type: YTN; PAM sequence: TTG
ccaggagccagggattaata

SEQ ID NO: 175760 - DNA, 20 bp, Artificial Sequence
  Description of Artificial Sequence: Synthetic oligonucleotide
  Target: ATXN1; (-) strand; PAM type: YTN; PAM sequence: TTT
gccaggagccagggattaat

SEQ ID NO: 175761 - DNA, 20 bp, Artificial Sequence
  Description of Artificial Sequence: Synthetic oligonucleotide
  Target: ATXN1; (-) strand; PAM type: YTN; PAM sequence: TTT
tgccaggagccagggattaa

SEQ ID NO: 175762 - DNA, 20 bp, Artificial Sequence
  Description of Artificial Sequence: Synthetic oligonucleotide
  Target: ATXN1; (-) strand; PAM type: YTN; PAM sequence: TTT
ttgccaggagccagggatta

SEQ ID NO: 175763 - DNA, 20 bp, Artificial Sequence
  Description of Artificial Sequence: Synthetic oligonucleotide
  Target: ATXN1; (-) strand; PAM type: YTN; PAM sequence: CTG
tacaaatgcaaggagttttt

SEQ ID NO: 175764 - DNA, 20 bp, Artificial Sequence
  Description of Artificial Sequence: Synthetic oligonucleotide
  Target: ATXN1; (-) strand; PAM type: YTN; PAM sequence: TTC
tgtacaaatgcaaggagttt

SEQ ID NO: 175765 - DNA, 20 bp, Artificial Sequence
  Description of Artificial Sequence: Synthetic oligonucleotide
  Target: ATXN1; (-) strand; PAM type: YTN; PAM sequence: TTT
ctgtacaaatgcaaggagtt

SEQ ID NO: 175766 - DNA, 20 bp, Artificial Sequence
  Description of Artificial Sequence: Synthetic oligonucleotide
  Target: ATXN1; (-) strand; PAM type: YTN; PAM sequence: TTC
catttctgtacaaatgcaag

SEQ ID NO: 175767 - DNA, 20 bp, Artificial Sequence
  Description of Artificial Sequence: Synthetic oligonucleotide
  Target: ATXN1; (-) strand; PAM type: YTN; PAM sequence: TTA
atgtggccaaaaaccgattc

SEQ ID NO: 175768 - DNA, 20 bp, Artificial Sequence
  Description of Artificial Sequence: Synthetic oligonucleotide
  Target: ATXN1; (-) strand; PAM type: YTN; PAM sequence: CTT
aatgtggccaaaaaccgatt

SEQ ID NO: 175769 - DNA, 20 bp, Artificial Sequence
  Description of Artificial Sequence: Synthetic oligonucleotide
  Target: ATXN1; (-) strand; PAM type: YTN; PAM sequence: TTA
aggaaagaagtatcgcttaa

SEQ ID NO: 175770 - DNA, 20 bp, Artificial Sequence
  Description of Artificial Sequence: Synthetic oligonucleotide
  Target: ATXN1; (-) strand; PAM type: YTN; PAM sequence: CTT
aaggaaagaagtatcgctta

SEQ ID NO: 175771 - DNA, 20 bp, Artificial Sequence
  Description of Artificial Sequence: Synthetic oligonucleotide
  Target: ATXN1; (-) strand; PAM type: YTN; PAM sequence: TTG
atgtgcttaaggaaagaagt

SEQ ID NO: 175772 - DNA, 20 bp, Artificial Sequence
  Description of Artificial Sequence: Synthetic oligonucleotide
  Target: ATXN1; (-) strand; PAM type: YTN; PAM sequence: CTG
aaagccacagagggagttga

SEQ ID NO: 175773 - DNA, 20 bp, Artificial Sequence
  Description of Artificial Sequence: Synthetic oligonucleotide
  Target: ATXN1; (-) strand; PAM type: YTN; PAM sequence: TTC
ctgaaagccacagagggagt

SEQ ID NO: 175774 - DNA, 20 bp, Artificial Sequence
  Description of Artificial Sequence: Synthetic oligonucleotide
  Target: ATXN1; (-) strand; PAM type: YTN; PAM sequence: CTA
agcattcctgaaagccacag

SEQ ID NO: 175775 - DNA, 20 bp, Artificial Sequence
  Description of Artificial Sequence: Synthetic oligonucleotide
  Target: ATXN1; (-) strand; PAM type: YTN; PAM sequence: TTC
caaaggctaagcattcctga

SEQ ID NO: 175776 - DNA, 20 bp, Artificial Sequence
  Description of Artificial Sequence: Synthetic oligonucleotide
  Target: ATXN1; (-) strand; PAM type: YTN; PAM sequence: TTA
ttccaaaggctaagcattcc

SEQ ID NO: 175777 - DNA, 20 bp, Artificial Sequence
  Description of Artificial Sequence: Synthetic oligonucleotide
  Target: ATXN1; (-) strand; PAM type: YTN; PAM sequence: TTT
attccaaaggctaagcattc

SEQ ID NO: 175778 - DNA, 20 bp, Artificial Sequence
  Description of Artificial Sequence: Synthetic oligonucleotide
  Target: ATXN1; (-) strand; PAM type: YTN; PAM sequence: CTT
tattccaaaggctaagcatt

SEQ ID NO: 175779 - DNA, 20 bp, Artificial Sequence
  Description of Artificial Sequence: Synthetic oligonucleotide
  Target: ATXN1; (-) strand; PAM type: YTN; PAM sequence: CTA
ctttattccaaaggctaagc

SEQ ID NO: 175780 - DNA, 20 bp, Artificial Sequence
  Description of Artificial Sequence: Synthetic oligonucleotide
  Target: ATXN1; (-) strand; PAM type: YTN; PAM sequence: TTC
tactttattccaaaggctaa

SEQ ID NO: 175781 - DNA, 20 bp, Artificial Sequence
  Description of Artificial Sequence: Synthetic oligonucleotide
  Target: ATXN1; (-) strand; PAM type: YTN; PAM sequence: TTT
ctactttattccaaaggcta

SEQ ID NO: 175782 - DNA, 20 bp, Artificial Sequence
  Description of Artificial Sequence: Synthetic oligonucleotide
  Target: ATXN1; (-) strand; PAM type: YTN; PAM sequence: CTT
tctactttattccaaaggct

SEQ ID NO: 175783 - DNA, 20 bp, Artificial Sequence
  Description of Artificial Sequence: Synthetic oligonucleotide
  Target: ATXN1; (-) strand; PAM type: YTN; PAM sequence: CTG
tactttctactttattccaa

SEQ ID NO: 175784 - DNA, 20 bp, Artificial Sequence
  Description of Artificial Sequence: Synthetic oligonucleotide
  Target: ATXN1; (-) strand; PAM type: YTN; PAM sequence: TTC
tgtactttctactttattcc

SEQ ID NO: 175785 - DNA, 20 bp, Artificial Sequence
  Description of Artificial Sequence: Synthetic oligonucleotide
  Target: ATXN1; (-) strand; PAM type: YTN; PAM sequence: TTT
ctgtactttctactttattc

SEQ ID NO: 175786 - DNA, 20 bp, Artificial Sequence
  Description of Artificial Sequence: Synthetic oligonucleotide
  Target: ATXN1; (-) strand; PAM type: YTN; PAM sequence: TTC
cagtggatttctgtactttc

SEQ ID NO: 175787 - DNA, 20 bp, Artificial Sequence
  Description of Artificial Sequence: Synthetic oligonucleotide
  Target: ATXN1; (-) strand; PAM type: YTN; PAM sequence: TTG
acatgtgccaggccatgtat

SEQ ID NO: 175788 - DNA, 20 bp, Artificial Sequence
  Description of Artificial Sequence: Synthetic oligonucleotide
  Target: ATXN1; (-) strand; PAM type: YTN; PAM sequence: TTT
gacatgtgccaggccatgta

SEQ ID NO: 175789 - DNA, 20 bp, Artificial Sequence
  Description of Artificial Sequence: Synthetic oligonucleotide
  Target: ATXN1; (-) strand; PAM type: YTN; PAM sequence: TTG
atttgacatgtgccaggcca

SEQ ID NO: 175790 - DNA, 20 bp, Artificial Sequence
  Description of Artificial Sequence: Synthetic oligonucleotide
  Target: ATXN1; (-) strand; PAM type: YTN; PAM sequence: TTT
gatttgacatgtgccaggcc

SEQ ID NO: 175791 - DNA, 20 bp, Artificial Sequence
  Description of Artificial Sequence: Synthetic oligonucleotide
  Target: ATXN1; (-) strand; PAM type: YTN; PAM sequence: CTT
tgatttgacatgtgccaggc

SEQ ID NO: 175792 - DNA, 20 bp, Artificial Sequence
  Description of Artificial Sequence: Synthetic oligonucleotide
  Target: ATXN1; (-) strand; PAM type: YTN; PAM sequence: TTC
tttgatttgacatgtgccag

SEQ ID NO: 175793 - DNA, 20 bp, Artificial Sequence
  Description of Artificial Sequence: Synthetic oligonucleotide
  Target: ATXN1; (-) strand; PAM type: YTN; PAM sequence: CTT
ctttgatttgacatgtgcca

SEQ ID NO: 175794 - DNA, 20 bp, Artificial Sequence
  Description of Artificial Sequence: Synthetic oligonucleotide
  Target: ATXN1; (-) strand; PAM type: YTN; PAM sequence: TTC
cttctttgatttgacatgtg

SEQ ID NO: 175795 - DNA, 20 bp, Artificial Sequence
  Description of Artificial Sequence: Synthetic oligonucleotide
  Target: ATXN1; (-) strand; PAM type: YTN; PAM sequence: CTA
ttccttctttgatttgacat

SEQ ID NO: 175796 - DNA, 20 bp, Artificial Sequence
  Description of Artificial Sequence: Synthetic oligonucleotide
  Target: ATXN1; (-) strand; PAM type: YTN; PAM sequence: CTC
tattccttctttgatttgac

SEQ ID NO: 175797 - DNA, 20 bp, Artificial Sequence
  Description of Artificial Sequence: Synthetic oligonucleotide
  Target: ATXN1; (-) strand; PAM type: YTN; PAM sequence: TTC
tctattccttctttgatttg

SEQ ID NO: 175798 - DNA, 20 bp, Artificial Sequence
  Description of Artificial Sequence: Synthetic oligonucleotide
  Target: ATXN1; (-) strand; PAM type: YTN; PAM sequence: CTT
ctctattccttctttgattt

SEQ ID NO: 175799 - DNA, 20 bp, Artificial Sequence
  Description of Artificial Sequence: Synthetic oligonucleotide
  Target: ATXN1; (-) strand; PAM type: YTN; PAM sequence: CTG
cttctctattccttctttga

SEQ ID NO: 175800 - DNA, 20 bp, Artificial Sequence
  Description of Artificial Sequence: Synthetic oligonucleotide
  Target: ATXN1; (-) strand; PAM type: YTN; PAM sequence: CTC
cctgcttctctattccttct

SEQ ID NO: 175801 - DNA, 20 bp, Artificial Sequence
  Description of Artificial Sequence: Synthetic oligonucleotide
  Target: ATXN1; (-) strand; PAM type: YTN; PAM sequence: CTC
atgaatgctccctgcttctc

SEQ ID NO: 175802 - DNA, 20 bp, Artificial Sequence
  Description of Artificial Sequence: Synthetic oligonucleotide
  Target: ATXN1; (-) strand; PAM type: YTN; PAM sequence: TTC
agatctcatgaatgctccct

SEQ ID NO: 175803 - DNA, 20 bp, Artificial Sequence
  Description of Artificial Sequence: Synthetic oligonucleotide
  Target: ATXN1; (-) strand; PAM type: YTN; PAM sequence: CTG
ttcagatctcatgaatgctc

SEQ ID NO: 175804 - DNA, 20 bp, Artificial Sequence
  Description of Artificial Sequence: Synthetic oligonucleotide
  Target: ATXN1; (-) strand; PAM type: YTN; PAM sequence: TTG
catggtcagactgttcagat

SEQ ID NO: 175805 - DNA, 20 bp, Artificial Sequence
  Description of Artificial Sequence: Synthetic oligonucleotide
  Target: ATXN1; (-) strand; PAM type: YTN; PAM sequence: TTA
aagtataataataataaaat

SEQ ID NO: 175806 - DNA, 20 bp, Artificial Sequence
  Description of Artificial Sequence: Synthetic oligonucleotide
  Target: ATXN1; (-) strand; PAM type: YTN; PAM sequence: CTT
aaagtataataataataaaa

SEQ ID NO: 175807 - DNA, 20 bp, Artificial Sequence
  Description of Artificial Sequence: Synthetic oligonucleotide
  Target: ATXN1; (-) strand; PAM type: YTN; PAM sequence: CTA
aaacttaaagtataataata

SEQ ID NO: 175808 - DNA, 20 bp, Artificial Sequence
  Description of Artificial Sequence: Synthetic oligonucleotide
  Target: ATXN1; (-) strand; PAM type: YTN; PAM sequence: TTG
tgcacatgtaacctaaaact

SEQ ID NO: 175809 - DNA, 20 bp, Artificial Sequence
  Description of Artificial Sequence: Synthetic oligonucleotide
  Target: ATXN1; (-) strand; PAM type: YTN; PAM sequence: CTG
cacattgtgcacatgtaacc

SEQ ID NO: 175810 - DNA, 20 bp, Artificial Sequence
  Description of Artificial Sequence: Synthetic oligonucleotide
  Target: ATXN1; (-) strand; PAM type: YTN; PAM sequence: CTA
acctgcacattgtgcacatg

SEQ ID NO: 175811 - DNA, 20 bp, Artificial Sequence
  Description of Artificial Sequence: Synthetic oligonucleotide
  Target: ATXN1; (-) strand; PAM type: YTN; PAM sequence: TTA
atgggtgcagcacaccagca

SEQ ID NO: 175812 - DNA, 20 bp, Artificial Sequence
  Description of Artificial Sequence: Synthetic oligonucleotide
  Target: ATXN1; (-) strand; PAM type: YTN; PAM sequence: CTA
aatgacgagttaatgggtgc

SEQ ID NO: 175813 - DNA, 20 bp, Artificial Sequence
  Description of Artificial Sequence: Synthetic oligonucleotide
  Target: ATXN1; (-) strand; PAM type: YTN; PAM sequence: CTA
atgctaaatgacgagttaat

SEQ ID NO: 175814 - DNA, 20 bp, Artificial Sequence
  Description of Artificial Sequence: Synthetic oligonucleotide
  Target: ATXN1; (-) strand; PAM type: YTN; PAM sequence: TTA
ggagatatacctaatgctaa

SEQ ID NO: 175815 - DNA, 20 bp, Artificial Sequence
  Description of Artificial Sequence: Synthetic oligonucleotide
  Target: ATXN1; (-) strand; PAM type: YTN; PAM sequence: TTG
tggggtggggggagggggga

SEQ ID NO: 175816 - DNA, 20 bp, Artificial Sequence
  Description of Artificial Sequence: Synthetic oligonucleotide
  Target: ATXN1; (-) strand; PAM type: YTN; PAM sequence: CTG
ttgtggggtggggggagggg

SEQ ID NO: 175817 - DNA, 20 bp, Artificial Sequence
  Description of Artificial Sequence: Synthetic oligonucleotide
  Target: ATXN1; (-) strand; PAM type: YTN; PAM sequence: CTG
gggactgttgtggggtgggg

SEQ ID NO: 175818 - DNA, 20 bp, Artificial Sequence
  Description of Artificial Sequence: Synthetic oligonucleotide
  Target: ATXN1; (-) strand; PAM type: YTN; PAM sequence: CTC
tggggactgttgtggggtgg

SEQ ID NO: 175819 - DNA, 20 bp, Artificial Sequence
  Description of Artificial Sequence: Synthetic oligonucleotide
  Target: ATXN1; (-) strand; PAM type: YTN; PAM sequence: TTG
aacaatgagaacacatggac

SEQ ID NO: 175820 - DNA, 20 bp, Artificial Sequence
  Description of Artificial Sequence: Synthetic oligonucleotide
  Target: ATXN1; (-) strand; PAM type: YTN; PAM sequence: TTG
cggtgggaattgaacaatga

SEQ ID NO: 175821 - DNA, 20 bp, Artificial Sequence
  Description of Artificial Sequence: Synthetic oligonucleotide
  Target: ATXN1; (-) strand; PAM type: YTN; PAM sequence: TTA
ggagtattgcggtgggaatt

SEQ ID NO: 175822 - DNA, 20 bp, Artificial Sequence
  Description of Artificial Sequence: Synthetic oligonucleotide
  Target: ATXN1; (-) strand; PAM type: YTN; PAM sequence: TTA
gcgttaggagtattgcggtg

SEQ ID NO: 175823 - DNA, 20 bp, Artificial Sequence
  Description of Artificial Sequence: Synthetic oligonucleotide
  Target: ATXN1; (-) strand; PAM type: YTN; PAM sequence: TTA
ttagcgttaggagtattgcg

SEQ ID NO: 175824 - DNA, 20 bp, Artificial Sequence
  Description of Artificial Sequence: Synthetic oligonucleotide
  Target: ATXN1; (-) strand; PAM type: YTN; PAM sequence: CTA
caattattagcgttaggagt

SEQ ID NO: 175825 - DNA, 20 bp, Artificial Sequence
  Description of Artificial Sequence: Synthetic oligonucleotide
  Target: ATXN1; (-) strand; PAM type: YTN; PAM sequence: TTA
acacctacaattattagcgt

SEQ ID NO: 175826 - DNA, 20 bp, Artificial Sequence
  Description of Artificial Sequence: Synthetic oligonucleotide
  Target: ATXN1; (-) strand; PAM type: YTN; PAM sequence: TTA
ccattaacacctacaattat

SEQ ID NO: 175827 - DNA, 20 bp, Artificial Sequence
  Description of Artificial Sequence: Synthetic oligonucleotide
  Target: ATXN1; (-) strand; PAM type: YTN; PAM sequence: TTG
ttaccattaacacctacaat

SEQ ID NO: 175828 - DNA, 20 bp, Artificial Sequence
  Description of Artificial Sequence: Synthetic oligonucleotide
  Target: ATXN1; (-) strand; PAM type: YTN; PAM sequence: TTA
taacaaattgttaccattaa

SEQ ID NO: 175829 - DNA, 20 bp, Artificial Sequence
  Description of Artificial Sequence: Synthetic oligonucleotide
  Target: ATXN1; (-) strand; PAM type: YTN; PAM sequence: TTT
ataacaaattgttaccatta

SEQ ID NO: 175830 - DNA, 20 bp, Artificial Sequence
  Description of Artificial Sequence: Synthetic oligonucleotide
  Target: ATXN1; (-) strand; PAM type: YTN; PAM sequence: TTG
tatcatttataacaaattgt

SEQ ID NO: 175831 - DNA, 20 bp, Artificial Sequence
  Description of Artificial Sequence: Synthetic oligonucleotide
  Target: ATXN1; (-) strand; PAM type: YTN; PAM sequence: CTA
aggaacaaatagaaatatgt

SEQ ID NO: 175832 - DNA, 20 bp, Artificial Sequence
  Description of Artificial Sequence: Synthetic oligonucleotide
  Target: ATXN1; (-) strand; PAM type: YTN; PAM sequence: TTG
aaagctaaggaacaaataga

SEQ ID NO: 175833 - DNA, 20 bp, Artificial Sequence
  Description of Artificial Sequence: Synthetic oligonucleotide
  Target: ATXN1; (-) strand; PAM type: YTN; PAM sequence: CTT
gaaagctaaggaacaaatag

SEQ ID NO: 175834 - DNA, 20 bp, Artificial Sequence
  Description of Artificial Sequence: Synthetic oligonucleotide
  Target: ATXN1; (-) strand; PAM type: YTN; PAM sequence: TTC
agaccatgacatcaagcgaa

SEQ ID NO: 175835 - DNA, 20 bp, Artificial Sequence
  Description of Artificial Sequence: Synthetic oligonucleotide
  Target: ATXN1; (-) strand; PAM type: YTN; PAM sequence: TTT
cagaccatgacatcaagcga

SEQ ID NO: 175836 - DNA, 20 bp, Artificial Sequence
  Description of Artificial Sequence: Synthetic oligonucleotide
  Target: ATXN1; (-) strand; PAM type: YTN; PAM sequence: TTG
gccaaatttcagaccatgac

SEQ ID NO: 175837 - DNA, 20 bp, Artificial Sequence
  Description of Artificial Sequence: Synthetic oligonucleotide
  Target: ATXN1; (-) strand; PAM type: YTN; PAM sequence: CTT
ggccaaatttcagaccatga

SEQ ID NO: 175838 - DNA, 20 bp, Artificial Sequence
  Description of Artificial Sequence: Synthetic oligonucleotide
  Target: ATXN1; (-) strand; PAM type: YTN; PAM sequence: CTG
aaaataggaacaccttggcc

SEQ ID NO: 175839 - DNA, 20 bp, Artificial Sequence
  Description of Artificial Sequence: Synthetic oligonucleotide
  Target: ATXN1; (-) strand; PAM type: YTN; PAM sequence: CTG
tgggcatatcgaggcctgaa

SEQ ID NO: 175840 - DNA, 20 bp, Artificial Sequence
  Description of Artificial Sequence: Synthetic oligonucleotide
  Target: ATXN1; (-) strand; PAM type: YTN; PAM sequence: TTC
aatgaaggataaccagggaa

SEQ ID NO: 175841 - DNA, 20 bp, Artificial Sequence
  Description of Artificial Sequence: Synthetic oligonucleotide
  Target: ATXN1; (-) strand; PAM type: YTN; PAM sequence: TTG
gttcaatgaaggataaccag

SEQ ID NO: 175842 - DNA, 20 bp, Artificial Sequence
  Description of Artificial Sequence: Synthetic oligonucleotide
  Target: ATXN1; (-) strand; PAM type: YTN; PAM sequence: CTA
gtaagtggaggagttggttc

SEQ ID NO: 175843 - DNA, 20 bp, Artificial Sequence
  Description of Artificial Sequence: Synthetic oligonucleotide
  Target: ATXN1; (-) strand; PAM type: YTN; PAM sequence: TTG
tacaaagtcacacagctagt

SEQ ID NO: 175844 - DNA, 20 bp, Artificial Sequence
  Description of Artificial Sequence: Synthetic oligonucleotide
  Target: ATXN1; (-) strand; PAM type: YTN; PAM sequence: CTT
gtacaaagtcacacagctag

SEQ ID NO: 175845 - DNA, 20 bp, Artificial Sequence
  Description of Artificial Sequence: Synthetic oligonucleotide
  Target: ATXN1; (-) strand; PAM type: YTN; PAM sequence: TTA
cttgtacaaagtcacacagc

SEQ ID NO: 175846 - DNA, 20 bp, Artificial Sequence
  Description of Artificial Sequence: Synthetic oligonucleotide
  Target: ATXN1; (-) strand; PAM type: YTN; PAM sequence: CTT
acttgtacaaagtcacacag

SEQ ID NO: 175847 - DNA, 20 bp, Artificial Sequence
  Description of Artificial Sequence: Synthetic oligonucleotide
  Target: ATXN1; (-) strand; PAM type: YTN; PAM sequence: TTA
ccttacttgtacaaagtcac

SEQ ID NO: 175848 - DNA, 20 bp, Artificial Sequence
  Description of Artificial Sequence: Synthetic oligonucleotide
  Target: ATXN1; (-) strand; PAM type: YTN; PAM sequence: TTA
gggtgggtggttaccttact

SEQ ID NO: 175849 - DNA, 20 bp, Artificial Sequence
  Description of Artificial Sequence: Synthetic oligonucleotide
  Target: ATXN1; (-) strand; PAM type: YTN; PAM sequence: CTT
agggtgggtggttaccttac

SEQ ID NO: 175850 - DNA, 20 bp, Artificial Sequence
  Description of Artificial Sequence: Synthetic oligonucleotide
  Target: ATXN1; (-) strand; PAM type: YTN; PAM sequence: TTG
gggcttagggtgggtggtta

SEQ ID NO: 175851 - DNA, 20 bp, Artificial Sequence
  Description of Artificial Sequence: Synthetic oligonucleotide
  Target: ATXN1; (-) strand; PAM type: YTN; PAM sequence: TTC
aacagaaaaggaaattgggg

SEQ ID NO: 175852 - DNA, 20 bp, Artificial Sequence
  Description of Artificial Sequence: Synthetic oligonucleotide
  Target: ATXN1; (-) strand; PAM type: YTN; PAM sequence: TTA
ttcaacagaaaaggaaattg

SEQ ID NO: 175853 - DNA, 20 bp, Artificial Sequence
  Description of Artificial Sequence: Synthetic oligonucleotide
  Target: ATXN1; (-) strand; PAM type: YTN; PAM sequence: CTT
attcaacagaaaaggaaatt

SEQ ID NO: 175854 - DNA, 20 bp, Artificial Sequence
  Description of Artificial Sequence: Synthetic oligonucleotide
  Target: ATXN1; (-) strand; PAM type: YTN; PAM sequence: TTA
cccttattcaacagaaaagg

SEQ ID NO: 175855 - DNA, 20 bp, Artificial Sequence
  Description of Artificial Sequence: Synthetic oligonucleotide
  Target: ATXN1; (-) strand; PAM type: YTN; PAM sequence: TTG
taagacatatgtaccatcat

SEQ ID NO: 175856 - DNA, 20 bp, Artificial Sequence
  Description of Artificial Sequence: Synthetic oligonucleotide
  Target: ATXN1; (-) strand; PAM type: YTN; PAM sequence: CTC
atgacagttgtaagacatat

SEQ ID NO: 175857 - DNA, 20 bp, Artificial Sequence
  Description of Artificial Sequence: Synthetic oligonucleotide
  Target: ATXN1; (-) strand; PAM type: YTN; PAM sequence: CTC
aaagaagaaaacaatacaaa

SEQ ID NO: 175858 - DNA, 20 bp, Artificial Sequence
  Description of Artificial Sequence: Synthetic oligonucleotide
  Target: ATXN1; (-) strand; PAM type: YTN; PAM sequence: CTA
ggcaacatagcaagaaccca

SEQ ID NO: 175859 - DNA, 20 bp, Artificial Sequence
  Description of Artificial Sequence: Synthetic oligonucleotide
  Target: ATXN1; (-) strand; PAM type: YTN; PAM sequence: CTA
gcctaggcaacatagcaaga

SEQ ID NO: 175860 - DNA, 20 bp, Artificial Sequence
  Description of Artificial Sequence: Synthetic oligonucleotide
  Target: ATXN1; (-) strand; PAM type: YTN; PAM sequence: TTG
agcctagcctaggcaacata

SEQ ID NO: 175861 - DNA, 20 bp, Artificial Sequence
  Description of Artificial Sequence: Synthetic oligonucleotide
  Target: ATXN1; (-) strand; PAM type: YTN; PAM sequence: TTT
gagcctagcctaggcaacat

SEQ ID NO: 175862 - DNA, 20 bp, Artificial Sequence
  Description of Artificial Sequence: Synthetic oligonucleotide
  Target: ATXN1; (-) strand; PAM type: YTN; PAM sequence: TTG
agccccagagtttgagccta

SEQ ID NO: 175863 - DNA, 20 bp, Artificial Sequence
  Description of Artificial Sequence: Synthetic oligonucleotide
  Target: ATXN1; (-) strand; PAM type: YTN; PAM sequence: CTT
gagccccagagtttgagcct

SEQ ID NO: 175864 - DNA, 20 bp, Artificial Sequence
  Description of Artificial Sequence: Synthetic oligonucleotide
  Target: ATXN1; (-) strand; PAM type: YTN; PAM sequence: CTG
aggcaggaggatcacttgag

SEQ ID NO: 175865 - DNA, 20 bp, Artificial Sequence
  Description of Artificial Sequence: Synthetic oligonucleotide
  Target: ATXN1; (-) strand; PAM type: YTN; PAM sequence: TTG
ggtggctgaggcaggaggat

SEQ ID NO: 175866 - DNA, 20 bp, Artificial Sequence
  Description of Artificial Sequence: Synthetic oligonucleotide
  Target: ATXN1; (-) strand; PAM type: YTN; PAM sequence: CTT
gggtggctgaggcaggagga

SEQ ID NO: 175867 - DNA, 20 bp, Artificial Sequence
  Description of Artificial Sequence: Synthetic oligonucleotide
  Target: ATXN1; (-) strand; PAM type: YTN; PAM sequence: CTA
cttgggtggctgaggcagga

SEQ ID NO: 175868 - DNA, 20 bp, Artificial Sequence
  Description of Artificial Sequence: Synthetic oligonucleotide
  Target: ATXN1; (-) strand; PAM type: YTN; PAM sequence: CTC
ccagctacttgggtggctga

SEQ ID NO: 175869 - DNA, 20 bp, Artificial Sequence
  Description of Artificial Sequence: Synthetic oligonucleotide
  Target: ATXN1; (-) strand; PAM type: YTN; PAM sequence: CTG
tactcccagctacttgggtg

SEQ ID NO: 175870 - DNA, 20 bp, Artificial Sequence
  Description of Artificial Sequence: Synthetic oligonucleotide
  Target: ATXN1; (-) strand; PAM type: YTN; PAM sequence: CTC
atgggaagccatgtgcagtg

SEQ ID NO: 175871 - DNA, 20 bp, Artificial Sequence
  Description of Artificial Sequence: Synthetic oligonucleotide
  Target: ATXN1; (-) strand; PAM type: YTN; PAM sequence: TTC
atcaaaagctcatgggaagc

SEQ ID NO: 175872 - DNA, 20 bp, Artificial Sequence
  Description of Artificial Sequence: Synthetic oligonucleotide
  Target: ATXN1; (-) strand; PAM type: YTN; PAM sequence: TTA
catgcagcagttcatcaaaa

SEQ ID NO: 175873 - DNA, 20 bp, Artificial Sequence
  Description of Artificial Sequence: Synthetic oligonucleotide
  Target: ATXN1; (-) strand; PAM type: YTN; PAM sequence: TTT
acatgcagcagttcatcaaa

SEQ ID NO: 175874 - DNA, 20 bp, Artificial Sequence
  Description of Artificial Sequence: Synthetic oligonucleotide
  Target: ATXN1; (-) strand; PAM type: YTN; PAM sequence: CTA
aaatatttacatgcagcagt

SEQ ID NO: 175875 - DNA, 20 bp, Artificial Sequence
  Description of Artificial Sequence: Synthetic oligonucleotide
  Target: ATXN1; (-) strand; PAM type: YTN; PAM sequence: CTG
tgctaaaatatttacatgca

SEQ ID NO: 175876 - DNA, 20 bp, Artificial Sequence
  Description of Artificial Sequence: Synthetic oligonucleotide
  Target: ATXN1; (-) strand; PAM type: YTN; PAM sequence: TTA
tgtgccaagcactgtgctaa

SEQ ID NO: 175877 - DNA, 20 bp, Artificial Sequence
  Description of Artificial Sequence: Synthetic oligonucleotide
  Target: ATXN1; (-) strand; PAM type: YTN; PAM sequence: TTG
aacatgtattatgtgccaag

SEQ ID NO: 175878 - DNA, 20 bp, Artificial Sequence
  Description of Artificial Sequence: Synthetic oligonucleotide
  Target: ATXN1; (-) strand; PAM type: YTN; PAM sequence: TTA
ttgaacatgtattatgtgcc

SEQ ID NO: 175879 - DNA, 20 bp, Artificial Sequence
  Description of Artificial Sequence: Synthetic oligonucleotide
  Target: ATXN1; (-) strand; PAM type: YTN; PAM sequence: TTT
attgaacatgtattatgtgc

SEQ ID NO: 175880 - DNA, 20 bp, Artificial Sequence
  Description of Artificial Sequence: Synthetic oligonucleotide
  Target: ATXN1; (-) strand; PAM type: YTN; PAM sequence: TTG
gaatagataacatttattga

SEQ ID NO: 175881 - DNA, 20 bp, Artificial Sequence
  Description of Artificial Sequence: Synthetic oligonucleotide
  Target: ATXN1; (-) strand; PAM type: YTN; PAM sequence: TTA
taataatgattggaatagat

SEQ ID NO: 175882 - DNA, 20 bp, Artificial Sequence
  Description of Artificial Sequence: Synthetic oligonucleotide
  Target: ATXN1; (-) strand; PAM type: YTN; PAM sequence: TTA
attataataatgattggaat

SEQ ID NO: 175883 - DNA, 20 bp, Artificial Sequence
  Description of Artificial Sequence: Synthetic oligonucleotide
  Target: ATXN1; (-) strand; PAM type: YTN; PAM sequence: CTA
ttaattataataatgattgg

SEQ ID NO: 175884 - DNA, 20 bp, Artificial Sequence
  Description of Artificial Sequence: Synthetic oligonucleotide
  Target: ATXN1; (-) strand; PAM type: YTN; PAM sequence: TTG
gctattaattataataatga

SEQ ID NO: 175885 - DNA, 20 bp, Artificial Sequence
  Description of Artificial Sequence: Synthetic oligonucleotide
  Target: ATXN1; (-) strand; PAM type: YTN; PAM sequence: CTA
tcataagaataggattggct

SEQ ID NO: 175886 - DNA, 20 bp, Artificial Sequence
  Description of Artificial Sequence: Synthetic oligonucleotide
  Target: ATXN1; (-) strand; PAM type: YTN; PAM sequence: TTA
ccaggcaaatgagtagacag

SEQ ID NO: 175887 - DNA, 20 bp, Artificial Sequence
  Description of Artificial Sequence: Synthetic oligonucleotide
  Target: ATXN1; (-) strand; PAM type: YTN; PAM sequence: TTA
taaaatacaaagagtatatg

SEQ ID NO: 175888 - DNA, 20 bp, Artificial Sequence
  Description of Artificial Sequence: Synthetic oligonucleotide
  Target: ATXN1; (-) strand; PAM type: YTN; PAM sequence: TTT
ataaaatacaaagagtatat

SEQ ID NO: 175889 - DNA, 20 bp, Artificial Sequence
  Description of Artificial Sequence: Synthetic oligonucleotide
  Target: ATXN1; (-) strand; PAM type: YTN; PAM sequence: TTA
atgtatatatttataaaata

SEQ ID NO: 175890 - DNA, 20 bp, Artificial Sequence
  Description of Artificial Sequence: Synthetic oligonucleotide
  Target: ATXN1; (-) strand; PAM type: YTN; PAM sequence: TTA
taaaatatattaatgtatat

SEQ ID NO: 175891 - DNA, 20 bp, Artificial Sequence
  Description of Artificial Sequence: Synthetic oligonucleotide
  Target: ATXN1; (-) strand; PAM type: YTN; PAM sequence: TTT
ataaaatatattaatgtata

SEQ ID NO: 175892 - DNA, 20 bp, Artificial Sequence
  Description of Artificial Sequence: Synthetic oligonucleotide
  Target: ATXN1; (-) strand; PAM type: YTN; PAM sequence: TTA
taaaaatatttataaaatat

SEQ ID NO: 175893 - DNA, 20 bp, Artificial Sequence
  Description of Artificial Sequence: Synthetic oligonucleotide
  Target: ATXN1; (-) strand; PAM type: YTN; PAM sequence: CTC
aaaatattataaaaatattt

SEQ ID NO: 175894 - DNA, 20 bp, Artificial Sequence
  Description of Artificial Sequence: Synthetic oligonucleotide
  Target: ATXN1; (-) strand; PAM type: YTN; PAM sequence: TTA
ctcaaaatattataaaaata

SEQ ID NO: 175895 - DNA, 20 bp, Artificial Sequence
  Description of Artificial Sequence: Synthetic oligonucleotide
  Target: ATXN1; (-) strand; PAM type: YTN; PAM sequence: TTA
aattactcaaaatattataa

SEQ ID NO: 175896 - DNA, 20 bp, Artificial Sequence
  Description of Artificial Sequence: Synthetic oligonucleotide
  Target: ATXN1; (-) strand; PAM type: YTN; PAM sequence: TTT
aaattactcaaaatattata

SEQ ID NO: 175897 - DNA, 20 bp, Artificial Sequence
  Description of Artificial Sequence: Synthetic oligonucleotide
  Target: ATXN1; (-) strand; PAM type: YTN; PAM sequence: TTT
taaattactcaaaatattat

SEQ ID NO: 175898 - DNA, 20 bp, Artificial Sequence
  Description of Artificial Sequence: Synthetic oligonucleotide
  Target: ATXN1; (-) strand; PAM type: YTN; PAM sequence: TTG
ggcattttaaattactcaaa

SEQ ID NO: 175899 - DNA, 20 bp, Artificial Sequence
  Description of Artificial Sequence: Synthetic oligonucleotide
  Target: ATXN1; (-) strand; PAM type: YTN; PAM sequence: TTT
gggcattttaaattactcaa

SEQ ID NO: 175900 - DNA, 20 bp, Artificial Sequence
  Description of Artificial Sequence: Synthetic oligonucleotide
  Target: ATXN1; (-) strand; PAM type: YTN; PAM sequence: TTG
tatcacaagaaaacagccat

SEQ ID NO: 175901 - DNA, 20 bp, Artificial Sequence
  Description of Artificial Sequence: Synthetic oligonucleotide
  Target: ATXN1; (-) strand; PAM type: YTN; PAM sequence: CTC
catggttgtatcacaagaaa

SEQ ID NO: 175902 - DNA, 20 bp, Artificial Sequence
  Description of Artificial Sequence: Synthetic oligonucleotide
  Target: ATXN1; (-) strand; PAM type: YTN; PAM sequence: CTG
gaaagtactccatggttgta

SEQ ID NO: 175903 - DNA, 20 bp, Artificial Sequence
  Description of Artificial Sequence: Synthetic oligonucleotide
  Target: ATXN1; (-) strand; PAM type: YTN; PAM sequence: CTG
ccatacccaccctggaaagt

SEQ ID NO: 175904 - DNA, 20 bp, Artificial Sequence
  Description of Artificial Sequence: Synthetic oligonucleotide
  Target: ATXN1; (-) strand; PAM type: YTN; PAM sequence: TTG
cacactgccatacccaccct

SEQ ID NO: 175905 - DNA, 20 bp, Artificial Sequence
  Description of Artificial Sequence: Synthetic oligonucleotide
  Target: ATXN1; (-) strand; PAM type: YTN; PAM sequence: TTT
gcacactgccatacccaccc

SEQ ID NO: 175906 - DNA, 20 bp, Artificial Sequence
  Description of Artificial Sequence: Synthetic oligonucleotide
  Target: ATXN1; (-) strand; PAM type: YTN; PAM sequence: CTT
tgcacactgccatacccacc

SEQ ID NO: 175907 - DNA, 20 bp, Artificial Sequence
  Description of Artificial Sequence: Synthetic oligonucleotide
  Target: ATXN1; (-) strand; PAM type: YTN; PAM sequence: TTC
ctttgcacactgccataccc

SEQ ID NO: 175908 - DNA, 20 bp, Artificial Sequence
  Description of Artificial Sequence: Synthetic oligonucleotide
  Target: ATXN1; (-) strand; PAM type: YTN; PAM sequence: TTT
cctttgcacactgccatacc

SEQ ID NO: 175909 - DNA, 20 bp, Artificial Sequence
  Description of Artificial Sequence: Synthetic oligonucleotide
  Target: ATXN1; (-) strand; PAM type: YTN; PAM sequence: TTT
tcctttgcacactgccatac

SEQ ID NO: 175910 - DNA, 20 bp, Artificial Sequence
  Description of Artificial Sequence: Synthetic oligonucleotide
  Target: ATXN1; (-) strand; PAM type: YTN; PAM sequence: CTT
ttcctttgcacactgccata

SEQ ID NO: 175911 - DNA, 20 bp, Artificial Sequence
  Description of Artificial Sequence: Synthetic oligonucleotide
  Target: ATXN1; (-) strand; PAM type: YTN; PAM sequence: CTG
cccagggccaggccttttcc

SEQ ID NO: 175912 - DNA, 20 bp, Artificial Sequence
  Description of Artificial Sequence: Synthetic oligonucleotide
  Target: ATXN1; (-) strand; PAM type: YTN; PAM sequence: CTG
aaaatagcactgcccagggc

SEQ ID NO: 175913 - DNA, 20 bp, Artificial Sequence
  Description of Artificial Sequence: Synthetic oligonucleotide
  Target: ATXN1; (-) strand; PAM type: YTN; PAM sequence: CTC
tgaaaatagcactgcccagg

SEQ ID NO: 175914 - DNA, 20 bp, Artificial Sequence
  Description of Artificial Sequence: Synthetic oligonucleotide
  Target: ATXN1; (-) strand; PAM type: YTN; PAM sequence: CTC
acacactctgaaaatagcac

SEQ ID NO: 175915 - DNA, 20 bp, Artificial Sequence
  Description of Artificial Sequence: Synthetic oligonucleotide
  Target: ATXN1; (-) strand; PAM type: YTN; PAM sequence: CTG
gccctcacacactctgaaaa

SEQ ID NO: 175916 - DNA, 20 bp, Artificial Sequence
  Description of Artificial Sequence: Synthetic oligonucleotide
  Target: ATXN1; (-) strand; PAM type: YTN; PAM sequence: TTC
aaagggaaatatgggatgtg

SEQ ID NO: 175917 - DNA, 20 bp, Artificial Sequence
  Description of Artificial Sequence: Synthetic oligonucleotide
  Target: ATXN1; (-) strand; PAM type: YTN; PAM sequence: CTT
caaagggaaatatgggatgt

SEQ ID NO: 175918 - DNA, 20 bp, Artificial Sequence
  Description of Artificial Sequence: Synthetic oligonucleotide
  Target: ATXN1; (-) strand; PAM type: YTN; PAM sequence: TTC
ttcaaagggaaatatgggat

SEQ ID NO: 175919 - DNA, 20 bp, Artificial Sequence
  Description of Artificial Sequence: Synthetic oligonucleotide
  Target: ATXN1; (-) strand; PAM type: YTN; PAM sequence: TTT
cttcaaagggaaatatggga

SEQ ID NO: 175920 - DNA, 20 bp, Artificial Sequence
  Description of Artificial Sequence: Synthetic oligonucleotide
  Target: ATXN1; (-) strand; PAM type: YTN; PAM sequence: CTG
atttcttcaaagggaaatat

SEQ ID NO: 175921 - DNA, 20 bp, Artificial Sequence
  Description of Artificial Sequence: Synthetic oligonucleotide
  Target: ATXN1; (-) strand; PAM type: YTN; PAM sequence: TTG
gctgatttcttcaaagggaa

SEQ ID NO: 175922 - DNA, 20 bp, Artificial Sequence
  Description of Artificial Sequence: Synthetic oligonucleotide
  Target: ATXN1; (-) strand; PAM type: YTN; PAM sequence: TTA
cgttggctgatttcttcaaa

SEQ ID NO: 175923 - DNA, 20 bp, Artificial Sequence
  Description of Artificial Sequence: Synthetic oligonucleotide
  Target: ATXN1; (-) strand; PAM type: YTN; PAM sequence: TTG
ttacgttggctgatttcttc

SEQ ID NO: 175924 - DNA, 20 bp, Artificial Sequence
  Description of Artificial Sequence: Synthetic oligonucleotide
  Target: ATXN1; (-) strand; PAM type: YTN; PAM sequence: CTT
gttacgttggctgatttctt

SEQ ID NO: 175925 - DNA, 20 bp, Artificial Sequence
  Description of Artificial Sequence: Synthetic oligonucleotide
  Target: ATXN1; (-) strand; PAM type: YTN; PAM sequence: TTG
cttgttacgttggctgattt

SEQ ID NO: 175926 - DNA, 20 bp, Artificial Sequence
  Description of Artificial Sequence: Synthetic oligonucleotide
  Target: ATXN1; (-) strand; PAM type: YTN; PAM sequence: TTT
gcttgttacgttggctgatt

SEQ ID NO: 175927 - DNA, 20 bp, Artificial Sequence
  Description of Artificial Sequence: Synthetic oligonucleotide
  Target: ATXN1; (-) strand; PAM type: YTN; PAM sequence: CTT
tgcttgttacgttggctgat

SEQ ID NO: 175928 - DNA, 20 bp, Artificial Sequence
  Description of Artificial Sequence: Synthetic oligonucleotide
  Target: ATXN1; (-) strand; PAM type: YTN; PAM sequence: CTG
gcacctttgcttgttacgtt

SEQ ID NO: 175929 - DNA, 20 bp, Artificial Sequence
  Description of Artificial Sequence: Synthetic oligonucleotide
  Target: ATXN1; (-) strand; PAM type: YTN; PAM sequence: CTC
cctggcacctttgcttgtta

SEQ ID NO: 175930 - DNA, 20 bp, Artificial Sequence
  Description of Artificial Sequence: Synthetic oligonucleotide
  Target: ATXN1; (-) strand; PAM type: YTN; PAM sequence: CTC
aaggcctccctggcaccttt

SEQ ID NO: 175931 - DNA, 20 bp, Artificial Sequence
  Description of Artificial Sequence: Synthetic oligonucleotide
  Target: ATXN1; (-) strand; PAM type: YTN; PAM sequence: CTG
gtaccctcaaggcctccctg

SEQ ID NO: 175932 - DNA, 20 bp, Artificial Sequence
  Description of Artificial Sequence: Synthetic oligonucleotide
  Target: ATXN1; (-) strand; PAM type: YTN; PAM sequence: CTG
tacactggtaccctcaaggc

SEQ ID NO: 175933 - DNA, 20 bp, Artificial Sequence
  Description of Artificial Sequence: Synthetic oligonucleotide
  Target: ATXN1; (-) strand; PAM type: YTN; PAM sequence: CTC
agcatgcacatgtagcagtg

SEQ ID NO: 175934 - DNA, 20 bp, Artificial Sequence
  Description of Artificial Sequence: Synthetic oligonucleotide
  Target: ATXN1; (-) strand; PAM type: YTN; PAM sequence: CTA
gtacacaaaggcagacccgg

SEQ ID NO: 175935 - DNA, 20 bp, Artificial Sequence
  Description of Artificial Sequence: Synthetic oligonucleotide
  Target: ATXN1; (-) strand; PAM type: YTN; PAM sequence: TTC
ccctagtacacaaaggcaga

SEQ ID NO: 175936 - DNA, 20 bp, Artificial Sequence
  Description of Artificial Sequence: Synthetic oligonucleotide
  Target: ATXN1; (-) strand; PAM type: YTN; PAM sequence: CTC
accacacattcccctagtac

SEQ ID NO: 175937 - DNA, 20 bp, Artificial Sequence
  Description of Artificial Sequence: Synthetic oligonucleotide
  Target: ATXN1; (-) strand; PAM type: YTN; PAM sequence: CTC
cagcctcaccacacattccc

SEQ ID NO: 175938 - DNA, 20 bp, Artificial Sequence
  Description of Artificial Sequence: Synthetic oligonucleotide
  Target: ATXN1; (-) strand; PAM type: YTN; PAM sequence: CTG
tcccctccagcctcaccaca

SEQ ID NO: 175939 - DNA, 20 bp, Artificial Sequence
  Description of Artificial Sequence: Synthetic oligonucleotide
  Target: ATXN1; (-) strand; PAM type: YTN; PAM sequence: CTC
tgtcccctccagcctcacca

SEQ ID NO: 175940 - DNA, 20 bp, Artificial Sequence
  Description of Artificial Sequence: Synthetic oligonucleotide
  Target: ATXN1; (-) strand; PAM type: YTN; PAM sequence: CTC
acaggtggccagctctgtcc

SEQ ID NO: 175941 - DNA, 20 bp, Artificial Sequence
  Description of Artificial Sequence: Synthetic oligonucleotide
  Target: ATXN1; (-) strand; PAM type: YTN; PAM sequence: TTC
tcacaggtggccagctctgt

SEQ ID NO: 175942 - DNA, 20 bp, Artificial Sequence
  Description of Artificial Sequence: Synthetic oligonucleotide
  Target: ATXN1; (-) strand; PAM type: YTN; PAM sequence: CTT
ctcacaggtggccagctctg

SEQ ID NO: 175943 - DNA, 20 bp, Artificial Sequence
  Description of Artificial Sequence: Synthetic oligonucleotide
  Target: ATXN1; (-) strand; PAM type: YTN; PAM sequence: CTG
agagtccttctcacaggtgg

SEQ ID NO: 175944 - DNA, 20 bp, Artificial Sequence
  Description of Artificial Sequence: Synthetic oligonucleotide
  Target: ATXN1; (-) strand; PAM type: YTN; PAM sequence: CTG
ccaaatgatgacagcagccc

SEQ ID NO: 175945 - DNA, 20 bp, Artificial Sequence
  Description of Artificial Sequence: Synthetic oligonucleotide
  Target: ATXN1; (-) strand; PAM type: YTN; PAM sequence: CTC
tgccaaatgatgacagcagc

SEQ ID NO: 175946 - DNA, 20 bp, Artificial Sequence
  Description of Artificial Sequence: Synthetic oligonucleotide
  Target: ATXN1; (-) strand; PAM type: YTN; PAM sequence: TTG
gagtagaaggatggactctg

SEQ ID NO: 175947 - DNA, 20 bp, Artificial Sequence
  Description of Artificial Sequence: Synthetic oligonucleotide
  Target: ATXN1; (-) strand; PAM type: YTN; PAM sequence: TTG
ggttggagtagaaggatgga

SEQ ID NO: 175948 - DNA, 20 bp, Artificial Sequence
  Description of Artificial Sequence: Synthetic oligonucleotide
  Target: ATXN1; (-) strand; PAM type: YTN; PAM sequence: CTG
agagtgaggttgggttggag

SEQ ID NO: 175949 - DNA, 20 bp, Artificial Sequence
  Description of Artificial Sequence: Synthetic oligonucleotide
  Target: ATXN1; (-) strand; PAM type: YTN; PAM sequence: CTC
cctgagagtgaggttgggtt

SEQ ID NO: 175950 - DNA, 20 bp, Artificial Sequence
  Description of Artificial Sequence: Synthetic oligonucleotide
  Target: ATXN1; (-) strand; PAM type: YTN; PAM sequence: CTC
atccgtcccctccctgagag

SEQ ID NO: 175951 - DNA, 20 bp, Artificial Sequence
  Description of Artificial Sequence: Synthetic oligonucleotide
  Target: ATXN1; (-) strand; PAM type: YTN; PAM sequence: CTG
tagatgataggatgagcggt

SEQ ID NO: 175952 - DNA, 20 bp, Artificial Sequence
  Description of Artificial Sequence: Synthetic oligonucleotide
  Target: ATXN1; (-) strand; PAM type: YTN; PAM sequence: TTA
aaaaccctgtagatgatagg

SEQ ID NO: 175953 - DNA, 20 bp, Artificial Sequence
  Description of Artificial Sequence: Synthetic oligonucleotide
  Target: ATXN1; (-) strand; PAM type: YTN; PAM sequence: TTT
aaaaaccctgtagatgatag

SEQ ID NO: 175954 - DNA, 20 bp, Artificial Sequence
  Description of Artificial Sequence: Synthetic oligonucleotide
  Target: ATXN1; (-) strand; PAM type: YTN; PAM sequence: CTT
taaaaaccctgtagatgata

SEQ ID NO: 175955 - DNA, 20 bp, Artificial Sequence
  Description of Artificial Sequence: Synthetic oligonucleotide
  Target: ATXN1; (-) strand; PAM type: YTN; PAM sequence: CTC
ggatcatggccacccaggcc

SEQ ID NO: 175956 - DNA, 20 bp, Artificial Sequence
  Description of Artificial Sequence: Synthetic oligonucleotide
  Target: ATXN1; (-) strand; PAM type: YTN; PAM sequence: CTG
tgcaccagaacaaaatgccc

SEQ ID NO: 175957 - DNA, 20 bp, Artificial Sequence
  Description of Artificial Sequence: Synthetic oligonucleotide
  Target: ATXN1; (-) strand; PAM type: YTN; PAM sequence: TTG
tatctgtgcaccagaacaaa

SEQ ID NO: 175958 - DNA, 20 bp, Artificial Sequence
  Description of Artificial Sequence: Synthetic oligonucleotide
  Target: ATXN1; (-) strand; PAM type: YTN; PAM sequence: TTT
gtatctgtgcaccagaacaa

SEQ ID NO: 175959 - DNA, 20 bp, Artificial Sequence
  Description of Artificial Sequence: Synthetic oligonucleotide
  Target: ATXN1; (-) strand; PAM type: YTN; PAM sequence: CTT
tgtatctgtgcaccagaaca

SEQ ID NO: 175960 - DNA, 20 bp, Artificial Sequence
  Description of Artificial Sequence: Synthetic oligonucleotide
  Target: ATXN1; (-) strand; PAM type: YTN; PAM sequence: CTC
cccatccccagtctttgtat

SEQ ID NO: 175961 - DNA, 20 bp, Artificial Sequence
  Description of Artificial Sequence: Synthetic oligonucleotide
  Target: ATXN1; (-) strand; PAM type: YTN; PAM sequence: CTG
tcctccccatccccagtctt

SEQ ID NO: 175962 - DNA, 20 bp, Artificial Sequence
  Description of Artificial Sequence: Synthetic oligonucleotide
  Target: ATXN1; (-) strand; PAM type: YTN; PAM sequence: TTA
ctgtcctccccatccccagt

SEQ ID NO: 175963 - DNA, 20 bp, Artificial Sequence
  Description of Artificial Sequence: Synthetic oligonucleotide
  Target: ATXN1; (-) strand; PAM type: YTN; PAM sequence: TTG
tataaaagattactgtcctc

SEQ ID NO: 175964 - DNA, 20 bp, Artificial Sequence
  Description of Artificial Sequence: Synthetic oligonucleotide
  Target: ATXN1; (-) strand; PAM type: YTN; PAM sequence: CTT
gtataaaagattactgtcct

SEQ ID NO: 175965 - DNA, 20 bp, Artificial Sequence
  Description of Artificial Sequence: Synthetic oligonucleotide
  Target: ATXN1; (-) strand; PAM type: YTN; PAM sequence: TTC
atgtgtccttgtataaaaga

SEQ ID NO: 175966 - DNA, 20 bp, Artificial Sequence
  Description of Artificial Sequence: Synthetic oligonucleotide
  Target: ATXN1; (-) strand; PAM type: YTN; PAM sequence: CTA
aggcaccagtgtggtggttc

SEQ ID NO: 175967 - DNA, 20 bp, Artificial Sequence
  Description of Artificial Sequence: Synthetic oligonucleotide
  Target: ATXN1; (-) strand; PAM type: YTN; PAM sequence: CTC
taaggcaccagtgtggtggt

SEQ ID NO: 175968 - DNA, 20 bp, Artificial Sequence
  Description of Artificial Sequence: Synthetic oligonucleotide
  Target: ATXN1; (-) strand; PAM type: YTN; PAM sequence: TTC
tctaaggcaccagtgtggtg

SEQ ID NO: 175969 - DNA, 20 bp, Artificial Sequence
  Description of Artificial Sequence: Synthetic oligonucleotide
  Target: ATXN1; (-) strand; PAM type: YTN; PAM sequence: CTA
tgttctctaaggcaccagtg

SEQ ID NO: 175970 - DNA, 20 bp, Artificial Sequence
  Description of Artificial Sequence: Synthetic oligonucleotide
  Target: ATXN1; (-) strand; PAM type: YTN; PAM sequence: TTG
cctatgttctctaaggcacc

SEQ ID NO: 175971 - DNA, 20 bp, Artificial Sequence
  Description of Artificial Sequence: Synthetic oligonucleotide
  Target: ATXN1; (-) strand; PAM type: YTN; PAM sequence: TTC
gttgcctatgttctctaagg

SEQ ID NO: 175972 - DNA, 20 bp, Artificial Sequence
  Description of Artificial Sequence: Synthetic oligonucleotide
  Target: ATXN1; (-) strand; PAM type: YTN; PAM sequence: CTG
cagcagagtattcgttgcct

SEQ ID NO: 175973 - DNA, 20 bp, Artificial Sequence
  Description of Artificial Sequence: Synthetic oligonucleotide
  Target: ATXN1; (-) strand; PAM type: YTN; PAM sequence: TTA
tgctgcagcagagtattcgt

SEQ ID NO: 175974 - DNA, 20 bp, Artificial Sequence
  Description of Artificial Sequence: Synthetic oligonucleotide
  Target: ATXN1; (-) strand; PAM type: YTN; PAM sequence: CTT
atgctgcagcagagtattcg

SEQ ID NO: 175975 - DNA, 20 bp, Artificial Sequence
  Description of Artificial Sequence: Synthetic oligonucleotide
  Target: ATXN1; (-) strand; PAM type: YTN; PAM sequence: TTC
gatcacttatgctgcagcag

SEQ ID NO: 175976 - DNA, 20 bp, Artificial Sequence
  Description of Artificial Sequence: Synthetic oligonucleotide
  Target: ATXN1; (-) strand; PAM type: YTN; PAM sequence: TTT
cgatcacttatgctgcagca

SEQ ID NO: 175977 - DNA, 20 bp, Artificial Sequence
  Description of Artificial Sequence: Synthetic oligonucleotide
  Target: ATXN1; (-) strand; PAM type: YTN; PAM sequence: CTT
tcgatcacttatgctgcagc

SEQ ID NO: 175978 - DNA, 20 bp, Artificial Sequence
  Description of Artificial Sequence: Synthetic oligonucleotide
  Target: ATXN1; (-) strand; PAM type: YTN; PAM sequence: TTA
acgtgtgactttcgatcact

SEQ ID NO: 175979 - DNA, 20 bp, Artificial Sequence
  Description of Artificial Sequence: Synthetic oligonucleotide
  Target: ATXN1; (-) strand; PAM type: YTN; PAM sequence: TTG
cattaacgtgtgactttcga

SEQ ID NO: 175980 - DNA, 20 bp, Artificial Sequence
  Description of Artificial Sequence: Synthetic oligonucleotide
  Target: ATXN1; (-) strand; PAM type: YTN; PAM sequence: TTT
gcattaacgtgtgactttcg

SEQ ID NO: 175981 - DNA, 20 bp, Artificial Sequence
  Description of Artificial Sequence: Synthetic oligonucleotide
  Target: ATXN1; (-) strand; PAM type: YTN; PAM sequence: TTA
cataatttgcattaacgtgt

SEQ ID NO: 175982 - DNA, 20 bp, Artificial Sequence
  Description of Artificial Sequence: Synthetic oligonucleotide
  Target: ATXN1; (-) strand; PAM type: YTN; PAM sequence: TTT
acataatttgcattaacgtg

SEQ ID NO: 175983 - DNA, 20 bp, Artificial Sequence
  Description of Artificial Sequence: Synthetic oligonucleotide
  Target: ATXN1; (-) strand; PAM type: YTN; PAM sequence: TTA
gtgaggatttacataatttg

SEQ ID NO: 175984 - DNA, 20 bp, Artificial Sequence
  Description of Artificial Sequence: Synthetic oligonucleotide
  Target: ATXN1; (-) strand; PAM type: YTN; PAM sequence: TTT
agtgaggatttacataattt

SEQ ID NO: 175985 - DNA, 20 bp, Artificial Sequence
  Description of Artificial Sequence: Synthetic oligonucleotide
  Target: ATXN1; (-) strand; PAM type: YTN; PAM sequence: TTC
aaatcatttagtgaggattt

SEQ ID NO: 175986 - DNA, 20 bp, Artificial Sequence
  Description of Artificial Sequence: Synthetic oligonucleotide
  Target: ATXN1; (-) strand; PAM type: YTN; PAM sequence: CTA
ttcaaatcatttagtgagga

SEQ ID NO: 175987 - DNA, 20 bp, Artificial Sequence
  Description of Artificial Sequence: Synthetic oligonucleotide
  Target: ATXN1; (-) strand; PAM type: YTN; PAM sequence: TTC
tattcaaatcatttagtgag

SEQ ID NO: 175988 - DNA, 20 bp, Artificial Sequence
  Description of Artificial Sequence: Synthetic oligonucleotide
  Target: ATXN1; (-) strand; PAM type: YTN; PAM sequence: TTT
ctattcaaatcatttagtga

SEQ ID NO: 175989 - DNA, 20 bp, Artificial Sequence
  Description of Artificial Sequence: Synthetic oligonucleotide
  Target: ATXN1; (-) strand; PAM type: YTN; PAM sequence: CTT
tctattcaaatcatttagtg

SEQ ID NO: 175990 - DNA, 20 bp, Artificial Sequence
  Description of Artificial Sequence: Synthetic oligonucleotide
  Target: ATXN1; (-) strand; PAM type: YTN; PAM sequence: TTC
ctttctattcaaatcattta

SEQ ID NO: 175991 - DNA, 20 bp, Artificial Sequence
  Description of Artificial Sequence: Synthetic oligonucleotide
  Target: ATXN1; (-) strand; PAM type: YTN; PAM sequence: TTT
cctttctattcaaatcattt

SEQ ID NO: 175992 - DNA, 20 bp, Artificial Sequence
  Description of Artificial Sequence: Synthetic oligonucleotide
  Target: ATXN1; (-) strand; PAM type: YTN; PAM sequence: CTA
tggtgatttcctttctattc

SEQ ID NO: 175993 - DNA, 20 bp, Artificial Sequence
  Description of Artificial Sequence: Synthetic oligonucleotide
  Target: ATXN1; (-) strand; PAM type: YTN; PAM sequence: TTA
tggagaacagtggtgctatg

SEQ ID NO: 175994 - DNA, 20 bp, Artificial Sequence
  Description of Artificial Sequence: Synthetic oligonucleotide
  Target: ATXN1; (-) strand; PAM type: YTN; PAM sequence: CTC
acgttatggagaacagtggt

SEQ ID NO: 175995 - DNA, 20 bp, Artificial Sequence
  Description of Artificial Sequence: Synthetic oligonucleotide
  Target: ATXN1; (-) strand; PAM type: YTN; PAM sequence: CTG
cagctcacgttatggagaac

SEQ ID NO: 175996 - DNA, 20 bp, Artificial Sequence
  Description of Artificial Sequence: Synthetic oligonucleotide
  Target: ATXN1; (-) strand; PAM type: YTN; PAM sequence: CTC
ataccggggaagtaaaatgc

SEQ ID NO: 175997 - DNA, 20 bp, Artificial Sequence
  Description of Artificial Sequence: Synthetic oligonucleotide
  Target: ATXN1; (-) strand; PAM type: YTN; PAM sequence: CTG
ccctcataccggggaagtaa

SEQ ID NO: 175998 - DNA, 20 bp, Artificial Sequence
  Description of Artificial Sequence: Synthetic oligonucleotide
  Target: ATXN1; (-) strand; PAM type: YTN; PAM sequence: CTA
gctgccctcataccggggaa

SEQ ID NO: 175999 - DNA, 20 bp, Artificial Sequence
  Description of Artificial Sequence: Synthetic oligonucleotide
  Target: ATXN1; (-) strand; PAM type: YTN; PAM sequence: CTC
tagctgccctcataccgggg

SEQ ID NO: 176000 - DNA, 20 bp, Artificial Sequence
  Description of Artificial Sequence: Synthetic oligonucleotide
  Target: ATXN1; (-) strand; PAM type: YTN; PAM sequence: CTC
tctagctgccctcataccgg

SEQ ID NO: 176001 - DNA, 20 bp, Artificial Sequence
  Description of Artificial Sequence: Synthetic oligonucleotide
  Target: ATXN1; (-) strand; PAM type: YTN; PAM sequence: CTG
aaggtccccagagacagtga

SEQ ID NO: 176002 - DNA, 20 bp, Artificial Sequence
  Description of Artificial Sequence: Synthetic oligonucleotide
  Target: ATXN1; (-) strand; PAM type: YTN; PAM sequence: TTG
tctgaaggtccccagagaca

SEQ ID NO: 176003 - DNA, 20 bp, Artificial Sequence
  Description of Artificial Sequence: Synthetic oligonucleotide
  Target: ATXN1; (-) strand; PAM type: YTN; PAM sequence: TTT
gtctgaaggtccccagagac

SEQ ID NO: 176004 - DNA, 20 bp, Artificial Sequence
  Description of Artificial Sequence: Synthetic oligonucleotide
  Target: ATXN1; (-) strand; PAM type: YTN; PAM sequence: CTA
atttgtctgaaggtccccag

SEQ ID NO: 176005 - DNA, 20 bp, Artificial Sequence
  Description of Artificial Sequence: Synthetic oligonucleotide
  Target: ATXN1; (-) strand; PAM type: YTN; PAM sequence: TTC
acaagatagctaatttgtct

SEQ ID NO: 176006 - DNA, 20 bp, Artificial Sequence
  Description of Artificial Sequence: Synthetic oligonucleotide
  Target: ATXN1; (-) strand; PAM type: YTN; PAM sequence: CTG
ttcacaagatagctaatttg

SEQ ID NO: 176007 - DNA, 20 bp, Artificial Sequence
  Description of Artificial Sequence: Synthetic oligonucleotide
  Target: ATXN1; (-) strand; PAM type: YTN; PAM sequence: CTG
ggactgttcacaagatagct

SEQ ID NO: 176008 - DNA, 20 bp, Artificial Sequence
  Description of Artificial Sequence: Synthetic oligonucleotide
  Target: ATXN1; (-) strand; PAM type: YTN; PAM sequence: TTG
gcatcctgggactgttcaca

SEQ ID NO: 176009 - DNA, 20 bp, Artificial Sequence
  Description of Artificial Sequence: Synthetic oligonucleotide
  Target: ATXN1; (-) strand; PAM type: YTN; PAM sequence: TTA
gaaagttggcatcctgggac

SEQ ID NO: 176010 - DNA, 20 bp, Artificial Sequence
  Description of Artificial Sequence: Synthetic oligonucleotide
  Target: ATXN1; (-) strand; PAM type: YTN; PAM sequence: TTT
agaaagttggcatcctggga

SEQ ID NO: 176011 - DNA, 20 bp, Artificial Sequence
  Description of Artificial Sequence: Synthetic oligonucleotide
  Target: ATXN1; (-) strand; PAM type: YTN; PAM sequence: TTA
tttagaaagttggcatcctg

SEQ ID NO: 176012 - DNA, 20 bp, Artificial Sequence
  Description of Artificial Sequence: Synthetic oligonucleotide
  Target: ATXN1; (-) strand; PAM type: YTN; PAM sequence: TTT
atttagaaagttggcatcct

SEQ ID NO: 176013 - DNA, 20 bp, Artificial Sequence
  Description of Artificial Sequence: Synthetic oligonucleotide
  Target: ATXN1; (-) strand; PAM type: YTN; PAM sequence: TTG
atgtttatttagaaagttgg

SEQ ID NO: 176014 - DNA, 20 bp, Artificial Sequence
  Description of Artificial Sequence: Synthetic oligonucleotide
  Target: ATXN1; (-) strand; PAM type: YTN; PAM sequence: TTT
gatgtttatttagaaagttg

SEQ ID NO: 176015 - DNA, 20 bp, Artificial Sequence
  Description of Artificial Sequence: Synthetic oligonucleotide
  Target: ATXN1; (-) strand; PAM type: YTN; PAM sequence: TTT
tgatgtttatttagaaagtt

SEQ ID NO: 176016 - DNA, 20 bp, Artificial Sequence
  Description of Artificial Sequence: Synthetic oligonucleotide
  Target: ATXN1; (-) strand; PAM type: YTN; PAM sequence: TTA
agtgatacagacagtaaatg

SEQ ID NO: 176017 - DNA, 20 bp, Artificial Sequence
  Description of Artificial Sequence: Synthetic oligonucleotide
  Target: ATXN1; (-) strand; PAM type: YTN; PAM sequence: CTT
aagtgatacagacagtaaat

SEQ ID NO: 176018 - DNA, 20 bp, Artificial Sequence
  Description of Artificial Sequence: Synthetic oligonucleotide
  Target: ATXN1; (-) strand; PAM type: YTN; PAM sequence: CTC
ttaagtgatacagacagtaa

SEQ ID NO: 176019 - DNA, 20 bp, Artificial Sequence
  Description of Artificial Sequence: Synthetic oligonucleotide
  Target: ATXN1; (-) strand; PAM type: YTN; PAM sequence: CTC
aacctcttaagtgatacaga

SEQ ID NO: 176020 - DNA, 20 bp, Artificial Sequence
  Description of Artificial Sequence: Synthetic oligonucleotide
  Target: ATXN1; (-) strand; PAM type: YTN; PAM sequence: TTC
tcaacctcttaagtgataca

SEQ ID NO: 176021 - DNA, 20 bp, Artificial Sequence
  Description of Artificial Sequence: Synthetic oligonucleotide
  Target: ATXN1; (-) strand; PAM type: YTN; PAM sequence: CTC
cattctcaacctcttaagtg

SEQ ID NO: 176022 - DNA, 20 bp, Artificial Sequence
  Description of Artificial Sequence: Synthetic oligonucleotide
  Target: ATXN1; (-) strand; PAM type: YTN; PAM sequence: CTC
ccccctccattctcaacctc

SEQ ID NO: 176023 - DNA, 20 bp, Artificial Sequence
  Description of Artificial Sequence: Synthetic oligonucleotide
  Target: ATXN1; (-) strand; PAM type: YTN; PAM sequence: TTA
ggctcccccctccattctca

SEQ ID NO: 176024 - DNA, 20 bp, Artificial Sequence
  Description of Artificial Sequence: Synthetic oligonucleotide
  Target: ATXN1; (-) strand; PAM type: YTN; PAM sequence: TTG
cagttaggctcccccctcca

SEQ ID NO: 176025 - DNA, 20 bp, Artificial Sequence
  Description of Artificial Sequence: Synthetic oligonucleotide
  Target: ATXN1; (-) strand; PAM type: YTN; PAM sequence: TTT
gcagttaggctcccccctcc

SEQ ID NO: 176026 - DNA, 20 bp, Artificial Sequence
  Description of Artificial Sequence: Synthetic oligonucleotide
  Target: ATXN1; (-) strand; PAM type: YTN; PAM sequence: TTA
aataaaaacacgcaaatgtt

SEQ ID NO: 176027 - DNA, 20 bp, Artificial Sequence
  Description of Artificial Sequence: Synthetic oligonucleotide
  Target: ATXN1; (-) strand; PAM type: YTN; PAM sequence: TTG
ttaaataaaaacacgcaaat

SEQ ID NO: 176028 - DNA, 20 bp, Artificial Sequence
  Description of Artificial Sequence: Synthetic oligonucleotide
  Target: ATXN1; (-) strand; PAM type: YTN; PAM sequence: CTA
ttgttaaataaaaacacgca

SEQ ID NO: 176029 - DNA, 20 bp, Artificial Sequence
  Description of Artificial Sequence: Synthetic oligonucleotide
  Target: ATXN1; (-) strand; PAM type: YTN; PAM sequence: CTA
agctattgttaaataaaaac

SEQ ID NO: 176030 - DNA, 20 bp, Artificial Sequence
  Description of Artificial Sequence: Synthetic oligonucleotide
  Target: ATXN1; (-) strand; PAM type: YTN; PAM sequence: CTA
atagctaagctattgttaaa

SEQ ID NO: 176031 - DNA, 20 bp, Artificial Sequence
  Description of Artificial Sequence: Synthetic oligonucleotide
  Target: ATXN1; (-) strand; PAM type: YTN; PAM sequence: TTG
tctaatagctaagctattgt

SEQ ID NO: 176032 - DNA, 20 bp, Artificial Sequence
  Description of Artificial Sequence: Synthetic oligonucleotide
  Target: ATXN1; (-) strand; PAM type: YTN; PAM sequence: CTA
tattgtctaatagctaagct

SEQ ID NO: 176033 - DNA, 20 bp, Artificial Sequence
  Description of Artificial Sequence: Synthetic oligonucleotide
  Target: ATXN1; (-) strand; PAM type: YTN; PAM sequence: CTC
tatattgtctaatagctaag

SEQ ID NO: 176034 - DNA, 20 bp, Artificial Sequence
  Description of Artificial Sequence: Synthetic oligonucleotide
  Target: ATXN1; (-) strand; PAM type: YTN; PAM sequence: CTA
atactctatattgtctaata

SEQ ID NO: 176035 - DNA, 20 bp, Artificial Sequence
  Description of Artificial Sequence: Synthetic oligonucleotide
  Target: ATXN1; (-) strand; PAM type: YTN; PAM sequence: TTC
taatactctatattgtctaa

SEQ ID NO: 176036 - DNA, 20 bp, Artificial Sequence
  Description of Artificial Sequence: Synthetic oligonucleotide
  Target: ATXN1; (-) strand; PAM type: YTN; PAM sequence: TTT
ctaatactctatattgtcta

SEQ ID NO: 176037 - DNA, 20 bp, Artificial Sequence
  Description of Artificial Sequence: Synthetic oligonucleotide
  Target: ATXN1; (-) strand; PAM type: YTN; PAM sequence: CTT
tctaatactctatattgtct

SEQ ID NO: 176038 - DNA, 20 bp, Artificial Sequence
  Description of Artificial Sequence: Synthetic oligonucleotide
  Target: ATXN1; (-) strand; PAM type: YTN; PAM sequence: CTA
agacagtctttctaatactc

SEQ ID NO: 176039 - DNA, 20 bp, Artificial Sequence
  Description of Artificial Sequence: Synthetic oligonucleotide
  Target: ATXN1; (-) strand; PAM type: YTN; PAM sequence: TTC
taagacagtctttctaatac

SEQ ID NO: 176040 - DNA, 20 bp, Artificial Sequence
  Description of Artificial Sequence: Synthetic oligonucleotide
  Target: ATXN1; (-) strand; PAM type: YTN; PAM sequence: CTT
ctaagacagtctttctaata

SEQ ID NO: 176041 - DNA, 20 bp, Artificial Sequence
  Description of Artificial Sequence: Synthetic oligonucleotide
  Target: ATXN1; (-) strand; PAM type: YTN; PAM sequence: TTC
agtcttctaagacagtcttt

SEQ ID NO: 176042 - DNA, 20 bp, Artificial Sequence
  Description of Artificial Sequence: Synthetic oligonucleotide
  Target: ATXN1; (-) strand; PAM type: YTN; PAM sequence: CTT
cagtcttctaagacagtctt

SEQ ID NO: 176043 - DNA, 20 bp, Artificial Sequence
  Description of Artificial Sequence: Synthetic oligonucleotide
  Target: ATXN1; (-) strand; PAM type: YTN; PAM sequence: CTC
ttcagtcttctaagacagtc

SEQ ID NO: 176044 - DNA, 20 bp, Artificial Sequence
  Description of Artificial Sequence: Synthetic oligonucleotide
  Target: ATXN1; (-) strand; PAM type: YTN; PAM sequence: TTC
acctcttcagtcttctaaga

SEQ ID NO: 176045 - DNA, 20 bp, Artificial Sequence
  Description of Artificial Sequence: Synthetic oligonucleotide
  Target: ATXN1; (-) strand; PAM type: YTN; PAM sequence: CTT
cacctcttcagtcttctaag

SEQ ID NO: 176046 - DNA, 20 bp, Artificial Sequence
  Description of Artificial Sequence: Synthetic oligonucleotide
  Target: ATXN1; (-) strand; PAM type: YTN; PAM sequence: CTC
agaacaccagcttcacctct

SEQ ID NO: 176047 - DNA, 20 bp, Artificial Sequence
  Description of Artificial Sequence: Synthetic oligonucleotide
  Target: ATXN1; (-) strand; PAM type: YTN; PAM sequence: CTG
tgtagacatactcagaacac

SEQ ID NO: 176048 - DNA, 20 bp, Artificial Sequence
  Description of Artificial Sequence: Synthetic oligonucleotide
  Target: ATXN1; (-) strand; PAM type: YTN; PAM sequence: CTA
tgcaggctgtgtagacatac

SEQ ID NO: 176049 - DNA, 20 bp, Artificial Sequence
  Description of Artificial Sequence: Synthetic oligonucleotide
  Target: ATXN1; (-) strand; PAM type: YTN; PAM sequence: CTC
tatgcaggctgtgtagacat

SEQ ID NO: 176050 - DNA, 20 bp, Artificial Sequence
  Description of Artificial Sequence: Synthetic oligonucleotide
  Target: ATXN1; (-) strand; PAM type: YTN; PAM sequence: CTG
cctctatgcaggctgtgtag

SEQ ID NO: 176051 - DNA, 20 bp, Artificial Sequence
  Description of Artificial Sequence: Synthetic oligonucleotide
  Target: ATXN1; (-) strand; PAM type: YTN; PAM sequence: TTA
tatacatctgcctctatgca

SEQ ID NO: 176052 - DNA, 20 bp, Artificial Sequence
  Description of Artificial Sequence: Synthetic oligonucleotide
  Target: ATXN1; (-) strand; PAM type: YTN; PAM sequence: TTT
atatacatctgcctctatgc

SEQ ID NO: 176053 - DNA, 20 bp, Artificial Sequence
  Description of Artificial Sequence: Synthetic oligonucleotide
  Target: ATXN1; (-) strand; PAM type: YTN; PAM sequence: TTA
ggcagagtaacatgatcatt

SEQ ID NO: 176054 - DNA, 20 bp, Artificial Sequence
  Description of Artificial Sequence: Synthetic oligonucleotide
  Target: ATXN1; (-) strand; PAM type: YTN; PAM sequence: TTT
aggcagagtaacatgatcat

SEQ ID NO: 176055 - DNA, 20 bp, Artificial Sequence
  Description of Artificial Sequence: Synthetic oligonucleotide
  Target: ATXN1; (-) strand; PAM type: YTN; PAM sequence: TTT
taggcagagtaacatgatca

SEQ ID NO: 176056 - DNA, 20 bp, Artificial Sequence
  Description of Artificial Sequence: Synthetic oligonucleotide
  Target: ATXN1; (-) strand; PAM type: YTN; PAM sequence: TTA
tccattttaggcagagtaac

SEQ ID NO: 176057 - DNA, 20 bp, Artificial Sequence
  Description of Artificial Sequence: Synthetic oligonucleotide
  Target: ATXN1; (-) strand; PAM type: YTN; PAM sequence: TTT
atccattttaggcagagtaa

SEQ ID NO: 176058 - DNA, 20 bp, Artificial Sequence
  Description of Artificial Sequence: Synthetic oligonucleotide
  Target: ATXN1; (-) strand; PAM type: YTN; PAM sequence: TTT
tatccattttaggcagagta

SEQ ID NO: 176059 - DNA, 20 bp, Artificial Sequence
  Description of Artificial Sequence: Synthetic oligonucleotide
  Target: ATXN1; (-) strand; PAM type: YTN; PAM sequence: TTC
cgagttttatccattttagg

SEQ ID NO: 176060 - DNA, 20 bp, Artificial Sequence
  Description of Artificial Sequence: Synthetic oligonucleotide
  Target: ATXN1; (-) strand; PAM type: YTN; PAM sequence: TTG
ttccgagttttatccatttt

SEQ ID NO: 176061 - DNA, 20 bp, Artificial Sequence
  Description of Artificial Sequence: Synthetic oligonucleotide
  Target: ATXN1; (-) strand; PAM type: YTN; PAM sequence: TTT
gttccgagttttatccattt

SEQ ID NO: 176062 - DNA, 20 bp, Artificial Sequence
  Description of Artificial Sequence: Synthetic oligonucleotide
  Target: ATXN1; (-) strand; PAM type: YTN; PAM sequence: TTT
tgttccgagttttatccatt

SEQ ID NO: 176063 - DNA, 20 bp, Artificial Sequence
  Description of Artificial Sequence: Synthetic oligonucleotide
  Target: ATXN1; (-) strand; PAM type: YTN; PAM sequence: TTG
ttttgttccgagttttatcc

SEQ ID NO: 176064 - DNA, 20 bp, Artificial Sequence
  Description of Artificial Sequence: Synthetic oligonucleotide
  Target: ATXN1; (-) strand; PAM type: YTN; PAM sequence: CTA
aatgtggattgttttgttcc

SEQ ID NO: 176065 - DNA, 20 bp, Artificial Sequence
  Description of Artificial Sequence: Synthetic oligonucleotide
  Target: ATXN1; (-) strand; PAM type: YTN; PAM sequence: TTA
ctaaatgtggattgttttgt

SEQ ID NO: 176066 - DNA, 20 bp, Artificial Sequence
  Description of Artificial Sequence: Synthetic oligonucleotide
  Target: ATXN1; (-) strand; PAM type: YTN; PAM sequence: TTC
agggtattactaaatgtgga

SEQ ID NO: 176067 - DNA, 20 bp, Artificial Sequence
  Description of Artificial Sequence: Synthetic oligonucleotide
  Target: ATXN1; (-) strand; PAM type: YTN; PAM sequence: CTT
cagggtattactaaatgtgg

SEQ ID NO: 176068 - DNA, 20 bp, Artificial Sequence
  Description of Artificial Sequence: Synthetic oligonucleotide
  Target: ATXN1; (-) strand; PAM type: YTN; PAM sequence: TTA
gagtcagcttcagggtatta

SEQ ID NO: 176069 - DNA, 20 bp, Artificial Sequence
  Description of Artificial Sequence: Synthetic oligonucleotide
  Target: ATXN1; (-) strand; PAM type: YTN; PAM sequence: TTG
tcacagtgaatacaaattag

SEQ ID NO: 176070 - DNA, 20 bp, Artificial Sequence
  Description of Artificial Sequence: Synthetic oligonucleotide
  Target: ATXN1; (-) strand; PAM type: YTN; PAM sequence: TTG
aaagtaaggagttgtcacag

SEQ ID NO: 176071 - DNA, 20 bp, Artificial Sequence
  Description of Artificial Sequence: Synthetic oligonucleotide
  Target: ATXN1; (-) strand; PAM type: YTN; PAM sequence: TTT
gaaagtaaggagttgtcaca

SEQ ID NO: 176072 - DNA, 20 bp, Artificial Sequence
  Description of Artificial Sequence: Synthetic oligonucleotide
  Target: ATXN1; (-) strand; PAM type: YTN; PAM sequence: TTC
agatttgaaagtaaggagtt

SEQ ID NO: 176073 - DNA, 20 bp, Artificial Sequence
  Description of Artificial Sequence: Synthetic oligonucleotide
  Target: ATXN1; (-) strand; PAM type: YTN; PAM sequence: CTT
cagatttgaaagtaaggagt

SEQ ID NO: 176074 - DNA, 20 bp, Artificial Sequence
  Description of Artificial Sequence: Synthetic oligonucleotide
  Target: ATXN1; (-) strand; PAM type: YTN; PAM sequence: TTA
cttcagatttgaaagtaagg

SEQ ID NO: 176075 - DNA, 20 bp, Artificial Sequence
  Description of Artificial Sequence: Synthetic oligonucleotide
  Target: ATXN1; (-) strand; PAM type: YTN; PAM sequence: CTA
ataattacttcagatttgaa

SEQ ID NO: 176076 - DNA, 20 bp, Artificial Sequence
  Description of Artificial Sequence: Synthetic oligonucleotide
  Target: ATXN1; (-) strand; PAM type: YTN; PAM sequence: TTC
taataattacttcagatttg

SEQ ID NO: 176077 - DNA, 20 bp, Artificial Sequence
  Description of Artificial Sequence: Synthetic oligonucleotide
  Target: ATXN1; (-) strand; PAM type: YTN; PAM sequence: TTT
ctaataattacttcagattt

SEQ ID NO: 176078 - DNA, 20 bp, Artificial Sequence
  Description of Artificial Sequence: Synthetic oligonucleotide
  Target: ATXN1; (-) strand; PAM type: YTN; PAM sequence: CTT
tctaataattacttcagatt

SEQ ID NO: 176079 - DNA, 20 bp, Artificial Sequence
  Description of Artificial Sequence: Synthetic oligonucleotide
  Target: ATXN1; (-) strand; PAM type: YTN; PAM sequence: CTC
actttctaataattacttca

SEQ ID NO: 176080 - DNA, 20 bp, Artificial Sequence
  Description of Artificial Sequence: Synthetic oligonucleotide
  Target: ATXN1; (-) strand; PAM type: YTN; PAM sequence: TTC
tcactttctaataattactt

SEQ ID NO: 176081 - DNA, 20 bp, Artificial Sequence
  Description of Artificial Sequence: Synthetic oligonucleotide
  Target: ATXN1; (-) strand; PAM type: YTN; PAM sequence: TTT
ctcactttctaataattact

SEQ ID NO: 176082 - DNA, 20 bp, Artificial Sequence
  Description of Artificial Sequence: Synthetic oligonucleotide
  Target: ATXN1; (-) strand; PAM type: YTN; PAM sequence: TTT
tctcactttctaataattac

SEQ ID NO: 176083 - DNA, 20 bp, Artificial Sequence
  Description of Artificial Sequence: Synthetic oligonucleotide
  Target: ATXN1; (-) strand; PAM type: YTN; PAM sequence: CTG
ttttctcactttctaataat

SEQ ID NO: 176084 - DNA, 20 bp, Artificial Sequence
  Description of Artificial Sequence: Synthetic oligonucleotide
  Target: ATXN1; (-) strand; PAM type: YTN; PAM sequence: TTC
ccaaaagtaatgtctgtttt

SEQ ID NO: 176085 - DNA, 20 bp, Artificial Sequence
  Description of Artificial Sequence: Synthetic oligonucleotide
  Target: ATXN1; (-) strand; PAM type: YTN; PAM sequence: CTT
cccaaaagtaatgtctgttt

SEQ ID NO: 176086 - DNA, 20 bp, Artificial Sequence
  Description of Artificial Sequence: Synthetic oligonucleotide
  Target: ATXN1; (-) strand; PAM type: YTN; PAM sequence: CTC
ccagcttcccaaaagtaatg

SEQ ID NO: 176087 - DNA, 20 bp, Artificial Sequence
  Description of Artificial Sequence: Synthetic oligonucleotide
  Target: ATXN1; (-) strand; PAM type: YTN; PAM sequence: CTA
taaagccatctcccagcttc

SEQ ID NO: 176088 - DNA, 20 bp, Artificial Sequence
  Description of Artificial Sequence: Synthetic oligonucleotide
  Target: ATXN1; (-) strand; PAM type: YTN; PAM sequence: TTA
gactataaagccatctccca

SEQ ID NO: 176089 - DNA, 20 bp, Artificial Sequence
  Description of Artificial Sequence: Synthetic oligonucleotide
  Target: ATXN1; (-) strand; PAM type: YTN; PAM sequence: CTT
agactataaagccatctccc

SEQ ID NO: 176090 - DNA, 20 bp, Artificial Sequence
  Description of Artificial Sequence: Synthetic oligonucleotide
  Target: ATXN1; (-) strand; PAM type: YTN; PAM sequence: CTA
gtggcaacttagactataaa

SEQ ID NO: 176091 - DNA, 20 bp, Artificial Sequence
  Description of Artificial Sequence: Synthetic oligonucleotide
  Target: ATXN1; (-) strand; PAM type: YTN; PAM sequence: CTA
tctagtggcaacttagacta

SEQ ID NO: 176092 - DNA, 20 bp, Artificial Sequence
  Description of Artificial Sequence: Synthetic oligonucleotide
  Target: ATXN1; (-) strand; PAM type: YTN; PAM sequence: TTC
tatctagtggcaacttagac

SEQ ID NO: 176093 - DNA, 20 bp, Artificial Sequence
  Description of Artificial Sequence: Synthetic oligonucleotide
  Target: ATXN1; (-) strand; PAM type: YTN; PAM sequence: TTA
tgggtcattctatctagtgg

SEQ ID NO: 176094 - DNA, 20 bp, Artificial Sequence
  Description of Artificial Sequence: Synthetic oligonucleotide
  Target: ATXN1; (-) strand; PAM type: YTN; PAM sequence: TTT
atgggtcattctatctagtg

SEQ ID NO: 176095 - DNA, 20 bp, Artificial Sequence
  Description of Artificial Sequence: Synthetic oligonucleotide
  Target: ATXN1; (-) strand; PAM type: YTN; PAM sequence: TTT
tatgggtcattctatctagt

SEQ ID NO: 176096 - DNA, 20 bp, Artificial Sequence
  Description of Artificial Sequence: Synthetic oligonucleotide
  Target: ATXN1; (-) strand; PAM type: YTN; PAM sequence: TTT
ttatgggtcattctatctag

SEQ ID NO: 176097 - DNA, 20 bp, Artificial Sequence
  Description of Artificial Sequence: Synthetic oligonucleotide
  Target: ATXN1; (-) strand; PAM type: YTN; PAM sequence: TTC
caagtaatttttatgggtca

SEQ ID NO: 176098 - DNA, 20 bp, Artificial Sequence
  Description of Artificial Sequence: Synthetic oligonucleotide
  Target: ATXN1; (-) strand; PAM type: YTN; PAM sequence: CTT
ccaagtaatttttatgggtc

SEQ ID NO: 176099 - DNA, 20 bp, Artificial Sequence
  Description of Artificial Sequence: Synthetic oligonucleotide
  Target: ATXN1; (-) strand; PAM type: YTN; PAM sequence: TTA
tgagataatagccttccaag

SEQ ID NO: 176100 - DNA, 20 bp, Artificial Sequence
  Description of Artificial Sequence: Synthetic oligonucleotide
  Target: ATXN1; (-) strand; PAM type: YTN; PAM sequence: TTA
taggccccggttatgagata

SEQ ID NO: 176101 - DNA, 20 bp, Artificial Sequence
  Description of Artificial Sequence: Synthetic oligonucleotide
  Target: ATXN1; (-) strand; PAM type: YTN; PAM sequence: TTT
ataggccccggttatgagat

SEQ ID NO: 176102 - DNA, 20 bp, Artificial Sequence
  Description of Artificial Sequence: Synthetic oligonucleotide
  Target: ATXN1; (-) strand; PAM type: YTN; PAM sequence: TTT
tataggccccggttatgaga

SEQ ID NO: 176103 - DNA, 20 bp, Artificial Sequence
  Description of Artificial Sequence: Synthetic oligonucleotide
  Target: ATXN1; (-) strand; PAM type: YTN; PAM sequence: TTA
gattttataggccccggtta

SEQ ID NO: 176104 - DNA, 20 bp, Artificial Sequence
  Description of Artificial Sequence: Synthetic oligonucleotide
  Target: ATXN1; (-) strand; PAM type: YTN; PAM sequence: CTG
ttagattttataggccccgg

SEQ ID NO: 176105 - DNA, 20 bp, Artificial Sequence
  Description of Artificial Sequence: Synthetic oligonucleotide
  Target: ATXN1; (-) strand; PAM type: YTN; PAM sequence: CTG
taactgttagattttatagg

SEQ ID NO: 176106 - DNA, 20 bp, Artificial Sequence
  Description of Artificial Sequence: Synthetic oligonucleotide
  Target: ATXN1; (-) strand; PAM type: YTN; PAM sequence: TTA
aaatacacacgagagagaga

SEQ ID NO: 176107 - DNA, 20 bp, Artificial Sequence
  Description of Artificial Sequence: Synthetic oligonucleotide
  Target: ATXN1; (-) strand; PAM type: YTN; PAM sequence: TTA
attaaaatacacacgagaga

SEQ ID NO: 176108 - DNA, 20 bp, Artificial Sequence
  Description of Artificial Sequence: Synthetic oligonucleotide
  Target: ATXN1; (-) strand; PAM type: YTN; PAM sequence: TTT
aattaaaatacacacgagag

SEQ ID NO: 176109 - DNA, 20 bp, Artificial Sequence
  Description of Artificial Sequence: Synthetic oligonucleotide
  Target: ATXN1; (-) strand; PAM type: YTN; PAM sequence: CTT
taattaaaatacacacgaga

SEQ ID NO: 176110 - DNA, 20 bp, Artificial Sequence
  Description of Artificial Sequence: Synthetic oligonucleotide
  Target: ATXN1; (-) strand; PAM type: YTN; PAM sequence: TTA
agtctttaattaaaatacac

SEQ ID NO: 176111 - DNA, 20 bp, Artificial Sequence
  Description of Artificial Sequence: Synthetic oligonucleotide
  Target: ATXN1; (-) strand; PAM type: YTN; PAM sequence: TTT
aagtctttaattaaaataca

SEQ ID NO: 176112 - DNA, 20 bp, Artificial Sequence
  Description of Artificial Sequence: Synthetic oligonucleotide
  Target: ATXN1; (-) strand; PAM type: YTN; PAM sequence: TTA
gcagtttaagtctttaatta

SEQ ID NO: 176113 - DNA, 20 bp, Artificial Sequence
  Description of Artificial Sequence: Synthetic oligonucleotide
  Target: ATXN1; (-) strand; PAM type: YTN; PAM sequence: CTT
agcagtttaagtctttaatt

SEQ ID NO: 176114 - DNA, 20 bp, Artificial Sequence
  Description of Artificial Sequence: Synthetic oligonucleotide
  Target: ATXN1; (-) strand; PAM type: YTN; PAM sequence: CTC
ttagcagtttaagtctttaa

SEQ ID NO: 176115 - DNA, 20 bp, Artificial Sequence
  Description of Artificial Sequence: Synthetic oligonucleotide
  Target: ATXN1; (-) strand; PAM type: YTN; PAM sequence: TTG
tctcttagcagtttaagtct

SEQ ID NO: 176116 - DNA, 20 bp, Artificial Sequence
  Description of Artificial Sequence: Synthetic oligonucleotide
  Target: ATXN1; (-) strand; PAM type: YTN; PAM sequence: TTT
gtctcttagcagtttaagtc

SEQ ID NO: 176117 - DNA, 20 bp, Artificial Sequence
  Description of Artificial Sequence: Synthetic oligonucleotide
  Target: ATXN1; (-) strand; PAM type: YTN; PAM sequence: TTT
tgtctcttagcagtttaagt

SEQ ID NO: 176118 - DNA, 20 bp, Artificial Sequence
  Description of Artificial Sequence: Synthetic oligonucleotide
  Target: ATXN1; (-) strand; PAM type: YTN; PAM sequence: TTC
agttttgtctcttagcagtt

SEQ ID NO: 176119 - DNA, 20 bp, Artificial Sequence
  Description of Artificial Sequence: Synthetic oligonucleotide
  Target: ATXN1; (-) strand; PAM type: YTN; PAM sequence: TTT
cagttttgtctcttagcagt

SEQ ID NO: 176120 - DNA, 20 bp, Artificial Sequence
  Description of Artificial Sequence: Synthetic oligonucleotide
  Target: ATXN1; (-) strand; PAM type: YTN; PAM sequence: TTT
tcagttttgtctcttagcag

SEQ ID NO: 176121 - DNA, 20 bp, Artificial Sequence
  Description of Artificial Sequence: Synthetic oligonucleotide
  Target: ATXN1; (-) strand; PAM type: YTN; PAM sequence: TTA
cgtacatgttttcagttttg

SEQ ID NO: 176122 - DNA, 20 bp, Artificial Sequence
  Description of Artificial Sequence: Synthetic oligonucleotide
  Target: ATXN1; (-) strand; PAM type: YTN; PAM sequence: TTG
gattacgtacatgttttcag

SEQ ID NO: 176123 - DNA, 20 bp, Artificial Sequence
  Description of Artificial Sequence: Synthetic oligonucleotide
  Target: ATXN1; (-) strand; PAM type: YTN; PAM sequence: TTA
tgcaaaattggattacgtac

SEQ ID NO: 176124 - DNA, 20 bp, Artificial Sequence
  Description of Artificial Sequence: Synthetic oligonucleotide
  Target: ATXN1; (-) strand; PAM type: YTN; PAM sequence: CTA
caaaaccgcagagacattat

SEQ ID NO: 176125 - DNA, 20 bp, Artificial Sequence
  Description of Artificial Sequence: Synthetic oligonucleotide
  Target: ATXN1; (-) strand; PAM type: YTN; PAM sequence: CTA
ccataaaccagtaaatgtgt

SEQ ID NO: 176126 - DNA, 20 bp, Artificial Sequence
  Description of Artificial Sequence: Synthetic oligonucleotide
  Target: ATXN1; (-) strand; PAM type: YTN; PAM sequence: TTC
ctaccataaaccagtaaatg

SEQ ID NO: 176127 - DNA, 20 bp, Artificial Sequence
  Description of Artificial Sequence: Synthetic oligonucleotide
  Target: ATXN1; (-) strand; PAM type: YTN; PAM sequence: TTT
cctaccataaaccagtaaat

SEQ ID NO: 176128 - DNA, 20 bp, Artificial Sequence
  Description of Artificial Sequence: Synthetic oligonucleotide
  Target: ATXN1; (-) strand; PAM type: YTN; PAM sequence: TTT
tcctaccataaaccagtaaa

SEQ ID NO: 176129 - DNA, 20 bp, Artificial Sequence
  Description of Artificial Sequence: Synthetic oligonucleotide
  Target: ATXN1; (-) strand; PAM type: YTN; PAM sequence: CTG
aatcacaaaggcgagtgcca

SEQ ID NO: 176130 - DNA, 20 bp, Artificial Sequence
  Description of Artificial Sequence: Synthetic oligonucleotide
  Target: ATXN1; (-) strand; PAM type: YTN; PAM sequence: TTC
atgcctgaatcacaaaggcg

SEQ ID NO: 176131 - DNA, 20 bp, Artificial Sequence
  Description of Artificial Sequence: Synthetic oligonucleotide
  Target: ATXN1; (-) strand; PAM type: YTN; PAM sequence: TTT
catgcctgaatcacaaaggc

SEQ ID NO: 176132 - DNA, 20 bp, Artificial Sequence
  Description of Artificial Sequence: Synthetic oligonucleotide
  Target: ATXN1; (-) strand; PAM type: YTN; PAM sequence: CTC
atggtttcatgcctgaatca

SEQ ID NO: 176133 - DNA, 20 bp, Artificial Sequence
  Description of Artificial Sequence: Synthetic oligonucleotide
  Target: ATXN1; (-) strand; PAM type: YTN; PAM sequence: CTG
ggcacctcatggtttcatgc

SEQ ID NO: 176134 - DNA, 20 bp, Artificial Sequence
  Description of Artificial Sequence: Synthetic oligonucleotide
  Target: ATXN1; (-) strand; PAM type: YTN; PAM sequence: TTC
cagctgggcacctcatggtt

SEQ ID NO: 176135 - DNA, 20 bp, Artificial Sequence
  Description of Artificial Sequence: Synthetic oligonucleotide
  Target: ATXN1; (-) strand; PAM type: YTN; PAM sequence: CTG
aattccagctgggcacctca

SEQ ID NO: 176136 - DNA, 20 bp, Artificial Sequence
  Description of Artificial Sequence: Synthetic oligonucleotide
  Target: ATXN1; (-) strand; PAM type: YTN; PAM sequence: TTC
tgaattccagctgggcacct

SEQ ID NO: 176137 - DNA, 20 bp, Artificial Sequence
  Description of Artificial Sequence: Synthetic oligonucleotide
  Target: ATXN1; (-) strand; PAM type: YTN; PAM sequence: CTT
ctgaattccagctgggcacc

SEQ ID NO: 176138 - DNA, 20 bp, Artificial Sequence
  Description of Artificial Sequence: Synthetic oligonucleotide
  Target: ATXN1; (-) strand; PAM type: YTN; PAM sequence: TTC
ttctgaattccagctgggca

SEQ ID NO: 176139 - DNA, 20 bp, Artificial Sequence
  Description of Artificial Sequence: Synthetic oligonucleotide
  Target: ATXN1; (-) strand; PAM type: YTN; PAM sequence: CTT
cttctgaattccagctgggc

SEQ ID NO: 176140 - DNA, 20 bp, Artificial Sequence
  Description of Artificial Sequence: Synthetic oligonucleotide
  Target: ATXN1; (-) strand; PAM type: YTN; PAM sequence: CTA
atgtacttcttctgaattcc

SEQ ID NO: 176141 - DNA, 20 bp, Artificial Sequence
  Description of Artificial Sequence: Synthetic oligonucleotide
  Target: ATXN1; (-) strand; PAM type: YTN; PAM sequence: CTG
tcctaatgtacttcttctga

SEQ ID NO: 176142 - DNA, 20 bp, Artificial Sequence
  Description of Artificial Sequence: Synthetic oligonucleotide
  Target: ATXN1; (-) strand; PAM type: YTN; PAM sequence: CTC
tgtcctaatgtacttcttct

SEQ ID NO: 176143 - DNA, 20 bp, Artificial Sequence
  Description of Artificial Sequence: Synthetic oligonucleotide
  Target: ATXN1; (-) strand; PAM type: YTN; PAM sequence: CTG
cccctctgtcctaatgtact

SEQ ID NO: 176144 - DNA, 20 bp, Artificial Sequence
  Description of Artificial Sequence: Synthetic oligonucleotide
  Target: ATXN1; (-) strand; PAM type: YTN; PAM sequence: CTA
ataaataaatacaaagctgc

SEQ ID NO: 176145 - DNA, 20 bp, Artificial Sequence
  Description of Artificial Sequence: Synthetic oligonucleotide
  Target: ATXN1; (-) strand; PAM type: YTN; PAM sequence: TTG
gaagaacctaataaataaat

SEQ ID NO: 176146 - DNA, 20 bp, Artificial Sequence
  Description of Artificial Sequence: Synthetic oligonucleotide
  Target: ATXN1; (-) strand; PAM type: YTN; PAM sequence: TTA
agttggaagaacctaataaa

SEQ ID NO: 176147 - DNA, 20 bp, Artificial Sequence
  Description of Artificial Sequence: Synthetic oligonucleotide
  Target: ATXN1; (-) strand; PAM type: YTN; PAM sequence: CTT
aagttggaagaacctaataa

SEQ ID NO: 176148 - DNA, 20 bp, Artificial Sequence
  Description of Artificial Sequence: Synthetic oligonucleotide
  Target: ATXN1; (-) strand; PAM type: YTN; PAM sequence: CTG
gcaacttaagttggaagaac

SEQ ID NO: 176149 - DNA, 20 bp, Artificial Sequence
  Description of Artificial Sequence: Synthetic oligonucleotide
  Target: ATXN1; (-) strand; PAM type: YTN; PAM sequence: CTA
ccctggcaacttaagttgga

SEQ ID NO: 176150 - DNA, 20 bp, Artificial Sequence
  Description of Artificial Sequence: Synthetic oligonucleotide
  Target: ATXN1; (-) strand; PAM type: YTN; PAM sequence: CTC
atgctaccctggcaacttaa

SEQ ID NO: 176151 - DNA, 20 bp, Artificial Sequence
  Description of Artificial Sequence: Synthetic oligonucleotide
  Target: ATXN1; (-) strand; PAM type: YTN; PAM sequence: TTA
aaaagctcatgctaccctgg

SEQ ID NO: 176152 - DNA, 20 bp, Artificial Sequence
  Description of Artificial Sequence: Synthetic oligonucleotide
  Target: ATXN1; (-) strand; PAM type: YTN; PAM sequence: TTT
aaaaagctcatgctaccctg

SEQ ID NO: 176153 - DNA, 20 bp, Artificial Sequence
  Description of Artificial Sequence: Synthetic oligonucleotide
  Target: ATXN1; (-) strand; PAM type: YTN; PAM sequence: TTT
taaaaagctcatgctaccct

SEQ ID NO: 176154 - DNA, 20 bp, Artificial Sequence
  Description of Artificial Sequence: Synthetic oligonucleotide
  Target: ATXN1; (-) strand; PAM type: YTN; PAM sequence: TTT
ttaaaaagctcatgctaccc

SEQ ID NO: 176155 - DNA, 20 bp, Artificial Sequence
  Description of Artificial Sequence: Synthetic oligonucleotide
  Target: ATXN1; (-) strand; PAM type: YTN; PAM sequence: CTG
tttttaaaaagctcatgcta

SEQ ID NO: 176156 - DNA, 20 bp, Artificial Sequence
  Description of Artificial Sequence: Synthetic oligonucleotide
  Target: ATXN1; (-) strand; PAM type: YTN; PAM sequence: CTA
aaacaggaaggccagaaaca

SEQ ID NO: 176157 - DNA, 20 bp, Artificial Sequence
  Description of Artificial Sequence: Synthetic oligonucleotide
  Target: ATXN1; (-) strand; PAM type: YTN; PAM sequence: TTA
gataaaagcctaaaacagga

SEQ ID NO: 176158 - DNA, 20 bp, Artificial Sequence
  Description of Artificial Sequence: Synthetic oligonucleotide
  Target: ATXN1; (-) strand; PAM type: YTN; PAM sequence: CTA
ttagataaaagcctaaaaca

SEQ ID NO: 176159 - DNA, 20 bp, Artificial Sequence
  Description of Artificial Sequence: Synthetic oligonucleotide
  Target: ATXN1; (-) strand; PAM type: YTN; PAM sequence: CTC
tattagataaaagcctaaaa

SEQ ID NO: 176160 - DNA, 20 bp, Artificial Sequence
  Description of Artificial Sequence: Synthetic oligonucleotide
  Target: ATXN1; (-) strand; PAM type: YTN; PAM sequence: CTC
acactctattagataaaagc

SEQ ID NO: 176161 - DNA, 20 bp, Artificial Sequence
  Description of Artificial Sequence: Synthetic oligonucleotide
  Target: ATXN1; (-) strand; PAM type: YTN; PAM sequence: TTC
tcacactctattagataaaa

SEQ ID NO: 176162 - DNA, 20 bp, Artificial Sequence
  Description of Artificial Sequence: Synthetic oligonucleotide
  Target: ATXN1; (-) strand; PAM type: YTN; PAM sequence: CTT
ctcacactctattagataaa

SEQ ID NO: 176163 - DNA, 20 bp, Artificial Sequence
  Description of Artificial Sequence: Synthetic oligonucleotide
  Target: ATXN1; (-) strand; PAM type: YTN; PAM sequence: CTC
atgtcttctcacactctatt

SEQ ID NO: 176164 - DNA, 20 bp, Artificial Sequence
  Description of Artificial Sequence: Synthetic oligonucleotide
  Target: ATXN1; (-) strand; PAM type: YTN; PAM sequence: CTG
catgtgaactcatgtcttct

SEQ ID NO: 176165 - DNA, 20 bp, Artificial Sequence
  Description of Artificial Sequence: Synthetic oligonucleotide
  Target: ATXN1; (-) strand; PAM type: YTN; PAM sequence: TTA
gctgcatgtgaactcatgtc

SEQ ID NO: 176166 - DNA, 20 bp, Artificial Sequence
  Description of Artificial Sequence: Synthetic oligonucleotide
  Target: ATXN1; (-) strand; PAM type: YTN; PAM sequence: CTT
agctgcatgtgaactcatgt

SEQ ID NO: 176167 - DNA, 20 bp, Artificial Sequence
  Description of Artificial Sequence: Synthetic oligonucleotide
  Target: ATXN1; (-) strand; PAM type: YTN; PAM sequence: CTC
atccttagctgcatgtgaac

SEQ ID NO: 176168 - DNA, 20 bp, Artificial Sequence
  Description of Artificial Sequence: Synthetic oligonucleotide
  Target: ATXN1; (-) strand; PAM type: YTN; PAM sequence: TTG
aataatctcatccttagctg

SEQ ID NO: 176169 - DNA, 20 bp, Artificial Sequence
  Description of Artificial Sequence: Synthetic oligonucleotide
  Target: ATXN1; (-) strand; PAM type: YTN; PAM sequence: TTT
gaataatctcatccttagct

SEQ ID NO: 176170 - DNA, 20 bp, Artificial Sequence
  Description of Artificial Sequence: Synthetic oligonucleotide
  Target: ATXN1; (-) strand; PAM type: YTN; PAM sequence: TTC
agtttgaataatctcatcct

SEQ ID NO: 176171 - DNA, 20 bp, Artificial Sequence
  Description of Artificial Sequence: Synthetic oligonucleotide
  Target: ATXN1; (-) strand; PAM type: YTN; PAM sequence: TTT
cagtttgaataatctcatcc

SEQ ID NO: 176172 - DNA, 20 bp, Artificial Sequence
  Description of Artificial Sequence: Synthetic oligonucleotide
  Target: ATXN1; (-) strand; PAM type: YTN; PAM sequence: TTG
gtttcagtttgaataatctc

SEQ ID NO: 176173 - DNA, 20 bp, Artificial Sequence
  Description of Artificial Sequence: Synthetic oligonucleotide
  Target: ATXN1; (-) strand; PAM type: YTN; PAM sequence: TTG
atatgtggggttggtttcag

SEQ ID NO: 176174 - DNA, 20 bp, Artificial Sequence
  Description of Artificial Sequence: Synthetic oligonucleotide
  Target: ATXN1; (-) strand; PAM type: YTN; PAM sequence: TTT
gatatgtggggttggtttca

SEQ ID NO: 176175 - DNA, 20 bp, Artificial Sequence
  Description of Artificial Sequence: Synthetic oligonucleotide
  Target: ATXN1; (-) strand; PAM type: YTN; PAM sequence: TTA
aagtgacgaaaatgacacca

SEQ ID NO: 176176 - DNA, 20 bp, Artificial Sequence
  Description of Artificial Sequence: Synthetic oligonucleotide
  Target: ATXN1; (-) strand; PAM type: YTN; PAM sequence: CTG
ttaaagtgacgaaaatgaca

SEQ ID NO: 176177 - DNA, 20 bp, Artificial Sequence
  Description of Artificial Sequence: Synthetic oligonucleotide
  Target: ATXN1; (-) strand; PAM type: YTN; PAM sequence: CTA
ctgttaaagtgacgaaaatg

SEQ ID NO: 176178 - DNA, 20 bp, Artificial Sequence
  Description of Artificial Sequence: Synthetic oligonucleotide
  Target: ATXN1; (-) strand; PAM type: YTN; PAM sequence: TTC
tactgttaaagtgacgaaaa

SEQ ID NO: 176179 - DNA, 20 bp, Artificial Sequence
  Description of Artificial Sequence: Synthetic oligonucleotide
  Target: ATXN1; (-) strand; PAM type: YTN; PAM sequence: TTT
ctactgttaaagtgacgaaa

SEQ ID NO: 176180 - DNA, 20 bp, Artificial Sequence
  Description of Artificial Sequence: Synthetic oligonucleotide
  Target: ATXN1; (-) strand; PAM type: YTN; PAM sequence: CTT
tctactgttaaagtgacgaa

SEQ ID NO: 176181 - DNA, 20 bp, Artificial Sequence
  Description of Artificial Sequence: Synthetic oligonucleotide
  Target: ATXN1; (-) strand; PAM type: YTN; PAM sequence: CTG
tgtcctttctactgttaaag

SEQ ID NO: 176182 - DNA, 20 bp, Artificial Sequence
  Description of Artificial Sequence: Synthetic oligonucleotide
  Target: ATXN1; (-) strand; PAM type: YTN; PAM sequence: TTC
ctgtgtcctttctactgtta

SEQ ID NO: 176183 - DNA, 20 bp, Artificial Sequence
  Description of Artificial Sequence: Synthetic oligonucleotide
  Target: ATXN1; (-) strand; PAM type: YTN; PAM sequence: TTT
cctgtgtcctttctactgtt

SEQ ID NO: 176184 - DNA, 20 bp, Artificial Sequence
  Description of Artificial Sequence: Synthetic oligonucleotide
  Target: ATXN1; (-) strand; PAM type: YTN; PAM sequence: TTT
tcctgtgtcctttctactgt

SEQ ID NO: 176185 - DNA, 20 bp, Artificial Sequence
  Description of Artificial Sequence: Synthetic oligonucleotide
  Target: ATXN1; (-) strand; PAM type: YTN; PAM sequence: TTT
ttcctgtgtcctttctactg

SEQ ID NO: 176186 - DNA, 20 bp, Artificial Sequence
  Description of Artificial Sequence: Synthetic oligonucleotide
  Target: ATXN1; (-) strand; PAM type: YTN; PAM sequence: TTT
tttcctgtgtcctttctact

SEQ ID NO: 176187 - DNA, 20 bp, Artificial Sequence
  Description of Artificial Sequence: Synthetic oligonucleotide
  Target: ATXN1; (-) strand; PAM type: YTN; PAM sequence: TTT
ttttcctgtgtcctttctac

SEQ ID NO: 176188 - DNA, 20 bp, Artificial Sequence
  Description of Artificial Sequence: Synthetic oligonucleotide
  Target: ATXN1; (-) strand; PAM type: YTN; PAM sequence: TTT
tttttcctgtgtcctttcta

SEQ ID NO: 176189 - DNA, 20 bp, Artificial Sequence
  Description of Artificial Sequence: Synthetic oligonucleotide
  Target: ATXN1; (-) strand; PAM type: YTN; PAM sequence: TTT
ttttttcctgtgtcctttct

SEQ ID NO: 176190 - DNA, 20 bp, Artificial Sequence
  Description of Artificial Sequence: Synthetic oligonucleotide
  Target: ATXN1; (-) strand; PAM type: YTN; PAM sequence: TTT
tttttttcctgtgtcctttc

SEQ ID NO: 176191 - DNA, 20 bp, Artificial Sequence
  Description of Artificial Sequence: Synthetic oligonucleotide
  Target: ATXN1; (-) strand; PAM type: YTN; PAM sequence: CTT
ttttttttcctgtgtccttt

SEQ ID NO: 176192 - DNA, 20 bp, Artificial Sequence
  Description of Artificial Sequence: Synthetic oligonucleotide
  Target: ATXN1; (-) strand; PAM type: YTN; PAM sequence: TTC
ttttttttttcctgtgtcct

SEQ ID NO: 176193 - DNA, 20 bp, Artificial Sequence
  Description of Artificial Sequence: Synthetic oligonucleotide
  Target: ATXN1; (-) strand; PAM type: YTN; PAM sequence: TTC
attcttttttttttcctgtg

SEQ ID NO: 176194 - DNA, 20 bp, Artificial Sequence
  Description of Artificial Sequence: Synthetic oligonucleotide
  Target: ATXN1; (-) strand; PAM type: YTN; PAM sequence: TTT
cattcttttttttttcctgt

SEQ ID NO: 176195 - DNA, 20 bp, Artificial Sequence
  Description of Artificial Sequence: Synthetic oligonucleotide
  Target: ATXN1; (-) strand; PAM type: YTN; PAM sequence: TTC
agtaaatgatttcattcttt

SEQ ID NO: 176196 - DNA, 20 bp, Artificial Sequence
  Description of Artificial Sequence: Synthetic oligonucleotide
  Target: ATXN1; (-) strand; PAM type: YTN; PAM sequence: TTA
gttcagtaaatgatttcatt

SEQ ID NO: 176197 - DNA, 20 bp, Artificial Sequence
  Description of Artificial Sequence: Synthetic oligonucleotide
  Target: ATXN1; (-) strand; PAM type: YTN; PAM sequence: CTG
ttagttcagtaaatgatttc

SEQ ID NO: 176198 - DNA, 20 bp, Artificial Sequence
  Description of Artificial Sequence: Synthetic oligonucleotide
  Target: ATXN1; (-) strand; PAM type: YTN; PAM sequence: TTA
tccaaggcaggaggggacaa

SEQ ID NO: 176199 - DNA, 20 bp, Artificial Sequence
  Description of Artificial Sequence: Synthetic oligonucleotide
  Target: ATXN1; (-) strand; PAM type: YTN; PAM sequence: TTT
atccaaggcaggaggggaca

SEQ ID NO: 176200 - DNA, 20 bp, Artificial Sequence
  Description of Artificial Sequence: Synthetic oligonucleotide
  Target: ATXN1; (-) strand; PAM type: YTN; PAM sequence: TTA
tttatccaaggcaggagggg

SEQ ID NO: 176201 - DNA, 20 bp, Artificial Sequence
  Description of Artificial Sequence: Synthetic oligonucleotide
  Target: ATXN1; (-) strand; PAM type: YTN; PAM sequence: TTA
gtcattatttatccaaggca

SEQ ID NO: 176202 - DNA, 20 bp, Artificial Sequence
  Description of Artificial Sequence: Synthetic oligonucleotide
  Target: ATXN1; (-) strand; PAM type: YTN; PAM sequence: TTA
aaaattagtcattatttatc

SEQ ID NO: 176203 - DNA, 20 bp, Artificial Sequence
  Description of Artificial Sequence: Synthetic oligonucleotide
  Target: ATXN1; (-) strand; PAM type: YTN; PAM sequence: TTT
aaaaattagtcattatttat

SEQ ID NO: 176204 - DNA, 20 bp, Artificial Sequence
  Description of Artificial Sequence: Synthetic oligonucleotide
  Target: ATXN1; (-) strand; PAM type: YTN; PAM sequence: TTA
tttaaaaattagtcattatt

SEQ ID NO: 176205 - DNA, 20 bp, Artificial Sequence
  Description of Artificial Sequence: Synthetic oligonucleotide
  Target: ATXN1; (-) strand; PAM type: YTN; PAM sequence: CTG
ttatttaaaaattagtcatt

SEQ ID NO: 176206 - DNA, 20 bp, Artificial Sequence
  Description of Artificial Sequence: Synthetic oligonucleotide
  Target: ATXN1; (-) strand; PAM type: YTN; PAM sequence: CTG
taccaatctgttatttaaaa

SEQ ID NO: 176207 - DNA, 20 bp, Artificial Sequence
  Description of Artificial Sequence: Synthetic oligonucleotide
  Target: ATXN1; (-) strand; PAM type: YTN; PAM sequence: CTC
agagctgtaccaatctgtta

SEQ ID NO: 176208 - DNA, 20 bp, Artificial Sequence
  Description of Artificial Sequence: Synthetic oligonucleotide
  Target: ATXN1; (-) strand; PAM type: YTN; PAM sequence: CTA
atctcagagctgtaccaatc

SEQ ID NO: 176209 - DNA, 20 bp, Artificial Sequence
  Description of Artificial Sequence: Synthetic oligonucleotide
  Target: ATXN1; (-) strand; PAM type: YTN; PAM sequence: CTC
ctaatctcagagctgtacca

SEQ ID NO: 176210 - DNA, 20 bp, Artificial Sequence
  Description of Artificial Sequence: Synthetic oligonucleotide
  Target: ATXN1; (-) strand; PAM type: YTN; PAM sequence: CTG
tctcctaatctcagagctgt

SEQ ID NO: 176211 - DNA, 20 bp, Artificial Sequence
  Description of Artificial Sequence: Synthetic oligonucleotide
  Target: ATXN1; (-) strand; PAM type: YTN; PAM sequence: TTC
tgtctcctaatctcagagct

SEQ ID NO: 176212 - DNA, 20 bp, Artificial Sequence
  Description of Artificial Sequence: Synthetic oligonucleotide
  Target: ATXN1; (-) strand; PAM type: YTN; PAM sequence: TTT
ctgtctcctaatctcagagc

SEQ ID NO: 176213 - DNA, 20 bp, Artificial Sequence
  Description of Artificial Sequence: Synthetic oligonucleotide
  Target: ATXN1; (-) strand; PAM type: YTN; PAM sequence: CTT
tctgtctcctaatctcagag

SEQ ID NO: 176214 - DNA, 20 bp, Artificial Sequence
  Description of Artificial Sequence: Synthetic oligonucleotide
  Target: ATXN1; (-) strand; PAM type: YTN; PAM sequence: TTC
catgctttctgtctcctaat

SEQ ID NO: 176215 - DNA, 20 bp, Artificial Sequence
  Description of Artificial Sequence: Synthetic oligonucleotide
  Target: ATXN1; (-) strand; PAM type: YTN; PAM sequence: TTT
ccatgctttctgtctcctaa

SEQ ID NO: 176216 - DNA, 20 bp, Artificial Sequence
  Description of Artificial Sequence: Synthetic oligonucleotide
  Target: ATXN1; (-) strand; PAM type: YTN; PAM sequence: CTT
tccatgctttctgtctccta

SEQ ID NO: 176217 - DNA, 20 bp, Artificial Sequence
  Description of Artificial Sequence: Synthetic oligonucleotide
  Target: ATXN1; (-) strand; PAM type: YTN; PAM sequence: CTG
aggacctttccatgctttct

SEQ ID NO: 176218 - DNA, 20 bp, Artificial Sequence
  Description of Artificial Sequence: Synthetic oligonucleotide
  Target: ATXN1; (-) strand; PAM type: YTN; PAM sequence: CTA
aaaggtctgaggacctttcc

SEQ ID NO: 176219 - DNA, 20 bp, Artificial Sequence
  Description of Artificial Sequence: Synthetic oligonucleotide
  Target: ATXN1; (-) strand; PAM type: YTN; PAM sequence: TTC
agaggaacaggaaagcacca

SEQ ID NO: 176220 - DNA, 20 bp, Artificial Sequence
  Description of Artificial Sequence: Synthetic oligonucleotide
  Target: ATXN1; (-) strand; PAM type: YTN; PAM sequence: TTG
aaaaatgcccattcagagga

SEQ ID NO: 176221 - DNA, 20 bp, Artificial Sequence
  Description of Artificial Sequence: Synthetic oligonucleotide
  Target: ATXN1; (-) strand; PAM type: YTN; PAM sequence: TTT
gaaaaatgcccattcagagg

SEQ ID NO: 176222 - DNA, 20 bp, Artificial Sequence
  Description of Artificial Sequence: Synthetic oligonucleotide
  Target: ATXN1; (-) strand; PAM type: YTN; PAM sequence: TTT
tgaaaaatgcccattcagag

SEQ ID NO: 176223 - DNA, 20 bp, Artificial Sequence
  Description of Artificial Sequence: Synthetic oligonucleotide
  Target: ATXN1; (-) strand; PAM type: YTN; PAM sequence: TTC
aaaatggttttgaaaaatgc

SEQ ID NO: 176224 - DNA, 20 bp, Artificial Sequence
  Description of Artificial Sequence: Synthetic oligonucleotide
  Target: ATXN1; (-) strand; PAM type: YTN; PAM sequence: TTA
cattcaaaatggttttgaaa

SEQ ID NO: 176225 - DNA, 20 bp, Artificial Sequence
  Description of Artificial Sequence: Synthetic oligonucleotide
  Target: ATXN1; (-) strand; PAM type: YTN; PAM sequence: TTT
acattcaaaatggttttgaa

SEQ ID NO: 176226 - DNA, 20 bp, Artificial Sequence
  Description of Artificial Sequence: Synthetic oligonucleotide
  Target: ATXN1; (-) strand; PAM type: YTN; PAM sequence: TTT
tacattcaaaatggttttga

SEQ ID NO: 176227 - DNA, 20 bp, Artificial Sequence
  Description of Artificial Sequence: Synthetic oligonucleotide
  Target: ATXN1; (-) strand; PAM type: YTN; PAM sequence: CTT
ttacattcaaaatggttttg

SEQ ID NO: 176228 - DNA, 20 bp, Artificial Sequence
  Description of Artificial Sequence: Synthetic oligonucleotide
  Target: ATXN1; (-) strand; PAM type: YTN; PAM sequence: CTA
cagccttttacattcaaaat

SEQ ID NO: 176229 - DNA, 20 bp, Artificial Sequence
  Description of Artificial Sequence: Synthetic oligonucleotide
  Target: ATXN1; (-) strand; PAM type: YTN; PAM sequence: CTC
tacagccttttacattcaaa

SEQ ID NO: 176230 - DNA, 20 bp, Artificial Sequence
  Description of Artificial Sequence: Synthetic oligonucleotide
  Target: ATXN1; (-) strand; PAM type: YTN; PAM sequence: TTG
aactctacagccttttacat

SEQ ID NO: 176231 - DNA, 20 bp, Artificial Sequence
  Description of Artificial Sequence: Synthetic oligonucleotide
  Target: ATXN1; (-) strand; PAM type: YTN; PAM sequence: CTC
ataaagtaggaagaagccca

SEQ ID NO: 176232 - DNA, 20 bp, Artificial Sequence
  Description of Artificial Sequence: Synthetic oligonucleotide
  Target: ATXN1; (-) strand; PAM type: YTN; PAM sequence: CTG
tgtataacctcataaagtag

SEQ ID NO: 176233 - DNA, 20 bp, Artificial Sequence
  Description of Artificial Sequence: Synthetic oligonucleotide
  Target: ATXN1; (-) strand; PAM type: YTN; PAM sequence: TTG
aacctgtgtataacctcata

SEQ ID NO: 176234 - DNA, 20 bp, Artificial Sequence
  Description of Artificial Sequence: Synthetic oligonucleotide
  Target: ATXN1; (-) strand; PAM type: YTN; PAM sequence: CTT
gaacctgtgtataacctcat

SEQ ID NO: 176235 - DNA, 20 bp, Artificial Sequence
  Description of Artificial Sequence: Synthetic oligonucleotide
  Target: ATXN1; (-) strand; PAM type: YTN; PAM sequence: CTC
acccttgaacctgtgtataa

SEQ ID NO: 176236 - DNA, 20 bp, Artificial Sequence
  Description of Artificial Sequence: Synthetic oligonucleotide
  Target: ATXN1; (-) strand; PAM type: YTN; PAM sequence: TTA
ccctcacccttgaacctgtg

SEQ ID NO: 176237 - DNA, 20 bp, Artificial Sequence
  Description of Artificial Sequence: Synthetic oligonucleotide
  Target: ATXN1; (-) strand; PAM type: YTN; PAM sequence: TTT
accctcacccttgaacctgt

SEQ ID NO: 176238 - DNA, 20 bp, Artificial Sequence
  Description of Artificial Sequence: Synthetic oligonucleotide
  Target: ATXN1; (-) strand; PAM type: YTN; PAM sequence: CTT
taccctcacccttgaacctg

SEQ ID NO: 176239 - DNA, 20 bp, Artificial Sequence
  Description of Artificial Sequence: Synthetic oligonucleotide
  Target: ATXN1; (-) strand; PAM type: YTN; PAM sequence: TTG
tctttaccctcacccttgaa

SEQ ID NO: 176240 - DNA, 20 bp, Artificial Sequence
  Description of Artificial Sequence: Synthetic oligonucleotide
  Target: ATXN1; (-) strand; PAM type: YTN; PAM sequence: CTT
gtctttaccctcacccttga

SEQ ID NO: 176241 - DNA, 20 bp, Artificial Sequence
  Description of Artificial Sequence: Synthetic oligonucleotide
  Target: ATXN1; (-) strand; PAM type: YTN; PAM sequence: CTG
cttgtctttaccctcaccct

SEQ ID NO: 176242 - DNA, 20 bp, Artificial Sequence
  Description of Artificial Sequence: Synthetic oligonucleotide
  Target: ATXN1; (-) strand; PAM type: YTN; PAM sequence: CTG
cacctgcttgtctttaccct

SEQ ID NO: 176243 - DNA, 20 bp, Artificial Sequence
  Description of Artificial Sequence: Synthetic oligonucleotide
  Target: ATXN1; (-) strand; PAM type: YTN; PAM sequence: CTC
tgcacctgcttgtctttacc

SEQ ID NO: 176244 - DNA, 20 bp, Artificial Sequence
  Description of Artificial Sequence: Synthetic oligonucleotide
  Target: ATXN1; (-) strand; PAM type: YTN; PAM sequence: CTC
ccgtgtgaaactctgcacct

SEQ ID NO: 176245 - DNA, 20 bp, Artificial Sequence
  Description of Artificial Sequence: Synthetic oligonucleotide
  Target: ATXN1; (-) strand; PAM type: YTN; PAM sequence: CTC
acgccccccccaccctcccg

SEQ ID NO: 176246 - DNA, 20 bp, Artificial Sequence
  Description of Artificial Sequence: Synthetic oligonucleotide
  Target: ATXN1; (-) strand; PAM type: YTN; PAM sequence: CTC
ccacaaatatgtatgcatgc

SEQ ID NO: 176247 - DNA, 20 bp, Artificial Sequence
  Description of Artificial Sequence: Synthetic oligonucleotide
  Target: ATXN1; (-) strand; PAM type: YTN; PAM sequence: CTC
atctcccacaaatatgtatg

SEQ ID NO: 176248 - DNA, 20 bp, Artificial Sequence
  Description of Artificial Sequence: Synthetic oligonucleotide
  Target: ATXN1; (-) strand; PAM type: YTN; PAM sequence: TTG
catgcacgctcatctcccac

SEQ ID NO: 176249 - DNA, 20 bp, Artificial Sequence
  Description of Artificial Sequence: Synthetic oligonucleotide
  Target: ATXN1; (-) strand; PAM type: YTN; PAM sequence: TTT
gcatgcacgctcatctccca

SEQ ID NO: 176250 - DNA, 20 bp, Artificial Sequence
  Description of Artificial Sequence: Synthetic oligonucleotide
  Target: ATXN1; (-) strand; PAM type: YTN; PAM sequence: CTA
tttgcatgcacgctcatctc

SEQ ID NO: 176251 - DNA, 20 bp, Artificial Sequence
  Description of Artificial Sequence: Synthetic oligonucleotide
  Target: ATXN1; (-) strand; PAM type: YTN; PAM sequence: CTG
cacacctatttgcatgcacg

SEQ ID NO: 176252 - DNA, 20 bp, Artificial Sequence
  Description of Artificial Sequence: Synthetic oligonucleotide
  Target: ATXN1; (-) strand; PAM type: YTN; PAM sequence: TTC
tgcacacctatttgcatgca

SEQ ID NO: 176253 - DNA, 20 bp, Artificial Sequence
  Description of Artificial Sequence: Synthetic oligonucleotide
  Target: ATXN1; (-) strand; PAM type: YTN; PAM sequence: CTT
ctgcacacctatttgcatgc

SEQ ID NO: 176254 - DNA, 20 bp, Artificial Sequence
  Description of Artificial Sequence: Synthetic oligonucleotide
  Target: ATXN1; (-) strand; PAM type: YTN; PAM sequence: CTC
acttctgcacacctatttgc

SEQ ID NO: 176255 - DNA, 20 bp, Artificial Sequence
  Description of Artificial Sequence: Synthetic oligonucleotide
  Target: ATXN1; (-) strand; PAM type: YTN; PAM sequence: TTG
tgtgcactcacttctgcaca

SEQ ID NO: 176256 - DNA, 20 bp, Artificial Sequence
  Description of Artificial Sequence: Synthetic oligonucleotide
  Target: ATXN1; (-) strand; PAM type: YTN; PAM sequence: TTT
gtgtgcactcacttctgcac

SEQ ID NO: 176257 - DNA, 20 bp, Artificial Sequence
  Description of Artificial Sequence: Synthetic oligonucleotide
  Target: ATXN1; (-) strand; PAM type: YTN; PAM sequence: CTC
acccacacatgtgcatttgt

SEQ ID NO: 176258 - DNA, 20 bp, Artificial Sequence
  Description of Artificial Sequence: Synthetic oligonucleotide
  Target: ATXN1; (-) strand; PAM type: YTN; PAM sequence: TTG
tatgcacactcacccacaca

SEQ ID NO: 176259 - DNA, 20 bp, Artificial Sequence
  Description of Artificial Sequence: Synthetic oligonucleotide
  Target: ATXN1; (-) strand; PAM type: YTN; PAM sequence: CTT
gtatgcacactcacccacac

SEQ ID NO: 176260 - DNA, 20 bp, Artificial Sequence
  Description of Artificial Sequence: Synthetic oligonucleotide
  Target: ATXN1; (-) strand; PAM type: YTN; PAM sequence: CTG
cacatgtacttgtatgcaca

SEQ ID NO: 176261 - DNA, 20 bp, Artificial Sequence
  Description of Artificial Sequence: Synthetic oligonucleotide
  Target: ATXN1; (-) strand; PAM type: YTN; PAM sequence: CTG
cacacatgtatgcatatcaa

SEQ ID NO: 176262 - DNA, 20 bp, Artificial Sequence
  Description of Artificial Sequence: Synthetic oligonucleotide
  Target: ATXN1; (-) strand; PAM type: YTN; PAM sequence: CTC
acgcctgcacacatgtatgc

SEQ ID NO: 176263 - DNA, 20 bp, Artificial Sequence
  Description of Artificial Sequence: Synthetic oligonucleotide
  Target: ATXN1; (-) strand; PAM type: YTN; PAM sequence: CTG
tgtacacactcacgcctgca

SEQ ID NO: 176264 - DNA, 20 bp, Artificial Sequence
  Description of Artificial Sequence: Synthetic oligonucleotide
  Target: ATXN1; (-) strand; PAM type: YTN; PAM sequence: CTG
cacactgtgtacacactcac

SEQ ID NO: 176265 - DNA, 20 bp, Artificial Sequence
  Description of Artificial Sequence: Synthetic oligonucleotide
  Target: ATXN1; (-) strand; PAM type: YTN; PAM sequence: CTG
cagtgtacatatacatgcac

SEQ ID NO: 176266 - DNA, 20 bp, Artificial Sequence
  Description of Artificial Sequence: Synthetic oligonucleotide
  Target: ATXN1; (-) strand; PAM type: YTN; PAM sequence: TTG
cccctgcagtgtacatatac

SEQ ID NO: 176267 - DNA, 20 bp, Artificial Sequence
  Description of Artificial Sequence: Synthetic oligonucleotide
  Target: ATXN1; (-) strand; PAM type: YTN; PAM sequence: TTC
catattgcccctgcagtgta

SEQ ID NO: 176268 - DNA, 20 bp, Artificial Sequence
  Description of Artificial Sequence: Synthetic oligonucleotide
  Target: ATXN1; (-) strand; PAM type: YTN; PAM sequence: TTT
ccatattgcccctgcagtgt

SEQ ID NO: 176269 - DNA, 20 bp, Artificial Sequence
  Description of Artificial Sequence: Synthetic oligonucleotide
  Target: ATXN1; (-) strand; PAM type: YTN; PAM sequence: TTT
tccatattgcccctgcagtg

SEQ ID NO: 176270 - DNA, 20 bp, Artificial Sequence
  Description of Artificial Sequence: Synthetic oligonucleotide
  Target: ATXN1; (-) strand; PAM type: YTN; PAM sequence: TTT
ttccatattgcccctgcagt

SEQ ID NO: 176271 - DNA, 20 bp, Artificial Sequence
  Description of Artificial Sequence: Synthetic oligonucleotide
  Target: ATXN1; (-) strand; PAM type: YTN; PAM sequence: TTT
tttccatattgcccctgcag

SEQ ID NO: 176272 - DNA, 20 bp, Artificial Sequence
  Description of Artificial Sequence: Synthetic oligonucleotide
  Target: ATXN1; (-) strand; PAM type: YTN; PAM sequence: TTT
ttttccatattgcccctgca

SEQ ID NO: 176273 - DNA, 20 bp, Artificial Sequence
  Description of Artificial Sequence: Synthetic oligonucleotide
  Target: ATXN1; (-) strand; PAM type: YTN; PAM sequence: TTC
catgtttttttccatattgc

SEQ ID NO: 176274 - DNA, 20 bp, Artificial Sequence
  Description of Artificial Sequence: Synthetic oligonucleotide
  Target: ATXN1; (-) strand; PAM type: YTN; PAM sequence: TTG
tattccatgtttttttccat

SEQ ID NO: 176275 - DNA, 20 bp, Artificial Sequence
  Description of Artificial Sequence: Synthetic oligonucleotide
  Target: ATXN1; (-) strand; PAM type: YTN; PAM sequence: CTG
cattgtattccatgtttttt

SEQ ID NO: 176276 - DNA, 20 bp, Artificial Sequence
  Description of Artificial Sequence: Synthetic oligonucleotide
  Target: ATXN1; (-) strand; PAM type: YTN; PAM sequence: CTA
aactgcattgtattccatgt

SEQ ID NO: 176277 - DNA, 20 bp, Artificial Sequence
  Description of Artificial Sequence: Synthetic oligonucleotide
  Target: ATXN1; (-) strand; PAM type: YTN; PAM sequence: CTG
ccagtcgtggctaaactgca

SEQ ID NO: 176278 - DNA, 20 bp, Artificial Sequence
  Description of Artificial Sequence: Synthetic oligonucleotide
  Target: ATXN1; (-) strand; PAM type: YTN; PAM sequence: TTG
gctgccagtcgtggctaaac

SEQ ID NO: 176279 - DNA, 20 bp, Artificial Sequence
  Description of Artificial Sequence: Synthetic oligonucleotide
  Target: ATXN1; (-) strand; PAM type: YTN; PAM sequence: CTT
ggctgccagtcgtggctaaa

SEQ ID NO: 176280 - DNA, 20 bp, Artificial Sequence
  Description of Artificial Sequence: Synthetic oligonucleotide
  Target: ATXN1; (-) strand; PAM type: YTN; PAM sequence: TTA
aaggtcaatcttggctgcca

SEQ ID NO: 176281 - DNA, 20 bp, Artificial Sequence
  Description of Artificial Sequence: Synthetic oligonucleotide
  Target: ATXN1; (-) strand; PAM type: YTN; PAM sequence: CTT
aaaggtcaatcttggctgcc

SEQ ID NO: 176282 - DNA, 20 bp, Artificial Sequence
  Description of Artificial Sequence: Synthetic oligonucleotide
  Target: ATXN1; (-) strand; PAM type: YTN; PAM sequence: TTG
gcatataataaaaaatgcat

SEQ ID NO: 176283 - DNA, 20 bp, Artificial Sequence
  Description of Artificial Sequence: Synthetic oligonucleotide
  Target: ATXN1; (-) strand; PAM type: YTN; PAM sequence: CTG
ggattggcatataataaaaa

SEQ ID NO: 176284 - DNA, 20 bp, Artificial Sequence
  Description of Artificial Sequence: Synthetic oligonucleotide
  Target: ATXN1; (-) strand; PAM type: YTN; PAM sequence: TTG
caccaggtcctgggattggc

SEQ ID NO: 176285 - DNA, 20 bp, Artificial Sequence
  Description of Artificial Sequence: Synthetic oligonucleotide
  Target: ATXN1; (-) strand; PAM type: YTN; PAM sequence: TTT
gcaccaggtcctgggattgg

SEQ ID NO: 176286 - DNA, 20 bp, Artificial Sequence
  Description of Artificial Sequence: Synthetic oligonucleotide
  Target: ATXN1; (-) strand; PAM type: YTN; PAM sequence: CTT
tgcaccaggtcctgggattg

SEQ ID NO: 176287 - DNA, 20 bp, Artificial Sequence
  Description of Artificial Sequence: Synthetic oligonucleotide
  Target: ATXN1; (-) strand; PAM type: YTN; PAM sequence: CTA
tctttgcaccaggtcctggg

SEQ ID NO: 176288 - DNA, 20 bp, Artificial Sequence
  Description of Artificial Sequence: Synthetic oligonucleotide
  Target: ATXN1; (-) strand; PAM type: YTN; PAM sequence: CTG
gctatctttgcaccaggtcc

SEQ ID NO: 176289 - DNA, 20 bp, Artificial Sequence
  Description of Artificial Sequence: Synthetic oligonucleotide
  Target: ATXN1; (-) strand; PAM type: YTN; PAM sequence: TTA
ctggctatctttgcaccagg

SEQ ID NO: 176290 - DNA, 20 bp, Artificial Sequence
  Description of Artificial Sequence: Synthetic oligonucleotide
  Target: ATXN1; (-) strand; PAM type: YTN; PAM sequence: CTT
actggctatctttgcaccag

SEQ ID NO: 176291 - DNA, 20 bp, Artificial Sequence
  Description of Artificial Sequence: Synthetic oligonucleotide
  Target: ATXN1; (-) strand; PAM type: YTN; PAM sequence: TTC
ttactggctatctttgcacc

SEQ ID NO: 176292 - DNA, 20 bp, Artificial Sequence
  Description of Artificial Sequence: Synthetic oligonucleotide
  Target: ATXN1; (-) strand; PAM type: YTN; PAM sequence: CTT
cttactggctatctttgcac

SEQ ID NO: 176293 - DNA, 20 bp, Artificial Sequence
  Description of Artificial Sequence: Synthetic oligonucleotide
  Target: ATXN1; (-) strand; PAM type: YTN; PAM sequence: TTA
cttcttactggctatctttg

SEQ ID NO: 176294 - DNA, 20 bp, Artificial Sequence
  Description of Artificial Sequence: Synthetic oligonucleotide
  Target: ATXN1; (-) strand; PAM type: YTN; PAM sequence: CTT
acttcttactggctatcttt

SEQ ID NO: 176295 - DNA, 20 bp, Artificial Sequence
  Description of Artificial Sequence: Synthetic oligonucleotide
  Target: ATXN1; (-) strand; PAM type: YTN; PAM sequence: TTC
aaaagatgaagatcttactt

SEQ ID NO: 176296 - DNA, 20 bp, Artificial Sequence
  Description of Artificial Sequence: Synthetic oligonucleotide
  Target: ATXN1; (-) strand; PAM type: YTN; PAM sequence: CTT
caaaagatgaagatcttact

SEQ ID NO: 176297 - DNA, 20 bp, Artificial Sequence
  Description of Artificial Sequence: Synthetic oligonucleotide
  Target: ATXN1; (-) strand; PAM type: YTN; PAM sequence: TTA
tatacttcaaaagatgaaga

SEQ ID NO: 176298 - DNA, 20 bp, Artificial Sequence
  Description of Artificial Sequence: Synthetic oligonucleotide
  Target: ATXN1; (-) strand; PAM type: YTN; PAM sequence: CTT
atatacttcaaaagatgaag

SEQ ID NO: 176299 - DNA, 20 bp, Artificial Sequence
  Description of Artificial Sequence: Synthetic oligonucleotide
  Target: ATXN1; (-) strand; PAM type: YTN; PAM sequence: TTA
gcacagaggcaaataaaaaa

SEQ ID NO: 176300 - DNA, 20 bp, Artificial Sequence
  Description of Artificial Sequence: Synthetic oligonucleotide
  Target: ATXN1; (-) strand; PAM type: YTN; PAM sequence: CTT
agcacagaggcaaataaaaa

SEQ ID NO: 176301 - DNA, 20 bp, Artificial Sequence
  Description of Artificial Sequence: Synthetic oligonucleotide
  Target: ATXN1; (-) strand; PAM type: YTN; PAM sequence: TTC
ttagcacagaggcaaataaa

SEQ ID NO: 176302 - DNA, 20 bp, Artificial Sequence
  Description of Artificial Sequence: Synthetic oligonucleotide
  Target: ATXN1; (-) strand; PAM type: YTN; PAM sequence: CTT
cttagcacagaggcaaataa

SEQ ID NO: 176303 - DNA, 20 bp, Artificial Sequence
  Description of Artificial Sequence: Synthetic oligonucleotide
  Target: ATXN1; (-) strand; PAM type: YTN; PAM sequence: TTC
ttcttagcacagaggcaaat

SEQ ID NO: 176304 - DNA, 20 bp, Artificial Sequence
  Description of Artificial Sequence: Synthetic oligonucleotide
  Target: ATXN1; (-) strand; PAM type: YTN; PAM sequence: TTG
gccattcttcttagcacaga

SEQ ID NO: 176305 - DNA, 20 bp, Artificial Sequence
  Description of Artificial Sequence: Synthetic oligonucleotide
  Target: ATXN1; (-) strand; PAM type: YTN; PAM sequence: TTT
ggccattcttcttagcacag

SEQ ID NO: 176306 - DNA, 20 bp, Artificial Sequence
  Description of Artificial Sequence: Synthetic oligonucleotide
  Target: ATXN1; (-) strand; PAM type: YTN; PAM sequence: TTG
gaatgaagaggaatatgatt

SEQ ID NO: 176307 - DNA, 20 bp, Artificial Sequence
  Description of Artificial Sequence: Synthetic oligonucleotide
  Target: ATXN1; (-) strand; PAM type: YTN; PAM sequence: CTT
ggaatgaagaggaatatgat

SEQ ID NO: 176308 - DNA, 20 bp, Artificial Sequence
  Description of Artificial Sequence: Synthetic oligonucleotide
  Target: ATXN1; (-) strand; PAM type: YTN; PAM sequence: CTC
caacttggaatgaagaggaa

SEQ ID NO: 176309 - DNA, 20 bp, Artificial Sequence
  Description of Artificial Sequence: Synthetic oligonucleotide
  Target: ATXN1; (-) strand; PAM type: YTN; PAM sequence: CTG
ctccaacttggaatgaagag

SEQ ID NO: 176310 - DNA, 20 bp, Artificial Sequence
  Description of Artificial Sequence: Synthetic oligonucleotide
  Target: ATXN1; (-) strand; PAM type: YTN; PAM sequence: TTC
tgctccaacttggaatgaag

SEQ ID NO: 176311 - DNA, 20 bp, Artificial Sequence
  Description of Artificial Sequence: Synthetic oligonucleotide
  Target: ATXN1; (-) strand; PAM type: YTN; PAM sequence: CTG
ttctgctccaacttggaatg

SEQ ID NO: 176312 - DNA, 20 bp, Artificial Sequence
  Description of Artificial Sequence: Synthetic oligonucleotide
  Target: ATXN1; (-) strand; PAM type: YTN; PAM sequence: CTA
aggctgttctgctccaactt

SEQ ID NO: 176313 - DNA, 20 bp, Artificial Sequence
  Description of Artificial Sequence: Synthetic oligonucleotide
  Target: ATXN1; (-) strand; PAM type: YTN; PAM sequence: TTG
gcagcaacctaaggctgttc

SEQ ID NO: 176314 - DNA, 20 bp, Artificial Sequence
  Description of Artificial Sequence: Synthetic oligonucleotide
  Target: ATXN1; (-) strand; PAM type: YTN; PAM sequence: CTC
gaaggataacagttggcagc

SEQ ID NO: 176315 - DNA, 20 bp, Artificial Sequence
  Description of Artificial Sequence: Synthetic oligonucleotide
  Target: ATXN1; (-) strand; PAM type: YTN; PAM sequence: CTC
tcgaaggataacagttggca

SEQ ID NO: 176316 - DNA, 20 bp, Artificial Sequence
  Description of Artificial Sequence: Synthetic oligonucleotide
  Target: ATXN1; (-) strand; PAM type: YTN; PAM sequence: CTC
aaaatatgtggccctctcga

SEQ ID NO: 176317 - DNA, 20 bp, Artificial Sequence
  Description of Artificial Sequence: Synthetic oligonucleotide
  Target: ATXN1; (-) strand; PAM type: YTN; PAM sequence: CTG
aaacctcaaaatatgtggcc

SEQ ID NO: 176318 - DNA, 20 bp, Artificial Sequence
  Description of Artificial Sequence: Synthetic oligonucleotide
  Target: ATXN1; (-) strand; PAM type: YTN; PAM sequence: CTC
tgaaacctcaaaatatgtgg

SEQ ID NO: 176319 - DNA, 20 bp, Artificial Sequence
  Description of Artificial Sequence: Synthetic oligonucleotide
  Target: ATXN1; (-) strand; PAM type: YTN; PAM sequence: CTG
tctctgaaacctcaaaatat

SEQ ID NO: 176320 - DNA, 20 bp, Artificial Sequence
  Description of Artificial Sequence: Synthetic oligonucleotide
  Target: ATXN1; (-) strand; PAM type: YTN; PAM sequence: CTC
actgtctctgaaacctcaaa

SEQ ID NO: 176321 - DNA, 20 bp, Artificial Sequence
  Description of Artificial Sequence: Synthetic oligonucleotide
  Target: ATXN1; (-) strand; PAM type: YTN; PAM sequence: CTA
cctcactgtctctgaaacct

SEQ ID NO: 176322 - DNA, 20 bp, Artificial Sequence
  Description of Artificial Sequence: Synthetic oligonucleotide
  Target: ATXN1; (-) strand; PAM type: YTN; PAM sequence: CTC
aaggcagaatctacctcact

SEQ ID NO: 176323 - DNA, 20 bp, Artificial Sequence
  Description of Artificial Sequence: Synthetic oligonucleotide
  Target: ATXN1; (-) strand; PAM type: YTN; PAM sequence: TTC
tcaaggcagaatctacctca

SEQ ID NO: 176324 - DNA, 20 bp, Artificial Sequence
  Description of Artificial Sequence: Synthetic oligonucleotide
  Target: ATXN1; (-) strand; PAM type: YTN; PAM sequence: TTT
ctcaaggcagaatctacctc

SEQ ID NO: 176325 - DNA, 20 bp, Artificial Sequence
  Description of Artificial Sequence: Synthetic oligonucleotide
  Target: ATXN1; (-) strand; PAM type: YTN; PAM sequence: CTG
atatttctcaaggcagaatc

SEQ ID NO: 176326 - DNA, 20 bp, Artificial Sequence
  Description of Artificial Sequence: Synthetic oligonucleotide
  Target: ATXN1; (-) strand; PAM type: YTN; PAM sequence: TTG
agtgtctgatatttctcaag

SEQ ID NO: 176327 - DNA, 20 bp, Artificial Sequence
  Description of Artificial Sequence: Synthetic oligonucleotide
  Target: ATXN1; (-) strand; PAM type: YTN; PAM sequence: CTT
gagtgtctgatatttctcaa

SEQ ID NO: 176328 - DNA, 20 bp, Artificial Sequence
  Description of Artificial Sequence: Synthetic oligonucleotide
  Target: ATXN1; (-) strand; PAM type: YTN; PAM sequence: CTC
agtgtgtcgccggagtactt

SEQ ID NO: 176329 - DNA, 20 bp, Artificial Sequence
  Description of Artificial Sequence: Synthetic oligonucleotide
  Target: ATXN1; (-) strand; PAM type: YTN; PAM sequence: TTG
ctcagtgtgtcgccggagta

SEQ ID NO: 176330 - DNA, 20 bp, Artificial Sequence
  Description of Artificial Sequence: Synthetic oligonucleotide
  Target: ATXN1; (-) strand; PAM type: YTN; PAM sequence: TTT
gctcagtgtgtcgccggagt

SEQ ID NO: 176331 - DNA, 20 bp, Artificial Sequence
  Description of Artificial Sequence: Synthetic oligonucleotide
  Target: ATXN1; (-) strand; PAM type: YTN; PAM sequence: CTG
gcaaaaacatttgctcagtg

SEQ ID NO: 176332 - DNA, 20 bp, Artificial Sequence
  Description of Artificial Sequence: Synthetic oligonucleotide
  Target: ATXN1; (-) strand; PAM type: YTN; PAM sequence: CTG
ctggcaaaaacatttgctca

SEQ ID NO: 176333 - DNA, 20 bp, Artificial Sequence
  Description of Artificial Sequence: Synthetic oligonucleotide
  Target: ATXN1; (-) strand; PAM type: YTN; PAM sequence: TTC
tgctggcaaaaacatttgct

SEQ ID NO: 176334 - DNA, 20 bp, Artificial Sequence
  Description of Artificial Sequence: Synthetic oligonucleotide
  Target: ATXN1; (-) strand; PAM type: YTN; PAM sequence: TTT
ctgctggcaaaaacatttgc

SEQ ID NO: 176335 - DNA, 20 bp, Artificial Sequence
  Description of Artificial Sequence: Synthetic oligonucleotide
  Target: ATXN1; (-) strand; PAM type: YTN; PAM sequence: CTT
tctgctggcaaaaacatttg

SEQ ID NO: 176336 - DNA, 20 bp, Artificial Sequence
  Description of Artificial Sequence: Synthetic oligonucleotide
  Target: ATXN1; (-) strand; PAM type: YTN; PAM sequence: CTA
tatctttctgctggcaaaaa

SEQ ID NO: 176337 - DNA, 20 bp, Artificial Sequence
  Description of Artificial Sequence: Synthetic oligonucleotide
  Target: ATXN1; (-) strand; PAM type: YTN; PAM sequence: CTG
cgccacggtgaacccaccta

SEQ ID NO: 176338 - DNA, 20 bp, Artificial Sequence
  Description of Artificial Sequence: Synthetic oligonucleotide
  Target: ATXN1; (-) strand; PAM type: YTN; PAM sequence: CTC
acctgcgccacggtgaaccc

SEQ ID NO: 176339 - DNA, 20 bp, Artificial Sequence
  Description of Artificial Sequence: Synthetic oligonucleotide
  Target: ATXN1; (-) strand; PAM type: YTN; PAM sequence: CTC
cctcacctgcgccacggtga

SEQ ID NO: 176340 - DNA, 20 bp, Artificial Sequence
  Description of Artificial Sequence: Synthetic oligonucleotide
  Target: ATXN1; (-) strand; PAM type: YTN; PAM sequence: CTC
tccctcacctgcgccacggt

SEQ ID NO: 176341 - DNA, 20 bp, Artificial Sequence
  Description of Artificial Sequence: Synthetic oligonucleotide
  Target: ATXN1; (-) strand; PAM type: YTN; PAM sequence: TTC
ctctccctcacctgcgccac

SEQ ID NO: 176342 - DNA, 20 bp, Artificial Sequence
  Description of Artificial Sequence: Synthetic oligonucleotide
  Target: ATXN1; (-) strand; PAM type: YTN; PAM sequence: CTT
cctctccctcacctgcgcca

SEQ ID NO: 176343 - DNA, 20 bp, Artificial Sequence
  Description of Artificial Sequence: Synthetic oligonucleotide
  Target: ATXN1; (-) strand; PAM type: YTN; PAM sequence: CTG
tgcacagcttcctctccctc

SEQ ID NO: 176344 - DNA, 20 bp, Artificial Sequence
  Description of Artificial Sequence: Synthetic oligonucleotide
  Target: ATXN1; (-) strand; PAM type: YTN; PAM sequence: TTA
ctgtgcacagcttcctctcc

SEQ ID NO: 176345 - DNA, 20 bp, Artificial Sequence
  Description of Artificial Sequence: Synthetic oligonucleotide
  Target: ATXN1; (-) strand; PAM type: YTN; PAM sequence: CTT
actgtgcacagcttcctctc

SEQ ID NO: 176346 - DNA, 20 bp, Artificial Sequence
  Description of Artificial Sequence: Synthetic oligonucleotide
  Target: ATXN1; (-) strand; PAM type: YTN; PAM sequence: CTG
gagaagagaaagtgcgctta

SEQ ID NO: 176347 - DNA, 20 bp, Artificial Sequence
  Description of Artificial Sequence: Synthetic oligonucleotide
  Target: ATXN1; (-) strand; PAM type: YTN; PAM sequence: CTG
tggcaccaggatgtctggag

SEQ ID NO: 176348 - DNA, 20 bp, Artificial Sequence
  Description of Artificial Sequence: Synthetic oligonucleotide
  Target: ATXN1; (-) strand; PAM type: YTN; PAM sequence: CTA
ctgtggcaccaggatgtctg

SEQ ID NO: 176349 - DNA, 20 bp, Artificial Sequence
  Description of Artificial Sequence: Synthetic oligonucleotide
  Target: ATXN1; (-) strand; PAM type: YTN; PAM sequence: TTA
cagaagaggagagagaatgg

SEQ ID NO: 176350 - DNA, 20 bp, Artificial Sequence
  Description of Artificial Sequence: Synthetic oligonucleotide
  Target: ATXN1; (-) strand; PAM type: YTN; PAM sequence: TTA
gaagttacagaagaggagag

SEQ ID NO: 176351 - DNA, 20 bp, Artificial Sequence
  Description of Artificial Sequence: Synthetic oligonucleotide
  Target: ATXN1; (-) strand; PAM type: YTN; PAM sequence: CTT
agaagttacagaagaggaga

SEQ ID NO: 176352 - DNA, 20 bp, Artificial Sequence
  Description of Artificial Sequence: Synthetic oligonucleotide
  Target: ATXN1; (-) strand; PAM type: YTN; PAM sequence: TTA
aggcaaaggtcttagaagtt

SEQ ID NO: 176353 - DNA, 20 bp, Artificial Sequence
  Description of Artificial Sequence: Synthetic oligonucleotide
  Target: ATXN1; (-) strand; PAM type: YTN; PAM sequence: CTT
aaggcaaaggtcttagaagt

SEQ ID NO: 176354 - DNA, 20 bp, Artificial Sequence
  Description of Artificial Sequence: Synthetic oligonucleotide
  Target: ATXN1; (-) strand; PAM type: YTN; PAM sequence: TTC
acttaaggcaaaggtcttag

SEQ ID NO: 176355 - DNA, 20 bp, Artificial Sequence
  Description of Artificial Sequence: Synthetic oligonucleotide
  Target: ATXN1; (-) strand; PAM type: YTN; PAM sequence: TTA
ggaggatccattcacttaag

SEQ ID NO: 176356 - DNA, 20 bp, Artificial Sequence
  Description of Artificial Sequence: Synthetic oligonucleotide
  Target: ATXN1; (-) strand; PAM type: YTN; PAM sequence: CTT
aggaggatccattcacttaa

SEQ ID NO: 176357 - DNA, 20 bp, Artificial Sequence
  Description of Artificial Sequence: Synthetic oligonucleotide
  Target: ATXN1; (-) strand; PAM type: YTN; PAM sequence: CTG
tcttaggaggatccattcac

SEQ ID NO: 176358 - DNA, 20 bp, Artificial Sequence
  Description of Artificial Sequence: Synthetic oligonucleotide
  Target: ATXN1; (-) strand; PAM type: YTN; PAM sequence: TTA
tggctgtcttaggaggatcc

SEQ ID NO: 176359 - DNA, 20 bp, Artificial Sequence
  Description of Artificial Sequence: Synthetic oligonucleotide
  Target: ATXN1; (-) strand; PAM type: YTN; PAM sequence: TTC
aagtcaaagagcagggacgt

SEQ ID NO: 176360 - DNA, 20 bp, Artificial Sequence
  Description of Artificial Sequence: Synthetic oligonucleotide
  Target: ATXN1; (-) strand; PAM type: YTN; PAM sequence: TTT
caagtcaaagagcagggacg

SEQ ID NO: 176361 - DNA, 20 bp, Artificial Sequence
  Description of Artificial Sequence: Synthetic oligonucleotide
  Target: ATXN1; (-) strand; PAM type: YTN; PAM sequence: TTT
tcaagtcaaagagcagggac

SEQ ID NO: 176362 - DNA, 20 bp, Artificial Sequence
  Description of Artificial Sequence: Synthetic oligonucleotide
  Target: ATXN1; (-) strand; PAM type: YTN; PAM sequence: CTT
ttcaagtcaaagagcaggga

SEQ ID NO: 176363 - DNA, 20 bp, Artificial Sequence
  Description of Artificial Sequence: Synthetic oligonucleotide
  Target: ATXN1; (-) strand; PAM type: YTN; PAM sequence: CTC
caagaaagggtgaacttttc

SEQ ID NO: 176364 - DNA, 20 bp, Artificial Sequence
  Description of Artificial Sequence: Synthetic oligonucleotide
  Target: ATXN1; (-) strand; PAM type: YTN; PAM sequence: CTC
tccaagaaagggtgaacttt

SEQ ID NO: 176365 - DNA, 20 bp, Artificial Sequence
  Description of Artificial Sequence: Synthetic oligonucleotide
  Target: ATXN1; (-) strand; PAM type: YTN; PAM sequence: CTC
tctccaagaaagggtgaact

SEQ ID NO: 176366 - DNA, 20 bp, Artificial Sequence
  Description of Artificial Sequence: Synthetic oligonucleotide
  Target: ATXN1; (-) strand; PAM type: YTN; PAM sequence: CTC
tctctccaagaaagggtgaa

SEQ ID NO: 176367 - DNA, 20 bp, Artificial Sequence
  Description of Artificial Sequence: Synthetic oligonucleotide
  Target: ATXN1; (-) strand; PAM type: YTN; PAM sequence: TTC
caagtctctctctccaagaa

SEQ ID NO: 176368 - DNA, 20 bp, Artificial Sequence
  Description of Artificial Sequence: Synthetic oligonucleotide
  Target: ATXN1; (-) strand; PAM type: YTN; PAM sequence: TTT
ccaagtctctctctccaaga

SEQ ID NO: 176369 - DNA, 20 bp, Artificial Sequence
  Description of Artificial Sequence: Synthetic oligonucleotide
  Target: ATXN1; (-) strand; PAM type: YTN; PAM sequence: TTT
tccaagtctctctctccaag

SEQ ID NO: 176370 - DNA, 20 bp, Artificial Sequence
  Description of Artificial Sequence: Synthetic oligonucleotide
  Target: ATXN1; (-) strand; PAM type: YTN; PAM sequence: CTT
ttccaagtctctctctccaa

SEQ ID NO: 176371 - DNA, 20 bp, Artificial Sequence
  Description of Artificial Sequence: Synthetic oligonucleotide
  Target: ATXN1; (-) strand; PAM type: YTN; PAM sequence: CTC
ttttccaagtctctctctcc

SEQ ID NO: 176372 - DNA, 20 bp, Artificial Sequence
  Description of Artificial Sequence: Synthetic oligonucleotide
  Target: ATXN1; (-) strand; PAM type: YTN; PAM sequence: CTC
tcttttccaagtctctctct

SEQ ID NO: 176373 - DNA, 20 bp, Artificial Sequence
  Description of Artificial Sequence: Synthetic oligonucleotide
  Target: ATXN1; (-) strand; PAM type: YTN; PAM sequence: TTC
atgcctctcttttccaagtc

SEQ ID NO: 176374 - DNA, 20 bp, Artificial Sequence
  Description of Artificial Sequence: Synthetic oligonucleotide
  Target: ATXN1; (-) strand; PAM type: YTN; PAM sequence: CTT
catgcctctcttttccaagt

SEQ ID NO: 176375 - DNA, 20 bp, Artificial Sequence
  Description of Artificial Sequence: Synthetic oligonucleotide
  Target: ATXN1; (-) strand; PAM type: YTN; PAM sequence: TTG
agacccttcatgcctctctt

SEQ ID NO: 176376 - DNA, 20 bp, Artificial Sequence
  Description of Artificial Sequence: Synthetic oligonucleotide
  Target: ATXN1; (-) strand; PAM type: YTN; PAM sequence: CTT
gagacccttcatgcctctct

SEQ ID NO: 176377 - DNA, 20 bp, Artificial Sequence
  Description of Artificial Sequence: Synthetic oligonucleotide
  Target: ATXN1; (-) strand; PAM type: YTN; PAM sequence: TTG
ccagggcttgagacccttca

SEQ ID NO: 176378 - DNA, 20 bp, Artificial Sequence
  Description of Artificial Sequence: Synthetic oligonucleotide
  Target: ATXN1; (-) strand; PAM type: YTN; PAM sequence: CTG
aggcagaattgccagggctt

SEQ ID NO: 176379 - DNA, 20 bp, Artificial Sequence
  Description of Artificial Sequence: Synthetic oligonucleotide
  Target: ATXN1; (-) strand; PAM type: YTN; PAM sequence: TTC
actgaggcagaattgccagg

SEQ ID NO: 176380 - DNA, 20 bp, Artificial Sequence
  Description of Artificial Sequence: Synthetic oligonucleotide
  Target: ATXN1; (-) strand; PAM type: YTN; PAM sequence: CTG
tggaggtagaagtcggattc

SEQ ID NO: 176381 - DNA, 20 bp, Artificial Sequence
  Description of Artificial Sequence: Synthetic oligonucleotide
  Target: ATXN1; (-) strand; PAM type: YTN; PAM sequence: TTC
actgtggaggtagaagtcgg

SEQ ID NO: 176382 - DNA, 20 bp, Artificial Sequence
  Description of Artificial Sequence: Synthetic oligonucleotide
  Target: ATXN1; (-) strand; PAM type: YTN; PAM sequence: TTT
cactgtggaggtagaagtcg

SEQ ID NO: 176383 - DNA, 20 bp, Artificial Sequence
  Description of Artificial Sequence: Synthetic oligonucleotide
  Target: ATXN1; (-) strand; PAM type: YTN; PAM sequence: CTA
gggagatttcactgtggagg

SEQ ID NO: 176384 - DNA, 20 bp, Artificial Sequence
  Description of Artificial Sequence: Synthetic oligonucleotide
  Target: ATXN1; (-) strand; PAM type: YTN; PAM sequence: CTA
gctagggagatttcactgtg

SEQ ID NO: 176385 - DNA, 20 bp, Artificial Sequence
  Description of Artificial Sequence: Synthetic oligonucleotide
  Target: ATXN1; (-) strand; PAM type: YTN; PAM sequence: CTC
aactagctagggagatttca

SEQ ID NO: 176386 - DNA, 20 bp, Artificial Sequence
  Description of Artificial Sequence: Synthetic oligonucleotide
  Target: ATXN1; (-) strand; PAM type: YTN; PAM sequence: CTG
cccctcaactagctagggag

SEQ ID NO: 176387 - DNA, 20 bp, Artificial Sequence
  Description of Artificial Sequence: Synthetic oligonucleotide
  Target: ATXN1; (-) strand; PAM type: YTN; PAM sequence: CTG
ctgcccctcaactagctagg

SEQ ID NO: 176388 - DNA, 20 bp, Artificial Sequence
  Description of Artificial Sequence: Synthetic oligonucleotide
  Target: ATXN1; (-) strand; PAM type: YTN; PAM sequence: TTA
atactgctgcccctcaacta

SEQ ID NO: 176389 - DNA, 20 bp, Artificial Sequence
  Description of Artificial Sequence: Synthetic oligonucleotide
  Target: ATXN1; (-) strand; PAM type: YTN; PAM sequence: TTA
ggaaggaacaattaatactg

SEQ ID NO: 176390 - DNA, 20 bp, Artificial Sequence
  Description of Artificial Sequence: Synthetic oligonucleotide
  Target: ATXN1; (-) strand; PAM type: YTN; PAM sequence: CTT
aggaaggaacaattaatact

SEQ ID NO: 176391 - DNA, 20 bp, Artificial Sequence
  Description of Artificial Sequence: Synthetic oligonucleotide
  Target: ATXN1; (-) strand; PAM type: YTN; PAM sequence: CTC
ttaggaaggaacaattaata

SEQ ID NO: 176392 - DNA, 20 bp, Artificial Sequence
  Description of Artificial Sequence: Synthetic oligonucleotide
  Target: ATXN1; (-) strand; PAM type: YTN; PAM sequence: TTG
acaactcttaggaaggaaca

SEQ ID NO: 176393 - DNA, 20 bp, Artificial Sequence
  Description of Artificial Sequence: Synthetic oligonucleotide
  Target: ATXN1; (-) strand; PAM type: YTN; PAM sequence: CTT
gacaactcttaggaaggaac

SEQ ID NO: 176394 - DNA, 20 bp, Artificial Sequence
  Description of Artificial Sequence: Synthetic oligonucleotide
  Target: ATXN1; (-) strand; PAM type: YTN; PAM sequence: TTG
cttgacaactcttaggaagg

SEQ ID NO: 176395 - DNA, 20 bp, Artificial Sequence
  Description of Artificial Sequence: Synthetic oligonucleotide
  Target: ATXN1; (-) strand; PAM type: YTN; PAM sequence: TTT
gcttgacaactcttaggaag

SEQ ID NO: 176396 - DNA, 20 bp, Artificial Sequence
  Description of Artificial Sequence: Synthetic oligonucleotide
  Target: ATXN1; (-) strand; PAM type: YTN; PAM sequence: TTG
atttgcttgacaactcttag

SEQ ID NO: 176397 - DNA, 20 bp, Artificial Sequence
  Description of Artificial Sequence: Synthetic oligonucleotide
  Target: ATXN1; (-) strand; PAM type: YTN; PAM sequence: CTC
aggttgatttgcttgacaac

SEQ ID NO: 176398 - DNA, 20 bp, Artificial Sequence
  Description of Artificial Sequence: Synthetic oligonucleotide
  Target: ATXN1; (-) strand; PAM type: YTN; PAM sequence: TTC
tcaggttgatttgcttgaca

SEQ ID NO: 176399 - DNA, 20 bp, Artificial Sequence
  Description of Artificial Sequence: Synthetic oligonucleotide
  Target: ATXN1; (-) strand; PAM type: YTN; PAM sequence: TTC
cagttctcaggttgatttgc

SEQ ID NO: 176400 - DNA, 20 bp, Artificial Sequence
  Description of Artificial Sequence: Synthetic oligonucleotide
  Target: ATXN1; (-) strand; PAM type: YTN; PAM sequence: TTG
ggtggattccagttctcagg

SEQ ID NO: 176401 - DNA, 20 bp, Artificial Sequence
  Description of Artificial Sequence: Synthetic oligonucleotide
  Target: ATXN1; (-) strand; PAM type: YTN; PAM sequence: CTT
gggtggattccagttctcag

SEQ ID NO: 176402 - DNA, 20 bp, Artificial Sequence
  Description of Artificial Sequence: Synthetic oligonucleotide
  Target: ATXN1; (-) strand; PAM type: YTN; PAM sequence: TTG
taaaaggcataggtgtgtct

SEQ ID NO: 176403 - DNA, 20 bp, Artificial Sequence
  Description of Artificial Sequence: Synthetic oligonucleotide
  Target: ATXN1; (-) strand; PAM type: YTN; PAM sequence: TTA
ttgtaaaaggcataggtgtg

SEQ ID NO: 176404 - DNA, 20 bp, Artificial Sequence
  Description of Artificial Sequence: Synthetic oligonucleotide
  Target: ATXN1; (-) strand; PAM type: YTN; PAM sequence: TTT
attgtaaaaggcataggtgt

SEQ ID NO: 176405 - DNA, 20 bp, Artificial Sequence
  Description of Artificial Sequence: Synthetic oligonucleotide
  Target: ATXN1; (-) strand; PAM type: YTN; PAM sequence: CTT
tattgtaaaaggcataggtg

SEQ ID NO: 176406 - DNA, 20 bp, Artificial Sequence
  Description of Artificial Sequence: Synthetic oligonucleotide
  Target: ATXN1; (-) strand; PAM type: YTN; PAM sequence: CTG
aatctttattgtaaaaggca

SEQ ID NO: 176407 - DNA, 20 bp, Artificial Sequence
  Description of Artificial Sequence: Synthetic oligonucleotide
  Target: ATXN1; (-) strand; PAM type: YTN; PAM sequence: TTC
actgaatctttattgtaaaa

SEQ ID NO: 176408 - DNA, 20 bp, Artificial Sequence
  Description of Artificial Sequence: Synthetic oligonucleotide
  Target: ATXN1; (-) strand; PAM type: YTN; PAM sequence: CTT
cactgaatctttattgtaaa

SEQ ID NO: 176409 - DNA, 20 bp, Artificial Sequence
  Description of Artificial Sequence: Synthetic oligonucleotide
  Target: ATXN1; (-) strand; PAM type: YTN; PAM sequence: TTC
ttcactgaatctttattgta

SEQ ID NO: 176410 - DNA, 20 bp, Artificial Sequence
  Description of Artificial Sequence: Synthetic oligonucleotide
  Target: ATXN1; (-) strand; PAM type: YTN; PAM sequence: TTG
tgaagggcaggattcttcac

SEQ ID NO: 176411 - DNA, 20 bp, Artificial Sequence
  Description of Artificial Sequence: Synthetic oligonucleotide
  Target: ATXN1; (-) strand; PAM type: YTN; PAM sequence: CTG
ttgtgaagggcaggattctt

SEQ ID NO: 176412 - DNA, 20 bp, Artificial Sequence
  Description of Artificial Sequence: Synthetic oligonucleotide
  Target: ATXN1; (-) strand; PAM type: YTN; PAM sequence: TTG
aggaggctgttgtgaagggc

SEQ ID NO: 176413 - DNA, 20 bp, Artificial Sequence
  Description of Artificial Sequence: Synthetic oligonucleotide
  Target: ATXN1; (-) strand; PAM type: YTN; PAM sequence: CTT
gaggaggctgttgtgaaggg

SEQ ID NO: 176414 - DNA, 20 bp, Artificial Sequence
  Description of Artificial Sequence: Synthetic oligonucleotide
  Target: ATXN1; (-) strand; PAM type: YTN; PAM sequence: CTA
cttgaggaggctgttgtgaa

SEQ ID NO: 176415 - DNA, 20 bp, Artificial Sequence
  Description of Artificial Sequence: Synthetic oligonucleotide
  Target: ATXN1; (-) strand; PAM type: YTN; PAM sequence: TTC
cctacttgaggaggctgttg

SEQ ID NO: 176416 - DNA, 20 bp, Artificial Sequence
  Description of Artificial Sequence: Synthetic oligonucleotide
  Target: ATXN1; (-) strand; PAM type: YTN; PAM sequence: TTT
ccctacttgaggaggctgtt

SEQ ID NO: 176417 - DNA, 20 bp, Artificial Sequence
  Description of Artificial Sequence: Synthetic oligonucleotide
  Target: ATXN1; (-) strand; PAM type: YTN; PAM sequence: TTT
tccctacttgaggaggctgt

SEQ ID NO: 176418 - DNA, 20 bp, Artificial Sequence
  Description of Artificial Sequence: Synthetic oligonucleotide
  Target: ATXN1; (-) strand; PAM type: YTN; PAM sequence: TTG
tagcgttttccctacttgag

SEQ ID NO: 176419 - DNA, 20 bp, Artificial Sequence
  Description of Artificial Sequence: Synthetic oligonucleotide
  Target: ATXN1; (-) strand; PAM type: YTN; PAM sequence: TTT
gtagcgttttccctacttga

SEQ ID NO: 176420 - DNA, 20 bp, Artificial Sequence
  Description of Artificial Sequence: Synthetic oligonucleotide
  Target: ATXN1; (-) strand; PAM type: YTN; PAM sequence: TTT
tgtagcgttttccctacttg

SEQ ID NO: 176421 - DNA, 20 bp, Artificial Sequence
  Description of Artificial Sequence: Synthetic oligonucleotide
  Target: ATXN1; (-) strand; PAM type: YTN; PAM sequence: TTT
ttgtagcgttttccctactt

SEQ ID NO: 176422 - DNA, 20 bp, Artificial Sequence
  Description of Artificial Sequence: Synthetic oligonucleotide
  Target: ATXN1; (-) strand; PAM type: YTN; PAM sequence: TTT
tttgtagcgttttccctact

SEQ ID NO: 176423 - DNA, 20 bp, Artificial Sequence
  Description of Artificial Sequence: Synthetic oligonucleotide
  Target: ATXN1; (-) strand; PAM type: YTN; PAM sequence: TTG
tcatgtatccattttttgta

SEQ ID NO: 176424 - DNA, 20 bp, Artificial Sequence
  Description of Artificial Sequence: Synthetic oligonucleotide
  Target: ATXN1; (-) strand; PAM type: YTN; PAM sequence: CTG
gttgtcatgtatccattttt

SEQ ID NO: 176425 - DNA, 20 bp, Artificial Sequence
  Description of Artificial Sequence: Synthetic oligonucleotide
  Target: ATXN1; (-) strand; PAM type: YTN; PAM sequence: TTC
ctggttgtcatgtatccatt

SEQ ID NO: 176426 - DNA, 20 bp, Artificial Sequence
  Description of Artificial Sequence: Synthetic oligonucleotide
  Target: ATXN1; (-) strand; PAM type: YTN; PAM sequence: CTG
tgggtgaaggagttcctggt

SEQ ID NO: 176427 - DNA, 20 bp, Artificial Sequence
  Description of Artificial Sequence: Synthetic oligonucleotide
  Target: ATXN1; (-) strand; PAM type: YTN; PAM sequence: CTC
tgtgggtgaaggagttcctg

SEQ ID NO: 176428 - DNA, 20 bp, Artificial Sequence
  Description of Artificial Sequence: Synthetic oligonucleotide
  Target: ATXN1; (-) strand; PAM type: YTN; PAM sequence: CTC
tctgtgggtgaaggagttcc

SEQ ID NO: 176429 - DNA, 20 bp, Artificial Sequence
  Description of Artificial Sequence: Synthetic oligonucleotide
  Target: ATXN1; (-) strand; PAM type: YTN; PAM sequence: TTG
ggaaaacagatggcagagat

SEQ ID NO: 176430 - DNA, 20 bp, Artificial Sequence
  Description of Artificial Sequence: Synthetic oligonucleotide
  Target: ATXN1; (-) strand; PAM type: YTN; PAM sequence: TTG
gcccaggttgggaaaacaga

SEQ ID NO: 176431 - DNA, 20 bp, Artificial Sequence
  Description of Artificial Sequence: Synthetic oligonucleotide
  Target: ATXN1; (-) strand; PAM type: YTN; PAM sequence: TTA
gaccacattggcccaggttg

SEQ ID NO: 176432 - DNA, 20 bp, Artificial Sequence
  Description of Artificial Sequence: Synthetic oligonucleotide
  Target: ATXN1; (-) strand; PAM type: YTN; PAM sequence: CTG
aaattagaccacattggccc

SEQ ID NO: 176433 - DNA, 20 bp, Artificial Sequence
  Description of Artificial Sequence: Synthetic oligonucleotide
  Target: ATXN1; (-) strand; PAM type: YTN; PAM sequence: TTG
tgaaaatatgaaagaactga

SEQ ID NO: 176434 - DNA, 20 bp, Artificial Sequence
  Description of Artificial Sequence: Synthetic oligonucleotide
  Target: ATXN1; (-) strand; PAM type: YTN; PAM sequence: CTT
gtgaaaatatgaaagaactg

SEQ ID NO: 176435 - DNA, 20 bp, Artificial Sequence
  Description of Artificial Sequence: Synthetic oligonucleotide
  Target: ATXN1; (-) strand; PAM type: YTN; PAM sequence: CTG
acttgtgaaaatatgaaaga

SEQ ID NO: 176436 - DNA, 20 bp, Artificial Sequence
  Description of Artificial Sequence: Synthetic oligonucleotide
  Target: ATXN1; (-) strand; PAM type: YTN; PAM sequence: CTC
tgacttgtgaaaatatgaaa

SEQ ID NO: 176437 - DNA, 20 bp, Artificial Sequence
  Description of Artificial Sequence: Synthetic oligonucleotide
  Target: ATXN1; (-) strand; PAM type: YTN; PAM sequence: TTC
cctctgacttgtgaaaatat

SEQ ID NO: 176438 - DNA, 20 bp, Artificial Sequence
  Description of Artificial Sequence: Synthetic oligonucleotide
  Target: ATXN1; (-) strand; PAM type: YTN; PAM sequence: TTT
ccctctgacttgtgaaaata

SEQ ID NO: 176439 - DNA, 20 bp, Artificial Sequence
  Description of Artificial Sequence: Synthetic oligonucleotide
  Target: ATXN1; (-) strand; PAM type: YTN; PAM sequence: CTG
gtttccctctgacttgtgaa

SEQ ID NO: 176440 - DNA, 20 bp, Artificial Sequence
  Description of Artificial Sequence: Synthetic oligonucleotide
  Target: ATXN1; (-) strand; PAM type: YTN; PAM sequence: TTC
ctggtttccctctgacttgt

SEQ ID NO: 176441 - DNA, 20 bp, Artificial Sequence
  Description of Artificial Sequence: Synthetic oligonucleotide
  Target: ATXN1; (-) strand; PAM type: YTN; PAM sequence: TTA
agattcctggtttccctctg

SEQ ID NO: 176442 - DNA, 20 bp, Artificial Sequence
  Description of Artificial Sequence: Synthetic oligonucleotide
  Target: ATXN1; (-) strand; PAM type: YTN; PAM sequence: TTT
aagattcctggtttccctct

SEQ ID NO: 176443 - DNA, 20 bp, Artificial Sequence
  Description of Artificial Sequence: Synthetic oligonucleotide
  Target: ATXN1; (-) strand; PAM type: YTN; PAM sequence: CTT
taagattcctggtttccctc

SEQ ID NO: 176444 - DNA, 20 bp, Artificial Sequence
  Description of Artificial Sequence: Synthetic oligonucleotide
  Target: ATXN1; (-) strand; PAM type: YTN; PAM sequence: TTC
agtagtaaacctttaagatt

SEQ ID NO: 176445 - DNA, 20 bp, Artificial Sequence
  Description of Artificial Sequence: Synthetic oligonucleotide
  Target: ATXN1; (-) strand; PAM type: YTN; PAM sequence: TTT
cagtagtaaacctttaagat

SEQ ID NO: 176446 - DNA, 20 bp, Artificial Sequence
  Description of Artificial Sequence: Synthetic oligonucleotide
  Target: ATXN1; (-) strand; PAM type: YTN; PAM sequence: TTT
tcagtagtaaacctttaaga

SEQ ID NO: 176447 - DNA, 20 bp, Artificial Sequence
  Description of Artificial Sequence: Synthetic oligonucleotide
  Target: ATXN1; (-) strand; PAM type: YTN; PAM sequence: CTT
ttcagtagtaaacctttaag

SEQ ID NO: 176448 - DNA, 20 bp, Artificial Sequence
  Description of Artificial Sequence: Synthetic oligonucleotide
  Target: ATXN1; (-) strand; PAM type: YTN; PAM sequence: CTG
aaaataaagtgcttttcagt

SEQ ID NO: 176449 - DNA, 20 bp, Artificial Sequence
  Description of Artificial Sequence: Synthetic oligonucleotide
  Target: ATXN1; (-) strand; PAM type: YTN; PAM sequence: TTA
ctgaaaataaagtgcttttc

SEQ ID NO: 176450 - DNA, 20 bp, Artificial Sequence
  Description of Artificial Sequence: Synthetic oligonucleotide
  Target: ATXN1; (-) strand; PAM type: YTN; PAM sequence: CTT
actgaaaataaagtgctttt

SEQ ID NO: 176451 - DNA, 20 bp, Artificial Sequence
  Description of Artificial Sequence: Synthetic oligonucleotide
  Target: ATXN1; (-) strand; PAM type: YTN; PAM sequence: TTA
aagcaccttactgaaaataa

SEQ ID NO: 176452 - DNA, 20 bp, Artificial Sequence
  Description of Artificial Sequence: Synthetic oligonucleotide
  Target: ATXN1; (-) strand; PAM type: YTN; PAM sequence: TTT
aaagcaccttactgaaaata

SEQ ID NO: 176453 - DNA, 20 bp, Artificial Sequence
  Description of Artificial Sequence: Synthetic oligonucleotide
  Target: ATXN1; (-) strand; PAM type: YTN; PAM sequence: TTT
taaagcaccttactgaaaat

SEQ ID NO: 176454 - DNA, 20 bp, Artificial Sequence
  Description of Artificial Sequence: Synthetic oligonucleotide
  Target: ATXN1; (-) strand; PAM type: YTN; PAM sequence: TTT
ttaaagcaccttactgaaaa

SEQ ID NO: 176455 - DNA, 20 bp, Artificial Sequence
  Description of Artificial Sequence: Synthetic oligonucleotide
  Target: ATXN1; (-) strand; PAM type: YTN; PAM sequence: TTT
tttaaagcaccttactgaaa

SEQ ID NO: 176456 - DNA, 20 bp, Artificial Sequence
  Description of Artificial Sequence: Synthetic oligonucleotide
  Target: ATXN1; (-) strand; PAM type: YTN; PAM sequence: CTA
ttttttaaagcaccttactg

SEQ ID NO: 176457 - DNA, 20 bp, Artificial Sequence
  Description of Artificial Sequence: Synthetic oligonucleotide
  Target: ATXN1; (-) strand; PAM type: YTN; PAM sequence: TTC
tattttttaaagcaccttac

SEQ ID NO: 176458 - DNA, 20 bp, Artificial Sequence
  Description of Artificial Sequence: Synthetic oligonucleotide
  Target: ATXN1; (-) strand; PAM type: YTN; PAM sequence: CTG
aatcagatcagatatgacaa

SEQ ID NO: 176459 - DNA, 20 bp, Artificial Sequence
  Description of Artificial Sequence: Synthetic oligonucleotide
  Target: ATXN1; (-) strand; PAM type: YTN; PAM sequence: TTA
cctgaatcagatcagatatg

SEQ ID NO: 176460 - DNA, 20 bp, Artificial Sequence
  Description of Artificial Sequence: Synthetic oligonucleotide
  Target: ATXN1; (-) strand; PAM type: YTN; PAM sequence: CTT
acctgaatcagatcagatat

SEQ ID NO: 176461 - DNA, 20 bp, Artificial Sequence
  Description of Artificial Sequence: Synthetic oligonucleotide
  Target: ATXN1; (-) strand; PAM type: YTN; PAM sequence: TTC
ttacctgaatcagatcagat

SEQ ID NO: 176462 - DNA, 20 bp, Artificial Sequence
  Description of Artificial Sequence: Synthetic oligonucleotide
  Target: ATXN1; (-) strand; PAM type: YTN; PAM sequence: TTT
cttacctgaatcagatcaga

SEQ ID NO: 176463 - DNA, 20 bp, Artificial Sequence
  Description of Artificial Sequence: Synthetic oligonucleotide
  Target: ATXN1; (-) strand; PAM type: YTN; PAM sequence: CTG
aaatttcttacctgaatcag

SEQ ID NO: 176464 - DNA, 20 bp, Artificial Sequence
  Description of Artificial Sequence: Synthetic oligonucleotide
  Target: ATXN1; (-) strand; PAM type: YTN; PAM sequence: TTC
tgaaatttcttacctgaatc

SEQ ID NO: 176465 - DNA, 20 bp, Artificial Sequence
  Description of Artificial Sequence: Synthetic oligonucleotide
  Target: ATXN1; (-) strand; PAM type: YTN; PAM sequence: TTT
ctgaaatttcttacctgaat

SEQ ID NO: 176466 - DNA, 20 bp, Artificial Sequence
  Description of Artificial Sequence: Synthetic oligonucleotide
  Target: ATXN1; (-) strand; PAM type: YTN; PAM sequence: CTT
tctgaaatttcttacctgaa

SEQ ID NO: 176467 - DNA, 20 bp, Artificial Sequence
  Description of Artificial Sequence: Synthetic oligonucleotide
  Target: ATXN1; (-) strand; PAM type: YTN; PAM sequence: TTC
cctttctgaaatttcttacc

SEQ ID NO: 176468 - DNA, 20 bp, Artificial Sequence
  Description of Artificial Sequence: Synthetic oligonucleotide
  Target: ATXN1; (-) strand; PAM type: YTN; PAM sequence: CTA
gagttccctttctgaaattt

SEQ ID NO: 176469 - DNA, 20 bp, Artificial Sequence
  Description of Artificial Sequence: Synthetic oligonucleotide
  Target: ATXN1; (-) strand; PAM type: YTN; PAM sequence: TTC
tagagttccctttctgaaat

SEQ ID NO: 176470 - DNA, 20 bp, Artificial Sequence
  Description of Artificial Sequence: Synthetic oligonucleotide
  Target: ATXN1; (-) strand; PAM type: YTN; PAM sequence: TTA
tgaaaaatgaattctagagt

SEQ ID NO: 176471 - DNA, 20 bp, Artificial Sequence
  Description of Artificial Sequence: Synthetic oligonucleotide
  Target: ATXN1; (-) strand; PAM type: YTN; PAM sequence: TTT
atgaaaaatgaattctagag

SEQ ID NO: 176472 - DNA, 20 bp, Artificial Sequence
  Description of Artificial Sequence: Synthetic oligonucleotide
  Target: ATXN1; (-) strand; PAM type: YTN; PAM sequence: CTT
tatgaaaaatgaattctaga

SEQ ID NO: 176473 - DNA, 20 bp, Artificial Sequence
  Description of Artificial Sequence: Synthetic oligonucleotide
  Target: ATXN1; (-) strand; PAM type: YTN; PAM sequence: CTG
tccctttatgaaaaatgaat

SEQ ID NO: 176474 - DNA, 20 bp, Artificial Sequence
  Description of Artificial Sequence: Synthetic oligonucleotide
  Target: ATXN1; (-) strand; PAM type: YTN; PAM sequence: CTG
actgtccctttatgaaaaat

SEQ ID NO: 176475 - DNA, 20 bp, Artificial Sequence
  Description of Artificial Sequence: Synthetic oligonucleotide
  Target: ATXN1; (-) strand; PAM type: YTN; PAM sequence: TTC
cactgactgtccctttatga

SEQ ID NO: 176476 - DNA, 20 bp, Artificial Sequence
  Description of Artificial Sequence: Synthetic oligonucleotide
  Target: ATXN1; (-) strand; PAM type: YTN; PAM sequence: CTA
ttccactgactgtcccttta

SEQ ID NO: 176477 - DNA, 20 bp, Artificial Sequence
  Description of Artificial Sequence: Synthetic oligonucleotide
  Target: ATXN1; (-) strand; PAM type: YTN; PAM sequence: CTC
tattccactgactgtccctt

SEQ ID NO: 176478 - DNA, 20 bp, Artificial Sequence
  Description of Artificial Sequence: Synthetic oligonucleotide
  Target: ATXN1; (-) strand; PAM type: YTN; PAM sequence: CTG
gtgctctattccactgactg

SEQ ID NO: 176479 - DNA, 20 bp, Artificial Sequence
  Description of Artificial Sequence: Synthetic oligonucleotide
  Target: ATXN1; (-) strand; PAM type: YTN; PAM sequence: CTA
cccctggtgctctattccac

SEQ ID NO: 176480 - DNA, 20 bp, Artificial Sequence
  Description of Artificial Sequence: Synthetic oligonucleotide
  Target: ATXN1; (-) strand; PAM type: YTN; PAM sequence: CTC
cccctacccctggtgctcta

SEQ ID NO: 176481 - DNA, 20 bp, Artificial Sequence
  Description of Artificial Sequence: Synthetic oligonucleotide
  Target: ATXN1; (-) strand; PAM type: YTN; PAM sequence: TTA
taaagactccccctacccct

SEQ ID NO: 176482 - DNA, 20 bp, Artificial Sequence
  Description of Artificial Sequence: Synthetic oligonucleotide
  Target: ATXN1; (-) strand; PAM type: YTN; PAM sequence: TTC
agagagaggtgtgtgattat

SEQ ID NO: 176483 - DNA, 20 bp, Artificial Sequence
  Description of Artificial Sequence: Synthetic oligonucleotide
  Target: ATXN1; (-) strand; PAM type: YTN; PAM sequence: CTA
acaagtgaaatgtattcaga

SEQ ID NO: 176484 - DNA, 20 bp, Artificial Sequence
  Description of Artificial Sequence: Synthetic oligonucleotide
  Target: ATXN1; (-) strand; PAM type: YTN; PAM sequence: CTG
atggctaacaagtgaaatgt

SEQ ID NO: 176485 - DNA, 20 bp, Artificial Sequence
  Description of Artificial Sequence: Synthetic oligonucleotide
  Target: ATXN1; (-) strand; PAM type: YTN; PAM sequence: TTC
agacctgatggctaacaagt

SEQ ID NO: 176486 - DNA, 20 bp, Artificial Sequence
  Description of Artificial Sequence: Synthetic oligonucleotide
  Target: ATXN1; (-) strand; PAM type: YTN; PAM sequence: TTT
cagacctgatggctaacaag

SEQ ID NO: 176487 - DNA, 20 bp, Artificial Sequence
  Description of Artificial Sequence: Synthetic oligonucleotide
  Target: ATXN1; (-) strand; PAM type: YTN; PAM sequence: TTT
tcagacctgatggctaacaa

SEQ ID NO: 176488 - DNA, 20 bp, Artificial Sequence
  Description of Artificial Sequence: Synthetic oligonucleotide
  Target: ATXN1; (-) strand; PAM type: YTN; PAM sequence: CTA
cagttttcagacctgatggc

SEQ ID NO: 176489 - DNA, 20 bp, Artificial Sequence
  Description of Artificial Sequence: Synthetic oligonucleotide
  Target: ATXN1; (-) strand; PAM type: YTN; PAM sequence: CTG
aacagagccagcactacagt

SEQ ID NO: 176490 - DNA, 20 bp, Artificial Sequence
  Description of Artificial Sequence: Synthetic oligonucleotide
  Target: ATXN1; (-) strand; PAM type: YTN; PAM sequence: TTG
aacaataactgaacagagcc

SEQ ID NO: 176491 - DNA, 20 bp, Artificial Sequence
  Description of Artificial Sequence: Synthetic oligonucleotide
  Target: ATXN1; (-) strand; PAM type: YTN; PAM sequence: CTT
gaacaataactgaacagagc

SEQ ID NO: 176492 - DNA, 20 bp, Artificial Sequence
  Description of Artificial Sequence: Synthetic oligonucleotide
  Target: ATXN1; (-) strand; PAM type: YTN; PAM sequence: TTG
agatcacacttgaacaataa

SEQ ID NO: 176493 - DNA, 20 bp, Artificial Sequence
  Description of Artificial Sequence: Synthetic oligonucleotide
  Target: ATXN1; (-) strand; PAM type: YTN; PAM sequence: TTC
agggtcgttgagatcacact

SEQ ID NO: 176494 - DNA, 20 bp, Artificial Sequence
  Description of Artificial Sequence: Synthetic oligonucleotide
  Target: ATXN1; (-) strand; PAM type: YTN; PAM sequence: TTT
cagggtcgttgagatcacac

SEQ ID NO: 176495 - DNA, 20 bp, Artificial Sequence
  Description of Artificial Sequence: Synthetic oligonucleotide
  Target: ATXN1; (-) strand; PAM type: YTN; PAM sequence: CTG
atgcaaaatgacaaagaaga

SEQ ID NO: 176496 - DNA, 20 bp, Artificial Sequence
  Description of Artificial Sequence: Synthetic oligonucleotide
  Target: ATXN1; (-) strand; PAM type: YTN; PAM sequence: TTG
cgtagtagaaggccgtgagg

SEQ ID NO: 176497 - DNA, 20 bp, Artificial Sequence
  Description of Artificial Sequence: Synthetic oligonucleotide
  Target: ATXN1; (-) strand; PAM type: YTN; PAM sequence: CTT
gcgtagtagaaggccgtgag

SEQ ID NO: 176498 - DNA, 20 bp, Artificial Sequence
  Description of Artificial Sequence: Synthetic oligonucleotide
  Target: ATXN1; (-) strand; PAM type: YTN; PAM sequence: TTA
tatcatgagaccttgcgtag

SEQ ID NO: 176499 - DNA, 20 bp, Artificial Sequence
  Description of Artificial Sequence: Synthetic oligonucleotide
  Target: ATXN1; (-) strand; PAM type: YTN; PAM sequence: TTT
atatcatgagaccttgcgta

SEQ ID NO: 176500 - DNA, 20 bp, Artificial Sequence
  Description of Artificial Sequence: Synthetic oligonucleotide
  Target: ATXN1; (-) strand; PAM type: YTN; PAM sequence: TTC
atttatatcatgagaccttg

SEQ ID NO: 176501 - DNA, 20 bp, Artificial Sequence
  Description of Artificial Sequence: Synthetic oligonucleotide
  Target: ATXN1; (-) strand; PAM type: YTN; PAM sequence: CTT
catttatatcatgagacctt

SEQ ID NO: 176502 - DNA, 20 bp, Artificial Sequence
  Description of Artificial Sequence: Synthetic oligonucleotide
  Target: ATXN1; (-) strand; PAM type: YTN; PAM sequence: CTG
gaaggaaaagaagataacct

SEQ ID NO: 176503 - DNA, 20 bp, Artificial Sequence
  Description of Artificial Sequence: Synthetic oligonucleotide
  Target: ATXN1; (-) strand; PAM type: YTN; PAM sequence: CTG
taaagaggagtgactggaag

SEQ ID NO: 176504 - DNA, 20 bp, Artificial Sequence
  Description of Artificial Sequence: Synthetic oligonucleotide
  Target: ATXN1; (-) strand; PAM type: YTN; PAM sequence: TTC
tgtaaagaggagtgactgga

SEQ ID NO: 176505 - DNA, 20 bp, Artificial Sequence
  Description of Artificial Sequence: Synthetic oligonucleotide
  Target: ATXN1; (-) strand; PAM type: YTN; PAM sequence: TTT
ctgtaaagaggagtgactgg

SEQ ID NO: 176506 - DNA, 20 bp, Artificial Sequence
  Description of Artificial Sequence: Synthetic oligonucleotide
  Target: ATXN1; (-) strand; PAM type: YTN; PAM sequence: TTA
tgtaggagatttctgtaaag

SEQ ID NO: 176507 - DNA, 20 bp, Artificial Sequence
  Description of Artificial Sequence: Synthetic oligonucleotide
  Target: ATXN1; (-) strand; PAM type: YTN; PAM sequence: CTC
aattatgtaggagatttctg

SEQ ID NO: 176508 - DNA, 20 bp, Artificial Sequence
  Description of Artificial Sequence: Synthetic oligonucleotide
  Target: ATXN1; (-) strand; PAM type: YTN; PAM sequence: TTG
atgacagcatctcaattatg

SEQ ID NO: 176509 - DNA, 20 bp, Artificial Sequence
  Description of Artificial Sequence: Synthetic oligonucleotide
  Target: ATXN1; (-) strand; PAM type: YTN; PAM sequence: CTG
attgatgacagcatctcaat

SEQ ID NO: 176510 - DNA, 20 bp, Artificial Sequence
  Description of Artificial Sequence: Synthetic oligonucleotide
  Target: ATXN1; (-) strand; PAM type: YTN; PAM sequence: TTG
actgattgatgacagcatct

SEQ ID NO: 176511 - DNA, 20 bp, Artificial Sequence
  Description of Artificial Sequence: Synthetic oligonucleotide
  Target: ATXN1; (-) strand; PAM type: YTN; PAM sequence: TTG
gttgactgattgatgacagc

SEQ ID NO: 176512 - DNA, 20 bp, Artificial Sequence
  Description of Artificial Sequence: Synthetic oligonucleotide
  Target: ATXN1; (-) strand; PAM type: YTN; PAM sequence: TTG
gttggttgactgattgatga

SEQ ID NO: 176513 - DNA, 20 bp, Artificial Sequence
  Description of Artificial Sequence: Synthetic oligonucleotide
  Target: ATXN1; (-) strand; PAM type: YTN; PAM sequence: CTT
ggttggttgactgattgatg

SEQ ID NO: 176514 - DNA, 20 bp, Artificial Sequence
  Description of Artificial Sequence: Synthetic oligonucleotide
  Target: ATXN1; (-) strand; PAM type: YTN; PAM sequence: TTC
agggggcttggttggttgac

SEQ ID NO: 176515 - DNA, 20 bp, Artificial Sequence
  Description of Artificial Sequence: Synthetic oligonucleotide
  Target: ATXN1; (-) strand; PAM type: YTN; PAM sequence: CTG
gaacatcacaaggacccagt

SEQ ID NO: 176516 - DNA, 20 bp, Artificial Sequence
  Description of Artificial Sequence: Synthetic oligonucleotide
  Target: ATXN1; (-) strand; PAM type: YTN; PAM sequence: TTA
aacccctggaacatcacaag

SEQ ID NO: 176517 - DNA, 20 bp, Artificial Sequence
  Description of Artificial Sequence: Synthetic oligonucleotide
  Target: ATXN1; (-) strand; PAM type: YTN; PAM sequence: TTG
taattaaacccctggaacat

SEQ ID NO: 176518 - DNA, 20 bp, Artificial Sequence
  Description of Artificial Sequence: Synthetic oligonucleotide
  Target: ATXN1; (-) strand; PAM type: YTN; PAM sequence: CTT
gtaattaaacccctggaaca

SEQ ID NO: 176519 - DNA, 20 bp, Artificial Sequence
  Description of Artificial Sequence: Synthetic oligonucleotide
  Target: ATXN1; (-) strand; PAM type: YTN; PAM sequence: TTC
cttgtaattaaacccctgga

SEQ ID NO: 176520 - DNA, 20 bp, Artificial Sequence
  Description of Artificial Sequence: Synthetic oligonucleotide
  Target: ATXN1; (-) strand; PAM type: YTN; PAM sequence: CTA
gcattccttgtaattaaacc

SEQ ID NO: 176521 - DNA, 20 bp, Artificial Sequence
  Description of Artificial Sequence: Synthetic oligonucleotide
  Target: ATXN1; (-) strand; PAM type: YTN; PAM sequence: TTA
ggagctagcattccttgtaa

SEQ ID NO: 176522 - DNA, 20 bp, Artificial Sequence
  Description of Artificial Sequence: Synthetic oligonucleotide
  Target: ATXN1; (-) strand; PAM type: YTN; PAM sequence: CTG
agatgttaggagctagcatt

SEQ ID NO: 176523 - DNA, 20 bp, Artificial Sequence
  Description of Artificial Sequence: Synthetic oligonucleotide
  Target: ATXN1; (-) strand; PAM type: YTN; PAM sequence: TTC
gagcccatggtatctgagat

SEQ ID NO: 176524 - DNA, 20 bp, Artificial Sequence
  Description of Artificial Sequence: Synthetic oligonucleotide
  Target: ATXN1; (-) strand; PAM type: YTN; PAM sequence: CTT
cgagcccatggtatctgaga

SEQ ID NO: 176525 - DNA, 20 bp, Artificial Sequence
  Description of Artificial Sequence: Synthetic oligonucleotide
  Target: ATXN1; (-) strand; PAM type: YTN; PAM sequence: TTA
caagtcttcgagcccatggt

SEQ ID NO: 176526 - DNA, 20 bp, Artificial Sequence
  Description of Artificial Sequence: Synthetic oligonucleotide
  Target: ATXN1; (-) strand; PAM type: YTN; PAM sequence: CTA
atatcacatgttacaagtct

SEQ ID NO: 176527 - DNA, 20 bp, Artificial Sequence
  Description of Artificial Sequence: Synthetic oligonucleotide
  Target: ATXN1; (-) strand; PAM type: YTN; PAM sequence: CTG
ccctaatatcacatgttaca

SEQ ID NO: 176528 - DNA, 20 bp, Artificial Sequence
  Description of Artificial Sequence: Synthetic oligonucleotide
  Target: ATXN1; (-) strand; PAM type: YTN; PAM sequence: TTG
ctgccctaatatcacatgtt

SEQ ID NO: 176529 - DNA, 20 bp, Artificial Sequence
  Description of Artificial Sequence: Synthetic oligonucleotide
  Target: ATXN1; (-) strand; PAM type: YTN; PAM sequence: CTA
aaaccccaaatcccggacca

SEQ ID NO: 176530 - DNA, 20 bp, Artificial Sequence
  Description of Artificial Sequence: Synthetic oligonucleotide
  Target: ATXN1; (-) strand; PAM type: YTN; PAM sequence: CTG
tgaagagagcccctaaaacc

SEQ ID NO: 176531 - DNA, 20 bp, Artificial Sequence
  Description of Artificial Sequence: Synthetic oligonucleotide
  Target: ATXN1; (-) strand; PAM type: YTN; PAM sequence: CTC
atctgtgaagagagccccta

SEQ ID NO: 176532 - DNA, 20 bp, Artificial Sequence
  Description of Artificial Sequence: Synthetic oligonucleotide
  Target: ATXN1; (-) strand; PAM type: YTN; PAM sequence: CTC
tcatctgtgaagagagcccc

SEQ ID NO: 176533 - DNA, 20 bp, Artificial Sequence
  Description of Artificial Sequence: Synthetic oligonucleotide
  Target: ATXN1; (-) strand; PAM type: YTN; PAM sequence: TTC
tctcatctgtgaagagagcc

SEQ ID NO: 176534 - DNA, 20 bp, Artificial Sequence
  Description of Artificial Sequence: Synthetic oligonucleotide
  Target: ATXN1; (-) strand; PAM type: YTN; PAM sequence: CTG
caaaattctctcatctgtga

SEQ ID NO: 176535 - DNA, 20 bp, Artificial Sequence
  Description of Artificial Sequence: Synthetic oligonucleotide
  Target: ATXN1; (-) strand; PAM type: YTN; PAM sequence: TTG
cagccagtggcaagaagctg

SEQ ID NO: 176536 - DNA, 20 bp, Artificial Sequence
  Description of Artificial Sequence: Synthetic oligonucleotide
  Target: ATXN1; (-) strand; PAM type: YTN; PAM sequence: CTG
gggagcgtcattgcagccag

SEQ ID NO: 176537 - DNA, 20 bp, Artificial Sequence
  Description of Artificial Sequence: Synthetic oligonucleotide
  Target: ATXN1; (-) strand; PAM type: YTN; PAM sequence: CTC
actggggagcgtcattgcag

SEQ ID NO: 176538 - DNA, 20 bp, Artificial Sequence
  Description of Artificial Sequence: Synthetic oligonucleotide
  Target: ATXN1; (-) strand; PAM type: YTN; PAM sequence: CTC
cacctcactggggagcgtca

SEQ ID NO: 176539 - DNA, 20 bp, Artificial Sequence
  Description of Artificial Sequence: Synthetic oligonucleotide
  Target: ATXN1; (-) strand; PAM type: YTN; PAM sequence: CTA
ggcctccacctcactgggga

SEQ ID NO: 176540 - DNA, 20 bp, Artificial Sequence
  Description of Artificial Sequence: Synthetic oligonucleotide
  Target: ATXN1; (-) strand; PAM type: YTN; PAM sequence: CTC
taggcctccacctcactggg

SEQ ID NO: 176541 - DNA, 20 bp, Artificial Sequence
  Description of Artificial Sequence: Synthetic oligonucleotide
  Target: ATXN1; (-) strand; PAM type: YTN; PAM sequence: CTC
tctaggcctccacctcactg

SEQ ID NO: 176542 - DNA, 20 bp, Artificial Sequence
  Description of Artificial Sequence: Synthetic oligonucleotide
  Target: ATXN1; (-) strand; PAM type: YTN; PAM sequence: CTC
tctctaggcctccacctcac

SEQ ID NO: 176543 - DNA, 20 bp, Artificial Sequence
  Description of Artificial Sequence: Synthetic oligonucleotide
  Target: ATXN1; (-) strand; PAM type: YTN; PAM sequence: CTC
ccctctctctaggcctccac

SEQ ID NO: 176544 - DNA, 20 bp, Artificial Sequence
  Description of Artificial Sequence: Synthetic oligonucleotide
  Target: ATXN1; (-) strand; PAM type: YTN; PAM sequence: TTA
agtcaccctcccctctctct

SEQ ID NO: 176545 - DNA, 20 bp, Artificial Sequence
  Description of Artificial Sequence: Synthetic oligonucleotide
  Target: ATXN1; (-) strand; PAM type: YTN; PAM sequence: CTT
aagtcaccctcccctctctc

SEQ ID NO: 176546 - DNA, 20 bp, Artificial Sequence
  Description of Artificial Sequence: Synthetic oligonucleotide
  Target: ATXN1; (-) strand; PAM type: YTN; PAM sequence: CTG
cccaccttaagtcaccctcc

SEQ ID NO: 176547 - DNA, 20 bp, Artificial Sequence
  Description of Artificial Sequence: Synthetic oligonucleotide
  Target: ATXN1; (-) strand; PAM type: YTN; PAM sequence: CTA
ggccctgcccaccttaagtc

SEQ ID NO: 176548 - DNA, 20 bp, Artificial Sequence
  Description of Artificial Sequence: Synthetic oligonucleotide
  Target: ATXN1; (-) strand; PAM type: YTN; PAM sequence: CTG
taatcaaggctaggccctgc

SEQ ID NO: 176549 - DNA, 20 bp, Artificial Sequence
  Description of Artificial Sequence: Synthetic oligonucleotide
  Target: ATXN1; (-) strand; PAM type: YTN; PAM sequence: TTG
agagcctgtaatcaaggcta

SEQ ID NO: 176550 - DNA, 20 bp, Artificial Sequence
  Description of Artificial Sequence: Synthetic oligonucleotide
  Target: ATXN1; (-) strand; PAM type: YTN; PAM sequence: CTT
gagagcctgtaatcaaggct

SEQ ID NO: 176551 - DNA, 20 bp, Artificial Sequence
  Description of Artificial Sequence: Synthetic oligonucleotide
  Target: ATXN1; (-) strand; PAM type: YTN; PAM sequence: TTA
atccttgagagcctgtaatc

SEQ ID NO: 176552 - DNA, 20 bp, Artificial Sequence
  Description of Artificial Sequence: Synthetic oligonucleotide
  Target: ATXN1; (-) strand; PAM type: YTN; PAM sequence: CTC
ccgaggttaatccttgagag

SEQ ID NO: 176553 - DNA, 20 bp, Artificial Sequence
  Description of Artificial Sequence: Synthetic oligonucleotide
  Target: ATXN1; (-) strand; PAM type: YTN; PAM sequence: CTG
tcctcccgaggttaatcctt

SEQ ID NO: 176554 - DNA, 20 bp, Artificial Sequence
  Description of Artificial Sequence: Synthetic oligonucleotide
  Target: ATXN1; (-) strand; PAM type: YTN; PAM sequence: CTC
tgtcctcccgaggttaatcc

SEQ ID NO: 176555 - DNA, 20 bp, Artificial Sequence
  Description of Artificial Sequence: Synthetic oligonucleotide
  Target: ATXN1; (-) strand; PAM type: YTN; PAM sequence: CTC
tctgtcctcccgaggttaat

SEQ ID NO: 176556 - DNA, 20 bp, Artificial Sequence
  Description of Artificial Sequence: Synthetic oligonucleotide
  Target: ATXN1; (-) strand; PAM type: YTN; PAM sequence: CTC
ctctctgtcctcccgaggtt

SEQ ID NO: 176557 - DNA, 20 bp, Artificial Sequence
  Description of Artificial Sequence: Synthetic oligonucleotide
  Target: ATXN1; (-) strand; PAM type: YTN; PAM sequence: CTC
tcctctctgtcctcccgagg

SEQ ID NO: 176558 - DNA, 20 bp, Artificial Sequence
  Description of Artificial Sequence: Synthetic oligonucleotide
  Target: ATXN1; (-) strand; PAM type: YTN; PAM sequence: TTC
tctcctctctgtcctcccga

SEQ ID NO: 176559 - DNA, 20 bp, Artificial Sequence
  Description of Artificial Sequence: Synthetic oligonucleotide
  Target: ATXN1; (-) strand; PAM type: YTN; PAM sequence: CTT
ctctcctctctgtcctcccg

SEQ ID NO: 176560 - DNA, 20 bp, Artificial Sequence
  Description of Artificial Sequence: Synthetic oligonucleotide
  Target: ATXN1; (-) strand; PAM type: YTN; PAM sequence: TTG
tcttctctcctctctgtcct

SEQ ID NO: 176561 - DNA, 20 bp, Artificial Sequence
  Description of Artificial Sequence: Synthetic oligonucleotide
  Target: ATXN1; (-) strand; PAM type: YTN; PAM sequence: CTT
gtcttctctcctctctgtcc

SEQ ID NO: 176562 - DNA, 20 bp, Artificial Sequence
  Description of Artificial Sequence: Synthetic oligonucleotide
  Target: ATXN1; (-) strand; PAM type: YTN; PAM sequence: TTC
accttgtcttctctcctctc

SEQ ID NO: 176563 - DNA, 20 bp, Artificial Sequence
  Description of Artificial Sequence: Synthetic oligonucleotide
  Target: ATXN1; (-) strand; PAM type: YTN; PAM sequence: CTT
caccttgtcttctctcctct

SEQ ID NO: 176564 - DNA, 20 bp, Artificial Sequence
  Description of Artificial Sequence: Synthetic oligonucleotide
  Target: ATXN1; (-) strand; PAM type: YTN; PAM sequence: CTC
acaaagcttcaccttgtctt

SEQ ID NO: 176565 - DNA, 20 bp, Artificial Sequence
  Description of Artificial Sequence: Synthetic oligonucleotide
  Target: ATXN1; (-) strand; PAM type: YTN; PAM sequence: CTG
tccactcacaaagcttcacc

SEQ ID NO: 176566 - DNA, 20 bp, Artificial Sequence
  Description of Artificial Sequence: Synthetic oligonucleotide
  Target: ATXN1; (-) strand; PAM type: YTN; PAM sequence: TTC
tgtccactcacaaagcttca

SEQ ID NO: 176567 - DNA, 20 bp, Artificial Sequence
  Description of Artificial Sequence: Synthetic oligonucleotide
  Target: ATXN1; (-) strand; PAM type: YTN; PAM sequence: TTT
ctgtccactcacaaagcttc

SEQ ID NO: 176568 - DNA, 20 bp, Artificial Sequence
  Description of Artificial Sequence: Synthetic oligonucleotide
  Target: ATXN1; (-) strand; PAM type: YTN; PAM sequence: TTA
atttctgtccactcacaaag

SEQ ID NO: 176569 - DNA, 20 bp, Artificial Sequence
  Description of Artificial Sequence: Synthetic oligonucleotide
  Target: ATXN1; (-) strand; PAM type: YTN; PAM sequence: TTT
aatttctgtccactcacaaa

SEQ ID NO: 176570 - DNA, 20 bp, Artificial Sequence
  Description of Artificial Sequence: Synthetic oligonucleotide
  Target: ATXN1; (-) strand; PAM type: YTN; PAM sequence: TTA
tttaatttctgtccactcac

SEQ ID NO: 176571 - DNA, 20 bp, Artificial Sequence
  Description of Artificial Sequence: Synthetic oligonucleotide
  Target: ATXN1; (-) strand; PAM type: YTN; PAM sequence: TTT
atttaatttctgtccactca

SEQ ID NO: 176572 - DNA, 20 bp, Artificial Sequence
  Description of Artificial Sequence: Synthetic oligonucleotide
  Target: ATXN1; (-) strand; PAM type: YTN; PAM sequence: CTT
tatttaatttctgtccactc

SEQ ID NO: 176573 - DNA, 20 bp, Artificial Sequence
  Description of Artificial Sequence: Synthetic oligonucleotide
  Target: ATXN1; (-) strand; PAM type: YTN; PAM sequence: TTG
gaaacccctttatttaattt

SEQ ID NO: 176574 - DNA, 20 bp, Artificial Sequence
  Description of Artificial Sequence: Synthetic oligonucleotide
  Target: ATXN1; (-) strand; PAM type: YTN; PAM sequence: CTT
ggaaacccctttatttaatt

SEQ ID NO: 176575 - DNA, 20 bp, Artificial Sequence
  Description of Artificial Sequence: Synthetic oligonucleotide
  Target: ATXN1; (-) strand; PAM type: YTN; PAM sequence: TTA
acttggaaacccctttattt

SEQ ID NO: 176576 - DNA, 20 bp, Artificial Sequence
  Description of Artificial Sequence: Synthetic oligonucleotide
  Target: ATXN1; (-) strand; PAM type: YTN; PAM sequence: CTT
aacttggaaacccctttatt

SEQ ID NO: 176577 - DNA, 20 bp, Artificial Sequence
  Description of Artificial Sequence: Synthetic oligonucleotide
  Target: ATXN1; (-) strand; PAM type: YTN; PAM sequence: CTG
tacttaacttggaaacccct

SEQ ID NO: 176578 - DNA, 20 bp, Artificial Sequence
  Description of Artificial Sequence: Synthetic oligonucleotide
  Target: ATXN1; (-) strand; PAM type: YTN; PAM sequence: CTC
caggagcactgtacttaact

SEQ ID NO: 176579 - DNA, 20 bp, Artificial Sequence
  Description of Artificial Sequence: Synthetic oligonucleotide
  Target: ATXN1; (-) strand; PAM type: YTN; PAM sequence: TTC
tccaggagcactgtacttaa

SEQ ID NO: 176580 - DNA, 20 bp, Artificial Sequence
  Description of Artificial Sequence: Synthetic oligonucleotide
  Target: ATXN1; (-) strand; PAM type: YTN; PAM sequence: CTT
ctccaggagcactgtactta

SEQ ID NO: 176581 - DNA, 20 bp, Artificial Sequence
  Description of Artificial Sequence: Synthetic oligonucleotide
  Target: ATXN1; (-) strand; PAM type: YTN; PAM sequence: TTG
cttctccaggagcactgtac

SEQ ID NO: 176582 - DNA, 20 bp, Artificial Sequence
  Description of Artificial Sequence: Synthetic oligonucleotide
  Target: ATXN1; (-) strand; PAM type: YTN; PAM sequence: CTT
gcttctccaggagcactgta

SEQ ID NO: 176583 - DNA, 20 bp, Artificial Sequence
  Description of Artificial Sequence: Synthetic oligonucleotide
  Target: ATXN1; (-) strand; PAM type: YTN; PAM sequence: CTC
caacttgcttctccaggagc

SEQ ID NO: 176584 - DNA, 20 bp, Artificial Sequence
  Description of Artificial Sequence: Synthetic oligonucleotide
  Target: ATXN1; (-) strand; PAM type: YTN; PAM sequence: CTG
catgtgtatgcatgatacca

SEQ ID NO: 176585 - DNA, 20 bp, Artificial Sequence
  Description of Artificial Sequence: Synthetic oligonucleotide
  Target: ATXN1; (-) strand; PAM type: YTN; PAM sequence: CTA
aatagtcctgcatgtgtatg

SEQ ID NO: 176586 - DNA, 20 bp, Artificial Sequence
  Description of Artificial Sequence: Synthetic oligonucleotide
  Target: ATXN1; (-) strand; PAM type: YTN; PAM sequence: TTG
tgatcagaataatcaggtac

SEQ ID NO: 176587 - DNA, 20 bp, Artificial Sequence
  Description of Artificial Sequence: Synthetic oligonucleotide
  Target: ATXN1; (-) strand; PAM type: YTN; PAM sequence: TTT
gtgatcagaataatcaggta

SEQ ID NO: 176588 - DNA, 20 bp, Artificial Sequence
  Description of Artificial Sequence: Synthetic oligonucleotide
  Target: ATXN1; (-) strand; PAM type: YTN; PAM sequence: TTG
tttgtgatcagaataatcag

SEQ ID NO: 176589 - DNA, 20 bp, Artificial Sequence
  Description of Artificial Sequence: Synthetic oligonucleotide
  Target: ATXN1; (-) strand; PAM type: YTN; PAM sequence: CTG
aagataaatgatgcataaaa

SEQ ID NO: 176590 - DNA, 20 bp, Artificial Sequence
  Description of Artificial Sequence: Synthetic oligonucleotide
  Target: ATXN1; (-) strand; PAM type: YTN; PAM sequence: CTC
tgaagataaatgatgcataa

SEQ ID NO: 176591 - DNA, 20 bp, Artificial Sequence
  Description of Artificial Sequence: Synthetic oligonucleotide
  Target: ATXN1; (-) strand; PAM type: YTN; PAM sequence: CTC
tctgaagataaatgatgcat

SEQ ID NO: 176592 - DNA, 20 bp, Artificial Sequence
  Description of Artificial Sequence: Synthetic oligonucleotide
  Target: ATXN1; (-) strand; PAM type: YTN; PAM sequence: CTC
agatagacactctctgaaga

SEQ ID NO: 176593 - DNA, 20 bp, Artificial Sequence
  Description of Artificial Sequence: Synthetic oligonucleotide
  Target: ATXN1; (-) strand; PAM type: YTN; PAM sequence: TTC
aagcagctcagatagacact

SEQ ID NO: 176594 - DNA, 20 bp, Artificial Sequence
  Description of Artificial Sequence: Synthetic oligonucleotide
  Target: ATXN1; (-) strand; PAM type: YTN; PAM sequence: CTT
caagcagctcagatagacac

SEQ ID NO: 176595 - DNA, 20 bp, Artificial Sequence
  Description of Artificial Sequence: Synthetic oligonucleotide
  Target: ATXN1; (-) strand; PAM type: YTN; PAM sequence: TTG
cttcaagcagctcagataga

SEQ ID NO: 176596 - DNA, 20 bp, Artificial Sequence
  Description of Artificial Sequence: Synthetic oligonucleotide
  Target: ATXN1; (-) strand; PAM type: YTN; PAM sequence: TTT
gcttcaagcagctcagatag

SEQ ID NO: 176597 - DNA, 20 bp, Artificial Sequence
  Description of Artificial Sequence: Synthetic oligonucleotide
  Target: ATXN1; (-) strand; PAM type: YTN; PAM sequence: TTC
gtttgcttcaagcagctcag

SEQ ID NO: 176598 - DNA, 20 bp, Artificial Sequence
  Description of Artificial Sequence: Synthetic oligonucleotide
  Target: ATXN1; (-) strand; PAM type: YTN; PAM sequence: TTT
cgtttgcttcaagcagctca

SEQ ID NO: 176599 - DNA, 20 bp, Artificial Sequence
  Description of Artificial Sequence: Synthetic oligonucleotide
  Target: ATXN1; (-) strand; PAM type: YTN; PAM sequence: CTA
gtccaatccataagtttcgt

SEQ ID NO: 176600 - DNA, 20 bp, Artificial Sequence
  Description of Artificial Sequence: Synthetic oligonucleotide
  Target: ATXN1; (-) strand; PAM type: YTN; PAM sequence: CTC
gtaaggctagtccaatccat

SEQ ID NO: 176601 - DNA, 20 bp, Artificial Sequence
  Description of Artificial Sequence: Synthetic oligonucleotide
  Target: ATXN1; (-) strand; PAM type: YTN; PAM sequence: TTC
tcgtaaggctagtccaatcc

SEQ ID NO: 176602 - DNA, 20 bp, Artificial Sequence
  Description of Artificial Sequence: Synthetic oligonucleotide
  Target: ATXN1; (-) strand; PAM type: YTN; PAM sequence: CTA
gcattctcgtaaggctagtc

SEQ ID NO: 176603 - DNA, 20 bp, Artificial Sequence
  Description of Artificial Sequence: Synthetic oligonucleotide
  Target: ATXN1; (-) strand; PAM type: YTN; PAM sequence: CTG
aaactagcattctcgtaagg

SEQ ID NO: 176604 - DNA, 20 bp, Artificial Sequence
  Description of Artificial Sequence: Synthetic oligonucleotide
  Target: ATXN1; (-) strand; PAM type: YTN; PAM sequence: CTC
tgaaactagcattctcgtaa

SEQ ID NO: 176605 - DNA, 20 bp, Artificial Sequence
  Description of Artificial Sequence: Synthetic oligonucleotide
  Target: ATXN1; (-) strand; PAM type: YTN; PAM sequence: CTA
taggcacagccatagctctg

SEQ ID NO: 176606 - DNA, 20 bp, Artificial Sequence
  Description of Artificial Sequence: Synthetic oligonucleotide
  Target: ATXN1; (-) strand; PAM type: YTN; PAM sequence: CTG
ctataggcacagccatagct

SEQ ID NO: 176607 - DNA, 20 bp, Artificial Sequence
  Description of Artificial Sequence: Synthetic oligonucleotide
  Target: ATXN1; (-) strand; PAM type: YTN; PAM sequence: CTA
caaactgctataggcacagc

SEQ ID NO: 176608 - DNA, 20 bp, Artificial Sequence
  Description of Artificial Sequence: Synthetic oligonucleotide
  Target: ATXN1; (-) strand; PAM type: YTN; PAM sequence: TTC
ctacaaactgctataggcac

SEQ ID NO: 176609 - DNA, 20 bp, Artificial Sequence
  Description of Artificial Sequence: Synthetic oligonucleotide
  Target: ATXN1; (-) strand; PAM type: YTN; PAM sequence: TTA
tataataaattcctacaaac

SEQ ID NO: 176610 - DNA, 20 bp, Artificial Sequence
  Description of Artificial Sequence: Synthetic oligonucleotide
  Target: ATXN1; (-) strand; PAM type: YTN; PAM sequence: TTT
atataataaattcctacaaa

SEQ ID NO: 176611 - DNA, 20 bp, Artificial Sequence
  Description of Artificial Sequence: Synthetic oligonucleotide
  Target: ATXN1; (-) strand; PAM type: YTN; PAM sequence: CTT
tatataataaattcctacaa

SEQ ID NO: 176612 - DNA, 20 bp, Artificial Sequence
  Description of Artificial Sequence: Synthetic oligonucleotide
  Target: ATXN1; (-) strand; PAM type: YTN; PAM sequence: TTA
aaaggactttatataataaa

SEQ ID NO: 176613 - DNA, 20 bp, Artificial Sequence
  Description of Artificial Sequence: Synthetic oligonucleotide
  Target: ATXN1; (-) strand; PAM type: YTN; PAM sequence: CTC
caaggggttaaaaggacttt

SEQ ID NO: 176614 - DNA, 20 bp, Artificial Sequence
  Description of Artificial Sequence: Synthetic oligonucleotide
  Target: ATXN1; (-) strand; PAM type: YTN; PAM sequence: CTG
gaggatcatgtgatgcgaag

SEQ ID NO: 176615 - DNA, 20 bp, Artificial Sequence
  Description of Artificial Sequence: Synthetic oligonucleotide
  Target: ATXN1; (-) strand; PAM type: YTN; PAM sequence: TTA
cctggaggatcatgtgatgc

SEQ ID NO: 176616 - DNA, 20 bp, Artificial Sequence
  Description of Artificial Sequence: Synthetic oligonucleotide
  Target: ATXN1; (-) strand; PAM type: YTN; PAM sequence: TTA
taggattacctggaggatca

SEQ ID NO: 176617 - DNA, 20 bp, Artificial Sequence
  Description of Artificial Sequence: Synthetic oligonucleotide
  Target: ATXN1; (-) strand; PAM type: YTN; PAM sequence: CTT
ataggattacctggaggatc

SEQ ID NO: 176618 - DNA, 20 bp, Artificial Sequence
  Description of Artificial Sequence: Synthetic oligonucleotide
  Target: ATXN1; (-) strand; PAM type: YTN; PAM sequence: TTC
cagtcttataggattacctg

SEQ ID NO: 176619 - DNA, 20 bp, Artificial Sequence
  Description of Artificial Sequence: Synthetic oligonucleotide
  Target: ATXN1; (-) strand; PAM type: YTN; PAM sequence: CTT
ccagtcttataggattacct

SEQ ID NO: 176620 - DNA, 20 bp, Artificial Sequence
  Description of Artificial Sequence: Synthetic oligonucleotide
  Target: ATXN1; (-) strand; PAM type: YTN; PAM sequence: TTC
ttccagtcttataggattac

SEQ ID NO: 176621 - DNA, 20 bp, Artificial Sequence
  Description of Artificial Sequence: Synthetic oligonucleotide
  Target: ATXN1; (-) strand; PAM type: YTN; PAM sequence: CTG
ttcttccagtcttataggat

SEQ ID NO: 176622 - DNA, 20 bp, Artificial Sequence
  Description of Artificial Sequence: Synthetic oligonucleotide
  Target: ATXN1; (-) strand; PAM type: YTN; PAM sequence: TTC
acacctgttcttccagtctt

SEQ ID NO: 176623 - DNA, 20 bp, Artificial Sequence
  Description of Artificial Sequence: Synthetic oligonucleotide
  Target: ATXN1; (-) strand; PAM type: YTN; PAM sequence: TTT
cacacctgttcttccagtct

SEQ ID NO: 176624 - DNA, 20 bp, Artificial Sequence
  Description of Artificial Sequence: Synthetic oligonucleotide
  Target: ATXN1; (-) strand; PAM type: YTN; PAM sequence: TTT
tcacacctgttcttccagtc

SEQ ID NO: 176625 - DNA, 20 bp, Artificial Sequence
  Description of Artificial Sequence: Synthetic oligonucleotide
  Target: ATXN1; (-) strand; PAM type: YTN; PAM sequence: CTT
ttcacacctgttcttccagt

SEQ ID NO: 176626 - DNA, 20 bp, Artificial Sequence
  Description of Artificial Sequence: Synthetic oligonucleotide
  Target: ATXN1; (-) strand; PAM type: YTN; PAM sequence: TTG
ataagacatggtcttttcac

SEQ ID NO: 176627 - DNA, 20 bp, Artificial Sequence
  Description of Artificial Sequence: Synthetic oligonucleotide
  Target: ATXN1; (-) strand; PAM type: YTN; PAM sequence: CTT
gataagacatggtcttttca

SEQ ID NO: 176628 - DNA, 20 bp, Artificial Sequence
  Description of Artificial Sequence: Synthetic oligonucleotide
  Target: ATXN1; (-) strand; PAM type: YTN; PAM sequence: CTG
ggtcttgataagacatggtc

SEQ ID NO: 176629 - DNA, 20 bp, Artificial Sequence
  Description of Artificial Sequence: Synthetic oligonucleotide
  Target: ATXN1; (-) strand; PAM type: YTN; PAM sequence: TTA
ggcccactgggtcttgataa

SEQ ID NO: 176630 - DNA, 20 bp, Artificial Sequence
  Description of Artificial Sequence: Synthetic oligonucleotide
  Target: ATXN1; (-) strand; PAM type: YTN; PAM sequence: CTT
aggcccactgggtcttgata

SEQ ID NO: 176631 - DNA, 20 bp, Artificial Sequence
  Description of Artificial Sequence: Synthetic oligonucleotide
  Target: ATXN1; (-) strand; PAM type: YTN; PAM sequence: TTA
gacagatcacttaggcccac

SEQ ID NO: 176632 - DNA, 20 bp, Artificial Sequence
  Description of Artificial Sequence: Synthetic oligonucleotide
  Target: ATXN1; (-) strand; PAM type: YTN; PAM sequence: CTT
agacagatcacttaggccca

SEQ ID NO: 176633 - DNA, 20 bp, Artificial Sequence
  Description of Artificial Sequence: Synthetic oligonucleotide
  Target: ATXN1; (-) strand; PAM type: YTN; PAM sequence: CTA
ccttagacagatcacttagg

SEQ ID NO: 176634 - DNA, 20 bp, Artificial Sequence
  Description of Artificial Sequence: Synthetic oligonucleotide
  Target: ATXN1; (-) strand; PAM type: YTN; PAM sequence: CTG
tctaccttagacagatcact

SEQ ID NO: 176635 - DNA, 20 bp, Artificial Sequence
  Description of Artificial Sequence: Synthetic oligonucleotide
  Target: ATXN1; (-) strand; PAM type: YTN; PAM sequence: CTC
tgtctaccttagacagatca

SEQ ID NO: 176636 - DNA, 20 bp, Artificial Sequence
  Description of Artificial Sequence: Synthetic oligonucleotide
  Target: ATXN1; (-) strand; PAM type: YTN; PAM sequence: CTG
ccctctgtctaccttagaca

SEQ ID NO: 176637 - DNA, 20 bp, Artificial Sequence
  Description of Artificial Sequence: Synthetic oligonucleotide
  Target: ATXN1; (-) strand; PAM type: YTN; PAM sequence: CTG
ccacctgccctctgtctacc

SEQ ID NO: 176638 - DNA, 20 bp, Artificial Sequence
  Description of Artificial Sequence: Synthetic oligonucleotide
  Target: ATXN1; (-) strand; PAM type: YTN; PAM sequence: CTC
cctgccacctgccctctgtc

SEQ ID NO: 176639 - DNA, 20 bp, Artificial Sequence
  Description of Artificial Sequence: Synthetic oligonucleotide
  Target: ATXN1; (-) strand; PAM type: YTN; PAM sequence: TTG
tagcaaccatgacaaaagaa

SEQ ID NO: 176640 - DNA, 20 bp, Artificial Sequence
  Description of Artificial Sequence: Synthetic oligonucleotide
  Target: ATXN1; (-) strand; PAM type: YTN; PAM sequence: CTG
taggagcaatgatgttgtag

SEQ ID NO: 176641 - DNA, 20 bp, Artificial Sequence
  Description of Artificial Sequence: Synthetic oligonucleotide
  Target: ATXN1; (-) strand; PAM type: YTN; PAM sequence: CTG
cctgtaggagcaatgatgtt

SEQ ID NO: 176642 - DNA, 20 bp, Artificial Sequence
  Description of Artificial Sequence: Synthetic oligonucleotide
  Target: ATXN1; (-) strand; PAM type: YTN; PAM sequence: TTC
tgcctgtaggagcaatgatg

SEQ ID NO: 176643 - DNA, 20 bp, Artificial Sequence
  Description of Artificial Sequence: Synthetic oligonucleotide
  Target: ATXN1; (-) strand; PAM type: YTN; PAM sequence: TTG
attctgcctgtaggagcaat

SEQ ID NO: 176644 - DNA, 20 bp, Artificial Sequence
  Description of Artificial Sequence: Synthetic oligonucleotide
  Target: ATXN1; (-) strand; PAM type: YTN; PAM sequence: CTT
gattctgcctgtaggagcaa

SEQ ID NO: 176645 - DNA, 20 bp, Artificial Sequence
  Description of Artificial Sequence: Synthetic oligonucleotide
  Target: ATXN1; (-) strand; PAM type: YTN; PAM sequence: CTC
ttgattctgcctgtaggagc

SEQ ID NO: 176646 - DNA, 20 bp, Artificial Sequence
  Description of Artificial Sequence: Synthetic oligonucleotide
  Target: ATXN1; (-) strand; PAM type: YTN; PAM sequence: TTG
aacccgtagctcttgattct

SEQ ID NO: 176647 - DNA, 20 bp, Artificial Sequence
  Description of Artificial Sequence: Synthetic oligonucleotide
  Target: ATXN1; (-) strand; PAM type: YTN; PAM sequence: CTT
gaacccgtagctcttgattc

SEQ ID NO: 176648 - DNA, 20 bp, Artificial Sequence
  Description of Artificial Sequence: Synthetic oligonucleotide
  Target: ATXN1; (-) strand; PAM type: YTN; PAM sequence: CTC
gtcccttgaacccgtagctc

SEQ ID NO: 176649 - DNA, 20 bp, Artificial Sequence
  Description of Artificial Sequence: Synthetic oligonucleotide
  Target: ATXN1; (-) strand; PAM type: YTN; PAM sequence: CTC
tcgtcccttgaacccgtagc

SEQ ID NO: 176650 - DNA, 20 bp, Artificial Sequence
  Description of Artificial Sequence: Synthetic oligonucleotide
  Target: ATXN1; (-) strand; PAM type: YTN; PAM sequence: TTC
cctctcgtcccttgaacccg

SEQ ID NO: 176651 - DNA, 20 bp, Artificial Sequence
  Description of Artificial Sequence: Synthetic oligonucleotide
  Target: ATXN1; (-) strand; PAM type: YTN; PAM sequence: CTT
ccctctcgtcccttgaaccc

SEQ ID NO: 176652 - DNA, 20 bp, Artificial Sequence
  Description of Artificial Sequence: Synthetic oligonucleotide
  Target: ATXN1; (-) strand; PAM type: YTN; PAM sequence: TTC
ttccctctcgtcccttgaac

SEQ ID NO: 176653 - DNA, 20 bp, Artificial Sequence
  Description of Artificial Sequence: Synthetic oligonucleotide
  Target: ATXN1; (-) strand; PAM type: YTN; PAM sequence: CTT
cttccctctcgtcccttgaa

SEQ ID NO: 176654 - DNA, 20 bp, Artificial Sequence
  Description of Artificial Sequence: Synthetic oligonucleotide
  Target: ATXN1; (-) strand; PAM type: YTN; PAM sequence: TTG
tgtccttcttccctctcgtc

SEQ ID NO: 176655 - DNA, 20 bp, Artificial Sequence
  Description of Artificial Sequence: Synthetic oligonucleotide
  Target: ATXN1; (-) strand; PAM type: YTN; PAM sequence: CTT
gtgtccttcttccctctcgt

SEQ ID NO: 176656 - DNA, 20 bp, Artificial Sequence
  Description of Artificial Sequence: Synthetic oligonucleotide
  Target: ATXN1; (-) strand; PAM type: YTN; PAM sequence: TTC
atgcgcatgcacacacccgg

SEQ ID NO: 176657 - DNA, 20 bp, Artificial Sequence
  Description of Artificial Sequence: Synthetic oligonucleotide
  Target: ATXN1; (-) strand; PAM type: YTN; PAM sequence: CTC
cattcatgcgcatgcacaca

SEQ ID NO: 176658 - DNA, 20 bp, Artificial Sequence
  Description of Artificial Sequence: Synthetic oligonucleotide
  Target: ATXN1; (-) strand; PAM type: YTN; PAM sequence: TTG
tgcacgcaggctccattcat

SEQ ID NO: 176659 - DNA, 20 bp, Artificial Sequence
  Description of Artificial Sequence: Synthetic oligonucleotide
  Target: ATXN1; (-) strand; PAM type: YTN; PAM sequence: TTT
gtgcacgcaggctccattca

SEQ ID NO: 176660 - DNA, 20 bp, Artificial Sequence
  Description of Artificial Sequence: Synthetic oligonucleotide
  Target: ATXN1; (-) strand; PAM type: YTN; PAM sequence: CTC
caaatcaccgaatgtttgtg

SEQ ID NO: 176661 - DNA, 20 bp, Artificial Sequence
  Description of Artificial Sequence: Synthetic oligonucleotide
  Target: ATXN1; (-) strand; PAM type: YTN; PAM sequence: CTG
cgtaaatggctccaaatcac

SEQ ID NO: 176662 - DNA, 20 bp, Artificial Sequence
  Description of Artificial Sequence: Synthetic oligonucleotide
  Target: ATXN1; (-) strand; PAM type: YTN; PAM sequence: TTC
cagatgagctgcgtaaatgg

SEQ ID NO: 176663 - DNA, 20 bp, Artificial Sequence
  Description of Artificial Sequence: Synthetic oligonucleotide
  Target: ATXN1; (-) strand; PAM type: YTN; PAM sequence: TTT
ccagatgagctgcgtaaatg

SEQ ID NO: 176664 - DNA, 20 bp, Artificial Sequence
  Description of Artificial Sequence: Synthetic oligonucleotide
  Target: ATXN1; (-) strand; PAM type: YTN; PAM sequence: TTT
tccagatgagctgcgtaaat

SEQ ID NO: 176665 - DNA, 20 bp, Artificial Sequence
  Description of Artificial Sequence: Synthetic oligonucleotide
  Target: ATXN1; (-) strand; PAM type: YTN; PAM sequence: CTG
tgattttccagatgagctgc

SEQ ID NO: 176666 - DNA, 20 bp, Artificial Sequence
  Description of Artificial Sequence: Synthetic oligonucleotide
  Target: ATXN1; (-) strand; PAM type: YTN; PAM sequence: CTG
ctgtgattttccagatgagc

SEQ ID NO: 176667 - DNA, 20 bp, Artificial Sequence
  Description of Artificial Sequence: Synthetic oligonucleotide
  Target: ATXN1; (-) strand; PAM type: YTN; PAM sequence: CTC
tgctgtgattttccagatga

SEQ ID NO: 176668 - DNA, 20 bp, Artificial Sequence
  Description of Artificial Sequence: Synthetic oligonucleotide
  Target: ATXN1; (-) strand; PAM type: YTN; PAM sequence: CTC
ctctgctgtgattttccaga

SEQ ID NO: 176669 - DNA, 20 bp, Artificial Sequence
  Description of Artificial Sequence: Synthetic oligonucleotide
  Target: ATXN1; (-) strand; PAM type: YTN; PAM sequence: CTC
tcctctgctgtgattttcca

SEQ ID NO: 176670 - DNA, 20 bp, Artificial Sequence
  Description of Artificial Sequence: Synthetic oligonucleotide
  Target: ATXN1; (-) strand; PAM type: YTN; PAM sequence: TTC
cccataggaaacctctcctc

SEQ ID NO: 176671 - DNA, 20 bp, Artificial Sequence
  Description of Artificial Sequence: Synthetic oligonucleotide
  Target: ATXN1; (-) strand; PAM type: YTN; PAM sequence: CTT
ccccataggaaacctctcct

SEQ ID NO: 176672 - DNA, 20 bp, Artificial Sequence
  Description of Artificial Sequence: Synthetic oligonucleotide
  Target: ATXN1; (-) strand; PAM type: YTN; PAM sequence: CTC
ccaacagacttccccatagg

SEQ ID NO: 176673 - DNA, 20 bp, Artificial Sequence
  Description of Artificial Sequence: Synthetic oligonucleotide
  Target: ATXN1; (-) strand; PAM type: YTN; PAM sequence: CTG
gagcaaagagagaggggtaa

SEQ ID NO: 176674 - DNA, 20 bp, Artificial Sequence
  Description of Artificial Sequence: Synthetic oligonucleotide
  Target: ATXN1; (-) strand; PAM type: YTN; PAM sequence: TTG
ccagtgcagcctggagcaaa

SEQ ID NO: 176675 - DNA, 20 bp, Artificial Sequence
  Description of Artificial Sequence: Synthetic oligonucleotide
  Target: ATXN1; (-) strand; PAM type: YTN; PAM sequence: TTT
gccagtgcagcctggagcaa

SEQ ID NO: 176676 - DNA, 20 bp, Artificial Sequence
  Description of Artificial Sequence: Synthetic oligonucleotide
  Target: ATXN1; (-) strand; PAM type: YTN; PAM sequence: TTA
aatagccgaaggtttgccag

SEQ ID NO: 176677 - DNA, 20 bp, Artificial Sequence
  Description of Artificial Sequence: Synthetic oligonucleotide
  Target: ATXN1; (-) strand; PAM type: YTN; PAM sequence: TTA
ttaaatagccgaaggtttgc

SEQ ID NO: 176678 - DNA, 20 bp, Artificial Sequence
  Description of Artificial Sequence: Synthetic oligonucleotide
  Target: ATXN1; (-) strand; PAM type: YTN; PAM sequence: CTA
ttattaaatagccgaaggtt

SEQ ID NO: 176679 - DNA, 20 bp, Artificial Sequence
  Description of Artificial Sequence: Synthetic oligonucleotide
  Target: ATXN1; (-) strand; PAM type: YTN; PAM sequence: CTA
gatactattattaaatagcc

SEQ ID NO: 176680 - DNA, 20 bp, Artificial Sequence
  Description of Artificial Sequence: Synthetic oligonucleotide
  Target: ATXN1; (-) strand; PAM type: YTN; PAM sequence: CTG
gatgtaaatcaactagatac

SEQ ID NO: 176681 - DNA, 20 bp, Artificial Sequence
  Description of Artificial Sequence: Synthetic oligonucleotide
  Target: ATXN1; (-) strand; PAM type: YTN; PAM sequence: CTG
ggcaaccctggatgtaaatc

SEQ ID NO: 176682 - DNA, 20 bp, Artificial Sequence
  Description of Artificial Sequence: Synthetic oligonucleotide
  Target: ATXN1; (-) strand; PAM type: YTN; PAM sequence: CTA
gaaccctgggcaaccctgga

SEQ ID NO: 176683 - DNA, 20 bp, Artificial Sequence
  Description of Artificial Sequence: Synthetic oligonucleotide
  Target: ATXN1; (-) strand; PAM type: YTN; PAM sequence: CTG
gcagtgcacacactagaacc

SEQ ID NO: 176684 - DNA, 20 bp, Artificial Sequence
  Description of Artificial Sequence: Synthetic oligonucleotide
  Target: ATXN1; (-) strand; PAM type: YTN; PAM sequence: TTG
tgcctggcagtgcacacact

SEQ ID NO: 176685 - DNA, 20 bp, Artificial Sequence
  Description of Artificial Sequence: Synthetic oligonucleotide
  Target: ATXN1; (-) strand; PAM type: YTN; PAM sequence: TTT
gtgcctggcagtgcacacac

SEQ ID NO: 176686 - DNA, 20 bp, Artificial Sequence
  Description of Artificial Sequence: Synthetic oligonucleotide
  Target: ATXN1; (-) strand; PAM type: YTN; PAM sequence: TTG
tttgtgcctggcagtgcaca

SEQ ID NO: 176687 - DNA, 20 bp, Artificial Sequence
  Description of Artificial Sequence: Synthetic oligonucleotide
  Target: ATXN1; (-) strand; PAM type: YTN; PAM sequence: CTT
gtttgtgcctggcagtgcac

SEQ ID NO: 176688 - DNA, 20 bp, Artificial Sequence
  Description of Artificial Sequence: Synthetic oligonucleotide
  Target: ATXN1; (-) strand; PAM type: YTN; PAM sequence: CTG
tacttgtttgtgcctggcag

SEQ ID NO: 176689 - DNA, 20 bp, Artificial Sequence
  Description of Artificial Sequence: Synthetic oligonucleotide
  Target: ATXN1; (-) strand; PAM type: YTN; PAM sequence: CTG
gtctgtacttgtttgtgcct

SEQ ID NO: 176690 - DNA, 20 bp, Artificial Sequence
  Description of Artificial Sequence: Synthetic oligonucleotide
  Target: ATXN1; (-) strand; PAM type: YTN; PAM sequence: TTG
tggggcatgagctggtctgt

SEQ ID NO: 176691 - DNA, 20 bp, Artificial Sequence
  Description of Artificial Sequence: Synthetic oligonucleotide
  Target: ATXN1; (-) strand; PAM type: YTN; PAM sequence: TTG
ttgtggggcatgagctggtc

SEQ ID NO: 176692 - DNA, 20 bp, Artificial Sequence
  Description of Artificial Sequence: Synthetic oligonucleotide
  Target: ATXN1; (-) strand; PAM type: YTN; PAM sequence: TTT
gttgtggggcatgagctggt

SEQ ID NO: 176693 - DNA, 20 bp, Artificial Sequence
  Description of Artificial Sequence: Synthetic oligonucleotide
  Target: ATXN1; (-) strand; PAM type: YTN; PAM sequence: CTT
tgttgtggggcatgagctgg

SEQ ID NO: 176694 - DNA, 20 bp, Artificial Sequence
  Description of Artificial Sequence: Synthetic oligonucleotide
  Target: ATXN1; (-) strand; PAM type: YTN; PAM sequence: TTC
cccataaaatggccactttg

SEQ ID NO: 176695 - DNA, 20 bp, Artificial Sequence
  Description of Artificial Sequence: Synthetic oligonucleotide
  Target: ATXN1; (-) strand; PAM type: YTN; PAM sequence: TTG
attccccataaaatggccac

SEQ ID NO: 176696 - DNA, 20 bp, Artificial Sequence
  Description of Artificial Sequence: Synthetic oligonucleotide
  Target: ATXN1; (-) strand; PAM type: YTN; PAM sequence: TTC
cagttgattccccataaaat

SEQ ID NO: 176697 - DNA, 20 bp, Artificial Sequence
  Description of Artificial Sequence: Synthetic oligonucleotide
  Target: ATXN1; (-) strand; PAM type: YTN; PAM sequence: CTG
agtagcagggcagacagaga

SEQ ID NO: 176698 - DNA, 20 bp, Artificial Sequence
  Description of Artificial Sequence: Synthetic oligonucleotide
  Target: ATXN1; (-) strand; PAM type: YTN; PAM sequence: TTC
tgagtagcagggcagacaga

SEQ ID NO: 176699 - DNA, 20 bp, Artificial Sequence
  Description of Artificial Sequence: Synthetic oligonucleotide
  Target: ATXN1; (-) strand; PAM type: YTN; PAM sequence: CTT
ctgagtagcagggcagacag

SEQ ID NO: 176700 - DNA, 20 bp, Artificial Sequence
  Description of Artificial Sequence: Synthetic oligonucleotide
  Target: ATXN1; (-) strand; PAM type: YTN; PAM sequence: TTC
caccgtcttctgagtagcag

SEQ ID NO: 176701 - DNA, 20 bp, Artificial Sequence
  Description of Artificial Sequence: Synthetic oligonucleotide
  Target: ATXN1; (-) strand; PAM type: YTN; PAM sequence: CTT
ccaccgtcttctgagtagca

SEQ ID NO: 176702 - DNA, 20 bp, Artificial Sequence
  Description of Artificial Sequence: Synthetic oligonucleotide
  Target: ATXN1; (-) strand; PAM type: YTN; PAM sequence: TTC
cttccaccgtcttctgagta

SEQ ID NO: 176703 - DNA, 20 bp, Artificial Sequence
  Description of Artificial Sequence: Synthetic oligonucleotide
  Target: ATXN1; (-) strand; PAM type: YTN; PAM sequence: TTC
agcattccttccaccgtctt

SEQ ID NO: 176704 - DNA, 20 bp, Artificial Sequence
  Description of Artificial Sequence: Synthetic oligonucleotide
  Target: ATXN1; (-) strand; PAM type: YTN; PAM sequence: CTT
cagcattccttccaccgtct

SEQ ID NO: 176705 - DNA, 20 bp, Artificial Sequence
  Description of Artificial Sequence: Synthetic oligonucleotide
  Target: ATXN1; (-) strand; PAM type: YTN; PAM sequence: TTA
cttcagcattccttccaccg

SEQ ID NO: 176706 - DNA, 20 bp, Artificial Sequence
  Description of Artificial Sequence: Synthetic oligonucleotide
  Target: ATXN1; (-) strand; PAM type: YTN; PAM sequence: CTT
acttcagcattccttccacc

SEQ ID NO: 176707 - DNA, 20 bp, Artificial Sequence
  Description of Artificial Sequence: Synthetic oligonucleotide
  Target: ATXN1; (-) strand; PAM type: YTN; PAM sequence: TTA
cagaagcttacttcagcatt

SEQ ID NO: 176708 - DNA, 20 bp, Artificial Sequence
  Description of Artificial Sequence: Synthetic oligonucleotide
  Target: ATXN1; (-) strand; PAM type: YTN; PAM sequence: CTT
acagaagcttacttcagcat

SEQ ID NO: 176709 - DNA, 20 bp, Artificial Sequence
  Description of Artificial Sequence: Synthetic oligonucleotide
  Target: ATXN1; (-) strand; PAM type: YTN; PAM sequence: CTC
ttacagaagcttacttcagc

SEQ ID NO: 176710 - DNA, 20 bp, Artificial Sequence
  Description of Artificial Sequence: Synthetic oligonucleotide
  Target: ATXN1; (-) strand; PAM type: YTN; PAM sequence: TTC
aaagccaggccagtgagctc

SEQ ID NO: 176711 - DNA, 20 bp, Artificial Sequence
  Description of Artificial Sequence: Synthetic oligonucleotide
  Target: ATXN1; (-) strand; PAM type: YTN; PAM sequence: TTT
caaagccaggccagtgagct

SEQ ID NO: 176712 - DNA, 20 bp, Artificial Sequence
  Description of Artificial Sequence: Synthetic oligonucleotide
  Target: ATXN1; (-) strand; PAM type: YTN; PAM sequence: CTT
tcaaagccaggccagtgagc

SEQ ID NO: 176713 - DNA, 20 bp, Artificial Sequence
  Description of Artificial Sequence: Synthetic oligonucleotide
  Target: ATXN1; (-) strand; PAM type: YTN; PAM sequence: CTC
tttcaaagccaggccagtga

SEQ ID NO: 176714 - DNA, 20 bp, Artificial Sequence
  Description of Artificial Sequence: Synthetic oligonucleotide
  Target: ATXN1; (-) strand; PAM type: YTN; PAM sequence: CTC
tctttcaaagccaggccagt

SEQ ID NO: 176715 - DNA, 20 bp, Artificial Sequence
  Description of Artificial Sequence: Synthetic oligonucleotide
  Target: ATXN1; (-) strand; PAM type: YTN; PAM sequence: CTG
atcctctctttcaaagccag

SEQ ID NO: 176716 - DNA, 20 bp, Artificial Sequence
  Description of Artificial Sequence: Synthetic oligonucleotide
  Target: ATXN1; (-) strand; PAM type: YTN; PAM sequence: TTC
agagatcccagctgatcctc

SEQ ID NO: 176717 - DNA, 20 bp, Artificial Sequence
  Description of Artificial Sequence: Synthetic oligonucleotide
  Target: ATXN1; (-) strand; PAM type: YTN; PAM sequence: CTA
ttcagagatcccagctgatc

SEQ ID NO: 176718 - DNA, 20 bp, Artificial Sequence
  Description of Artificial Sequence: Synthetic oligonucleotide
  Target: ATXN1; (-) strand; PAM type: YTN; PAM sequence: CTC
atctattcagagatcccagc

SEQ ID NO: 176719 - DNA, 20 bp, Artificial Sequence
  Description of Artificial Sequence: Synthetic oligonucleotide
  Target: ATXN1; (-) strand; PAM type: YTN; PAM sequence: CTC
ctcatctattcagagatccc

SEQ ID NO: 176720 - DNA, 20 bp, Artificial Sequence
  Description of Artificial Sequence: Synthetic oligonucleotide
  Target: ATXN1; (-) strand; PAM type: YTN; PAM sequence: CTG
actcctcatctattcagaga

SEQ ID NO: 176721 - DNA, 20 bp, Artificial Sequence
  Description of Artificial Sequence: Synthetic oligonucleotide
  Target: ATXN1; (-) strand; PAM type: YTN; PAM sequence: TTC
accctgactcctcatctatt

SEQ ID NO: 176722 - DNA, 20 bp, Artificial Sequence
  Description of Artificial Sequence: Synthetic oligonucleotide
  Target: ATXN1; (-) strand; PAM type: YTN; PAM sequence: CTT
caccctgactcctcatctat

SEQ ID NO: 176723 - DNA, 20 bp, Artificial Sequence
  Description of Artificial Sequence: Synthetic oligonucleotide
  Target: ATXN1; (-) strand; PAM type: YTN; PAM sequence: CTG
tcttcaccctgactcctcat

SEQ ID NO: 176724 - DNA, 20 bp, Artificial Sequence
  Description of Artificial Sequence: Synthetic oligonucleotide
  Target: ATXN1; (-) strand; PAM type: YTN; PAM sequence: TTC
tgtcttcaccctgactcctc

SEQ ID NO: 176725 - DNA, 20 bp, Artificial Sequence
  Description of Artificial Sequence: Synthetic oligonucleotide
  Target: ATXN1; (-) strand; PAM type: YTN; PAM sequence: TTT
ctgtcttcaccctgactcct

SEQ ID NO: 176726 - DNA, 20 bp, Artificial Sequence
  Description of Artificial Sequence: Synthetic oligonucleotide
  Target: ATXN1; (-) strand; PAM type: YTN; PAM sequence: TTG
tttctgtcttcaccctgact

SEQ ID NO: 176727 - DNA, 20 bp, Artificial Sequence
  Description of Artificial Sequence: Synthetic oligonucleotide
  Target: ATXN1; (-) strand; PAM type: YTN; PAM sequence: TTT
gtttctgtcttcaccctgac

SEQ ID NO: 176728 - DNA, 20 bp, Artificial Sequence
  Description of Artificial Sequence: Synthetic oligonucleotide
  Target: ATXN1; (-) strand; PAM type: YTN; PAM sequence: CTT
tgtttctgtcttcaccctga

SEQ ID NO: 176729 - DNA, 20 bp, Artificial Sequence
  Description of Artificial Sequence: Synthetic oligonucleotide
  Target: ATXN1; (-) strand; PAM type: YTN; PAM sequence: TTC
tttgtttctgtcttcaccct

SEQ ID NO: 176730 - DNA, 20 bp, Artificial Sequence
  Description of Artificial Sequence: Synthetic oligonucleotide
  Target: ATXN1; (-) strand; PAM type: YTN; PAM sequence: CTT
ctttgtttctgtcttcaccc

SEQ ID NO: 176731 - DNA, 20 bp, Artificial Sequence
  Description of Artificial Sequence: Synthetic oligonucleotide
  Target: ATXN1; (-) strand; PAM type: YTN; PAM sequence: CTG
aaacacttctttgtttctgt

SEQ ID NO: 176732 - DNA, 20 bp, Artificial Sequence
  Description of Artificial Sequence: Synthetic oligonucleotide
  Target: ATXN1; (-) strand; PAM type: YTN; PAM sequence: TTG
cacctgaaacacttctttgt

SEQ ID NO: 176733 - DNA, 20 bp, Artificial Sequence
  Description of Artificial Sequence: Synthetic oligonucleotide
  Target: ATXN1; (-) strand; PAM type: YTN; PAM sequence: TTT
gcacctgaaacacttctttg

SEQ ID NO: 176734 - DNA, 20 bp, Artificial Sequence
  Description of Artificial Sequence: Synthetic oligonucleotide
  Target: ATXN1; (-) strand; PAM type: YTN; PAM sequence: CTT
tgcacctgaaacacttcttt

SEQ ID NO: 176735 - DNA, 20 bp, Artificial Sequence
  Description of Artificial Sequence: Synthetic oligonucleotide
  Target: ATXN1; (-) strand; PAM type: YTN; PAM sequence: TTC
ctttgcacctgaaacacttc

SEQ ID NO: 176736 - DNA, 20 bp, Artificial Sequence
  Description of Artificial Sequence: Synthetic oligonucleotide
  Target: ATXN1; (-) strand; PAM type: YTN; PAM sequence: TTT
cctttgcacctgaaacactt

SEQ ID NO: 176737 - DNA, 20 bp, Artificial Sequence
  Description of Artificial Sequence: Synthetic oligonucleotide
  Target: ATXN1; (-) strand; PAM type: YTN; PAM sequence: TTC
agagagtcatggagcaccca

SEQ ID NO: 176738 - DNA, 20 bp, Artificial Sequence
  Description of Artificial Sequence: Synthetic oligonucleotide
  Target: ATXN1; (-) strand; PAM type: YTN; PAM sequence: CTT
cagagagtcatggagcaccc

SEQ ID NO: 176739 - DNA, 20 bp, Artificial Sequence
  Description of Artificial Sequence: Synthetic oligonucleotide
  Target: ATXN1; (-) strand; PAM type: YTN; PAM sequence: CTC
ccttcagagagtcatggagc

SEQ ID NO: 176740 - DNA, 20 bp, Artificial Sequence
  Description of Artificial Sequence: Synthetic oligonucleotide
  Target: ATXN1; (-) strand; PAM type: YTN; PAM sequence: TTG
gactcccttcagagagtcat

SEQ ID NO: 176741 - DNA, 20 bp, Artificial Sequence
  Description of Artificial Sequence: Synthetic oligonucleotide
  Target: ATXN1; (-) strand; PAM type: YTN; PAM sequence: CTT
ggactcccttcagagagtca

SEQ ID NO: 176742 - DNA, 20 bp, Artificial Sequence
  Description of Artificial Sequence: Synthetic oligonucleotide
  Target: ATXN1; (-) strand; PAM type: YTN; PAM sequence: CTG
aatggtccagcccttggact

SEQ ID NO: 176743 - DNA, 20 bp, Artificial Sequence
  Description of Artificial Sequence: Synthetic oligonucleotide
  Target: ATXN1; (-) strand; PAM type: YTN; PAM sequence: TTC
tgaatggtccagcccttgga

SEQ ID NO: 176744 - DNA, 20 bp, Artificial Sequence
  Description of Artificial Sequence: Synthetic oligonucleotide
  Target: ATXN1; (-) strand; PAM type: YTN; PAM sequence: CTG
aaggttctgaatggtccagc

SEQ ID NO: 176745 - DNA, 20 bp, Artificial Sequence
  Description of Artificial Sequence: Synthetic oligonucleotide
  Target: ATXN1; (-) strand; PAM type: YTN; PAM sequence: TTC
ctgaaggttctgaatggtcc

SEQ ID NO: 176746 - DNA, 20 bp, Artificial Sequence
  Description of Artificial Sequence: Synthetic oligonucleotide
  Target: ATXN1; (-) strand; PAM type: YTN; PAM sequence: CTT
cctgaaggttctgaatggtc

SEQ ID NO: 176747 - DNA, 20 bp, Artificial Sequence
  Description of Artificial Sequence: Synthetic oligonucleotide
  Target: ATXN1; (-) strand; PAM type: YTN; PAM sequence: CTG
agtcttcctgaaggttctga

SEQ ID NO: 176748 - DNA, 20 bp, Artificial Sequence
  Description of Artificial Sequence: Synthetic oligonucleotide
  Target: ATXN1; (-) strand; PAM type: YTN; PAM sequence: TTC
tgagtcttcctgaaggttct

SEQ ID NO: 176749 - DNA, 20 bp, Artificial Sequence
  Description of Artificial Sequence: Synthetic oligonucleotide
  Target: ATXN1; (-) strand; PAM type: YTN; PAM sequence: CTG
ttctgagtcttcctgaaggt

SEQ ID NO: 176750 - DNA, 20 bp, Artificial Sequence
  Description of Artificial Sequence: Synthetic oligonucleotide
  Target: ATXN1; (-) strand; PAM type: YTN; PAM sequence: CTG
gagctgttctgagtcttcct

SEQ ID NO: 176751 - DNA, 20 bp, Artificial Sequence
  Description of Artificial Sequence: Synthetic oligonucleotide
  Target: ATXN1; (-) strand; PAM type: YTN; PAM sequence: CTC
aggcaggctggagctgttct

SEQ ID NO: 176752 - DNA, 20 bp, Artificial Sequence
  Description of Artificial Sequence: Synthetic oligonucleotide
  Target: ATXN1; (-) strand; PAM type: YTN; PAM sequence: TTC
cagctcaggcaggctggagc

SEQ ID NO: 176753 - DNA, 20 bp, Artificial Sequence
  Description of Artificial Sequence: Synthetic oligonucleotide
  Target: ATXN1; (-) strand; PAM type: YTN; PAM sequence: CTT
ccagctcaggcaggctggag

SEQ ID NO: 176754 - DNA, 20 bp, Artificial Sequence
  Description of Artificial Sequence: Synthetic oligonucleotide
  Target: ATXN1; (-) strand; PAM type: YTN; PAM sequence: CTG
cttccagctcaggcaggctg

SEQ ID NO: 176755 - DNA, 20 bp, Artificial Sequence
  Description of Artificial Sequence: Synthetic oligonucleotide
  Target: ATXN1; (-) strand; PAM type: YTN; PAM sequence: CTC
agaggagacgcaacaccaac

SEQ ID NO: 176756 - DNA, 20 bp, Artificial Sequence
  Description of Artificial Sequence: Synthetic oligonucleotide
  Target: ATXN1; (-) strand; PAM type: YTN; PAM sequence: CTG
gaaggtcctcagaggagacg

SEQ ID NO: 176757 - DNA, 20 bp, Artificial Sequence
  Description of Artificial Sequence: Synthetic oligonucleotide
  Target: ATXN1; (-) strand; PAM type: YTN; PAM sequence: TTC
tggaaggtcctcagaggaga

SEQ ID NO: 176758 - DNA, 20 bp, Artificial Sequence
  Description of Artificial Sequence: Synthetic oligonucleotide
  Target: ATXN1; (-) strand; PAM type: YTN; PAM sequence: TTA
gatggttctggaaggtcctc

SEQ ID NO: 176759 - DNA, 20 bp, Artificial Sequence
  Description of Artificial Sequence: Synthetic oligonucleotide
  Target: ATXN1; (-) strand; PAM type: YTN; PAM sequence: CTG
acccatgccattagatggtt

SEQ ID NO: 176760 - DNA, 20 bp, Artificial Sequence
  Description of Artificial Sequence: Synthetic oligonucleotide
  Target: ATXN1; (-) strand; PAM type: YTN; PAM sequence: TTC
tgacccatgccattagatgg

SEQ ID NO: 176761 - DNA, 20 bp, Artificial Sequence
  Description of Artificial Sequence: Synthetic oligonucleotide
  Target: ATXN1; (-) strand; PAM type: YTN; PAM sequence: CTG
agtgcaaaatgcagcagtca

SEQ ID NO: 176762 - DNA, 20 bp, Artificial Sequence
  Description of Artificial Sequence: Synthetic oligonucleotide
  Target: ATXN1; (-) strand; PAM type: YTN; PAM sequence: TTC
atggaaggccctgagtgcaa

SEQ ID NO: 176763 - DNA, 20 bp, Artificial Sequence
  Description of Artificial Sequence: Synthetic oligonucleotide
  Target: ATXN1; (-) strand; PAM type: YTN; PAM sequence: CTG
ccattcatggaaggccctga

SEQ ID NO: 176764 - DNA, 20 bp, Artificial Sequence
  Description of Artificial Sequence: Synthetic oligonucleotide
  Target: ATXN1; (-) strand; PAM type: YTN; PAM sequence: CTG
caaaggtaccagaaactgcc

SEQ ID NO: 176765 - DNA, 20 bp, Artificial Sequence
  Description of Artificial Sequence: Synthetic oligonucleotide
  Target: ATXN1; (-) strand; PAM type: YTN; PAM sequence: TTA
gggaatagtctgcaaaggta

SEQ ID NO: 176766 - DNA, 20 bp, Artificial Sequence
  Description of Artificial Sequence: Synthetic oligonucleotide
  Target: ATXN1; (-) strand; PAM type: YTN; PAM sequence: TTA
tgtgtaaagggcatgttagg

SEQ ID NO: 176767 - DNA, 20 bp, Artificial Sequence
  Description of Artificial Sequence: Synthetic oligonucleotide
  Target: ATXN1; (-) strand; PAM type: YTN; PAM sequence: TTT
atgtgtaaagggcatgttag

SEQ ID NO: 176768 - DNA, 20 bp, Artificial Sequence
  Description of Artificial Sequence: Synthetic oligonucleotide
  Target: ATXN1; (-) strand; PAM type: YTN; PAM sequence: CTG
aatttatgtgtaaagggcat

SEQ ID NO: 176769 - DNA, 20 bp, Artificial Sequence
  Description of Artificial Sequence: Synthetic oligonucleotide
  Target: ATXN1; (-) strand; PAM type: YTN; PAM sequence: TTG
gctgaatttatgtgtaaagg

SEQ ID NO: 176770 - DNA, 20 bp, Artificial Sequence
  Description of Artificial Sequence: Synthetic oligonucleotide
  Target: ATXN1; (-) strand; PAM type: YTN; PAM sequence: TTC
agttggctgaatttatgtgt

SEQ ID NO: 176771 - DNA, 20 bp, Artificial Sequence
  Description of Artificial Sequence: Synthetic oligonucleotide
  Target: ATXN1; (-) strand; PAM type: YTN; PAM sequence: TTT
cagttggctgaatttatgtg

SEQ ID NO: 176772 - DNA, 20 bp, Artificial Sequence
  Description of Artificial Sequence: Synthetic oligonucleotide
  Target: ATXN1; (-) strand; PAM type: YTN; PAM sequence: CTG
atttcagttggctgaattta

SEQ ID NO: 176773 - DNA, 20 bp, Artificial Sequence
  Description of Artificial Sequence: Synthetic oligonucleotide
  Target: ATXN1; (-) strand; PAM type: YTN; PAM sequence: CTC
tgatttcagttggctgaatt

SEQ ID NO: 176774 - DNA, 20 bp, Artificial Sequence
  Description of Artificial Sequence: Synthetic oligonucleotide
  Target: ATXN1; (-) strand; PAM type: YTN; PAM sequence: TTG
ctctgatttcagttggctga

SEQ ID NO: 176775 - DNA, 20 bp, Artificial Sequence
  Description of Artificial Sequence: Synthetic oligonucleotide
  Target: ATXN1; (-) strand; PAM type: YTN; PAM sequence: CTC
aaatattgctctgatttcag

SEQ ID NO: 176776 - DNA, 20 bp, Artificial Sequence
  Description of Artificial Sequence: Synthetic oligonucleotide
  Target: ATXN1; (-) strand; PAM type: YTN; PAM sequence: TTA
gagggaaaaaaggccatagc

SEQ ID NO: 176777 - DNA, 20 bp, Artificial Sequence
  Description of Artificial Sequence: Synthetic oligonucleotide
  Target: ATXN1; (-) strand; PAM type: YTN; PAM sequence: TTT
agagggaaaaaaggccatag

SEQ ID NO: 176778 - DNA, 20 bp, Artificial Sequence
  Description of Artificial Sequence: Synthetic oligonucleotide
  Target: ATXN1; (-) strand; PAM type: YTN; PAM sequence: TTT
tagagggaaaaaaggccata

SEQ ID NO: 176779 - DNA, 20 bp, Artificial Sequence
  Description of Artificial Sequence: Synthetic oligonucleotide
  Target: ATXN1; (-) strand; PAM type: YTN; PAM sequence: TTG
gtagcattttagagggaaaa

SEQ ID NO: 176780 - DNA, 20 bp, Artificial Sequence
  Description of Artificial Sequence: Synthetic oligonucleotide
  Target: ATXN1; (-) strand; PAM type: YTN; PAM sequence: TTT
ggtagcattttagagggaaa

SEQ ID NO: 176781 - DNA, 20 bp, Artificial Sequence
  Description of Artificial Sequence: Synthetic oligonucleotide
  Target: ATXN1; (-) strand; PAM type: YTN; PAM sequence: CTA
gtgtttggtagcattttaga

SEQ ID NO: 176782 - DNA, 20 bp, Artificial Sequence
  Description of Artificial Sequence: Synthetic oligonucleotide
  Target: ATXN1; (-) strand; PAM type: YTN; PAM sequence: CTA
agagatctagtgtttggtag

SEQ ID NO: 176783 - DNA, 20 bp, Artificial Sequence
  Description of Artificial Sequence: Synthetic oligonucleotide
  Target: ATXN1; (-) strand; PAM type: YTN; PAM sequence: TTA
aaatatgaaagaactaagag

SEQ ID NO: 176784 - DNA, 20 bp, Artificial Sequence
  Description of Artificial Sequence: Synthetic oligonucleotide
  Target: ATXN1; (-) strand; PAM type: YTN; PAM sequence: TTT
aaaatatgaaagaactaaga

SEQ ID NO: 176785 - DNA, 20 bp, Artificial Sequence
  Description of Artificial Sequence: Synthetic oligonucleotide
  Target: ATXN1; (-) strand; PAM type: YTN; PAM sequence: CTT
taaaatatgaaagaactaag

SEQ ID NO: 176786 - DNA, 20 bp, Artificial Sequence
  Description of Artificial Sequence: Synthetic oligonucleotide
  Target: ATXN1; (-) strand; PAM type: YTN; PAM sequence: CTG
tgcactttaaaatatgaaag

SEQ ID NO: 176787 - DNA, 20 bp, Artificial Sequence
  Description of Artificial Sequence: Synthetic oligonucleotide
  Target: ATXN1; (-) strand; PAM type: YTN; PAM sequence: CTG
aaatcaggcatctgtgcact

SEQ ID NO: 176788 - DNA, 20 bp, Artificial Sequence
  Description of Artificial Sequence: Synthetic oligonucleotide
  Target: ATXN1; (-) strand; PAM type: YTN; PAM sequence: TTC
acagaatctgaaatcaggca

SEQ ID NO: 176789 - DNA, 20 bp, Artificial Sequence
  Description of Artificial Sequence: Synthetic oligonucleotide
  Target: ATXN1; (-) strand; PAM type: YTN; PAM sequence: TTT
cacagaatctgaaatcaggc

SEQ ID NO: 176790 - DNA, 20 bp, Artificial Sequence
  Description of Artificial Sequence: Synthetic oligonucleotide
  Target: ATXN1; (-) strand; PAM type: YTN; PAM sequence: CTG
tttcacagaatctgaaatca

SEQ ID NO: 176791 - DNA, 20 bp, Artificial Sequence
  Description of Artificial Sequence: Synthetic oligonucleotide
  Target: ATXN1; (-) strand; PAM type: YTN; PAM sequence: CTC
tgtttcacagaatctgaaat

SEQ ID NO: 176792 - DNA, 20 bp, Artificial Sequence
  Description of Artificial Sequence: Synthetic oligonucleotide
  Target: ATXN1; (-) strand; PAM type: YTN; PAM sequence: TTG
tgctctgtttcacagaatct

SEQ ID NO: 176793 - DNA, 20 bp, Artificial Sequence
  Description of Artificial Sequence: Synthetic oligonucleotide
  Target: ATXN1; (-) strand; PAM type: YTN; PAM sequence: TTT
gtgctctgtttcacagaatc

SEQ ID NO: 176794 - DNA, 20 bp, Artificial Sequence
  Description of Artificial Sequence: Synthetic oligonucleotide
  Target: ATXN1; (-) strand; PAM type: YTN; PAM sequence: TTA
atttgtgctctgtttcacag

SEQ ID NO: 176795 - DNA, 20 bp, Artificial Sequence
  Description of Artificial Sequence: Synthetic oligonucleotide
  Target: ATXN1; (-) strand; PAM type: YTN; PAM sequence: TTG
taaatattaatttgtgctct

SEQ ID NO: 176796 - DNA, 20 bp, Artificial Sequence
  Description of Artificial Sequence: Synthetic oligonucleotide
  Target: ATXN1; (-) strand; PAM type: YTN; PAM sequence: TTT
gtaaatattaatttgtgctc

SEQ ID NO: 176797 - DNA, 20 bp, Artificial Sequence
  Description of Artificial Sequence: Synthetic oligonucleotide
  Target: ATXN1; (-) strand; PAM type: YTN; PAM sequence: CTG
agacagaaagcatttgtaaa

SEQ ID NO: 176798 - DNA, 20 bp, Artificial Sequence
  Description of Artificial Sequence: Synthetic oligonucleotide
  Target: ATXN1; (-) strand; PAM type: YTN; PAM sequence: CTA
cagaggggtcctgagacaga

SEQ ID NO: 176799 - DNA, 20 bp, Artificial Sequence
  Description of Artificial Sequence: Synthetic oligonucleotide
  Target: ATXN1; (-) strand; PAM type: YTN; PAM sequence: TTA
gtagctacagaggggtcctg

SEQ ID NO: 176800 - DNA, 20 bp, Artificial Sequence
  Description of Artificial Sequence: Synthetic oligonucleotide
  Target: ATXN1; (-) strand; PAM type: YTN; PAM sequence: TTC
ccaaatgtgaagttagtagc

SEQ ID NO: 176801 - DNA, 20 bp, Artificial Sequence
  Description of Artificial Sequence: Synthetic oligonucleotide
  Target: ATXN1; (-) strand; PAM type: YTN; PAM sequence: TTT
cccaaatgtgaagttagtag

SEQ ID NO: 176802 - DNA, 20 bp, Artificial Sequence
  Description of Artificial Sequence: Synthetic oligonucleotide
  Target: ATXN1; (-) strand; PAM type: YTN; PAM sequence: TTT
tcccaaatgtgaagttagta

SEQ ID NO: 176803 - DNA, 20 bp, Artificial Sequence
  Description of Artificial Sequence: Synthetic oligonucleotide
  Target: ATXN1; (-) strand; PAM type: YTN; PAM sequence: TTT
ttcccaaatgtgaagttagt

SEQ ID NO: 176804 - DNA, 20 bp, Artificial Sequence
  Description of Artificial Sequence: Synthetic oligonucleotide
  Target: ATXN1; (-) strand; PAM type: YTN; PAM sequence: CTT
tttcccaaatgtgaagttag

SEQ ID NO: 176805 - DNA, 20 bp, Artificial Sequence
  Description of Artificial Sequence: Synthetic oligonucleotide
  Target: ATXN1; (-) strand; PAM type: YTN; PAM sequence: CTA
ctttttcccaaatgtgaagt

SEQ ID NO: 176806 - DNA, 20 bp, Artificial Sequence
  Description of Artificial Sequence: Synthetic oligonucleotide
  Target: ATXN1; (-) strand; PAM type: YTN; PAM sequence: TTG
gtaaacaacgtggcacagtg

SEQ ID NO: 176807 - DNA, 20 bp, Artificial Sequence
  Description of Artificial Sequence: Synthetic oligonucleotide
  Target: ATXN1; (-) strand; PAM type: YTN; PAM sequence: TTT
ggtaaacaacgtggcacagt

SEQ ID NO: 176808 - DNA, 20 bp, Artificial Sequence
  Description of Artificial Sequence: Synthetic oligonucleotide
  Target: ATXN1; (-) strand; PAM type: YTN; PAM sequence: TTT
tggtaaacaacgtggcacag

SEQ ID NO: 176809 - DNA, 20 bp, Artificial Sequence
  Description of Artificial Sequence: Synthetic oligonucleotide
  Target: ATXN1; (-) strand; PAM type: YTN; PAM sequence: CTT
ttggtaaacaacgtggcaca

SEQ ID NO: 176810 - DNA, 20 bp, Artificial Sequence
  Description of Artificial Sequence: Synthetic oligonucleotide
  Target: ATXN1; (-) strand; PAM type: YTN; PAM sequence: CTG
gtgggatacttttggtaaac

SEQ ID NO: 176811 - DNA, 20 bp, Artificial Sequence
  Description of Artificial Sequence: Synthetic oligonucleotide
  Target: ATXN1; (-) strand; PAM type: YTN; PAM sequence: TTA
aagtaatacacgtgggtgag

SEQ ID NO: 176812 - DNA, 20 bp, Artificial Sequence
  Description of Artificial Sequence: Synthetic oligonucleotide
  Target: ATXN1; (-) strand; PAM type: YTN; PAM sequence: TTT
aaagtaatacacgtgggtga

SEQ ID NO: 176813 - DNA, 20 bp, Artificial Sequence
  Description of Artificial Sequence: Synthetic oligonucleotide
  Target: ATXN1; (-) strand; PAM type: YTN; PAM sequence: TTT
taaagtaatacacgtgggtg

SEQ ID NO: 176814 - DNA, 20 bp, Artificial Sequence
  Description of Artificial Sequence: Synthetic oligonucleotide
  Target: ATXN1; (-) strand; PAM type: YTN; PAM sequence: TTA
ccgaaaggcattttaaagta

SEQ ID NO: 176815 - DNA, 20 bp, Artificial Sequence
  Description of Artificial Sequence: Synthetic oligonucleotide
  Target: ATXN1; (-) strand; PAM type: YTN; PAM sequence: TTT
accgaaaggcattttaaagt

SEQ ID NO: 176816 - DNA, 20 bp, Artificial Sequence
  Description of Artificial Sequence: Synthetic oligonucleotide
  Target: ATXN1; (-) strand; PAM type: YTN; PAM sequence: CTT
taccgaaaggcattttaaag

SEQ ID NO: 176817 - DNA, 20 bp, Artificial Sequence
  Description of Artificial Sequence: Synthetic oligonucleotide
  Target: ATXN1; (-) strand; PAM type: YTN; PAM sequence: CTC
ctttaccgaaaggcatttta

SEQ ID NO: 176818 - DNA, 20 bp, Artificial Sequence
  Description of Artificial Sequence: Synthetic oligonucleotide
  Target: ATXN1; (-) strand; PAM type: YTN; PAM sequence: TTC
tcctttaccgaaaggcattt

SEQ ID NO: 176819 - DNA, 20 bp, Artificial Sequence
  Description of Artificial Sequence: Synthetic oligonucleotide
  Target: ATXN1; (-) strand; PAM type: YTN; PAM sequence: TTC
aaattctcctttaccgaaag

SEQ ID NO: 176820 - DNA, 20 bp, Artificial Sequence
  Description of Artificial Sequence: Synthetic oligonucleotide
  Target: ATXN1; (-) strand; PAM type: YTN; PAM sequence: CTA
ttcaaattctcctttaccga

SEQ ID NO: 176821 - DNA, 20 bp, Artificial Sequence
  Description of Artificial Sequence: Synthetic oligonucleotide
  Target: ATXN1; (-) strand; PAM type: YTN; PAM sequence: TTA
atgcgtaaaatgctattcaa

SEQ ID NO: 176822 - DNA, 20 bp, Artificial Sequence
  Description of Artificial Sequence: Synthetic oligonucleotide
  Target: ATXN1; (-) strand; PAM type: YTN; PAM sequence: TTC
ccagacagttaatgcgtaaa

SEQ ID NO: 176823 - DNA, 20 bp, Artificial Sequence
  Description of Artificial Sequence: Synthetic oligonucleotide
  Target: ATXN1; (-) strand; PAM type: YTN; PAM sequence: TTG
ggagcattcccagacagtta

SEQ ID NO: 176824 - DNA, 20 bp, Artificial Sequence
  Description of Artificial Sequence: Synthetic oligonucleotide
  Target: ATXN1; (-) strand; PAM type: YTN; PAM sequence: TTA
tgttgggagcattcccagac

SEQ ID NO: 176825 - DNA, 20 bp, Artificial Sequence
  Description of Artificial Sequence: Synthetic oligonucleotide
  Target: ATXN1; (-) strand; PAM type: YTN; PAM sequence: TTC
agtatattatgttgggagca

SEQ ID NO: 176826 - DNA, 20 bp, Artificial Sequence
  Description of Artificial Sequence: Synthetic oligonucleotide
  Target: ATXN1; (-) strand; PAM type: YTN; PAM sequence: TTT
cagtatattatgttgggagc

SEQ ID NO: 176827 - DNA, 20 bp, Artificial Sequence
  Description of Artificial Sequence: Synthetic oligonucleotide
  Target: ATXN1; (-) strand; PAM type: YTN; PAM sequence: CTG
tgtttcagtatattatgttg

SEQ ID NO: 176828 - DNA, 20 bp, Artificial Sequence
  Description of Artificial Sequence: Synthetic oligonucleotide
  Target: ATXN1; (-) strand; PAM type: YTN; PAM sequence: TTC
tgtgtttcagtatattatgt

SEQ ID NO: 176829 - DNA, 20 bp, Artificial Sequence
  Description of Artificial Sequence: Synthetic oligonucleotide
  Target: ATXN1; (-) strand; PAM type: YTN; PAM sequence: CTT
ctgtgtttcagtatattatg

SEQ ID NO: 176830 - DNA, 20 bp, Artificial Sequence
  Description of Artificial Sequence: Synthetic oligonucleotide
  Target: ATXN1; (-) strand; PAM type: YTN; PAM sequence: CTA
cagccagtcttctgtgtttc

SEQ ID NO: 176831 - DNA, 20 bp, Artificial Sequence
  Description of Artificial Sequence: Synthetic oligonucleotide
  Target: ATXN1; (-) strand; PAM type: YTN; PAM sequence: CTG
gacctacagccagtcttctg

SEQ ID NO: 176832 - DNA, 20 bp, Artificial Sequence
  Description of Artificial Sequence: Synthetic oligonucleotide
  Target: ATXN1; (-) strand; PAM type: YTN; PAM sequence: CTA
ccaggtgatctggacctaca

SEQ ID NO: 176833 - DNA, 20 bp, Artificial Sequence
  Description of Artificial Sequence: Synthetic oligonucleotide
  Target: ATXN1; (-) strand; PAM type: YTN; PAM sequence: TTC
actaccaggtgatctggacc

SEQ ID NO: 176834 - DNA, 20 bp, Artificial Sequence
  Description of Artificial Sequence: Synthetic oligonucleotide
  Target: ATXN1; (-) strand; PAM type: YTN; PAM sequence: TTC
catggttcactaccaggtga

SEQ ID NO: 176835 - DNA, 20 bp, Artificial Sequence
  Description of Artificial Sequence: Synthetic oligonucleotide
  Target: ATXN1; (-) strand; PAM type: YTN; PAM sequence: TTT
ccatggttcactaccaggtg

SEQ ID NO: 176836 - DNA, 20 bp, Artificial Sequence
  Description of Artificial Sequence: Synthetic oligonucleotide
  Target: ATXN1; (-) strand; PAM type: YTN; PAM sequence: CTT
tccatggttcactaccaggt

SEQ ID NO: 176837 - DNA, 20 bp, Artificial Sequence
  Description of Artificial Sequence: Synthetic oligonucleotide
  Target: ATXN1; (-) strand; PAM type: YTN; PAM sequence: CTC
caaggtgtgtgaataatacc

SEQ ID NO: 176838 - DNA, 20 bp, Artificial Sequence
  Description of Artificial Sequence: Synthetic oligonucleotide
  Target: ATXN1; (-) strand; PAM type: YTN; PAM sequence: TTA
gagaatccgcaggctccaag

SEQ ID NO: 176839 - DNA, 20 bp, Artificial Sequence
  Description of Artificial Sequence: Synthetic oligonucleotide
  Target: ATXN1; (-) strand; PAM type: YTN; PAM sequence: CTT
agagaatccgcaggctccaa

SEQ ID NO: 176840 - DNA, 20 bp, Artificial Sequence
  Description of Artificial Sequence: Synthetic oligonucleotide
  Target: ATXN1; (-) strand; PAM type: YTN; PAM sequence: TTA
agaaggcttagagaatccgc

SEQ ID NO: 176841 - DNA, 20 bp, Artificial Sequence
  Description of Artificial Sequence: Synthetic oligonucleotide
  Target: ATXN1; (-) strand; PAM type: YTN; PAM sequence: CTG
aagaatgattaagaaggctt

SEQ ID NO: 176842 - DNA, 20 bp, Artificial Sequence
  Description of Artificial Sequence: Synthetic oligonucleotide
  Target: ATXN1; (-) strand; PAM type: YTN; PAM sequence: TTG
aaggacaaagtaatacctga

SEQ ID NO: 176843 - DNA, 20 bp, Artificial Sequence
  Description of Artificial Sequence: Synthetic oligonucleotide
  Target: ATXN1; (-) strand; PAM type: YTN; PAM sequence: TTT
gaaggacaaagtaatacctg

SEQ ID NO: 176844 - DNA, 20 bp, Artificial Sequence
  Description of Artificial Sequence: Synthetic oligonucleotide
  Target: ATXN1; (-) strand; PAM type: YTN; PAM sequence: TTT
tgaaggacaaagtaatacct

SEQ ID NO: 176845 - DNA, 20 bp, Artificial Sequence
  Description of Artificial Sequence: Synthetic oligonucleotide
  Target: ATXN1; (-) strand; PAM type: YTN; PAM sequence: CTG
ttttgaaggacaaagtaata

SEQ ID NO: 176846 - DNA, 20 bp, Artificial Sequence
  Description of Artificial Sequence: Synthetic oligonucleotide
  Target: ATXN1; (-) strand; PAM type: YTN; PAM sequence: CTG
ctgttttgaaggacaaagta

SEQ ID NO: 176847 - DNA, 20 bp, Artificial Sequence
  Description of Artificial Sequence: Synthetic oligonucleotide
  Target: ATXN1; (-) strand; PAM type: YTN; PAM sequence: CTG
aaatctgctgttttgaagga

SEQ ID NO: 176848 - DNA, 20 bp, Artificial Sequence
  Description of Artificial Sequence: Synthetic oligonucleotide
  Target: ATXN1; (-) strand; PAM type: YTN; PAM sequence: TTA
taaatgcgtctgaaatctgc

SEQ ID NO: 176849 - DNA, 20 bp, Artificial Sequence
  Description of Artificial Sequence: Synthetic oligonucleotide
  Target: ATXN1; (-) strand; PAM type: YTN; PAM sequence: TTT
ataaatgcgtctgaaatctg

SEQ ID NO: 176850 - DNA, 20 bp, Artificial Sequence
  Description of Artificial Sequence: Synthetic oligonucleotide
  Target: ATXN1; (-) strand; PAM type: YTN; PAM sequence: TTT
tataaatgcgtctgaaatct

SEQ ID NO: 176851 - DNA, 20 bp, Artificial Sequence
  Description of Artificial Sequence: Synthetic oligonucleotide
  Target: ATXN1; (-) strand; PAM type: YTN; PAM sequence: TTG
ttttataaatgcgtctgaaa

SEQ ID NO: 176852 - DNA, 20 bp, Artificial Sequence
  Description of Artificial Sequence: Synthetic oligonucleotide
  Target: ATXN1; (-) strand; PAM type: YTN; PAM sequence: CTG
aattgttttataaatgcgtc

SEQ ID NO: 176853 - DNA, 20 bp, Artificial Sequence
  Description of Artificial Sequence: Synthetic oligonucleotide
  Target: ATXN1; (-) strand; PAM type: YTN; PAM sequence: TTA
caactgaattgttttataaa

SEQ ID NO: 176854 - DNA, 20 bp, Artificial Sequence
  Description of Artificial Sequence: Synthetic oligonucleotide
  Target: ATXN1; (-) strand; PAM type: YTN; PAM sequence: TTA
gggacccagattacaactga

SEQ ID NO: 176855 - DNA, 20 bp, Artificial Sequence
  Description of Artificial Sequence: Synthetic oligonucleotide
  Target: ATXN1; (-) strand; PAM type: YTN; PAM sequence: TTT
agggacccagattacaactg

SEQ ID NO: 176856 - DNA, 20 bp, Artificial Sequence
  Description of Artificial Sequence: Synthetic oligonucleotide
  Target: ATXN1; (-) strand; PAM type: YTN; PAM sequence: CTT
tagggacccagattacaact

SEQ ID NO: 176857 - DNA, 20 bp, Artificial Sequence
  Description of Artificial Sequence: Synthetic oligonucleotide
  Target: ATXN1; (-) strand; PAM type: YTN; PAM sequence: CTG
aagctttagggacccagatt

SEQ ID NO: 176858 - DNA, 20 bp, Artificial Sequence
  Description of Artificial Sequence: Synthetic oligonucleotide
  Target: ATXN1; (-) strand; PAM type: YTN; PAM sequence: CTA
tactgaagctttagggaccc

SEQ ID NO: 176859 - DNA, 20 bp, Artificial Sequence
  Description of Artificial Sequence: Synthetic oligonucleotide
  Target: ATXN1; (-) strand; PAM type: YTN; PAM sequence: TTA
caagataaatgtctatactg

SEQ ID NO: 176860 - DNA, 20 bp, Artificial Sequence
  Description of Artificial Sequence: Synthetic oligonucleotide
  Target: ATXN1; (-) strand; PAM type: YTN; PAM sequence: CTT
acaagataaatgtctatact

SEQ ID NO: 176861 - DNA, 20 bp, Artificial Sequence
  Description of Artificial Sequence: Synthetic oligonucleotide
  Target: ATXN1; (-) strand; PAM type: YTN; PAM sequence: TTA
cttacaagataaatgtctat

SEQ ID NO: 176862 - DNA, 20 bp, Artificial Sequence
  Description of Artificial Sequence: Synthetic oligonucleotide
  Target: ATXN1; (-) strand; PAM type: YTN; PAM sequence: TTG
ttacttacaagataaatgtc

SEQ ID NO: 176863 - DNA, 20 bp, Artificial Sequence
  Description of Artificial Sequence: Synthetic oligonucleotide
  Target: ATXN1; (-) strand; PAM type: YTN; PAM sequence: TTT
gttacttacaagataaatgt

SEQ ID NO: 176864 - DNA, 20 bp, Artificial Sequence
  Description of Artificial Sequence: Synthetic oligonucleotide
  Target: ATXN1; (-) strand; PAM type: YTN; PAM sequence: CTT
tgttacttacaagataaatg

SEQ ID NO: 176865 - DNA, 20 bp, Artificial Sequence
  Description of Artificial Sequence: Synthetic oligonucleotide
  Target: ATXN1; (-) strand; PAM type: YTN; PAM sequence: CTC
tttgttacttacaagataaa

SEQ ID NO: 176866 - DNA, 20 bp, Artificial Sequence
  Description of Artificial Sequence: Synthetic oligonucleotide
  Target: ATXN1; (-) strand; PAM type: YTN; PAM sequence: TTC
ccatctctttgttacttaca

SEQ ID NO: 176867 - DNA, 20 bp, Artificial Sequence
  Description of Artificial Sequence: Synthetic oligonucleotide
  Target: ATXN1; (-) strand; PAM type: YTN; PAM sequence: CTT
cccatctctttgttacttac

SEQ ID NO: 176868 - DNA, 20 bp, Artificial Sequence
  Description of Artificial Sequence: Synthetic oligonucleotide
  Target: ATXN1; (-) strand; PAM type: YTN; PAM sequence: TTA
ggaaatcttcccatctcttt

SEQ ID NO: 176869 - DNA, 20 bp, Artificial Sequence
  Description of Artificial Sequence: Synthetic oligonucleotide
  Target: ATXN1; (-) strand; PAM type: YTN; PAM sequence: CTT
aggaaatcttcccatctctt

SEQ ID NO: 176870 - DNA, 20 bp, Artificial Sequence
  Description of Artificial Sequence: Synthetic oligonucleotide
  Target: ATXN1; (-) strand; PAM type: YTN; PAM sequence: TTG
aatagtgagtaacacaagca

SEQ ID NO: 176871 - DNA, 20 bp, Artificial Sequence
  Description of Artificial Sequence: Synthetic oligonucleotide
  Target: ATXN1; (-) strand; PAM type: YTN; PAM sequence: TTT
gaatagtgagtaacacaagc

SEQ ID NO: 176872 - DNA, 20 bp, Artificial Sequence
  Description of Artificial Sequence: Synthetic oligonucleotide
  Target: ATXN1; (-) strand; PAM type: YTN; PAM sequence: TTT
tgaatagtgagtaacacaag

SEQ ID NO: 176873 - DNA, 20 bp, Artificial Sequence
  Description of Artificial Sequence: Synthetic oligonucleotide
  Target: ATXN1; (-) strand; PAM type: YTN; PAM sequence: TTA
aattttgaatagtgagtaac

SEQ ID NO: 176874 - DNA, 20 bp, Artificial Sequence
  Description of Artificial Sequence: Synthetic oligonucleotide
  Target: ATXN1; (-) strand; PAM type: YTN; PAM sequence: CTT
aaattttgaatagtgagtaa

SEQ ID NO: 176875 - DNA, 20 bp, Artificial Sequence
  Description of Artificial Sequence: Synthetic oligonucleotide
  Target: ATXN1; (-) strand; PAM type: YTN; PAM sequence: TTC
ttaaattttgaatagtgagt

SEQ ID NO: 176876 - DNA, 20 bp, Artificial Sequence
  Description of Artificial Sequence: Synthetic oligonucleotide
  Target: ATXN1; (-) strand; PAM type: YTN; PAM sequence: TTA
ttcttaaattttgaatagtg

SEQ ID NO: 176877 - DNA, 20 bp, Artificial Sequence
  Description of Artificial Sequence: Synthetic oligonucleotide
  Target: ATXN1; (-) strand; PAM type: YTN; PAM sequence: CTT
attcttaaattttgaatagt

SEQ ID NO: 176878 - DNA, 20 bp, Artificial Sequence
  Description of Artificial Sequence: Synthetic oligonucleotide
  Target: ATXN1; (-) strand; PAM type: YTN; PAM sequence: TTC
ttattcttaaattttgaata

SEQ ID NO: 176879 - DNA, 20 bp, Artificial Sequence
  Description of Artificial Sequence: Synthetic oligonucleotide
  Target: ATXN1; (-) strand; PAM type: YTN; PAM sequence: CTT
cttattcttaaattttgaat

SEQ ID NO: 176880 - DNA, 20 bp, Artificial Sequence
  Description of Artificial Sequence: Synthetic oligonucleotide
  Target: ATXN1; (-) strand; PAM type: YTN; PAM sequence: CTC
ccagatgacttcttattctt

SEQ ID NO: 176881 - DNA, 20 bp, Artificial Sequence
  Description of Artificial Sequence: Synthetic oligonucleotide
  Target: ATXN1; (-) strand; PAM type: YTN; PAM sequence: TTC
tcccagatgacttcttattc

SEQ ID NO: 176882 - DNA, 20 bp, Artificial Sequence
  Description of Artificial Sequence: Synthetic oligonucleotide
  Target: ATXN1; (-) strand; PAM type: YTN; PAM sequence: TTT
ctcccagatgacttcttatt

SEQ ID NO: 176883 - DNA, 20 bp, Artificial Sequence
  Description of Artificial Sequence: Synthetic oligonucleotide
  Target: ATXN1; (-) strand; PAM type: YTN; PAM sequence: CTT
tctcccagatgacttcttat

SEQ ID NO: 176884 - DNA, 20 bp, Artificial Sequence
  Description of Artificial Sequence: Synthetic oligonucleotide
  Target: ATXN1; (-) strand; PAM type: YTN; PAM sequence: CTC
ggtcccatcccctttctccc

SEQ ID NO: 176885 - DNA, 20 bp, Artificial Sequence
  Description of Artificial Sequence: Synthetic oligonucleotide
  Target: ATXN1; (-) strand; PAM type: YTN; PAM sequence: TTC
agggatgctcggtcccatcc

SEQ ID NO: 176886 - DNA, 20 bp, Artificial Sequence
  Description of Artificial Sequence: Synthetic oligonucleotide
  Target: ATXN1; (-) strand; PAM type: YTN; PAM sequence: TTT
cagggatgctcggtcccatc

SEQ ID NO: 176887 - DNA, 20 bp, Artificial Sequence
  Description of Artificial Sequence: Synthetic oligonucleotide
  Target: ATXN1; (-) strand; PAM type: YTN; PAM sequence: CTG
agccgtgtttcagggatgct

SEQ ID NO: 176888 - DNA, 20 bp, Artificial Sequence
  Description of Artificial Sequence: Synthetic oligonucleotide
  Target: ATXN1; (-) strand; PAM type: YTN; PAM sequence: TTG
agtgagggagcaggtgatgg

SEQ ID NO: 176889 - DNA, 20 bp, Artificial Sequence
  Description of Artificial Sequence: Synthetic oligonucleotide
  Target: ATXN1; (-) strand; PAM type: YTN; PAM sequence: TTG
tggttgagtgagggagcagg

SEQ ID NO: 176890 - DNA, 20 bp, Artificial Sequence
  Description of Artificial Sequence: Synthetic oligonucleotide
  Target: ATXN1; (-) strand; PAM type: YTN; PAM sequence: TTT
gtggttgagtgagggagcag

SEQ ID NO: 176891 - DNA, 20 bp, Artificial Sequence
  Description of Artificial Sequence: Synthetic oligonucleotide
  Target: ATXN1; (-) strand; PAM type: YTN; PAM sequence: TTG
cagccgtgtttgtggttgag

SEQ ID NO: 176892 - DNA, 20 bp, Artificial Sequence
  Description of Artificial Sequence: Synthetic oligonucleotide
  Target: ATXN1; (-) strand; PAM type: YTN; PAM sequence: CTG
atattgcagccgtgtttgtg

SEQ ID NO: 176893 - DNA, 20 bp, Artificial Sequence
  Description of Artificial Sequence: Synthetic oligonucleotide
  Target: ATXN1; (-) strand; PAM type: YTN; PAM sequence: CTG
accctgatattgcagccgtg

SEQ ID NO: 176894 - DNA, 20 bp, Artificial Sequence
  Description of Artificial Sequence: Synthetic oligonucleotide
  Target: ATXN1; (-) strand; PAM type: YTN; PAM sequence: CTA
cgggatgtggaacactgacc

SEQ ID NO: 176895 - DNA, 20 bp, Artificial Sequence
  Description of Artificial Sequence: Synthetic oligonucleotide
  Target: ATXN1; (-) strand; PAM type: YTN; PAM sequence: CTG
ctacgggatgtggaacactg

SEQ ID NO: 176896 - DNA, 20 bp, Artificial Sequence
  Description of Artificial Sequence: Synthetic oligonucleotide
  Target: ATXN1; (-) strand; PAM type: YTN; PAM sequence: CTG
gaacagagggtcatctgcta

SEQ ID NO: 176897 - DNA, 20 bp, Artificial Sequence
  Description of Artificial Sequence: Synthetic oligonucleotide
  Target: ATXN1; (-) strand; PAM type: YTN; PAM sequence: TTC
tggaacagagggtcatctgc

SEQ ID NO: 176898 - DNA, 20 bp, Artificial Sequence
  Description of Artificial Sequence: Synthetic oligonucleotide
  Target: ATXN1; (-) strand; PAM type: YTN; PAM sequence: TTG
ttctggaacagagggtcatc

SEQ ID NO: 176899 - DNA, 20 bp, Artificial Sequence
  Description of Artificial Sequence: Synthetic oligonucleotide
  Target: ATXN1; (-) strand; PAM type: YTN; PAM sequence: TTT
gttctggaacagagggtcat

SEQ ID NO: 176900 - DNA, 20 bp, Artificial Sequence
  Description of Artificial Sequence: Synthetic oligonucleotide
  Target: ATXN1; (-) strand; PAM type: YTN; PAM sequence: TTG
tttgttctggaacagagggt

SEQ ID NO: 176901 - DNA, 20 bp, Artificial Sequence
  Description of Artificial Sequence: Synthetic oligonucleotide
  Target: ATXN1; (-) strand; PAM type: YTN; PAM sequence: TTT
gtttgttctggaacagaggg

SEQ ID NO: 176902 - DNA, 20 bp, Artificial Sequence
  Description of Artificial Sequence: Synthetic oligonucleotide
  Target: ATXN1; (-) strand; PAM type: YTN; PAM sequence: CTT
tgtttgttctggaacagagg

SEQ ID NO: 176903 - DNA, 20 bp, Artificial Sequence
  Description of Artificial Sequence: Synthetic oligonucleotide
  Target: ATXN1; (-) strand; PAM type: YTN; PAM sequence: TTA
tagggtgcacactttgtttg

SEQ ID NO: 176904 - DNA, 20 bp, Artificial Sequence
  Description of Artificial Sequence: Synthetic oligonucleotide
  Target: ATXN1; (-) strand; PAM type: YTN; PAM sequence: CTT
atagggtgcacactttgttt

SEQ ID NO: 176905 - DNA, 20 bp, Artificial Sequence
  Description of Artificial Sequence: Synthetic oligonucleotide
  Target: ATXN1; (-) strand; PAM type: YTN; PAM sequence: CTA
atgtcatcatgcttataggg

SEQ ID NO: 176906 - DNA, 20 bp, Artificial Sequence
  Description of Artificial Sequence: Synthetic oligonucleotide
  Target: ATXN1; (-) strand; PAM type: YTN; PAM sequence: TTC
taatgtcatcatgcttatag

SEQ ID NO: 176907 - DNA, 20 bp, Artificial Sequence
  Description of Artificial Sequence: Synthetic oligonucleotide
  Target: ATXN1; (-) strand; PAM type: YTN; PAM sequence: CTA
attctaatgtcatcatgctt

SEQ ID NO: 176908 - DNA, 20 bp, Artificial Sequence
  Description of Artificial Sequence: Synthetic oligonucleotide
  Target: ATXN1; (-) strand; PAM type: YTN; PAM sequence: TTG
aagtctaattctaatgtcat

SEQ ID NO: 176909 - DNA, 20 bp, Artificial Sequence
  Description of Artificial Sequence: Synthetic oligonucleotide
  Target: ATXN1; (-) strand; PAM type: YTN; PAM sequence: TTT
gaagtctaattctaatgtca

SEQ ID NO: 176910 - DNA, 20 bp, Artificial Sequence
  Description of Artificial Sequence: Synthetic oligonucleotide
  Target: ATXN1; (-) strand; PAM type: YTN; PAM sequence: CTT
tgaagtctaattctaatgtc

SEQ ID NO: 176911 - DNA, 20 bp, Artificial Sequence
  Description of Artificial Sequence: Synthetic oligonucleotide
  Target: ATXN1; (-) strand; PAM type: YTN; PAM sequence: CTA
gctttgaagtctaattctaa

SEQ ID NO: 176912 - DNA, 20 bp, Artificial Sequence
  Description of Artificial Sequence: Synthetic oligonucleotide
  Target: ATXN1; (-) strand; PAM type: YTN; PAM sequence: TTG
aggctagctttgaagtctaa

SEQ ID NO: 176913 - DNA, 20 bp, Artificial Sequence
  Description of Artificial Sequence: Synthetic oligonucleotide
  Target: ATXN1; (-) strand; PAM type: YTN; PAM sequence: CTT
gaggctagctttgaagtcta

SEQ ID NO: 176914 - DNA, 20 bp, Artificial Sequence
  Description of Artificial Sequence: Synthetic oligonucleotide
  Target: ATXN1; (-) strand; PAM type: YTN; PAM sequence: CTG
tgagcatcttgaggctagct

SEQ ID NO: 176915 - DNA, 20 bp, Artificial Sequence
  Description of Artificial Sequence: Synthetic oligonucleotide
  Target: ATXN1; (-) strand; PAM type: YTN; PAM sequence: TTA
atatcagtctgtgagcatct

SEQ ID NO: 176916 - DNA, 20 bp, Artificial Sequence
  Description of Artificial Sequence: Synthetic oligonucleotide
  Target: ATXN1; (-) strand; PAM type: YTN; PAM sequence: TTG
tggcagacagtggttaatat

SEQ ID NO: 176917 - DNA, 20 bp, Artificial Sequence
  Description of Artificial Sequence: Synthetic oligonucleotide
  Target: ATXN1; (-) strand; PAM type: YTN; PAM sequence: CTT
gtggcagacagtggttaata

SEQ ID NO: 176918 - DNA, 20 bp, Artificial Sequence
  Description of Artificial Sequence: Synthetic oligonucleotide
  Target: ATXN1; (-) strand; PAM type: YTN; PAM sequence: TTG
tgccatatgcttgtggcaga

SEQ ID NO: 176919 - DNA, 20 bp, Artificial Sequence
  Description of Artificial Sequence: Synthetic oligonucleotide
  Target: ATXN1; (-) strand; PAM type: YTN; PAM sequence: CTT
gtgccatatgcttgtggcag

SEQ ID NO: 176920 - DNA, 20 bp, Artificial Sequence
  Description of Artificial Sequence: Synthetic oligonucleotide
  Target: ATXN1; (-) strand; PAM type: YTN; PAM sequence: CTG
tcttgtgccatatgcttgtg

SEQ ID NO: 176921 - DNA, 20 bp, Artificial Sequence
  Description of Artificial Sequence: Synthetic oligonucleotide
  Target: ATXN1; (-) strand; PAM type: YTN; PAM sequence: CTC
cagcctgtcttgtgccatat

SEQ ID NO: 176922 - DNA, 20 bp, Artificial Sequence
  Description of Artificial Sequence: Synthetic oligonucleotide
  Target: ATXN1; (-) strand; PAM type: YTN; PAM sequence: CTG
ctccagcctgtcttgtgcca

SEQ ID NO: 176923 - DNA, 20 bp, Artificial Sequence
  Description of Artificial Sequence: Synthetic oligonucleotide
  Target: ATXN1; (-) strand; PAM type: YTN; PAM sequence: TTG
tgatctgctccagcctgtct

SEQ ID NO: 176924 - DNA, 20 bp, Artificial Sequence
  Description of Artificial Sequence: Synthetic oligonucleotide
  Target: ATXN1; (-) strand; PAM type: YTN; PAM sequence: CTT
gtgatctgctccagcctgtc

SEQ ID NO: 176925 - DNA, 20 bp, Artificial Sequence
  Description of Artificial Sequence: Synthetic oligonucleotide
  Target: ATXN1; (-) strand; PAM type: YTN; PAM sequence: TTC
cttgtgatctgctccagcct

SEQ ID NO: 176926 - DNA, 20 bp, Artificial Sequence
  Description of Artificial Sequence: Synthetic oligonucleotide
  Target: ATXN1; (-) strand; PAM type: YTN; PAM sequence: TTT
ccttgtgatctgctccagcc

SEQ ID NO: 176927 - DNA, 20 bp, Artificial Sequence
  Description of Artificial Sequence: Synthetic oligonucleotide
  Target: ATXN1; (-) strand; PAM type: YTN; PAM sequence: CTT
tccttgtgatctgctccagc

SEQ ID NO: 176928 - DNA, 20 bp, Artificial Sequence
  Description of Artificial Sequence: Synthetic oligonucleotide
  Target: ATXN1; (-) strand; PAM type: YTN; PAM sequence: TTG
tgggccaatatgccaacgag

SEQ ID NO: 176929 - DNA, 20 bp, Artificial Sequence
  Description of Artificial Sequence: Synthetic oligonucleotide
  Target: ATXN1; (-) strand; PAM type: YTN; PAM sequence: CTG
tggcagtattgtgggccaat

SEQ ID NO: 176930 - DNA, 20 bp, Artificial Sequence
  Description of Artificial Sequence: Synthetic oligonucleotide
  Target: ATXN1; (-) strand; PAM type: YTN; PAM sequence: CTC
tgtggcagtattgtgggcca

SEQ ID NO: 176931 - DNA, 20 bp, Artificial Sequence
  Description of Artificial Sequence: Synthetic oligonucleotide
  Target: ATXN1; (-) strand; PAM type: YTN; PAM sequence: CTG
cctctgtggcagtattgtgg

SEQ ID NO: 176932 - DNA, 20 bp, Artificial Sequence
  Description of Artificial Sequence: Synthetic oligonucleotide
  Target: ATXN1; (-) strand; PAM type: YTN; PAM sequence: CTC
tgcctctgtggcagtattgt

SEQ ID NO: 176933 - DNA, 20 bp, Artificial Sequence
  Description of Artificial Sequence: Synthetic oligonucleotide
  Target: ATXN1; (-) strand; PAM type: YTN; PAM sequence: CTA
agctctgcctctgtggcagt

SEQ ID NO: 176934 - DNA, 20 bp, Artificial Sequence
  Description of Artificial Sequence: Synthetic oligonucleotide
  Target: ATXN1; (-) strand; PAM type: YTN; PAM sequence: CTC
taagctctgcctctgtggca

SEQ ID NO: 176935 - DNA, 20 bp, Artificial Sequence
  Description of Artificial Sequence: Synthetic oligonucleotide
  Target: ATXN1; (-) strand; PAM type: YTN; PAM sequence: CTC
tctaagctctgcctctgtgg

SEQ ID NO: 176936 - DNA, 20 bp, Artificial Sequence
  Description of Artificial Sequence: Synthetic oligonucleotide
  Target: ATXN1; (-) strand; PAM type: YTN; PAM sequence: CTA
gcaccctctctaagctctgc

SEQ ID NO: 176937 - DNA, 20 bp, Artificial Sequence
  Description of Artificial Sequence: Synthetic oligonucleotide
  Target: ATXN1; (-) strand; PAM type: YTN; PAM sequence: TTG
cctagcaccctctctaagct

SEQ ID NO: 176938 - DNA, 20 bp, Artificial Sequence
  Description of Artificial Sequence: Synthetic oligonucleotide
  Target: ATXN1; (-) strand; PAM type: YTN; PAM sequence: CTT
gcctagcaccctctctaagc

SEQ ID NO: 176939 - DNA, 20 bp, Artificial Sequence
  Description of Artificial Sequence: Synthetic oligonucleotide
  Target: ATXN1; (-) strand; PAM type: YTN; PAM sequence: TTC
cagagtgaaatagcggatga

SEQ ID NO: 176940 - DNA, 20 bp, Artificial Sequence
  Description of Artificial Sequence: Synthetic oligonucleotide
  Target: ATXN1; (-) strand; PAM type: YTN; PAM sequence: TTT
ccagagtgaaatagcggatg

SEQ ID NO: 176941 - DNA, 20 bp, Artificial Sequence
  Description of Artificial Sequence: Synthetic oligonucleotide
  Target: ATXN1; (-) strand; PAM type: YTN; PAM sequence: CTT
tccagagtgaaatagcggat

SEQ ID NO: 176942 - DNA, 20 bp, Artificial Sequence
  Description of Artificial Sequence: Synthetic oligonucleotide
  Target: ATXN1; (-) strand; PAM type: YTN; PAM sequence: CTG
atcccctttccagagtgaaa

SEQ ID NO: 176943 - DNA, 20 bp, Artificial Sequence
  Description of Artificial Sequence: Synthetic oligonucleotide
  Target: ATXN1; (-) strand; PAM type: YTN; PAM sequence: TTC
ccccaactgatcccctttcc

SEQ ID NO: 176944 - DNA, 20 bp, Artificial Sequence
  Description of Artificial Sequence: Synthetic oligonucleotide
  Target: ATXN1; (-) strand; PAM type: YTN; PAM sequence: TTT
cccccaactgatcccctttc

SEQ ID NO: 176945 - DNA, 20 bp, Artificial Sequence
  Description of Artificial Sequence: Synthetic oligonucleotide
  Target: ATXN1; (-) strand; PAM type: YTN; PAM sequence: TTT
tcccccaactgatccccttt

SEQ ID NO: 176946 - DNA, 20 bp, Artificial Sequence
  Description of Artificial Sequence: Synthetic oligonucleotide
  Target: ATXN1; (-) strand; PAM type: YTN; PAM sequence: TTT
ttcccccaactgatcccctt

SEQ ID NO: 176947 - DNA, 20 bp, Artificial Sequence
  Description of Artificial Sequence: Synthetic oligonucleotide
  Target: ATXN1; (-) strand; PAM type: YTN; PAM sequence: TTT
tttcccccaactgatcccct

SEQ ID NO: 176948 - DNA, 20 bp, Artificial Sequence
  Description of Artificial Sequence: Synthetic oligonucleotide
  Target: ATXN1; (-) strand; PAM type: YTN; PAM sequence: TTT
ttttcccccaactgatcccc

SEQ ID NO: 176949 - DNA, 20 bp, Artificial Sequence
  Description of Artificial Sequence: Synthetic oligonucleotide
  Target: ATXN1; (-) strand; PAM type: YTN; PAM sequence: TTG
cagatttttttcccccaact

SEQ ID NO: 176950 - DNA, 20 bp, Artificial Sequence
  Description of Artificial Sequence: Synthetic oligonucleotide
  Target: ATXN1; (-) strand; PAM type: YTN; PAM sequence: TTT
gcagatttttttcccccaac

SEQ ID NO: 176951 - DNA, 20 bp, Artificial Sequence
  Description of Artificial Sequence: Synthetic oligonucleotide
  Target: ATXN1; (-) strand; PAM type: YTN; PAM sequence: CTC
aaaaggtttgcagatttttt

SEQ ID NO: 176952 - DNA, 20 bp, Artificial Sequence
  Description of Artificial Sequence: Synthetic oligonucleotide
  Target: ATXN1; (-) strand; PAM type: YTN; PAM sequence: CTG
tcctcaaaaggtttgcagat

SEQ ID NO: 176953 - DNA, 20 bp, Artificial Sequence
  Description of Artificial Sequence: Synthetic oligonucleotide
  Target: ATXN1; (-) strand; PAM type: YTN; PAM sequence: TTC
tgtcctcaaaaggtttgcag

SEQ ID NO: 176954 - DNA, 20 bp, Artificial Sequence
  Description of Artificial Sequence: Synthetic oligonucleotide
  Target: ATXN1; (-) strand; PAM type: YTN; PAM sequence: CTT
ctgtcctcaaaaggtttgca

SEQ ID NO: 176955 - DNA, 20 bp, Artificial Sequence
  Description of Artificial Sequence: Synthetic oligonucleotide
  Target: ATXN1; (-) strand; PAM type: YTN; PAM sequence: TTG
ccttctgtcctcaaaaggtt

SEQ ID NO: 176956 - DNA, 20 bp, Artificial Sequence
  Description of Artificial Sequence: Synthetic oligonucleotide
  Target: ATXN1; (-) strand; PAM type: YTN; PAM sequence: TTC
aagcaatattgccttctgtc

SEQ ID NO: 176957 - DNA, 20 bp, Artificial Sequence
  Description of Artificial Sequence: Synthetic oligonucleotide
  Target: ATXN1; (-) strand; PAM type: YTN; PAM sequence: TTT
caagcaatattgccttctgt

SEQ ID NO: 176958 - DNA, 20 bp, Artificial Sequence
  Description of Artificial Sequence: Synthetic oligonucleotide
  Target: ATXN1; (-) strand; PAM type: YTN; PAM sequence: CTC
ataaatttcaagcaatattg

SEQ ID NO: 176959 - DNA, 20 bp, Artificial Sequence
  Description of Artificial Sequence: Synthetic oligonucleotide
  Target: ATXN1; (-) strand; PAM type: YTN; PAM sequence: TTA
ctcataaatttcaagcaata

SEQ ID NO: 176960 - DNA, 20 bp, Artificial Sequence
  Description of Artificial Sequence: Synthetic oligonucleotide
  Target: ATXN1; (-) strand; PAM type: YTN; PAM sequence: CTC
attactcataaatttcaagc

SEQ ID NO: 176961 - DNA, 20 bp, Artificial Sequence
  Description of Artificial Sequence: Synthetic oligonucleotide
  Target: ATXN1; (-) strand; PAM type: YTN; PAM sequence: CTC
ccaaaatggctcattactca

SEQ ID NO: 176962 - DNA, 20 bp, Artificial Sequence
  Description of Artificial Sequence: Synthetic oligonucleotide
  Target: ATXN1; (-) strand; PAM type: YTN; PAM sequence: TTC
tcccaaaatggctcattact

SEQ ID NO: 176963 - DNA, 20 bp, Artificial Sequence
  Description of Artificial Sequence: Synthetic oligonucleotide
  Target: ATXN1; (-) strand; PAM type: YTN; PAM sequence: CTT
ctcccaaaatggctcattac

SEQ ID NO: 176964 - DNA, 20 bp, Artificial Sequence
  Description of Artificial Sequence: Synthetic oligonucleotide
  Target: ATXN1; (-) strand; PAM type: YTN; PAM sequence: TTC
cttctcccaaaatggctcat

SEQ ID NO: 176965 - DNA, 20 bp, Artificial Sequence
  Description of Artificial Sequence: Synthetic oligonucleotide
  Target: ATXN1; (-) strand; PAM type: YTN; PAM sequence: CTT
ccttctcccaaaatggctca

SEQ ID NO: 176966 - DNA, 20 bp, Artificial Sequence
  Description of Artificial Sequence: Synthetic oligonucleotide
  Target: ATXN1; (-) strand; PAM type: YTN; PAM sequence: CTG
tcaaaatgaatgacagaatc

SEQ ID NO: 176967 - DNA, 20 bp, Artificial Sequence
  Description of Artificial Sequence: Synthetic oligonucleotide
  Target: ATXN1; (-) strand; PAM type: YTN; PAM sequence: TTA
ataagccctgtcaaaatgaa

SEQ ID NO: 176968 - DNA, 20 bp, Artificial Sequence
  Description of Artificial Sequence: Synthetic oligonucleotide
  Target: ATXN1; (-) strand; PAM type: YTN; PAM sequence: TTG
tgttaataagccctgtcaaa

SEQ ID NO: 176969 - DNA, 20 bp, Artificial Sequence
  Description of Artificial Sequence: Synthetic oligonucleotide
  Target: ATXN1; (-) strand; PAM type: YTN; PAM sequence: TTT
gtgttaataagccctgtcaa

SEQ ID NO: 176970 - DNA, 20 bp, Artificial Sequence
  Description of Artificial Sequence: Synthetic oligonucleotide
  Target: ATXN1; (-) strand; PAM type: YTN; PAM sequence: TTT
tgtgttaataagccctgtca

SEQ ID NO: 176971 - DNA, 20 bp, Artificial Sequence
  Description of Artificial Sequence: Synthetic oligonucleotide
  Target: ATXN1; (-) strand; PAM type: YTN; PAM sequence: CTT
ttgtgttaataagccctgtc

SEQ ID NO: 176972 - DNA, 20 bp, Artificial Sequence
  Description of Artificial Sequence: Synthetic oligonucleotide
  Target: ATXN1; (-) strand; PAM type: YTN; PAM sequence: CTC
cttttgtgttaataagccct

SEQ ID NO: 176973 - DNA, 20 bp, Artificial Sequence
  Description of Artificial Sequence: Synthetic oligonucleotide
  Target: ATXN1; (-) strand; PAM type: YTN; PAM sequence: CTC
ctccttttgtgttaataagc

SEQ ID NO: 176974 - DNA, 20 bp, Artificial Sequence
  Description of Artificial Sequence: Synthetic oligonucleotide
  Target: ATXN1; (-) strand; PAM type: YTN; PAM sequence: CTC
tcctccttttgtgttaataa

SEQ ID NO: 176975 - DNA, 20 bp, Artificial Sequence
  Description of Artificial Sequence: Synthetic oligonucleotide
  Target: ATXN1; (-) strand; PAM type: YTN; PAM sequence: CTC
cccaccagccctctcctcct

SEQ ID NO: 176976 - DNA, 20 bp, Artificial Sequence
  Description of Artificial Sequence: Synthetic oligonucleotide
  Target: ATXN1; (-) strand; PAM type: YTN; PAM sequence: TTC
ccacaagtgccccaccctcc

SEQ ID NO: 176977 - DNA, 20 bp, Artificial Sequence
  Description of Artificial Sequence: Synthetic oligonucleotide
  Target: ATXN1; (-) strand; PAM type: YTN; PAM sequence: CTT
cccacaagtgccccaccctc

SEQ ID NO: 176978 - DNA, 20 bp, Artificial Sequence
  Description of Artificial Sequence: Synthetic oligonucleotide
  Target: ATXN1; (-) strand; PAM type: YTN; PAM sequence: CTG
caccttcccacaagtgcccc

SEQ ID NO: 176979 - DNA, 20 bp, Artificial Sequence
  Description of Artificial Sequence: Synthetic oligonucleotide
  Target: ATXN1; (-) strand; PAM type: YTN; PAM sequence: CTC
tgcaccttcccacaagtgcc

SEQ ID NO: 176980 - DNA, 20 bp, Artificial Sequence
  Description of Artificial Sequence: Synthetic oligonucleotide
  Target: ATXN1; (-) strand; PAM type: YTN; PAM sequence: CTC
tctgcaccttcccacaagtg

SEQ ID NO: 176981 - DNA, 20 bp, Artificial Sequence
  Description of Artificial Sequence: Synthetic oligonucleotide
  Target: ATXN1; (-) strand; PAM type: YTN; PAM sequence: CTG
tcctctctgcaccttcccac

SEQ ID NO: 176982 - DNA, 20 bp, Artificial Sequence
  Description of Artificial Sequence: Synthetic oligonucleotide
  Target: ATXN1; (-) strand; PAM type: YTN; PAM sequence: TTC
tgtcctctctgcaccttccc

SEQ ID NO: 176983 - DNA, 20 bp, Artificial Sequence
  Description of Artificial Sequence: Synthetic oligonucleotide
  Target: ATXN1; (-) strand; PAM type: YTN; PAM sequence: CTT
ctgtcctctctgcaccttcc

SEQ ID NO: 176984 - DNA, 20 bp, Artificial Sequence
  Description of Artificial Sequence: Synthetic oligonucleotide
  Target: ATXN1; (-) strand; PAM type: YTN; PAM sequence: TTC
acccttctgtcctctctgca

SEQ ID NO: 176985 - DNA, 20 bp, Artificial Sequence
  Description of Artificial Sequence: Synthetic oligonucleotide
  Target: ATXN1; (-) strand; PAM type: YTN; PAM sequence: CTT
cacccttctgtcctctctgc

SEQ ID NO: 176986 - DNA, 20 bp, Artificial Sequence
  Description of Artificial Sequence: Synthetic oligonucleotide
  Target: ATXN1; (-) strand; PAM type: YTN; PAM sequence: CTG
gcttcacccttctgtcctct

SEQ ID NO: 176987 - DNA, 20 bp, Artificial Sequence
  Description of Artificial Sequence: Synthetic oligonucleotide
  Target: ATXN1; (-) strand; PAM type: YTN; PAM sequence: CTG
gctggcttcacccttctgtc

SEQ ID NO: 176988 - DNA, 20 bp, Artificial Sequence
  Description of Artificial Sequence: Synthetic oligonucleotide
  Target: ATXN1; (-) strand; PAM type: YTN; PAM sequence: TTG
cctggctggcttcacccttc

SEQ ID NO: 176989 - DNA, 20 bp, Artificial Sequence
  Description of Artificial Sequence: Synthetic oligonucleotide
  Target: ATXN1; (-) strand; PAM type: YTN; PAM sequence: TTT
gcctggctggcttcaccctt

SEQ ID NO: 176990 - DNA, 20 bp, Artificial Sequence
  Description of Artificial Sequence: Synthetic oligonucleotide
  Target: ATXN1; (-) strand; PAM type: YTN; PAM sequence: CTC
atttgcctggctggcttcac

SEQ ID NO: 176991 - DNA, 20 bp, Artificial Sequence
  Description of Artificial Sequence: Synthetic oligonucleotide
  Target: ATXN1; (-) strand; PAM type: YTN; PAM sequence: TTC
tcatttgcctggctggcttc

SEQ ID NO: 176992 - DNA, 20 bp, Artificial Sequence
  Description of Artificial Sequence: Synthetic oligonucleotide
  Target: ATXN1; (-) strand; PAM type: YTN; PAM sequence: CTC
attctcatttgcctggctgg

SEQ ID NO: 176993 - DNA, 20 bp, Artificial Sequence
  Description of Artificial Sequence: Synthetic oligonucleotide
  Target: ATXN1; (-) strand; PAM type: YTN; PAM sequence: TTC
tcattctcatttgcctggct

SEQ ID NO: 176994 - DNA, 20 bp, Artificial Sequence
  Description of Artificial Sequence: Synthetic oligonucleotide
  Target: ATXN1; (-) strand; PAM type: YTN; PAM sequence: TTT
ctcattctcatttgcctggc

SEQ ID NO: 176995 - DNA, 20 bp, Artificial Sequence
  Description of Artificial Sequence: Synthetic oligonucleotide
  Target: ATXN1; (-) strand; PAM type: YTN; PAM sequence: TTG
caatttctcattctcatttg

SEQ ID NO: 176996 - DNA, 20 bp, Artificial Sequence
  Description of Artificial Sequence: Synthetic oligonucleotide
  Target: ATXN1; (-) strand; PAM type: YTN; PAM sequence: CTC
cataaggtccataattgcaa

SEQ ID NO: 176997 - DNA, 20 bp, Artificial Sequence
  Description of Artificial Sequence: Synthetic oligonucleotide
  Target: ATXN1; (-) strand; PAM type: YTN; PAM sequence: CTC
ctccataaggtccataattg

SEQ ID NO: 176998 - DNA, 20 bp, Artificial Sequence
  Description of Artificial Sequence: Synthetic oligonucleotide
  Target: ATXN1; (-) strand; PAM type: YTN; PAM sequence: TTA
ccagcagctcctccataagg

SEQ ID NO: 176999 - DNA, 20 bp, Artificial Sequence
  Description of Artificial Sequence: Synthetic oligonucleotide
  Target: ATXN1; (-) strand; PAM type: YTN; PAM sequence: CTT
accagcagctcctccataag

SEQ ID NO: 177000 - DNA, 20 bp, Artificial Sequence
  Description of Artificial Sequence: Synthetic oligonucleotide
  Target: ATXN1; (-) strand; PAM type: YTN; PAM sequence: TTG
gccagggtagcttaccagca

SEQ ID NO: 177001 - DNA, 20 bp, Artificial Sequence
  Description of Artificial Sequence: Synthetic oligonucleotide
  Target: ATXN1; (-) strand; PAM type: YTN; PAM sequence: TTT
ggccagggtagcttaccagc

SEQ ID NO: 177002 - DNA, 20 bp, Artificial Sequence
  Description of Artificial Sequence: Synthetic oligonucleotide
  Target: ATXN1; (-) strand; PAM type: YTN; PAM sequence: CTT
tggccagggtagcttaccag

SEQ ID NO: 177003 - DNA, 20 bp, Artificial Sequence
  Description of Artificial Sequence: Synthetic oligonucleotide
  Target: ATXN1; (-) strand; PAM type: YTN; PAM sequence: TTC
ctttggccagggtagcttac

SEQ ID NO: 177004 - DNA, 20 bp, Artificial Sequence
  Description of Artificial Sequence: Synthetic oligonucleotide
  Target: ATXN1; (-) strand; PAM type: YTN; PAM sequence: TTT
cctttggccagggtagctta

SEQ ID NO: 177005 - DNA, 20 bp, Artificial Sequence
  Description of Artificial Sequence: Synthetic oligonucleotide
  Target: ATXN1; (-) strand; PAM type: YTN; PAM sequence: TTT
tcctttggccagggtagctt

SEQ ID NO: 177006 - DNA, 20 bp, Artificial Sequence
  Description of Artificial Sequence: Synthetic oligonucleotide
  Target: ATXN1; (-) strand; PAM type: YTN; PAM sequence: TTG
gtccaatcaacattttcctt

SEQ ID NO: 177007 - DNA, 20 bp, Artificial Sequence
  Description of Artificial Sequence: Synthetic oligonucleotide
  Target: ATXN1; (-) strand; PAM type: YTN; PAM sequence: CTG
aaaattggtccaatcaacat

SEQ ID NO: 177008 - DNA, 20 bp, Artificial Sequence
  Description of Artificial Sequence: Synthetic oligonucleotide
  Target: ATXN1; (-) strand; PAM type: YTN; PAM sequence: CTC
tgaaaattggtccaatcaac

SEQ ID NO: 177009 - DNA, 20 bp, Artificial Sequence
  Description of Artificial Sequence: Synthetic oligonucleotide
  Target: ATXN1; (-) strand; PAM type: YTN; PAM sequence: TTC
cctctgaaaattggtccaat

SEQ ID NO: 177010 - DNA, 20 bp, Artificial Sequence
  Description of Artificial Sequence: Synthetic oligonucleotide
  Target: ATXN1; (-) strand; PAM type: YTN; PAM sequence: TTT
ccctctgaaaattggtccaa

SEQ ID NO: 177011 - DNA, 20 bp, Artificial Sequence
  Description of Artificial Sequence: Synthetic oligonucleotide
  Target: ATXN1; (-) strand; PAM type: YTN; PAM sequence: CTG
tttccctctgaaaattggtc

SEQ ID NO: 177012 - DNA, 20 bp, Artificial Sequence
  Description of Artificial Sequence: Synthetic oligonucleotide
  Target: ATXN1; (-) strand; PAM type: YTN; PAM sequence: CTG
tctgtttccctctgaaaatt

SEQ ID NO: 177013 - DNA, 20 bp, Artificial Sequence
  Description of Artificial Sequence: Synthetic oligonucleotide
  Target: ATXN1; (-) strand; PAM type: YTN; PAM sequence: TTG
cagaagagctgtctgtttcc

SEQ ID NO: 177014 - DNA, 20 bp, Artificial Sequence
  Description of Artificial Sequence: Synthetic oligonucleotide
  Target: ATXN1; (-) strand; PAM type: YTN; PAM sequence: CTT
gcagaagagctgtctgtttc

SEQ ID NO: 177015 - DNA, 20 bp, Artificial Sequence
  Description of Artificial Sequence: Synthetic oligonucleotide
  Target: ATXN1; (-) strand; PAM type: YTN; PAM sequence: CTG
cttgcagaagagctgtctgt

SEQ ID NO: 177016 - DNA, 20 bp, Artificial Sequence
  Description of Artificial Sequence: Synthetic oligonucleotide
  Target: ATXN1; (-) strand; PAM type: YTN; PAM sequence: TTG
tcatccatctgcttgcagaa

SEQ ID NO: 177017 - DNA, 20 bp, Artificial Sequence
  Description of Artificial Sequence: Synthetic oligonucleotide
  Target: ATXN1; (-) strand; PAM type: YTN; PAM sequence: TTT
gtcatccatctgcttgcaga

SEQ ID NO: 177018 - DNA, 20 bp, Artificial Sequence
  Description of Artificial Sequence: Synthetic oligonucleotide
  Target: ATXN1; (-) strand; PAM type: YTN; PAM sequence: CTA
gagatttgtcatccatctgc

SEQ ID NO: 177019 - DNA, 20 bp, Artificial Sequence
  Description of Artificial Sequence: Synthetic oligonucleotide
  Target: ATXN1; (-) strand; PAM type: YTN; PAM sequence: CTC
ctagagatttgtcatccatc

SEQ ID NO: 177020 - DNA, 20 bp, Artificial Sequence
  Description of Artificial Sequence: Synthetic oligonucleotide
  Target: ATXN1; (-) strand; PAM type: YTN; PAM sequence: CTC
ctcctagagatttgtcatcc

SEQ ID NO: 177021 - DNA, 20 bp, Artificial Sequence
  Description of Artificial Sequence: Synthetic oligonucleotide
  Target: ATXN1; (-) strand; PAM type: YTN; PAM sequence: TTC
acacatgaacaacacagcct

SEQ ID NO: 177022 - DNA, 20 bp, Artificial Sequence
  Description of Artificial Sequence: Synthetic oligonucleotide
  Target: ATXN1; (-) strand; PAM type: YTN; PAM sequence: TTT
cacacatgaacaacacagcc

SEQ ID NO: 177023 - DNA, 20 bp, Artificial Sequence
  Description of Artificial Sequence: Synthetic oligonucleotide
  Target: ATXN1; (-) strand; PAM type: YTN; PAM sequence: CTA
agaccatttcacacatgaac

SEQ ID NO: 177024 - DNA, 20 bp, Artificial Sequence
  Description of Artificial Sequence: Synthetic oligonucleotide
  Target: ATXN1; (-) strand; PAM type: YTN; PAM sequence: TTG
gctaagaccatttcacacat

SEQ ID NO: 177025 - DNA, 20 bp, Artificial Sequence
  Description of Artificial Sequence: Synthetic oligonucleotide
  Target: ATXN1; (-) strand; PAM type: YTN; PAM sequence: CTT
ggctaagaccatttcacaca

SEQ ID NO: 177026 - DNA, 20 bp, Artificial Sequence
  Description of Artificial Sequence: Synthetic oligonucleotide
  Target: ATXN1; (-) strand; PAM type: YTN; PAM sequence: CTC
cttggctaagaccatttcac

SEQ ID NO: 177027 - DNA, 20 bp, Artificial Sequence
  Description of Artificial Sequence: Synthetic oligonucleotide
  Target: ATXN1; (-) strand; PAM type: YTN; PAM sequence: TTA
ctccttggctaagaccattt

SEQ ID NO: 177028 - DNA, 20 bp, Artificial Sequence
  Description of Artificial Sequence: Synthetic oligonucleotide
  Target: ATXN1; (-) strand; PAM type: YTN; PAM sequence: TTT
actccttggctaagaccatt

SEQ ID NO: 177029 - DNA, 20 bp, Artificial Sequence
  Description of Artificial Sequence: Synthetic oligonucleotide
  Target: ATXN1; (-) strand; PAM type: YTN; PAM sequence: TTT
tactccttggctaagaccat

SEQ ID NO: 177030 - DNA, 20 bp, Artificial Sequence
  Description of Artificial Sequence: Synthetic oligonucleotide
  Target: ATXN1; (-) strand; PAM type: YTN; PAM sequence: CTT
ttactccttggctaagacca

SEQ ID NO: 177031 - DNA, 20 bp, Artificial Sequence
  Description of Artificial Sequence: Synthetic oligonucleotide
  Target: ATXN1; (-) strand; PAM type: YTN; PAM sequence: TTG
gcgcttttactccttggcta

SEQ ID NO: 177032 - DNA, 20 bp, Artificial Sequence
  Description of Artificial Sequence: Synthetic oligonucleotide
  Target: ATXN1; (-) strand; PAM type: YTN; PAM sequence: CTT
ggcgcttttactccttggct

SEQ ID NO: 177033 - DNA, 20 bp, Artificial Sequence
  Description of Artificial Sequence: Synthetic oligonucleotide
  Target: ATXN1; (-) strand; PAM type: YTN; PAM sequence: TTA
catacatggcttggcgcttt

SEQ ID NO: 177034 - DNA, 20 bp, Artificial Sequence
  Description of Artificial Sequence: Synthetic oligonucleotide
  Target: ATXN1; (-) strand; PAM type: YTN; PAM sequence: CTT
acatacatggcttggcgctt

SEQ ID NO: 177035 - DNA, 20 bp, Artificial Sequence
  Description of Artificial Sequence: Synthetic oligonucleotide
  Target: ATXN1; (-) strand; PAM type: YTN; PAM sequence: CTG
cttacatacatggcttggcg

SEQ ID NO: 177036 - DNA, 20 bp, Artificial Sequence
  Description of Artificial Sequence: Synthetic oligonucleotide
  Target: ATXN1; (-) strand; PAM type: YTN; PAM sequence: CTC
tgcttacatacatggcttgg

SEQ ID NO: 177037 - DNA, 20 bp, Artificial Sequence
  Description of Artificial Sequence: Synthetic oligonucleotide
  Target: ATXN1; (-) strand; PAM type: YTN; PAM sequence: CTC
ggccccaccaccacacacag

SEQ ID NO: 177038 - DNA, 20 bp, Artificial Sequence
  Description of Artificial Sequence: Synthetic oligonucleotide
  Target: ATXN1; (-) strand; PAM type: YTN; PAM sequence: CTC
acacacacacacatacagac

SEQ ID NO: 177039 - DNA, 20 bp, Artificial Sequence
  Description of Artificial Sequence: Synthetic oligonucleotide
  Target: ATXN1; (-) strand; PAM type: YTN; PAM sequence: CTC
tcacacacacacacatacag

SEQ ID NO: 177040 - DNA, 20 bp, Artificial Sequence
  Description of Artificial Sequence: Synthetic oligonucleotide
  Target: ATXN1; (-) strand; PAM type: YTN; PAM sequence: CTC
tctcacacacacacacatac

SEQ ID NO: 177041 - DNA, 20 bp, Artificial Sequence
  Description of Artificial Sequence: Synthetic oligonucleotide
  Target: ATXN1; (-) strand; PAM type: YTN; PAM sequence: CTC
tctctcacacacacacacat

SEQ ID NO: 177042 - DNA, 20 bp, Artificial Sequence
  Description of Artificial Sequence: Synthetic oligonucleotide
  Target: ATXN1; (-) strand; PAM type: YTN; PAM sequence: CTC
tctctctcacacacacacac

SEQ ID NO: 177043 - DNA, 20 bp, Artificial Sequence
  Description of Artificial Sequence: Synthetic oligonucleotide
  Target: ATXN1; (-) strand; PAM type: YTN; PAM sequence: CTC
tctctctctcacacacacac

SEQ ID NO: 177044 - DNA, 20 bp, Artificial Sequence
  Description of Artificial Sequence: Synthetic oligonucleotide
  Target: ATXN1; (-) strand; PAM type: YTN; PAM sequence: CTC
tctctctctctcacacacac

SEQ ID NO: 177045 - DNA, 20 bp, Artificial Sequence
  Description of Artificial Sequence: Synthetic oligonucleotide
  Target: ATXN1; (-) strand; PAM type: YTN; PAM sequence: CTC
tctctctctctctcacacac

SEQ ID NO: 177046 - DNA, 20 bp, Artificial Sequence
  Description of Artificial Sequence: Synthetic oligonucleotide
  Target: ATXN1; (-) strand; PAM type: YTN; PAM sequence: CTG
cctctctctctctctctcac

SEQ ID NO: 177047 - DNA, 20 bp, Artificial Sequence
  Description of Artificial Sequence: Synthetic oligonucleotide
  Target: ATXN1; (-) strand; PAM type: YTN; PAM sequence: CTC
tgcctctctctctctctctc

SEQ ID NO: 177048 - DNA, 20 bp, Artificial Sequence
  Description of Artificial Sequence: Synthetic oligonucleotide
  Target: ATXN1; (-) strand; PAM type: YTN; PAM sequence: CTC
tctgcctctctctctctctc

SEQ ID NO: 177049 - DNA, 20 bp, Artificial Sequence
  Description of Artificial Sequence: Synthetic oligonucleotide
  Target: ATXN1; (-) strand; PAM type: YTN; PAM sequence: TTC
tctctgcctctctctctctc

SEQ ID NO: 177050 - DNA, 20 bp, Artificial Sequence
  Description of Artificial Sequence: Synthetic oligonucleotide
  Target: ATXN1; (-) strand; PAM type: YTN; PAM sequence: CTT
ctctctgcctctctctctct

SEQ ID NO: 177051 - DNA, 20 bp, Artificial Sequence
  Description of Artificial Sequence: Synthetic oligonucleotide
  Target: ATXN1; (-) strand; PAM type: YTN; PAM sequence: CTC
catccttctctctgcctctc

SEQ ID NO: 177052 - DNA, 20 bp, Artificial Sequence
  Description of Artificial Sequence: Synthetic oligonucleotide
  Target: ATXN1; (-) strand; PAM type: YTN; PAM sequence: CTC
tccatccttctctctgcctc

SEQ ID NO: 177053 - DNA, 20 bp, Artificial Sequence
  Description of Artificial Sequence: Synthetic oligonucleotide
  Target: ATXN1; (-) strand; PAM type: YTN; PAM sequence: CTG
ccagtgtctctccatccttc

SEQ ID NO: 177054 - DNA, 20 bp, Artificial Sequence
  Description of Artificial Sequence: Synthetic oligonucleotide
  Target: ATXN1; (-) strand; PAM type: YTN; PAM sequence: TTG
ctgccagtgtctctccatcc

SEQ ID NO: 177055 - DNA, 20 bp, Artificial Sequence
  Description of Artificial Sequence: Synthetic oligonucleotide
  Target: ATXN1; (-) strand; PAM type: YTN; PAM sequence: TTT
gctgccagtgtctctccatc

SEQ ID NO: 177056 - DNA, 20 bp, Artificial Sequence
  Description of Artificial Sequence: Synthetic oligonucleotide
  Target: ATXN1; (-) strand; PAM type: YTN; PAM sequence: TTT
tgctgccagtgtctctccat

SEQ ID NO: 177057 - DNA, 20 bp, Artificial Sequence
  Description of Artificial Sequence: Synthetic oligonucleotide
  Target: ATXN1; (-) strand; PAM type: YTN; PAM sequence: TTC
agcaagagattttgctgcca

SEQ ID NO: 177058 - DNA, 20 bp, Artificial Sequence
  Description of Artificial Sequence: Synthetic oligonucleotide
  Target: ATXN1; (-) strand; PAM type: YTN; PAM sequence: TTT
cagcaagagattttgctgcc

SEQ ID NO: 177059 - DNA, 20 bp, Artificial Sequence
  Description of Artificial Sequence: Synthetic oligonucleotide
  Target: ATXN1; (-) strand; PAM type: YTN; PAM sequence: TTT
tcagcaagagattttgctgc

SEQ ID NO: 177060 - DNA, 20 bp, Artificial Sequence
  Description of Artificial Sequence: Synthetic oligonucleotide
  Target: ATXN1; (-) strand; PAM type: YTN; PAM sequence: CTG
gagttttcagcaagagattt

SEQ ID NO: 177061 - DNA, 20 bp, Artificial Sequence
  Description of Artificial Sequence: Synthetic oligonucleotide
  Target: ATXN1; (-) strand; PAM type: YTN; PAM sequence: TTA
aagtgtcctggagttttcag

SEQ ID NO: 177062 - DNA, 20 bp, Artificial Sequence
  Description of Artificial Sequence: Synthetic oligonucleotide
  Target: ATXN1; (-) strand; PAM type: YTN; PAM sequence: TTG
gttaaagtgtcctggagttt

SEQ ID NO: 177063 - DNA, 20 bp, Artificial Sequence
  Description of Artificial Sequence: Synthetic oligonucleotide
  Target: ATXN1; (-) strand; PAM type: YTN; PAM sequence: CTT
ggttaaagtgtcctggagtt

SEQ ID NO: 177064 - DNA, 20 bp, Artificial Sequence
  Description of Artificial Sequence: Synthetic oligonucleotide
  Target: ATXN1; (-) strand; PAM type: YTN; PAM sequence: CTG
cttggttaaagtgtcctgga

SEQ ID NO: 177065 - DNA, 20 bp, Artificial Sequence
  Description of Artificial Sequence: Synthetic oligonucleotide
  Target: ATXN1; (-) strand; PAM type: YTN; PAM sequence: CTG
gatagagggggagggaaaca

SEQ ID NO: 177066 - DNA, 20 bp, Artificial Sequence
  Description of Artificial Sequence: Synthetic oligonucleotide
  Target: ATXN1; (-) strand; PAM type: YTN; PAM sequence: TTA
aagcagcaaggggatgctgg

SEQ ID NO: 177067 - DNA, 20 bp, Artificial Sequence
  Description of Artificial Sequence: Synthetic oligonucleotide
  Target: ATXN1; (-) strand; PAM type: YTN; PAM sequence: CTA
agagatgggggaaaaggtta

SEQ ID NO: 177068 - DNA, 20 bp, Artificial Sequence
  Description of Artificial Sequence: Synthetic oligonucleotide
  Target: ATXN1; (-) strand; PAM type: YTN; PAM sequence: TTC
cacaggacaagatacatcta

SEQ ID NO: 177069 - DNA, 20 bp, Artificial Sequence
  Description of Artificial Sequence: Synthetic oligonucleotide
  Target: ATXN1; (-) strand; PAM type: YTN; PAM sequence: TTA
tagttccacaggacaagata

SEQ ID NO: 177070 - DNA, 20 bp, Artificial Sequence
  Description of Artificial Sequence: Synthetic oligonucleotide
  Target: ATXN1; (-) strand; PAM type: YTN; PAM sequence: CTT
atagttccacaggacaagat

SEQ ID NO: 177071 - DNA, 20 bp, Artificial Sequence
  Description of Artificial Sequence: Synthetic oligonucleotide
  Target: ATXN1; (-) strand; PAM type: YTN; PAM sequence: TTG
gatcttatagttccacagga

SEQ ID NO: 177072 - DNA, 20 bp, Artificial Sequence
  Description of Artificial Sequence: Synthetic oligonucleotide
  Target: ATXN1; (-) strand; PAM type: YTN; PAM sequence: TTT
ggatcttatagttccacagg

SEQ ID NO: 177073 - DNA, 20 bp, Artificial Sequence
  Description of Artificial Sequence: Synthetic oligonucleotide
  Target: ATXN1; (-) strand; PAM type: YTN; PAM sequence: TTT
tggatcttatagttccacag

SEQ ID NO: 177074 - DNA, 20 bp, Artificial Sequence
  Description of Artificial Sequence: Synthetic oligonucleotide
  Target: ATXN1; (-) strand; PAM type: YTN; PAM sequence: TTT
ttggatcttatagttccaca

SEQ ID NO: 177075 - DNA, 20 bp, Artificial Sequence
  Description of Artificial Sequence: Synthetic oligonucleotide
  Target: ATXN1; (-) strand; PAM type: YTN; PAM sequence: TTC
ccccagtttttggatcttat

SEQ ID NO: 177076 - DNA, 20 bp, Artificial Sequence
  Description of Artificial Sequence: Synthetic oligonucleotide
  Target: ATXN1; (-) strand; PAM type: YTN; PAM sequence: TTT
cccccagtttttggatctta

SEQ ID NO: 177077 - DNA, 20 bp, Artificial Sequence
  Description of Artificial Sequence: Synthetic oligonucleotide
  Target: ATXN1; (-) strand; PAM type: YTN; PAM sequence: CTT
tcccccagtttttggatctt

SEQ ID NO: 177078 - DNA, 20 bp, Artificial Sequence
  Description of Artificial Sequence: Synthetic oligonucleotide
  Target: ATXN1; (-) strand; PAM type: YTN; PAM sequence: TTC
tttcccccagtttttggatc

SEQ ID NO: 177079 - DNA, 20 bp, Artificial Sequence
  Description of Artificial Sequence: Synthetic oligonucleotide
  Target: ATXN1; (-) strand; PAM type: YTN; PAM sequence: TTT
ctttcccccagtttttggat

SEQ ID NO: 177080 - DNA, 20 bp, Artificial Sequence
  Description of Artificial Sequence: Synthetic oligonucleotide
  Target: ATXN1; (-) strand; PAM type: YTN; PAM sequence: TTT
tctttcccccagtttttgga

SEQ ID NO: 177081 - DNA, 20 bp, Artificial Sequence
  Description of Artificial Sequence: Synthetic oligonucleotide
  Target: ATXN1; (-) strand; PAM type: YTN; PAM sequence: TTT
ttctttcccccagtttttgg

SEQ ID NO: 177082 - DNA, 20 bp, Artificial Sequence
  Description of Artificial Sequence: Synthetic oligonucleotide
  Target: ATXN1; (-) strand; PAM type: YTN; PAM sequence: TTT
tttctttcccccagtttttg

SEQ ID NO: 177083 - DNA, 20 bp, Artificial Sequence
  Description of Artificial Sequence: Synthetic oligonucleotide
  Target: ATXN1; (-) strand; PAM type: YTN; PAM sequence: TTT
ttttctttcccccagttttt

SEQ ID NO: 177084 - DNA, 20 bp, Artificial Sequence
  Description of Artificial Sequence: Synthetic oligonucleotide
  Target: ATXN1; (-) strand; PAM type: YTN; PAM sequence: TTT
tttttctttcccccagtttt

SEQ ID NO: 177085 - DNA, 20 bp, Artificial Sequence
  Description of Artificial Sequence: Synthetic oligonucleotide
  Target: ATXN1; (-) strand; PAM type: YTN; PAM sequence: TTT
ttttttctttcccccagttt

SEQ ID NO: 177086 - DNA, 20 bp, Artificial Sequence
  Description of Artificial Sequence: Synthetic oligonucleotide
  Target: ATXN1; (-) strand; PAM type: YTN; PAM sequence: TTT
tttttttctttcccccagtt

SEQ ID NO: 177087 - DNA, 20 bp, Artificial Sequence
  Description of Artificial Sequence: Synthetic oligonucleotide
  Target: ATXN1; (-) strand; PAM type: YTN; PAM sequence: TTT
ttttttttctttcccccagt

SEQ ID NO: 177088 - DNA, 20 bp, Artificial Sequence
  Description of Artificial Sequence: Synthetic oligonucleotide
  Target: ATXN1; (-) strand; PAM type: YTN; PAM sequence: TTT
tttttttttctttcccccag

SEQ ID NO: 177089 - DNA, 20 bp, Artificial Sequence
  Description of Artificial Sequence: Synthetic oligonucleotide
  Target: ATXN1; (-) strand; PAM type: YTN; PAM sequence: TTT
ttttttttttctttccccca

SEQ ID NO: 177090 - DNA, 20 bp, Artificial Sequence
  Description of Artificial Sequence: Synthetic oligonucleotide
  Target: ATXN1; (-) strand; PAM type: YTN; PAM sequence: CTT
tttttttttttctttccccc

SEQ ID NO: 177091 - DNA, 20 bp, Artificial Sequence
  Description of Artificial Sequence: Synthetic oligonucleotide
  Target: ATXN1; (-) strand; PAM type: YTN; PAM sequence: TTG
gtctttttttttttttcttt

SEQ ID NO: 177092 - DNA, 20 bp, Artificial Sequence
  Description of Artificial Sequence: Synthetic oligonucleotide
  Target: ATXN1; (-) strand; PAM type: YTN; PAM sequence: CTT
ggtctttttttttttttctt

SEQ ID NO: 177093 - DNA, 20 bp, Artificial Sequence
  Description of Artificial Sequence: Synthetic oligonucleotide
  Target: ATXN1; (-) strand; PAM type: YTN; PAM sequence: CTA
cttggtcttttttttttttt

SEQ ID NO: 177094 - DNA, 20 bp, Artificial Sequence
  Description of Artificial Sequence: Synthetic oligonucleotide
  Target: ATXN1; (-) strand; PAM type: YTN; PAM sequence: CTC
tacttggtcttttttttttt

SEQ ID NO: 177095 - DNA, 20 bp, Artificial Sequence
  Description of Artificial Sequence: Synthetic oligonucleotide
  Target: ATXN1; (-) strand; PAM type: YTN; PAM sequence: CTG
cctctacttggtcttttttt

SEQ ID NO: 177096 - DNA, 20 bp, Artificial Sequence
  Description of Artificial Sequence: Synthetic oligonucleotide
  Target: ATXN1; (-) strand; PAM type: YTN; PAM sequence: CTC
gatcctgcctctacttggtc

SEQ ID NO: 177097 - DNA, 20 bp, Artificial Sequence
  Description of Artificial Sequence: Synthetic oligonucleotide
  Target: ATXN1; (-) strand; PAM type: YTN; PAM sequence: TTA
atctcgatcctgcctctact

SEQ ID NO: 177098 - DNA, 20 bp, Artificial Sequence
  Description of Artificial Sequence: Synthetic oligonucleotide
  Target: ATXN1; (-) strand; PAM type: YTN; PAM sequence: TTT
aatctcgatcctgcctctac

SEQ ID NO: 177099 - DNA, 20 bp, Artificial Sequence
  Description of Artificial Sequence: Synthetic oligonucleotide
  Target: ATXN1; (-) strand; PAM type: YTN; PAM sequence: CTT
taatctcgatcctgcctcta

SEQ ID NO: 177100 - DNA, 20 bp, Artificial Sequence
  Description of Artificial Sequence: Synthetic oligonucleotide
  Target: ATXN1; (-) strand; PAM type: YTN; PAM sequence: CTG
gccactttaatctcgatcct

SEQ ID NO: 177101 - DNA, 20 bp, Artificial Sequence
  Description of Artificial Sequence: Synthetic oligonucleotide
  Target: ATXN1; (-) strand; PAM type: YTN; PAM sequence: TTC
tggccactttaatctcgatc

SEQ ID NO: 177102 - DNA, 20 bp, Artificial Sequence
  Description of Artificial Sequence: Synthetic oligonucleotide
  Target: ATXN1; (-) strand; PAM type: YTN; PAM sequence: TTT
ctggccactttaatctcgat

SEQ ID NO: 177103 - DNA, 20 bp, Artificial Sequence
  Description of Artificial Sequence: Synthetic oligonucleotide
  Target: ATXN1; (-) strand; PAM type: YTN; PAM sequence: TTT
tctggccactttaatctcga

SEQ ID NO: 177104 - DNA, 20 bp, Artificial Sequence
  Description of Artificial Sequence: Synthetic oligonucleotide
  Target: ATXN1; (-) strand; PAM type: YTN; PAM sequence: TTA
ttttctggccactttaatct

SEQ ID NO: 177105 - DNA, 20 bp, Artificial Sequence
  Description of Artificial Sequence: Synthetic oligonucleotide
  Target: ATXN1; (-) strand; PAM type: YTN; PAM sequence: CTG
gcagattattttctggccac

SEQ ID NO: 177106 - DNA, 20 bp, Artificial Sequence
  Description of Artificial Sequence: Synthetic oligonucleotide
  Target: ATXN1; (-) strand; PAM type: YTN; PAM sequence: CTG
ctggcagattattttctggc

SEQ ID NO: 177107 - DNA, 20 bp, Artificial Sequence
  Description of Artificial Sequence: Synthetic oligonucleotide
  Target: ATXN1; (-) strand; PAM type: YTN; PAM sequence: CTC
tgctggcagattattttctg

SEQ ID NO: 177108 - DNA, 20 bp, Artificial Sequence
  Description of Artificial Sequence: Synthetic oligonucleotide
  Target: ATXN1; (-) strand; PAM type: YTN; PAM sequence: TTG
gcctctgctggcagattatt

SEQ ID NO: 177109 - DNA, 20 bp, Artificial Sequence
  Description of Artificial Sequence: Synthetic oligonucleotide
  Target: ATXN1; (-) strand; PAM type: YTN; PAM sequence: CTT
ggcctctgctggcagattat

SEQ ID NO: 177110 - DNA, 20 bp, Artificial Sequence
  Description of Artificial Sequence: Synthetic oligonucleotide
  Target: ATXN1; (-) strand; PAM type: YTN; PAM sequence: CTG
agcttggcctctgctggcag

SEQ ID NO: 177111 - DNA, 20 bp, Artificial Sequence
  Description of Artificial Sequence: Synthetic oligonucleotide
  Target: ATXN1; (-) strand; PAM type: YTN; PAM sequence: TTC
tgagcttggcctctgctggc

SEQ ID NO: 177112 - DNA, 20 bp, Artificial Sequence
  Description of Artificial Sequence: Synthetic oligonucleotide
  Target: ATXN1; (-) strand; PAM type: YTN; PAM sequence: TTG
ttctgagcttggcctctgct

SEQ ID NO: 177113 - DNA, 20 bp, Artificial Sequence
  Description of Artificial Sequence: Synthetic oligonucleotide
  Target: ATXN1; (-) strand; PAM type: YTN; PAM sequence: CTT
gttctgagcttggcctctgc

SEQ ID NO: 177114 - DNA, 20 bp, Artificial Sequence
  Description of Artificial Sequence: Synthetic oligonucleotide
  Target: ATXN1; (-) strand; PAM type: YTN; PAM sequence: TTG
aagggcttgttctgagcttg

SEQ ID NO: 177115 - DNA, 20 bp, Artificial Sequence
  Description of Artificial Sequence: Synthetic oligonucleotide
  Target: ATXN1; (-) strand; PAM type: YTN; PAM sequence: TTA
ggtgagcggcattgaagggc

SEQ ID NO: 177116 - DNA, 20 bp, Artificial Sequence
  Description of Artificial Sequence: Synthetic oligonucleotide
  Target: ATXN1; (-) strand; PAM type: YTN; PAM sequence: TTT
aggtgagcggcattgaaggg

SEQ ID NO: 177117 - DNA, 20 bp, Artificial Sequence
  Description of Artificial Sequence: Synthetic oligonucleotide
  Target: ATXN1; (-) strand; PAM type: YTN; PAM sequence: CTT
taggtgagcggcattgaagg

SEQ ID NO: 177118 - DNA, 20 bp, Artificial Sequence
  Description of Artificial Sequence: Synthetic oligonucleotide
  Target: ATXN1; (-) strand; PAM type: YTN; PAM sequence: TTG
gtgagggggcggggctttag

SEQ ID NO: 177119 - DNA, 20 bp, Artificial Sequence
  Description of Artificial Sequence: Synthetic oligonucleotide
  Target: ATXN1; (-) strand; PAM type: YTN; PAM sequence: TTA
ttggtgagggggcggggctt

SEQ ID NO: 177120 - DNA, 20 bp, Artificial Sequence
  Description of Artificial Sequence: Synthetic oligonucleotide
  Target: ATXN1; (-) strand; PAM type: YTN; PAM sequence: TTT
attggtgagggggcggggct

SEQ ID NO: 177121 - DNA, 20 bp, Artificial Sequence
  Description of Artificial Sequence: Synthetic oligonucleotide
  Target: ATXN1; (-) strand; PAM type: YTN; PAM sequence: CTT
tattggtgagggggcggggc

SEQ ID NO: 177122 - DNA, 20 bp, Artificial Sequence
  Description of Artificial Sequence: Synthetic oligonucleotide
  Target: ATXN1; (-) strand; PAM type: YTN; PAM sequence: CTG
gtccatgagaatagacttta

SEQ ID NO: 177123 - DNA, 20 bp, Artificial Sequence
  Description of Artificial Sequence: Synthetic oligonucleotide
  Target: ATXN1; (-) strand; PAM type: YTN; PAM sequence: CTC
cgacatacaatctggtccat

SEQ ID NO: 177124 - DNA, 20 bp, Artificial Sequence
  Description of Artificial Sequence: Synthetic oligonucleotide
  Target: ATXN1; (-) strand; PAM type: YTN; PAM sequence: TTC
tccgacatacaatctggtcc

SEQ ID NO: 177125 - DNA, 20 bp, Artificial Sequence
  Description of Artificial Sequence: Synthetic oligonucleotide
  Target: ATXN1; (-) strand; PAM type: YTN; PAM sequence: CTT
ctccgacatacaatctggtc

SEQ ID NO: 177126 - DNA, 20 bp, Artificial Sequence
  Description of Artificial Sequence: Synthetic oligonucleotide
  Target: ATXN1; (-) strand; PAM type: YTN; PAM sequence: CTC
ttctccgacatacaatctgg

SEQ ID NO: 177127 - DNA, 20 bp, Artificial Sequence
  Description of Artificial Sequence: Synthetic oligonucleotide
  Target: ATXN1; (-) strand; PAM type: YTN; PAM sequence: CTG
ctcttctccgacatacaatc

SEQ ID NO: 177128 - DNA, 20 bp, Artificial Sequence
  Description of Artificial Sequence: Synthetic oligonucleotide
  Target: ATXN1; (-) strand; PAM type: YTN; PAM sequence: CTC
ctgctcttctccgacataca

SEQ ID NO: 177129 - DNA, 20 bp, Artificial Sequence
  Description of Artificial Sequence: Synthetic oligonucleotide
  Target: ATXN1; (-) strand; PAM type: YTN; PAM sequence: CTA
gaccgtgtccatccacaaag

SEQ ID NO: 177130 - DNA, 20 bp, Artificial Sequence
  Description of Artificial Sequence: Synthetic oligonucleotide
  Target: ATXN1; (-) strand; PAM type: YTN; PAM sequence: CTG
gatctagaccgtgtccatcc

SEQ ID NO: 177131 - DNA, 20 bp, Artificial Sequence
  Description of Artificial Sequence: Synthetic oligonucleotide
  Target: ATXN1; (-) strand; PAM type: YTN; PAM sequence: TTC
catgtctggatctagaccgt

SEQ ID NO: 177132 - DNA, 20 bp, Artificial Sequence
  Description of Artificial Sequence: Synthetic oligonucleotide
  Target: ATXN1; (-) strand; PAM type: YTN; PAM sequence: CTG
gagagaagcatggcccccag

SEQ ID NO: 177133 - DNA, 20 bp, Artificial Sequence
  Description of Artificial Sequence: Synthetic oligonucleotide
  Target: ATXN1; (-) strand; PAM type: YTN; PAM sequence: CTG
tactggagagaagcatggcc

SEQ ID NO: 177134 - DNA, 20 bp, Artificial Sequence
  Description of Artificial Sequence: Synthetic oligonucleotide
  Target: ATXN1; (-) strand; PAM type: YTN; PAM sequence: CTG
ccacatctgtactggagaga

SEQ ID NO: 177135 - DNA, 20 bp, Artificial Sequence
  Description of Artificial Sequence: Synthetic oligonucleotide
  Target: ATXN1; (-) strand; PAM type: YTN; PAM sequence: TTG
ggaagggatgtctgccacat

SEQ ID NO: 177136 - DNA, 20 bp, Artificial Sequence
  Description of Artificial Sequence: Synthetic oligonucleotide
  Target: ATXN1; (-) strand; PAM type: YTN; PAM sequence: CTT
gggaagggatgtctgccaca

SEQ ID NO: 177137 - DNA, 20 bp, Artificial Sequence
  Description of Artificial Sequence: Synthetic oligonucleotide
  Target: ATXN1; (-) strand; PAM type: YTN; PAM sequence: TTC
gaatgcttgggaagggatgt

SEQ ID NO: 177138 - DNA, 20 bp, Artificial Sequence
  Description of Artificial Sequence: Synthetic oligonucleotide
  Target: ATXN1; (-) strand; PAM type: YTN; PAM sequence: TTA
aaagaacaattcgaatgctt

SEQ ID NO: 177139 - DNA, 20 bp, Artificial Sequence
  Description of Artificial Sequence: Synthetic oligonucleotide
  Target: ATXN1; (-) strand; PAM type: YTN; PAM sequence: CTT
aaaagaacaattcgaatgct

SEQ ID NO: 177140 - DNA, 20 bp, Artificial Sequence
  Description of Artificial Sequence: Synthetic oligonucleotide
  Target: ATXN1; (-) strand; PAM type: YTN; PAM sequence: TTA
accttaaaagaacaattcga

SEQ ID NO: 177141 - DNA, 20 bp, Artificial Sequence
  Description of Artificial Sequence: Synthetic oligonucleotide
  Target: ATXN1; (-) strand; PAM type: YTN; PAM sequence: CTT
aaccttaaaagaacaattcg

SEQ ID NO: 177142 - DNA, 20 bp, Artificial Sequence
  Description of Artificial Sequence: Synthetic oligonucleotide
  Target: ATXN1; (-) strand; PAM type: YTN; PAM sequence: TTA
ccttaaccttaaaagaacaa

SEQ ID NO: 177143 - DNA, 20 bp, Artificial Sequence
  Description of Artificial Sequence: Synthetic oligonucleotide
  Target: ATXN1; (-) strand; PAM type: YTN; PAM sequence: TTT
accttaaccttaaaagaaca

SEQ ID NO: 177144 - DNA, 20 bp, Artificial Sequence
  Description of Artificial Sequence: Synthetic oligonucleotide
  Target: ATXN1; (-) strand; PAM type: YTN; PAM sequence: CTG
gtttaccttaaccttaaaag

SEQ ID NO: 177145 - DNA, 20 bp, Artificial Sequence
  Description of Artificial Sequence: Synthetic oligonucleotide
  Target: ATXN1; (-) strand; PAM type: YTN; PAM sequence: CTG
agaaaccctggtttacctta

SEQ ID NO: 177146 - DNA, 20 bp, Artificial Sequence
  Description of Artificial Sequence: Synthetic oligonucleotide
  Target: ATXN1; (-) strand; PAM type: YTN; PAM sequence: CTG
caacacacaggacagccccc

SEQ ID NO: 177147 - DNA, 20 bp, Artificial Sequence
  Description of Artificial Sequence: Synthetic oligonucleotide
  Target: ATXN1; (-) strand; PAM type: YTN; PAM sequence: CTA
aacatcctgcaacacacagg

SEQ ID NO: 177148 - DNA, 20 bp, Artificial Sequence
  Description of Artificial Sequence: Synthetic oligonucleotide
  Target: ATXN1; (-) strand; PAM type: YTN; PAM sequence: CTG
ctaaacatcctgcaacacac

SEQ ID NO: 177149 - DNA, 20 bp, Artificial Sequence
  Description of Artificial Sequence: Synthetic oligonucleotide
  Target: ATXN1; (-) strand; PAM type: YTN; PAM sequence: CTA
gtgagtagaagtgaggaatg

SEQ ID NO: 177150 - DNA, 20 bp, Artificial Sequence
  Description of Artificial Sequence: Synthetic oligonucleotide
  Target: ATXN1; (-) strand; PAM type: YTN; PAM sequence: CTA
ccagcatctagtgagtagaa

SEQ ID NO: 177151 - DNA, 20 bp, Artificial Sequence
  Description of Artificial Sequence: Synthetic oligonucleotide
  Target: ATXN1; (-) strand; PAM type: YTN; PAM sequence: CTG
gggaggagctaccagcatct

SEQ ID NO: 177152 - DNA, 20 bp, Artificial Sequence
  Description of Artificial Sequence: Synthetic oligonucleotide
  Target: ATXN1; (-) strand; PAM type: YTN; PAM sequence: TTG
tcacgactggggaggagcta

SEQ ID NO: 177153 - DNA, 20 bp, Artificial Sequence
  Description of Artificial Sequence: Synthetic oligonucleotide
  Target: ATXN1; (-) strand; PAM type: YTN; PAM sequence: CTT
gtcacgactggggaggagct

SEQ ID NO: 177154 - DNA, 20 bp, Artificial Sequence
  Description of Artificial Sequence: Synthetic oligonucleotide
  Target: ATXN1; (-) strand; PAM type: YTN; PAM sequence: TTG
cttgtcacgactggggagga

SEQ ID NO: 177155 - DNA, 20 bp, Artificial Sequence
  Description of Artificial Sequence: Synthetic oligonucleotide
  Target: ATXN1; (-) strand; PAM type: YTN; PAM sequence: TTT
gcttgtcacgactggggagg

SEQ ID NO: 177156 - DNA, 20 bp, Artificial Sequence
  Description of Artificial Sequence: Synthetic oligonucleotide
  Target: ATXN1; (-) strand; PAM type: YTN; PAM sequence: TTT
tgcttgtcacgactggggag

SEQ ID NO: 177157 - DNA, 20 bp, Artificial Sequence
  Description of Artificial Sequence: Synthetic oligonucleotide
  Target: ATXN1; (-) strand; PAM type: YTN; PAM sequence: TTT
ttgcttgtcacgactgggga

SEQ ID NO: 177158 - DNA, 20 bp, Artificial Sequence
  Description of Artificial Sequence: Synthetic oligonucleotide
  Target: ATXN1; (-) strand; PAM type: YTN; PAM sequence: CTG
aagtcatttttgcttgtcac

SEQ ID NO: 177159 - DNA, 20 bp, Artificial Sequence
  Description of Artificial Sequence: Synthetic oligonucleotide
  Target: ATXN1; (-) strand; PAM type: YTN; PAM sequence: CTG
aatgtctgaagtcatttttg

SEQ ID NO: 177160 - DNA, 20 bp, Artificial Sequence
  Description of Artificial Sequence: Synthetic oligonucleotide
  Target: ATXN1; (-) strand; PAM type: YTN; PAM sequence: TTG
gcaatgtctgaatgtctgaa

SEQ ID NO: 177161 - DNA, 20 bp, Artificial Sequence
  Description of Artificial Sequence: Synthetic oligonucleotide
  Target: ATXN1; (-) strand; PAM type: YTN; PAM sequence: CTC
cgccgtgggcaagttggcaa

SEQ ID NO: 177162 - DNA, 20 bp, Artificial Sequence
  Description of Artificial Sequence: Synthetic oligonucleotide
  Target: ATXN1; (-) strand; PAM type: YTN; PAM sequence: CTC
cctccgccgtgggcaagttg

SEQ ID NO: 177163 - DNA, 20 bp, Artificial Sequence
  Description of Artificial Sequence: Synthetic oligonucleotide
  Target: ATXN1; (-) strand; PAM type: YTN; PAM sequence: TTG
ctccctccgccgtgggcaag

SEQ ID NO: 177164 - DNA, 20 bp, Artificial Sequence
  Description of Artificial Sequence: Synthetic oligonucleotide
  Target: ATXN1; (-) strand; PAM type: YTN; PAM sequence: TTT
gctccctccgccgtgggcaa

SEQ ID NO: 177165 - DNA, 20 bp, Artificial Sequence
  Description of Artificial Sequence: Synthetic oligonucleotide
  Target: ATXN1; (-) strand; PAM type: YTN; PAM sequence: TTT
tgctccctccgccgtgggca

SEQ ID NO: 177166 - DNA, 20 bp, Artificial Sequence
  Description of Artificial Sequence: Synthetic oligonucleotide
  Target: ATXN1; (-) strand; PAM type: YTN; PAM sequence: CTA
attttgctccctccgccgtg

SEQ ID NO: 177167 - DNA, 20 bp, Artificial Sequence
  Description of Artificial Sequence: Synthetic oligonucleotide
  Target: ATXN1; (-) strand; PAM type: YTN; PAM sequence: TTC
taattttgctccctccgccg

SEQ ID NO: 177168 - DNA, 20 bp, Artificial Sequence
  Description of Artificial Sequence: Synthetic oligonucleotide
  Target: ATXN1; (-) strand; PAM type: YTN; PAM sequence: CTC
cgtgattctaattttgctcc

SEQ ID NO: 177169 - DNA, 20 bp, Artificial Sequence
  Description of Artificial Sequence: Synthetic oligonucleotide
  Target: ATXN1; (-) strand; PAM type: YTN; PAM sequence: TTA
cctccgtgattctaattttg

SEQ ID NO: 177170 - DNA, 20 bp, Artificial Sequence
  Description of Artificial Sequence: Synthetic oligonucleotide
  Target: ATXN1; (-) strand; PAM type: YTN; PAM sequence: TTT
acctccgtgattctaatttt

SEQ ID NO: 177171 - DNA, 20 bp, Artificial Sequence
  Description of Artificial Sequence: Synthetic oligonucleotide
  Target: ATXN1; (-) strand; PAM type: YTN; PAM sequence: CTA
taaaatttacctccgtgatt

SEQ ID NO: 177172 - DNA, 20 bp, Artificial Sequence
  Description of Artificial Sequence: Synthetic oligonucleotide
  Target: ATXN1; (-) strand; PAM type: YTN; PAM sequence: CTC
tataaaatttacctccgtga

SEQ ID NO: 177173 - DNA, 20 bp, Artificial Sequence
  Description of Artificial Sequence: Synthetic oligonucleotide
  Target: ATXN1; (-) strand; PAM type: YTN; PAM sequence: CTC
tctataaaatttacctccgt

SEQ ID NO: 177174 - DNA, 20 bp, Artificial Sequence
  Description of Artificial Sequence: Synthetic oligonucleotide
  Target: ATXN1; (-) strand; PAM type: YTN; PAM sequence: TTA
gaaccagccaactctctata

SEQ ID NO: 177175 - DNA, 20 bp, Artificial Sequence
  Description of Artificial Sequence: Synthetic oligonucleotide
  Target: ATXN1; (-) strand; PAM type: YTN; PAM sequence: CTT
agaaccagccaactctctat

SEQ ID NO: 177176 - DNA, 20 bp, Artificial Sequence
  Description of Artificial Sequence: Synthetic oligonucleotide
  Target: ATXN1; (-) strand; PAM type: YTN; PAM sequence: TTC
cacttagaaccagccaactc

SEQ ID NO: 177177 - DNA, 20 bp, Artificial Sequence
  Description of Artificial Sequence: Synthetic oligonucleotide
  Target: ATXN1; (-) strand; PAM type: YTN; PAM sequence: TTT
ccacttagaaccagccaact

SEQ ID NO: 177178 - DNA, 20 bp, Artificial Sequence
  Description of Artificial Sequence: Synthetic oligonucleotide
  Target: ATXN1; (-) strand; PAM type: YTN; PAM sequence: TTT
tccacttagaaccagccaac

SEQ ID NO: 177179 - DNA, 20 bp, Artificial Sequence
  Description of Artificial Sequence: Synthetic oligonucleotide
  Target: ATXN1; (-) strand; PAM type: YTN; PAM sequence: TTC
atgcaataagagagtagttt

SEQ ID NO: 177180 - DNA, 20 bp, Artificial Sequence
  Description of Artificial Sequence: Synthetic oligonucleotide
  Target: ATXN1; (-) strand; PAM type: YTN; PAM sequence: CTT
catgcaataagagagtagtt

SEQ ID NO: 177181 - DNA, 20 bp, Artificial Sequence
  Description of Artificial Sequence: Synthetic oligonucleotide
  Target: ATXN1; (-) strand; PAM type: YTN; PAM sequence: TTA
accttcatgcaataagagag

SEQ ID NO: 177182 - DNA, 20 bp, Artificial Sequence
  Description of Artificial Sequence: Synthetic oligonucleotide
  Target: ATXN1; (-) strand; PAM type: YTN; PAM sequence: TTT
aaccttcatgcaataagaga

SEQ ID NO: 177183 - DNA, 20 bp, Artificial Sequence
  Description of Artificial Sequence: Synthetic oligonucleotide
  Target: ATXN1; (-) strand; PAM type: YTN; PAM sequence: TTA
tgaatgtgagtgtgtgtcac

SEQ ID NO: 177184 - DNA, 20 bp, Artificial Sequence
  Description of Artificial Sequence: Synthetic oligonucleotide
  Target: ATXN1; (-) strand; PAM type: YTN; PAM sequence: TTT
atgaatgtgagtgtgtgtca

SEQ ID NO: 177185 - DNA, 20 bp, Artificial Sequence
  Description of Artificial Sequence: Synthetic oligonucleotide
  Target: ATXN1; (-) strand; PAM type: YTN; PAM sequence: TTG
tatcgtgtgtgtgtttatga

SEQ ID NO: 177186 - DNA, 20 bp, Artificial Sequence
  Description of Artificial Sequence: Synthetic oligonucleotide
  Target: ATXN1; (-) strand; PAM type: YTN; PAM sequence: TTG
tcattgtatcgtgtgtgtgt

SEQ ID NO: 177187 - DNA, 20 bp, Artificial Sequence
  Description of Artificial Sequence: Synthetic oligonucleotide
  Target: ATXN1; (-) strand; PAM type: YTN; PAM sequence: TTT
gtcattgtatcgtgtgtgtg

SEQ ID NO: 177188 - DNA, 20 bp, Artificial Sequence
  Description of Artificial Sequence: Synthetic oligonucleotide
  Target: ATXN1; (-) strand; PAM type: YTN; PAM sequence: TTT
tgtcattgtatcgtgtgtgt

SEQ ID NO: 177189 - DNA, 20 bp, Artificial Sequence
  Description of Artificial Sequence: Synthetic oligonucleotide
  Target: ATXN1; (-) strand; PAM type: YTN; PAM sequence: TTA
gggattttgtcattgtatcg

SEQ ID NO: 177190 - DNA, 20 bp, Artificial Sequence
  Description of Artificial Sequence: Synthetic oligonucleotide
  Target: ATXN1; (-) strand; PAM type: YTN; PAM sequence: CTT
agggattttgtcattgtatc

SEQ ID NO: 177191 - DNA, 20 bp, Artificial Sequence
  Description of Artificial Sequence: Synthetic oligonucleotide
  Target: ATXN1; (-) strand; PAM type: YTN; PAM sequence: CTG
tcttagggattttgtcattg

SEQ ID NO: 177192 - DNA, 20 bp, Artificial Sequence
  Description of Artificial Sequence: Synthetic oligonucleotide
  Target: ATXN1; (-) strand; PAM type: YTN; PAM sequence: CTC
tgtcttagggattttgtcat

SEQ ID NO: 177193 - DNA, 20 bp, Artificial Sequence
  Description of Artificial Sequence: Synthetic oligonucleotide
  Target: ATXN1; (-) strand; PAM type: YTN; PAM sequence: TTA
caacaaatcaggcaaatgaa

SEQ ID NO: 177194 - DNA, 20 bp, Artificial Sequence
  Description of Artificial Sequence: Synthetic oligonucleotide
  Target: ATXN1; (-) strand; PAM type: YTN; PAM sequence: TTT
acaacaaatcaggcaaatga

SEQ ID NO: 177195 - DNA, 20 bp, Artificial Sequence
  Description of Artificial Sequence: Synthetic oligonucleotide
  Target: ATXN1; (-) strand; PAM type: YTN; PAM sequence: TTA
gaggcatttacaacaaatca

SEQ ID NO: 177196 - DNA, 20 bp, Artificial Sequence
  Description of Artificial Sequence: Synthetic oligonucleotide
  Target: ATXN1; (-) strand; PAM type: YTN; PAM sequence: TTT
agaggcatttacaacaaatc

SEQ ID NO: 177197 - DNA, 20 bp, Artificial Sequence
  Description of Artificial Sequence: Synthetic oligonucleotide
  Target: ATXN1; (-) strand; PAM type: YTN; PAM sequence: CTT
tagaggcatttacaacaaat

SEQ ID NO: 177198 - DNA, 20 bp, Artificial Sequence
  Description of Artificial Sequence: Synthetic oligonucleotide
  Target: ATXN1; (-) strand; PAM type: YTN; PAM sequence: CTC
aaactttagaggcatttaca

SEQ ID NO: 177199 - DNA, 20 bp, Artificial Sequence
  Description of Artificial Sequence: Synthetic oligonucleotide
  Target: ATXN1; (-) strand; PAM type: YTN; PAM sequence: CTG
ctcaaactttagaggcattt

SEQ ID NO: 177200 - DNA, 20 bp, Artificial Sequence
  Description of Artificial Sequence: Synthetic oligonucleotide
  Target: ATXN1; (-) strand; PAM type: YTN; PAM sequence: TTC
tgctcaaactttagaggcat

SEQ ID NO: 177201 - DNA, 20 bp, Artificial Sequence
  Description of Artificial Sequence: Synthetic oligonucleotide
  Target: ATXN1; (-) strand; PAM type: YTN; PAM sequence: TTG
atgttctgctcaaactttag

SEQ ID NO: 177202 - DNA, 20 bp, Artificial Sequence
  Description of Artificial Sequence: Synthetic oligonucleotide
  Target: ATXN1; (-) strand; PAM type: YTN; PAM sequence: CTT
gatgttctgctcaaacttta

SEQ ID NO: 177203 - DNA, 20 bp, Artificial Sequence
  Description of Artificial Sequence: Synthetic oligonucleotide
  Target: ATXN1; (-) strand; PAM type: YTN; PAM sequence: TTG
aaaacggaacccttgatgtt

SEQ ID NO: 177204 - DNA, 20 bp, Artificial Sequence
  Description of Artificial Sequence: Synthetic oligonucleotide
  Target: ATXN1; (-) strand; PAM type: YTN; PAM sequence: TTT
gaaaacggaacccttgatgt

SEQ ID NO: 177205 - DNA, 20 bp, Artificial Sequence
  Description of Artificial Sequence: Synthetic oligonucleotide
  Target: ATXN1; (-) strand; PAM type: YTN; PAM sequence: CTT
tgaaaacggaacccttgatg

SEQ ID NO: 177206 - DNA, 20 bp, Artificial Sequence
  Description of Artificial Sequence: Synthetic oligonucleotide
  Target: ATXN1; (-) strand; PAM type: YTN; PAM sequence: TTG
aggtcactttgaaaacggaa

SEQ ID NO: 177207 - DNA, 20 bp, Artificial Sequence
  Description of Artificial Sequence: Synthetic oligonucleotide
  Target: ATXN1; (-) strand; PAM type: YTN; PAM sequence: CTG
gaggcagttgaggtcacttt

SEQ ID NO: 177208 - DNA, 20 bp, Artificial Sequence
  Description of Artificial Sequence: Synthetic oligonucleotide
  Target: ATXN1; (-) strand; PAM type: YTN; PAM sequence: CTG
aaacgctggaggcagttgag

SEQ ID NO: 177209 - DNA, 20 bp, Artificial Sequence
  Description of Artificial Sequence: Synthetic oligonucleotide
  Target: ATXN1; (-) strand; PAM type: YTN; PAM sequence: CTC
aacacctgaaacgctggagg

SEQ ID NO: 177210 - DNA, 20 bp, Artificial Sequence
  Description of Artificial Sequence: Synthetic oligonucleotide
  Target: ATXN1; (-) strand; PAM type: YTN; PAM sequence: CTA
gagctcaacacctgaaacgc

SEQ ID NO: 177211 - DNA, 20 bp, Artificial Sequence
  Description of Artificial Sequence: Synthetic oligonucleotide
  Target: ATXN1; (-) strand; PAM type: YTN; PAM sequence: TTC
tagagctcaacacctgaaac

SEQ ID NO: 177212 - DNA, 20 bp, Artificial Sequence
  Description of Artificial Sequence: Synthetic oligonucleotide
  Target: ATXN1; (-) strand; PAM type: YTN; PAM sequence: CTT
ctagagctcaacacctgaaa

SEQ ID NO: 177213 - DNA, 20 bp, Artificial Sequence
  Description of Artificial Sequence: Synthetic oligonucleotide
  Target: ATXN1; (-) strand; PAM type: YTN; PAM sequence: CTG
gcttctagagctcaacacct

SEQ ID NO: 177214 - DNA, 20 bp, Artificial Sequence
  Description of Artificial Sequence: Synthetic oligonucleotide
  Target: ATXN1; (-) strand; PAM type: YTN; PAM sequence: TTC
catcctggcttctagagctc

SEQ ID NO: 177215 - DNA, 20 bp, Artificial Sequence
  Description of Artificial Sequence: Synthetic oligonucleotide
  Target: ATXN1; (-) strand; PAM type: YTN; PAM sequence: CTT
ccatcctggcttctagagct

SEQ ID NO: 177216 - DNA, 20 bp, Artificial Sequence
  Description of Artificial Sequence: Synthetic oligonucleotide
  Target: ATXN1; (-) strand; PAM type: YTN; PAM sequence: CTG
aaaacttccatcctggcttc

SEQ ID NO: 177217 - DNA, 20 bp, Artificial Sequence
  Description of Artificial Sequence: Synthetic oligonucleotide
  Target: ATXN1; (-) strand; PAM type: YTN; PAM sequence: CTG
cctgaaaacttccatcctgg

SEQ ID NO: 177218 - DNA, 20 bp, Artificial Sequence
  Description of Artificial Sequence: Synthetic oligonucleotide
  Target: ATXN1; (-) strand; PAM type: YTN; PAM sequence: TTG
tatctgcctgaaaacttcca

SEQ ID NO: 177219 - DNA, 20 bp, Artificial Sequence
  Description of Artificial Sequence: Synthetic oligonucleotide
  Target: ATXN1; (-) strand; PAM type: YTN; PAM sequence: CTG
ggagttgtatctgcctgaaa

SEQ ID NO: 177220 - DNA, 20 bp, Artificial Sequence
  Description of Artificial Sequence: Synthetic oligonucleotide
  Target: ATXN1; (-) strand; PAM type: YTN; PAM sequence: CTG
aatgaaagcctgggagttgt

SEQ ID NO: 177221 - DNA, 20 bp, Artificial Sequence
  Description of Artificial Sequence: Synthetic oligonucleotide
  Target: ATXN1; (-) strand; PAM type: YTN; PAM sequence: TTA
tagaagctgaatgaaagcct

SEQ ID NO: 177222 - DNA, 20 bp, Artificial Sequence
  Description of Artificial Sequence: Synthetic oligonucleotide
  Target: ATXN1; (-) strand; PAM type: YTN; PAM sequence: TTT
atagaagctgaatgaaagcc

SEQ ID NO: 177223 - DNA, 20 bp, Artificial Sequence
  Description of Artificial Sequence: Synthetic oligonucleotide
  Target: ATXN1; (-) strand; PAM type: YTN; PAM sequence: TTT
tatagaagctgaatgaaagc

SEQ ID NO: 177224 - DNA, 20 bp, Artificial Sequence
  Description of Artificial Sequence: Synthetic oligonucleotide
  Target: ATXN1; (-) strand; PAM type: YTN; PAM sequence: TTG
ttttatagaagctgaatgaa

SEQ ID NO: 177225 - DNA, 20 bp, Artificial Sequence
  Description of Artificial Sequence: Synthetic oligonucleotide
  Target: ATXN1; (-) strand; PAM type: YTN; PAM sequence: CTG
ttgttttatagaagctgaat

SEQ ID NO: 177226 - DNA, 20 bp, Artificial Sequence
  Description of Artificial Sequence: Synthetic oligonucleotide
  Target: ATXN1; (-) strand; PAM type: YTN; PAM sequence: CTG
tgtgcactgttgttttatag

SEQ ID NO: 177227 - DNA, 20 bp, Artificial Sequence
  Description of Artificial Sequence: Synthetic oligonucleotide
  Target: ATXN1; (-) strand; PAM type: YTN; PAM sequence: CTG
gtgatgaggcatgtgcctgt

SEQ ID NO: 177228 - DNA, 20 bp, Artificial Sequence
  Description of Artificial Sequence: Synthetic oligonucleotide
  Target: ATXN1; (-) strand; PAM type: YTN; PAM sequence: TTG
ggtgcacacagcagacactg

SEQ ID NO: 177229 - DNA, 20 bp, Artificial Sequence
  Description of Artificial Sequence: Synthetic oligonucleotide
  Target: ATXN1; (-) strand; PAM type: YTN; PAM sequence: TTT
gggtgcacacagcagacact

SEQ ID NO: 177230 - DNA, 20 bp, Artificial Sequence
  Description of Artificial Sequence: Synthetic oligonucleotide
  Target: ATXN1; (-) strand; PAM type: YTN; PAM sequence: TTT
tgggtgcacacagcagacac

SEQ ID NO: 177231 - DNA, 20 bp, Artificial Sequence
  Description of Artificial Sequence: Synthetic oligonucleotide
  Target: ATXN1; (-) strand; PAM type: YTN; PAM sequence: TTT
ttgggtgcacacagcagaca

SEQ ID NO: 177232 - DNA, 20 bp, Artificial Sequence
  Description of Artificial Sequence: Synthetic oligonucleotide
  Target: ATXN1; (-) strand; PAM type: YTN; PAM sequence: TTT
tttgggtgcacacagcagac

SEQ ID NO: 177233 - DNA, 20 bp, Artificial Sequence
  Description of Artificial Sequence: Synthetic oligonucleotide
  Target: ATXN1; (-) strand; PAM type: YTN; PAM sequence: CTT
ttttgggtgcacacagcaga

SEQ ID NO: 177234 - DNA, 20 bp, Artificial Sequence
  Description of Artificial Sequence: Synthetic oligonucleotide
  Target: ATXN1; (-) strand; PAM type: YTN; PAM sequence: TTC
ttttttgggtgcacacagca

SEQ ID NO: 177235 - DNA, 20 bp, Artificial Sequence
  Description of Artificial Sequence: Synthetic oligonucleotide
  Target: ATXN1; (-) strand; PAM type: YTN; PAM sequence: TTT
cttttttgggtgcacacagc

SEQ ID NO: 177236 - DNA, 20 bp, Artificial Sequence
  Description of Artificial Sequence: Synthetic oligonucleotide
  Target: ATXN1; (-) strand; PAM type: YTN; PAM sequence: CTT
tcttttttgggtgcacacag

SEQ ID NO: 177237 - DNA, 20 bp, Artificial Sequence
  Description of Artificial Sequence: Synthetic oligonucleotide
  Target: ATXN1; (-) strand; PAM type: YTN; PAM sequence: CTG
ctttcttttttgggtgcaca

SEQ ID NO: 177238 - DNA, 20 bp, Artificial Sequence
  Description of Artificial Sequence: Synthetic oligonucleotide
  Target: ATXN1; (-) strand; PAM type: YTN; PAM sequence: CTG
cgtctgctttcttttttggg

SEQ ID NO: 177239 - DNA, 20 bp, Artificial Sequence
  Description of Artificial Sequence: Synthetic oligonucleotide
  Target: ATXN1; (-) strand; PAM type: YTN; PAM sequence: TTC
tgcgtctgctttcttttttg

SEQ ID NO: 177240 - DNA, 20 bp, Artificial Sequence
  Description of Artificial Sequence: Synthetic oligonucleotide
  Target: ATXN1; (-) strand; PAM type: YTN; PAM sequence: TTT
ctgcgtctgctttctttttt

SEQ ID NO: 177241 - DNA, 20 bp, Artificial Sequence
  Description of Artificial Sequence: Synthetic oligonucleotide
  Target: ATXN1; (-) strand; PAM type: YTN; PAM sequence: CTT
tctgcgtctgctttcttttt

SEQ ID NO: 177242 - DNA, 20 bp, Artificial Sequence
  Description of Artificial Sequence: Synthetic oligonucleotide
  Target: ATXN1; (-) strand; PAM type: YTN; PAM sequence: TTC
aatcatctttctgcgtctgc

SEQ ID NO: 177243 - DNA, 20 bp, Artificial Sequence
  Description of Artificial Sequence: Synthetic oligonucleotide
  Target: ATXN1; (-) strand; PAM type: YTN; PAM sequence: TTT
caatcatctttctgcgtctg

SEQ ID NO: 177244 - DNA, 20 bp, Artificial Sequence
  Description of Artificial Sequence: Synthetic oligonucleotide
  Target: ATXN1; (-) strand; PAM type: YTN; PAM sequence: TTT
tcaatcatctttctgcgtct

SEQ ID NO: 177245 - DNA, 20 bp, Artificial Sequence
  Description of Artificial Sequence: Synthetic oligonucleotide
  Target: ATXN1; (-) strand; PAM type: YTN; PAM sequence: CTA
tggaatacattttcaatcat

SEQ ID NO: 177246 - DNA, 20 bp, Artificial Sequence
  Description of Artificial Sequence: Synthetic oligonucleotide
  Target: ATXN1; (-) strand; PAM type: YTN; PAM sequence: CTA
gagccctatggaatacattt

SEQ ID NO: 177247 - DNA, 20 bp, Artificial Sequence
  Description of Artificial Sequence: Synthetic oligonucleotide
  Target: ATXN1; (-) strand; PAM type: YTN; PAM sequence: TTC
aagacaaccctagagcccta

SEQ ID NO: 177248 - DNA, 20 bp, Artificial Sequence
  Description of Artificial Sequence: Synthetic oligonucleotide
  Target: ATXN1; (-) strand; PAM type: YTN; PAM sequence: TTT
caagacaaccctagagccct

SEQ ID NO: 177249 - DNA, 20 bp, Artificial Sequence
  Description of Artificial Sequence: Synthetic oligonucleotide
  Target: ATXN1; (-) strand; PAM type: YTN; PAM sequence: TTC
agaacagagcatttcaagac

SEQ ID NO: 177250 - DNA, 20 bp, Artificial Sequence
  Description of Artificial Sequence: Synthetic oligonucleotide
  Target: ATXN1; (-) strand; PAM type: YTN; PAM sequence: TTT
cagaacagagcatttcaaga

SEQ ID NO: 177251 - DNA, 20 bp, Artificial Sequence
  Description of Artificial Sequence: Synthetic oligonucleotide
  Target: ATXN1; (-) strand; PAM type: YTN; PAM sequence: TTA
tagagtgtttcagaacagag

SEQ ID NO: 177252 - DNA, 20 bp, Artificial Sequence
  Description of Artificial Sequence: Synthetic oligonucleotide
  Target: ATXN1; (-) strand; PAM type: YTN; PAM sequence: TTT
atagagtgtttcagaacaga

SEQ ID NO: 177253 - DNA, 20 bp, Artificial Sequence
  Description of Artificial Sequence: Synthetic oligonucleotide
  Target: ATXN1; (-) strand; PAM type: YTN; PAM sequence: TTT
tatagagtgtttcagaacag

SEQ ID NO: 177254 - DNA, 20 bp, Artificial Sequence
  Description of Artificial Sequence: Synthetic oligonucleotide
  Target: ATXN1; (-) strand; PAM type: YTN; PAM sequence: TTT
ttatagagtgtttcagaaca

SEQ ID NO: 177255 - DNA, 20 bp, Artificial Sequence
  Description of Artificial Sequence: Synthetic oligonucleotide
  Target: ATXN1; (-) strand; PAM type: YTN; PAM sequence: CTG
tgaggaatttttatagagtg

SEQ ID NO: 177256 - DNA, 20 bp, Artificial Sequence
  Description of Artificial Sequence: Synthetic oligonucleotide
  Target: ATXN1; (-) strand; PAM type: YTN; PAM sequence: CTG
aaaatctgtgaggaattttt

SEQ ID NO: 177257 - DNA, 20 bp, Artificial Sequence
  Description of Artificial Sequence: Synthetic oligonucleotide
  Target: ATXN1; (-) strand; PAM type: YTN; PAM sequence: CTA
gtcactgaaaatctgtgagg

SEQ ID NO: 177258 - DNA, 20 bp, Artificial Sequence
  Description of Artificial Sequence: Synthetic oligonucleotide
  Target: ATXN1; (-) strand; PAM type: YTN; PAM sequence: CTC
tagtcactgaaaatctgtga

SEQ ID NO: 177259 - DNA, 20 bp, Artificial Sequence
  Description of Artificial Sequence: Synthetic oligonucleotide
  Target: ATXN1; (-) strand; PAM type: YTN; PAM sequence: CTC
ccacagccccatgcctctag

SEQ ID NO: 177260 - DNA, 20 bp, Artificial Sequence
  Description of Artificial Sequence: Synthetic oligonucleotide
  Target: ATXN1; (-) strand; PAM type: YTN; PAM sequence: CTG
agcaccccctcccacagccc

SEQ ID NO: 177261 - DNA, 20 bp, Artificial Sequence
  Description of Artificial Sequence: Synthetic oligonucleotide
  Target: ATXN1; (-) strand; PAM type: YTN; PAM sequence: CTC
aataataaaagagtgcagct

SEQ ID NO: 177262 - DNA, 20 bp, Artificial Sequence
  Description of Artificial Sequence: Synthetic oligonucleotide
  Target: ATXN1; (-) strand; PAM type: YTN; PAM sequence: TTG
aatcagctcaataataaaag

SEQ ID NO: 177263 - DNA, 20 bp, Artificial Sequence
  Description of Artificial Sequence: Synthetic oligonucleotide
  Target: ATXN1; (-) strand; PAM type: YTN; PAM sequence: TTT
gaatcagctcaataataaaa

SEQ ID NO: 177264 - DNA, 20 bp, Artificial Sequence
  Description of Artificial Sequence: Synthetic oligonucleotide
  Target: ATXN1; (-) strand; PAM type: YTN; PAM sequence: CTT
tgaatcagctcaataataaa

SEQ ID NO: 177265 - DNA, 20 bp, Artificial Sequence
  Description of Artificial Sequence: Synthetic oligonucleotide
  Target: ATXN1; (-) strand; PAM type: YTN; PAM sequence: TTC
ctttgaatcagctcaataat

SEQ ID NO: 177266 - DNA, 20 bp, Artificial Sequence
  Description of Artificial Sequence: Synthetic oligonucleotide
  Target: ATXN1; (-) strand; PAM type: YTN; PAM sequence: CTG
ttcctttgaatcagctcaat

SEQ ID NO: 177267 - DNA, 20 bp, Artificial Sequence
  Description of Artificial Sequence: Synthetic oligonucleotide
  Target: ATXN1; (-) strand; PAM type: YTN; PAM sequence: TTA
tcaacataaaatctgttcct

SEQ ID NO: 177268 - DNA, 20 bp, Artificial Sequence
  Description of Artificial Sequence: Synthetic oligonucleotide
  Target: ATXN1; (-) strand; PAM type: YTN; PAM sequence: TTT
atcaacataaaatctgttcc

SEQ ID NO: 177269 - DNA, 20 bp, Artificial Sequence
  Description of Artificial Sequence: Synthetic oligonucleotide
  Target: ATXN1; (-) strand; PAM type: YTN; PAM sequence: TTA
aagtcagtatcaggtacatt

SEQ ID NO: 177270 - DNA, 20 bp, Artificial Sequence
  Description of Artificial Sequence: Synthetic oligonucleotide
  Target: ATXN1; (-) strand; PAM type: YTN; PAM sequence: TTA
cagatagaaaagacccagtc

SEQ ID NO: 177271 - DNA, 20 bp, Artificial Sequence
  Description of Artificial Sequence: Synthetic oligonucleotide
  Target: ATXN1; (-) strand; PAM type: YTN; PAM sequence: TTT
acagatagaaaagacccagt

SEQ ID NO: 177272 - DNA, 20 bp, Artificial Sequence
  Description of Artificial Sequence: Synthetic oligonucleotide
  Target: ATXN1; (-) strand; PAM type: YTN; PAM sequence: TTT
tacagatagaaaagacccag

SEQ ID NO: 177273 - DNA, 20 bp, Artificial Sequence
  Description of Artificial Sequence: Synthetic oligonucleotide
  Target: ATXN1; (-) strand; PAM type: YTN; PAM sequence: TTG
caaccatattttacagatag

SEQ ID NO: 177274 - DNA, 20 bp, Artificial Sequence
  Description of Artificial Sequence: Synthetic oligonucleotide
  Target: ATXN1; (-) strand; PAM type: YTN; PAM sequence: CTT
gcaaccatattttacagata

SEQ ID NO: 177275 - DNA, 20 bp, Artificial Sequence
  Description of Artificial Sequence: Synthetic oligonucleotide
  Target: ATXN1; (-) strand; PAM type: YTN; PAM sequence: TTG
tccatgaaagccttgcaacc

SEQ ID NO: 177276 - DNA, 20 bp, Artificial Sequence
  Description of Artificial Sequence: Synthetic oligonucleotide
  Target: ATXN1; (-) strand; PAM type: YTN; PAM sequence: CTT
gtccatgaaagccttgcaac

SEQ ID NO: 177277 - DNA, 20 bp, Artificial Sequence
  Description of Artificial Sequence: Synthetic oligonucleotide
  Target: ATXN1; (-) strand; PAM type: YTN; PAM sequence: CTA
ccagagacaagaggccatgt

SEQ ID NO: 177278 - DNA, 20 bp, Artificial Sequence
  Description of Artificial Sequence: Synthetic oligonucleotide
  Target: ATXN1; (-) strand; PAM type: YTN; PAM sequence: CTG
gtctaccagagacaagaggc

SEQ ID NO: 177279 - DNA, 20 bp, Artificial Sequence
  Description of Artificial Sequence: Synthetic oligonucleotide
  Target: ATXN1; (-) strand; PAM type: YTN; PAM sequence: CTC
agaaaaaaaaaaaaaaaggc

SEQ ID NO: 177280 - DNA, 20 bp, Artificial Sequence
  Description of Artificial Sequence: Synthetic oligonucleotide
  Target: ATXN1; (-) strand; PAM type: YTN; PAM sequence: CTA
catctcagaaaaaaaaaaaa

SEQ ID NO: 177281 - DNA, 20 bp, Artificial Sequence
  Description of Artificial Sequence: Synthetic oligonucleotide
  Target: ATXN1; (-) strand; PAM type: YTN; PAM sequence: CTG
ggtgacaagagcaaaactac

SEQ ID NO: 177282 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacaagagca

SEQ ID NO: 177283 - DNA, 20 bp, Artificial Sequence
  Description of Artificial Sequence: Synthetic oligonucleotide
  Target: ATXN1; (-) strand; PAM type: YTN; PAM sequence: TTG
cactccagcctgggtgacaa

SEQ ID NO: 177284 - DNA, 20 bp, Artificial Sequence
  Description of Artificial Sequence: Synthetic oligonucleotide
  Target: ATXN1; (-) strand; PAM type: YTN; PAM sequence: TTG
ccccattgcactccagcctg

SEQ ID NO: 177285 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgcccc

SEQ ID NO: 177286 - DNA, 20 bp, Artificial Sequence
  Description of Artificial Sequence: Synthetic oligonucleotide
  Target: ATXN1; (-) strand; PAM type: YTN; PAM sequence: CTG
ggagccagaggttgcagtga

SEQ ID NO: 177287 - DNA, 20 bp, Artificial Sequence
  Description of Artificial Sequence: Synthetic oligonucleotide
  Target: ATXN1; (-) strand; PAM type: YTN; PAM sequence: TTG
aacctgggagccagaggttg

SEQ ID NO: 177288 - DNA, 20 bp, Artificial Sequence
  Description of Artificial Sequence: Synthetic oligonucleotide
  Target: ATXN1; (-) strand; PAM type: YTN; PAM sequence: CTT
gaacctgggagccagaggtt

SEQ ID NO: 177289 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgaa

SEQ ID NO: 177290 - DNA, 20 bp, Artificial Sequence
  Description of Artificial Sequence: Synthetic oligonucleotide
  Target: ATXN1; (-) strand; PAM type: YTN; PAM sequence: CTC
cagaggctgaggcaggagaa

SEQ ID NO: 177291 - DNA, 20 bp, Artificial Sequence
  Description of Artificial Sequence: Synthetic oligonucleotide
  Target: ATXN1; (-) strand; PAM type: YTN; PAM sequence: CTA
ctccagaggctgaggcagga

SEQ ID NO: 177292 - DNA, 20 bp, Artificial Sequence
  Description of Artificial Sequence: Synthetic oligonucleotide
  Target: ATXN1; (-) strand; PAM type: YTN; PAM sequence: CTA
ctactccagaggctgaggca

SEQ ID NO: 177293 - DNA, 20 bp, Artificial Sequence
  Description of Artificial Sequence: Synthetic oligonucleotide
  Target: ATXN1; (-) strand; PAM type: YTN; PAM sequence: CTG
taatccctactactccagag

SEQ ID NO: 177294 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggtgagcgcctg

SEQ ID NO: 177295 - DNA, 20 bp, Artificial Sequence
  Description of Artificial Sequence: Synthetic oligonucleotide
  Target: ATXN1; (-) strand; PAM type: YTN; PAM sequence: CTA
aaaacacaaaaatgtgctgg

SEQ ID NO: 177296 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaaccccg

SEQ ID NO: 177297 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggccaacatg

SEQ ID NO: 177298 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggccaacat

SEQ ID NO: 177299 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagtttgagacca

SEQ ID NO: 177300 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcaggtggat

SEQ ID NO: 177301 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcaggtgga

SEQ ID NO: 177302 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcaggtgg

SEQ ID NO: 177303 - DNA, 20 bp, Artificial Sequence
  Description of Artificial Sequence: Synthetic oligonucleotide
  Target: ATXN1; (-) strand; PAM type: YTN; PAM sequence: CTC
aacactttgggaggccgagg

SEQ ID NO: 177304 - DNA, 20 bp, Artificial Sequence
  Description of Artificial Sequence: Synthetic oligonucleotide
  Target: ATXN1; (-) strand; PAM type: YTN; PAM sequence: CTA
taatctcaacactttgggag

SEQ ID NO: 177305 - DNA, 20 bp, Artificial Sequence
  Description of Artificial Sequence: Synthetic oligonucleotide
  Target: ATXN1; (-) strand; PAM type: YTN; PAM sequence: CTC
atgtctataatctcaacact

SEQ ID NO: 177306 - DNA, 20 bp, Artificial Sequence
  Description of Artificial Sequence: Synthetic oligonucleotide
  Target: ATXN1; (-) strand; PAM type: YTN; PAM sequence: CTG
agcatggtggctcatgtcta

SEQ ID NO: 177307 - DNA, 20 bp, Artificial Sequence
  Description of Artificial Sequence: Synthetic oligonucleotide
  Target: ATXN1; (-) strand; PAM type: YTN; PAM sequence: CTG
gtcagctgagcatggtggct

SEQ ID NO: 177308 - DNA, 20 bp, Artificial Sequence
  Description of Artificial Sequence: Synthetic oligonucleotide
  Target: ATXN1; (-) strand; PAM type: YTN; PAM sequence: CTA
gtcctggtcagctgagcatg

SEQ ID NO: 177309 - DNA, 20 bp, Artificial Sequence
  Description of Artificial Sequence: Synthetic oligonucleotide
  Target: ATXN1; (-) strand; PAM type: YTN; PAM sequence: TTA
ctagtcctggtcagctgagc

SEQ ID NO: 177310 - DNA, 20 bp, Artificial Sequence
  Description of Artificial Sequence: Synthetic oligonucleotide
  Target: ATXN1; (-) strand; PAM type: YTN; PAM sequence: CTA
ttactagtcctggtcagctg

SEQ ID NO: 177311 - DNA, 20 bp, Artificial Sequence
  Description of Artificial Sequence: Synthetic oligonucleotide
  Target: ATXN1; (-) strand; PAM type: YTN; PAM sequence: TTG
ctattactagtcctggtcag

SEQ ID NO: 177312 - DNA, 20 bp, Artificial Sequence
  Description of Artificial Sequence: Synthetic oligonucleotide
  Target: ATXN1; (-) strand; PAM type: YTN; PAM sequence: TTT
gctattactagtcctggtca

SEQ ID NO: 177313 - DNA, 20 bp, Artificial Sequence
  Description of Artificial Sequence: Synthetic oligonucleotide
  Target: ATXN1; (-) strand; PAM type: YTN; PAM sequence: TTG
caccaacccagtatttgcta

SEQ ID NO: 177314 - DNA, 20 bp, Artificial Sequence
  Description of Artificial Sequence: Synthetic oligonucleotide
  Target: ATXN1; (-) strand; PAM type: YTN; PAM sequence: TTT
gcaccaacccagtatttgct

SEQ ID NO: 177315 - DNA, 20 bp, Artificial Sequence
  Description of Artificial Sequence: Synthetic oligonucleotide
  Target: ATXN1; (-) strand; PAM type: YTN; PAM sequence: TTT
tgcaccaacccagtatttgc

SEQ ID NO: 177316 - DNA, 20 bp, Artificial Sequence
  Description of Artificial Sequence: Synthetic oligonucleotide
  Target: ATXN1; (-) strand; PAM type: YTN; PAM sequence: CTT
ttgcaccaacccagtatttg

SEQ ID NO: 177317 - DNA, 20 bp, Artificial Sequence
  Description of Artificial Sequence: Synthetic oligonucleotide
  Target: ATXN1; (-) strand; PAM type: YTN; PAM sequence: TTA
cttttgcaccaacccagtat

SEQ ID NO: 177318 - DNA, 20 bp, Artificial Sequence
  Description of Artificial Sequence: Synthetic oligonucleotide
  Target: ATXN1; (-) strand; PAM type: YTN; PAM sequence: TTC
aatggcaaaaaccacaatta

SEQ ID NO: 177319 - DNA, 20 bp, Artificial Sequence
  Description of Artificial Sequence: Synthetic oligonucleotide
  Target: ATXN1; (-) strand; PAM type: YTN; PAM sequence: TTT
caatggcaaaaaccacaatt

SEQ ID NO: 177320 - DNA, 20 bp, Artificial Sequence
  Description of Artificial Sequence: Synthetic oligonucleotide
  Target: ATXN1; (-) strand; PAM type: YTN; PAM sequence: CTT
tcaatggcaaaaaccacaat

SEQ ID NO: 177321 - DNA, 20 bp, Artificial Sequence
  Description of Artificial Sequence: Synthetic oligonucleotide
  Target: ATXN1; (-) strand; PAM type: YTN; PAM sequence: TTA
ctttcaatggcaaaaaccac

SEQ ID NO: 177322 - DNA, 20 bp, Artificial Sequence
  Description of Artificial Sequence: Synthetic oligonucleotide
  Target: ATXN1; (-) strand; PAM type: YTN; PAM sequence: TTG
ccattactttcaatggcaaa

SEQ ID NO: 177323 - DNA, 20 bp, Artificial Sequence
  Description of Artificial Sequence: Synthetic oligonucleotide
  Target: ATXN1; (-) strand; PAM type: YTN; PAM sequence: TTT
gccattactttcaatggcaa

SEQ ID NO: 177324 - DNA, 20 bp, Artificial Sequence
  Description of Artificial Sequence: Synthetic oligonucleotide
  Target: ATXN1; (-) strand; PAM type: YTN; PAM sequence: TTT
tgccattactttcaatggca

SEQ ID NO: 177325 - DNA, 20 bp, Artificial Sequence
  Description of Artificial Sequence: Synthetic oligonucleotide
  Target: ATXN1; (-) strand; PAM type: YTN; PAM sequence: TTG
tgattttgccattactttca

SEQ ID NO: 177326 - DNA, 20 bp, Artificial Sequence
  Description of Artificial Sequence: Synthetic oligonucleotide
  Target: ATXN1; (-) strand; PAM type: YTN; PAM sequence: TTG
gtgcaaaagtaattgtgatt

SEQ ID NO: 177327 - DNA, 20 bp, Artificial Sequence
  Description of Artificial Sequence: Synthetic oligonucleotide
  Target: ATXN1; (-) strand; PAM type: YTN; PAM sequence: TTA
tgttggtgcaaaagtaattg

SEQ ID NO: 177328 - DNA, 20 bp, Artificial Sequence
  Description of Artificial Sequence: Synthetic oligonucleotide
  Target: ATXN1; (-) strand; PAM type: YTN; PAM sequence: TTA
agaaatattatgttggtgca

SEQ ID NO: 177329 - DNA, 20 bp, Artificial Sequence
  Description of Artificial Sequence: Synthetic oligonucleotide
  Target: ATXN1; (-) strand; PAM type: YTN; PAM sequence: CTT
aagaaatattatgttggtgc

SEQ ID NO: 177330 - DNA, 20 bp, Artificial Sequence
  Description of Artificial Sequence: Synthetic oligonucleotide
  Target: ATXN1; (-) strand; PAM type: YTN; PAM sequence: TTG
gaacagtgcaagcgcttaag

SEQ ID NO: 177331 - DNA, 20 bp, Artificial Sequence
  Description of Artificial Sequence: Synthetic oligonucleotide
  Target: ATXN1; (-) strand; PAM type: YTN; PAM sequence: CTT
ggaacagtgcaagcgcttaa

SEQ ID NO: 177332 - DNA, 20 bp, Artificial Sequence
  Description of Artificial Sequence: Synthetic oligonucleotide
  Target: ATXN1; (-) strand; PAM type: YTN; PAM sequence: CTC
ttggaacagtgcaagcgctt

SEQ ID NO: 177333 - DNA, 20 bp, Artificial Sequence
  Description of Artificial Sequence: Synthetic oligonucleotide
  Target: ATXN1; (-) strand; PAM type: YTN; PAM sequence: TTA
aatgaatgtcaagctcttgg

SEQ ID NO: 177334 - DNA, 20 bp, Artificial Sequence
  Description of Artificial Sequence: Synthetic oligonucleotide
  Target: ATXN1; (-) strand; PAM type: YTN; PAM sequence: TTG
tgataattaaatgaatgtca

SEQ ID NO: 177335 - DNA, 20 bp, Artificial Sequence
  Description of Artificial Sequence: Synthetic oligonucleotide
  Target: ATXN1; (-) strand; PAM type: YTN; PAM sequence: TTG
ttgtgataattaaatgaatg

SEQ ID NO: 177336 - DNA, 20 bp, Artificial Sequence
  Description of Artificial Sequence: Synthetic oligonucleotide
  Target: ATXN1; (-) strand; PAM type: YTN; PAM sequence: CTC
aaaaagttgttgtgataatt

SEQ ID NO: 177337 - DNA, 20 bp, Artificial Sequence
  Description of Artificial Sequence: Synthetic oligonucleotide
  Target: ATXN1; (-) strand; PAM type: YTN; PAM sequence: CTA
cctcaaaaagttgttgtgat

SEQ ID NO: 177338 - DNA, 20 bp, Artificial Sequence
  Description of Artificial Sequence: Synthetic oligonucleotide
  Target: ATXN1; (-) strand; PAM type: YTN; PAM sequence: TTA
ataatgatagctacctcaaa

SEQ ID NO: 177339 - DNA, 20 bp, Artificial Sequence
  Description of Artificial Sequence: Synthetic oligonucleotide
  Target: ATXN1; (-) strand; PAM type: YTN; PAM sequence: CTT
aataatgatagctacctcaa

SEQ ID NO: 177340 - DNA, 20 bp, Artificial Sequence
  Description of Artificial Sequence: Synthetic oligonucleotide
  Target: ATXN1; (-) strand; PAM type: YTN; PAM sequence: TTG
gcttaataatgatagctacc

SEQ ID NO: 177341 - DNA, 20 bp, Artificial Sequence
  Description of Artificial Sequence: Synthetic oligonucleotide
  Target: ATXN1; (-) strand; PAM type: YTN; PAM sequence: CTT
ggcttaataatgatagctac

SEQ ID NO: 177342 - DNA, 20 bp, Artificial Sequence
  Description of Artificial Sequence: Synthetic oligonucleotide
  Target: ATXN1; (-) strand; PAM type: YTN; PAM sequence: TTG
caaacttggcttaataatga

SEQ ID NO: 177343 - DNA, 20 bp, Artificial Sequence
  Description of Artificial Sequence: Synthetic oligonucleotide
  Target: ATXN1; (-) strand; PAM type: YTN; PAM sequence: TTT
gcaaacttggcttaataatg

SEQ ID NO: 177344 - DNA, 20 bp, Artificial Sequence
  Description of Artificial Sequence: Synthetic oligonucleotide
  Target: ATXN1; (-) strand; PAM type: YTN; PAM sequence: CTC
atttgcaaacttggcttaat

SEQ ID NO: 177345 - DNA, 20 bp, Artificial Sequence
  Description of Artificial Sequence: Synthetic oligonucleotide
  Target: ATXN1; (-) strand; PAM type: YTN; PAM sequence: TTC
ctcatttgcaaacttggctt

SEQ ID NO: 177346 - DNA, 20 bp, Artificial Sequence
  Description of Artificial Sequence: Synthetic oligonucleotide
  Target: ATXN1; (-) strand; PAM type: YTN; PAM sequence: TTT
cctcatttgcaaacttggct

SEQ ID NO: 177347 - DNA, 20 bp, Artificial Sequence
  Description of Artificial Sequence: Synthetic oligonucleotide
  Target: ATXN1; (-) strand; PAM type: YTN; PAM sequence: CTT
tcctcatttgcaaacttggc

SEQ ID NO: 177348 - DNA, 20 bp, Artificial Sequence
  Description of Artificial Sequence: Synthetic oligonucleotide
  Target: ATXN1; (-) strand; PAM type: YTN; PAM sequence: CTC
ctttcctcatttgcaaactt

SEQ ID NO: 177349 - DNA, 20 bp, Artificial Sequence
  Description of Artificial Sequence: Synthetic oligonucleotide
  Target: ATXN1; (-) strand; PAM type: YTN; PAM sequence: CTG
tctcctttcctcatttgcaa

SEQ ID NO: 177350 - DNA, 20 bp, Artificial Sequence
  Description of Artificial Sequence: Synthetic oligonucleotide
  Target: ATXN1; (-) strand; PAM type: YTN; PAM sequence: CTC
cctgtctcctttcctcattt

SEQ ID NO: 177351 - DNA, 20 bp, Artificial Sequence
  Description of Artificial Sequence: Synthetic oligonucleotide
  Target: ATXN1; (-) strand; PAM type: YTN; PAM sequence: CTC
tccctgtctcctttcctcat

SEQ ID NO: 177352 - DNA, 20 bp, Artificial Sequence
  Description of Artificial Sequence: Synthetic oligonucleotide
  Target: ATXN1; (-) strand; PAM type: YTN; PAM sequence: CTG
aaactctccctgtctccttt

SEQ ID NO: 177353 - DNA, 20 bp, Artificial Sequence
  Description of Artificial Sequence: Synthetic oligonucleotide
  Target: ATXN1; (-) strand; PAM type: YTN; PAM sequence: TTG
gggtaagtgctgaaactctc

SEQ ID NO: 177354 - DNA, 20 bp, Artificial Sequence
  Description of Artificial Sequence: Synthetic oligonucleotide
  Target: ATXN1; (-) strand; PAM type: YTN; PAM sequence: CTG
taattggggtaagtgctgaa

SEQ ID NO: 177355 - DNA, 20 bp, Artificial Sequence
  Description of Artificial Sequence: Synthetic oligonucleotide
  Target: ATXN1; (-) strand; PAM type: YTN; PAM sequence: TTG
tgctgtaattggggtaagtg

SEQ ID NO: 177356 - DNA, 20 bp, Artificial Sequence
  Description of Artificial Sequence: Synthetic oligonucleotide
  Target: ATXN1; (-) strand; PAM type: YTN; PAM sequence: CTT
gtgctgtaattggggtaagt

SEQ ID NO: 177357 - DNA, 20 bp, Artificial Sequence
  Description of Artificial Sequence: Synthetic oligonucleotide
  Target: ATXN1; (-) strand; PAM type: YTN; PAM sequence: CTG
gcatcagcttgtgctgtaat

SEQ ID NO: 177358 - DNA, 20 bp, Artificial Sequence
  Description of Artificial Sequence: Synthetic oligonucleotide
  Target: ATXN1; (-) strand; PAM type: YTN; PAM sequence: CTC
tggcatcagcttgtgctgta

SEQ ID NO: 177359 - DNA, 20 bp, Artificial Sequence
  Description of Artificial Sequence: Synthetic oligonucleotide
  Target: ATXN1; (-) strand; PAM type: YTN; PAM sequence: CTC
cctctggcatcagcttgtgc

SEQ ID NO: 177360 - DNA, 20 bp, Artificial Sequence
  Description of Artificial Sequence: Synthetic oligonucleotide
  Target: ATXN1; (-) strand; PAM type: YTN; PAM sequence: TTC
aaatctccctctggcatcag

SEQ ID NO: 177361 - DNA, 20 bp, Artificial Sequence
  Description of Artificial Sequence: Synthetic oligonucleotide
  Target: ATXN1; (-) strand; PAM type: YTN; PAM sequence: CTG
ggttcaaatctccctctggc

SEQ ID NO: 177362 - DNA, 20 bp, Artificial Sequence
  Description of Artificial Sequence: Synthetic oligonucleotide
  Target: ATXN1; (-) strand; PAM type: YTN; PAM sequence: CTG
gagtgagccagcctgggttc

SEQ ID NO: 177363 - DNA, 20 bp, Artificial Sequence
  Description of Artificial Sequence: Synthetic oligonucleotide
  Target: ATXN1; (-) strand; PAM type: YTN; PAM sequence: TTA
gctggagtgagccagcctgg

SEQ ID NO: 177364 - DNA, 20 bp, Artificial Sequence
  Description of Artificial Sequence: Synthetic oligonucleotide
  Target: ATXN1; (-) strand; PAM type: YTN; PAM sequence: TTG
ggtgttagctggagtgagcc

SEQ ID NO: 177365 - DNA, 20 bp, Artificial Sequence
  Description of Artificial Sequence: Synthetic oligonucleotide
  Target: ATXN1; (-) strand; PAM type: YTN; PAM sequence: CTG
catgtgatggttgggtgtta

SEQ ID NO: 177366 - DNA, 20 bp, Artificial Sequence
  Description of Artificial Sequence: Synthetic oligonucleotide
  Target: ATXN1; (-) strand; PAM type: YTN; PAM sequence: TTA
gcagagcagggtggccctgc

SEQ ID NO: 177367 - DNA, 20 bp, Artificial Sequence
  Description of Artificial Sequence: Synthetic oligonucleotide
  Target: ATXN1; (-) strand; PAM type: YTN; PAM sequence: TTG
tgtgaatgtgttagcagagc

SEQ ID NO: 177368 - DNA, 20 bp, Artificial Sequence
  Description of Artificial Sequence: Synthetic oligonucleotide
  Target: ATXN1; (-) strand; PAM type: YTN; PAM sequence: CTG
gtgatgtgtagtgagttgtg

SEQ ID NO: 177369 - DNA, 20 bp, Artificial Sequence
  Description of Artificial Sequence: Synthetic oligonucleotide
  Target: ATXN1; (-) strand; PAM type: YTN; PAM sequence: TTA
ggagaaagcatcacgtcggt

SEQ ID NO: 177370 - DNA, 20 bp, Artificial Sequence
  Description of Artificial Sequence: Synthetic oligonucleotide
  Target: ATXN1; (-) strand; PAM type: YTN; PAM sequence: TTA
tggttaggagaaagcatcac

SEQ ID NO: 177371 - DNA, 20 bp, Artificial Sequence
  Description of Artificial Sequence: Synthetic oligonucleotide
  Target: ATXN1; (-) strand; PAM type: YTN; PAM sequence: TTT
atggttaggagaaagcatca

SEQ ID NO: 177372 - DNA, 20 bp, Artificial Sequence
  Description of Artificial Sequence: Synthetic oligonucleotide
  Target: ATXN1; (-) strand; PAM type: YTN; PAM sequence: TTA
tttatggttaggagaaagca

SEQ ID NO: 177373 - DNA, 20 bp, Artificial Sequence
  Description of Artificial Sequence: Synthetic oligonucleotide
  Target: ATXN1; (-) strand; PAM type: YTN; PAM sequence: TTA
ttatttatggttaggagaaa

SEQ ID NO: 177374 - DNA, 20 bp, Artificial Sequence
  Description of Artificial Sequence: Synthetic oligonucleotide
  Target: ATXN1; (-) strand; PAM type: YTN; PAM sequence: TTT
attatttatggttaggagaa

SEQ ID NO: 177375 - DNA, 20 bp, Artificial Sequence
  Description of Artificial Sequence: Synthetic oligonucleotide
  Target: ATXN1; (-) strand; PAM type: YTN; PAM sequence: CTT
tattatttatggttaggaga

SEQ ID NO: 177376 - DNA, 20 bp, Artificial Sequence
  Description of Artificial Sequence: Synthetic oligonucleotide
  Target: ATXN1; (-) strand; PAM type: YTN; PAM sequence: CTG
agtccctttattatttatgg

SEQ ID NO: 177377 - DNA, 20 bp, Artificial Sequence
  Description of Artificial Sequence: Synthetic oligonucleotide
  Target: ATXN1; (-) strand; PAM type: YTN; PAM sequence: TTC
tgagtccctttattatttat

SEQ ID NO: 177378 - DNA, 20 bp, Artificial Sequence
  Description of Artificial Sequence: Synthetic oligonucleotide
  Target: ATXN1; (-) strand; PAM type: YTN; PAM sequence: CTT
ctgagtccctttattattta

SEQ ID NO: 177379 - DNA, 20 bp, Artificial Sequence
  Description of Artificial Sequence: Synthetic oligonucleotide
  Target: ATXN1; (-) strand; PAM type: YTN; PAM sequence: TTG
gggcttctgagtccctttat

SEQ ID NO: 177380 - DNA, 20 bp, Artificial Sequence
  Description of Artificial Sequence: Synthetic oligonucleotide
  Target: ATXN1; (-) strand; PAM type: YTN; PAM sequence: CTT
ggggcttctgagtcccttta

SEQ ID NO: 177381 - DNA, 20 bp, Artificial Sequence
  Description of Artificial Sequence: Synthetic oligonucleotide
  Target: ATXN1; (-) strand; PAM type: YTN; PAM sequence: CTC
cccacttggggcttctgagt

SEQ ID NO: 177382 - DNA, 20 bp, Artificial Sequence
  Description of Artificial Sequence: Synthetic oligonucleotide
  Target: ATXN1; (-) strand; PAM type: YTN; PAM sequence: CTC
tccccacttggggcttctga

SEQ ID NO: 177383 - DNA, 20 bp, Artificial Sequence
  Description of Artificial Sequence: Synthetic oligonucleotide
  Target: ATXN1; (-) strand; PAM type: YTN; PAM sequence: TTA
acctctccccacttggggct

SEQ ID NO: 177384 - DNA, 20 bp, Artificial Sequence
  Description of Artificial Sequence: Synthetic oligonucleotide
  Target: ATXN1; (-) strand; PAM type: YTN; PAM sequence: CTA
accgcaaacccattaacctc

SEQ ID NO: 177385 - DNA, 20 bp, Artificial Sequence
  Description of Artificial Sequence: Synthetic oligonucleotide
  Target: ATXN1; (-) strand; PAM type: YTN; PAM sequence: TTC
taaccgcaaacccattaacc

SEQ ID NO: 177386 - DNA, 20 bp, Artificial Sequence
  Description of Artificial Sequence: Synthetic oligonucleotide
  Target: ATXN1; (-) strand; PAM type: YTN; PAM sequence: CTT
ctaaccgcaaacccattaac

SEQ ID NO: 177387 - DNA, 20 bp, Artificial Sequence
  Description of Artificial Sequence: Synthetic oligonucleotide
  Target: ATXN1; (-) strand; PAM type: YTN; PAM sequence: TTC
cgcaaagccttctaaccgca

SEQ ID NO: 177388 - DNA, 20 bp, Artificial Sequence
  Description of Artificial Sequence: Synthetic oligonucleotide
  Target: ATXN1; (-) strand; PAM type: YTN; PAM sequence: CTT
ccgcaaagccttctaaccgc

SEQ ID NO: 177389 - DNA, 20 bp, Artificial Sequence
  Description of Artificial Sequence: Synthetic oligonucleotide
  Target: ATXN1; (-) strand; PAM type: YTN; PAM sequence: CTC
ttccgcaaagccttctaacc

SEQ ID NO: 177390 - DNA, 20 bp, Artificial Sequence
  Description of Artificial Sequence: Synthetic oligonucleotide
  Target: ATXN1; (-) strand; PAM type: YTN; PAM sequence: CTC
ccatcccctcttccgcaaag

SEQ ID NO: 177391 - DNA, 20 bp, Artificial Sequence
  Description of Artificial Sequence: Synthetic oligonucleotide
  Target: ATXN1; (-) strand; PAM type: YTN; PAM sequence: TTC
agggcccagctcccatcccc

SEQ ID NO: 177392 - DNA, 20 bp, Artificial Sequence
  Description of Artificial Sequence: Synthetic oligonucleotide
  Target: ATXN1; (-) strand; PAM type: YTN; PAM sequence: CTT
cagggcccagctcccatccc

SEQ ID NO: 177393 - DNA, 20 bp, Artificial Sequence
  Description of Artificial Sequence: Synthetic oligonucleotide
  Target: ATXN1; (-) strand; PAM type: YTN; PAM sequence: CTA
cttcagggcccagctcccat

SEQ ID NO: 177394 - DNA, 20 bp, Artificial Sequence
  Description of Artificial Sequence: Synthetic oligonucleotide
  Target: ATXN1; (-) strand; PAM type: YTN; PAM sequence: CTC
tacttcagggcccagctccc

SEQ ID NO: 177395 - DNA, 20 bp, Artificial Sequence
  Description of Artificial Sequence: Synthetic oligonucleotide
  Target: ATXN1; (-) strand; PAM type: YTN; PAM sequence: TTC
ctctacttcagggcccagct

SEQ ID NO: 177396 - DNA, 20 bp, Artificial Sequence
  Description of Artificial Sequence: Synthetic oligonucleotide
  Target: ATXN1; (-) strand; PAM type: YTN; PAM sequence: CTT
cctctacttcagggcccagc

SEQ ID NO: 177397 - DNA, 20 bp, Artificial Sequence
  Description of Artificial Sequence: Synthetic oligonucleotide
  Target: ATXN1; (-) strand; PAM type: YTN; PAM sequence: CTG
acccagcccgtcaaaatcct

SEQ ID NO: 177398 - DNA, 20 bp, Artificial Sequence
  Description of Artificial Sequence: Synthetic oligonucleotide
  Target: ATXN1; (-) strand; PAM type: YTN; PAM sequence: CTC
catctgacccagcccgtcaa

SEQ ID NO: 177399 - DNA, 20 bp, Artificial Sequence
  Description of Artificial Sequence: Synthetic oligonucleotide
  Target: ATXN1; (-) strand; PAM type: YTN; PAM sequence: TTC
cctccatctgacccagcccg

SEQ ID NO: 177400 - DNA, 20 bp, Artificial Sequence
  Description of Artificial Sequence: Synthetic oligonucleotide
  Target: ATXN1; (-) strand; PAM type: YTN; PAM sequence: TTT
ccctccatctgacccagccc

SEQ ID NO: 177401 - DNA, 20 bp, Artificial Sequence
  Description of Artificial Sequence: Synthetic oligonucleotide
  Target: ATXN1; (-) strand; PAM type: YTN; PAM sequence: TTC
atcgccatatttccctccat

SEQ ID NO: 177402 - DNA, 20 bp, Artificial Sequence
  Description of Artificial Sequence: Synthetic oligonucleotide
  Target: ATXN1; (-) strand; PAM type: YTN; PAM sequence: CTG
tgcgtgttcatcgccatatt

SEQ ID NO: 177403 - DNA, 20 bp, Artificial Sequence
  Description of Artificial Sequence: Synthetic oligonucleotide
  Target: ATXN1; (-) strand; PAM type: YTN; PAM sequence: TTC
tgtgcgtgttcatcgccata

SEQ ID NO: 177404 - DNA, 20 bp, Artificial Sequence
  Description of Artificial Sequence: Synthetic oligonucleotide
  Target: ATXN1; (-) strand; PAM type: YTN; PAM sequence: CTA
atgttctgtgcgtgttcatc

SEQ ID NO: 177405 - DNA, 20 bp, Artificial Sequence
  Description of Artificial Sequence: Synthetic oligonucleotide
  Target: ATXN1; (-) strand; PAM type: YTN; PAM sequence: TTC
taatgttctgtgcgtgttca

SEQ ID NO: 177406 - DNA, 20 bp, Artificial Sequence
  Description of Artificial Sequence: Synthetic oligonucleotide
  Target: ATXN1; (-) strand; PAM type: YTN; PAM sequence: TTG
taattctaatgttctgtgcg

SEQ ID NO: 177407 - DNA, 20 bp, Artificial Sequence
  Description of Artificial Sequence: Synthetic oligonucleotide
  Target: ATXN1; (-) strand; PAM type: YTN; PAM sequence: TTC
acattgtaattctaatgttc

SEQ ID NO: 177408 - DNA, 20 bp, Artificial Sequence
  Description of Artificial Sequence: Synthetic oligonucleotide
  Target: ATXN1; (-) strand; PAM type: YTN; PAM sequence: CTT
cacattgtaattctaatgtt

SEQ ID NO: 177409 - DNA, 20 bp, Artificial Sequence
  Description of Artificial Sequence: Synthetic oligonucleotide
  Target: ATXN1; (-) strand; PAM type: YTN; PAM sequence: TTA
cttcacattgtaattctaat

SEQ ID NO: 177410 - DNA, 20 bp, Artificial Sequence
  Description of Artificial Sequence: Synthetic oligonucleotide
  Target: ATXN1; (-) strand; PAM type: YTN; PAM sequence: CTT
acttcacattgtaattctaa

SEQ ID NO: 177411 - DNA, 20 bp, Artificial Sequence
  Description of Artificial Sequence: Synthetic oligonucleotide
  Target: ATXN1; (-) strand; PAM type: YTN; PAM sequence: CTA
tgtcccaaccaaaccttact

SEQ ID NO: 177412 - DNA, 20 bp, Artificial Sequence
  Description of Artificial Sequence: Synthetic oligonucleotide
  Target: ATXN1; (-) strand; PAM type: YTN; PAM sequence: CTG
gcagcctatgtcccaaccaa

SEQ ID NO: 177413 - DNA, 20 bp, Artificial Sequence
  Description of Artificial Sequence: Synthetic oligonucleotide
  Target: ATXN1; (-) strand; PAM type: YTN; PAM sequence: CTC
cactggcagcctatgtccca

SEQ ID NO: 177414 - DNA, 20 bp, Artificial Sequence
  Description of Artificial Sequence: Synthetic oligonucleotide
  Target: ATXN1; (-) strand; PAM type: YTN; PAM sequence: CTG
ctccactggcagcctatgtc

SEQ ID NO: 177415 - DNA, 20 bp, Artificial Sequence
  Description of Artificial Sequence: Synthetic oligonucleotide
  Target: ATXN1; (-) strand; PAM type: YTN; PAM sequence: CTC
gccgcccccactgctccact

SEQ ID NO: 177416 - DNA, 20 bp, Artificial Sequence
  Description of Artificial Sequence: Synthetic oligonucleotide
  Target: ATXN1; (-) strand; PAM type: YTN; PAM sequence: CTA
ccctcgccgcccccactgct

SEQ ID NO: 177417 - DNA, 20 bp, Artificial Sequence
  Description of Artificial Sequence: Synthetic oligonucleotide
  Target: ATXN1; (-) strand; PAM type: YTN; PAM sequence: CTC
ccacccccctaccctcgccg

SEQ ID NO: 177418 - DNA, 20 bp, Artificial Sequence
  Description of Artificial Sequence: Synthetic oligonucleotide
  Target: ATXN1; (-) strand; PAM type: YTN; PAM sequence: CTA
gtgaggagggaacaggtgca

SEQ ID NO: 177419 - DNA, 20 bp, Artificial Sequence
  Description of Artificial Sequence: Synthetic oligonucleotide
  Target: ATXN1; (-) strand; PAM type: YTN; PAM sequence: CTC
catcacctagtgaggaggga

SEQ ID NO: 177420 - DNA, 20 bp, Artificial Sequence
  Description of Artificial Sequence: Synthetic oligonucleotide
  Target: ATXN1; (-) strand; PAM type: YTN; PAM sequence: CTG
cctccatcacctagtgagga

SEQ ID NO: 177421 - DNA, 20 bp, Artificial Sequence
  Description of Artificial Sequence: Synthetic oligonucleotide
  Target: ATXN1; (-) strand; PAM type: YTN; PAM sequence: CTC
tgcctccatcacctagtgag

SEQ ID NO: 177422 - DNA, 20 bp, Artificial Sequence
  Description of Artificial Sequence: Synthetic oligonucleotide
  Target: ATXN1; (-) strand; PAM type: YTN; PAM sequence: CTC
tctgcctccatcacctagtg

SEQ ID NO: 177423 - DNA, 20 bp, Artificial Sequence
  Description of Artificial Sequence: Synthetic oligonucleotide
  Target: ATXN1; (-) strand; PAM type: YTN; PAM sequence: TTC
agtgtcctctctgcctccat

SEQ ID NO: 177424 - DNA, 20 bp, Artificial Sequence
  Description of Artificial Sequence: Synthetic oligonucleotide
  Target: ATXN1; (-) strand; PAM type: YTN; PAM sequence: CTT
cagtgtcctctctgcctcca

SEQ ID NO: 177425 - DNA, 20 bp, Artificial Sequence
  Description of Artificial Sequence: Synthetic oligonucleotide
  Target: ATXN1; (-) strand; PAM type: YTN; PAM sequence: CTC
ttcagtgtcctctctgcctc

SEQ ID NO: 177426 - DNA, 20 bp, Artificial Sequence
  Description of Artificial Sequence: Synthetic oligonucleotide
  Target: ATXN1; (-) strand; PAM type: YTN; PAM sequence: CTC
tcttcagtgtcctctctgcc

SEQ ID NO: 177427 - DNA, 20 bp, Artificial Sequence
  Description of Artificial Sequence: Synthetic oligonucleotide
  Target: ATXN1; (-) strand; PAM type: YTN; PAM sequence: CTC
ctctcttcagtgtcctctct

SEQ ID NO: 177428 - DNA, 20 bp, Artificial Sequence
  Description of Artificial Sequence: Synthetic oligonucleotide
  Target: ATXN1; (-) strand; PAM type: YTN; PAM sequence: CTC
atgtctcctctcttcagtgt

SEQ ID NO: 177429 - DNA, 20 bp, Artificial Sequence
  Description of Artificial Sequence: Synthetic oligonucleotide
  Target: ATXN1; (-) strand; PAM type: YTN; PAM sequence: TTA
ggaaatgatgcaccagggcc

SEQ ID NO: 177430 - DNA, 20 bp, Artificial Sequence
  Description of Artificial Sequence: Synthetic oligonucleotide
  Target: ATXN1; (-) strand; PAM type: YTN; PAM sequence: CTT
aggaaatgatgcaccagggc

SEQ ID NO: 177431 - DNA, 20 bp, Artificial Sequence
  Description of Artificial Sequence: Synthetic oligonucleotide
  Target: ATXN1; (-) strand; PAM type: YTN; PAM sequence: TTC
ttaggaaatgatgcaccagg

SEQ ID NO: 177432 - DNA, 20 bp, Artificial Sequence
  Description of Artificial Sequence: Synthetic oligonucleotide
  Target: ATXN1; (-) strand; PAM type: YTN; PAM sequence: TTA
gggttcttaggaaatgatgc

SEQ ID NO: 177433 - DNA, 20 bp, Artificial Sequence
  Description of Artificial Sequence: Synthetic oligonucleotide
  Target: ATXN1; (-) strand; PAM type: YTN; PAM sequence: TTT
agggttcttaggaaatgatg

SEQ ID NO: 177434 - DNA, 20 bp, Artificial Sequence
  Description of Artificial Sequence: Synthetic oligonucleotide
  Target: ATXN1; (-) strand; PAM type: YTN; PAM sequence: TTA
aatttagggttcttaggaaa

SEQ ID NO: 177435 - DNA, 20 bp, Artificial Sequence
  Description of Artificial Sequence: Synthetic oligonucleotide
  Target: ATXN1; (-) strand; PAM type: YTN; PAM sequence: TTT
aaatttagggttcttaggaa

SEQ ID NO: 177436 - DNA, 20 bp, Artificial Sequence
  Description of Artificial Sequence: Synthetic oligonucleotide
  Target: ATXN1; (-) strand; PAM type: YTN; PAM sequence: CTA
tggggaagaaatagtagggc

SEQ ID NO: 177437 - DNA, 20 bp, Artificial Sequence
  Description of Artificial Sequence: Synthetic oligonucleotide
  Target: ATXN1; (-) strand; PAM type: YTN; PAM sequence: CTG
tctatggggaagaaatagta

SEQ ID NO: 177438 - DNA, 20 bp, Artificial Sequence
  Description of Artificial Sequence: Synthetic oligonucleotide
  Target: ATXN1; (-) strand; PAM type: YTN; PAM sequence: CTC
tgtctatggggaagaaatag

SEQ ID NO: 177439 - DNA, 20 bp, Artificial Sequence
  Description of Artificial Sequence: Synthetic oligonucleotide
  Target: ATXN1; (-) strand; PAM type: YTN; PAM sequence: CTA
agggatctctgtctatgggg

SEQ ID NO: 177440 - DNA, 20 bp, Artificial Sequence
  Description of Artificial Sequence: Synthetic oligonucleotide
  Target: ATXN1; (-) strand; PAM type: YTN; PAM sequence: TTG
aaagaactaagggatctctg

SEQ ID NO: 177441 - DNA, 20 bp, Artificial Sequence
  Description of Artificial Sequence: Synthetic oligonucleotide
  Target: ATXN1; (-) strand; PAM type: YTN; PAM sequence: TTT
gaaagaactaagggatctct

SEQ ID NO: 177442 - DNA, 20 bp, Artificial Sequence
  Description of Artificial Sequence: Synthetic oligonucleotide
  Target: ATXN1; (-) strand; PAM type: YTN; PAM sequence: CTA
cagtcagtaaggaaaaagga

SEQ ID NO: 177443 - DNA, 20 bp, Artificial Sequence
  Description of Artificial Sequence: Synthetic oligonucleotide
  Target: ATXN1; (-) strand; PAM type: YTN; PAM sequence: CTC
tacagtcagtaaggaaaaag

SEQ ID NO: 177444 - DNA, 20 bp, Artificial Sequence
  Description of Artificial Sequence: Synthetic oligonucleotide
  Target: ATXN1; (-) strand; PAM type: YTN; PAM sequence: TTG
gggtctctacagtcagtaag

SEQ ID NO: 177445 - DNA, 20 bp, Artificial Sequence
  Description of Artificial Sequence: Synthetic oligonucleotide
  Target: ATXN1; (-) strand; PAM type: YTN; PAM sequence: CTT
ggggtctctacagtcagtaa

SEQ ID NO: 177446 - DNA, 20 bp, Artificial Sequence
  Description of Artificial Sequence: Synthetic oligonucleotide
  Target: ATXN1; (-) strand; PAM type: YTN; PAM sequence: TTG
cagtgccagtgagaaacttg

SEQ ID NO: 177447 - DNA, 20 bp, Artificial Sequence
  Description of Artificial Sequence: Synthetic oligonucleotide
  Target: ATXN1; (-) strand; PAM type: YTN; PAM sequence: TTT
gcagtgccagtgagaaactt

SEQ ID NO: 177448 - DNA, 20 bp, Artificial Sequence
  Description of Artificial Sequence: Synthetic oligonucleotide
  Target: ATXN1; (-) strand; PAM type: YTN; PAM sequence: TTT
tgcagtgccagtgagaaact

SEQ ID NO: 177449 - DNA, 20 bp, Artificial Sequence
  Description of Artificial Sequence: Synthetic oligonucleotide
  Target: ATXN1; (-) strand; PAM type: YTN; PAM sequence: CTG
catatattttgcagtgccag

SEQ ID NO: 177450 - DNA, 20 bp, Artificial Sequence
  Description of Artificial Sequence: Synthetic oligonucleotide
  Target: ATXN1; (-) strand; PAM type: YTN; PAM sequence: TTC
tgcatatattttgcagtgcc

SEQ ID NO: 177451 - DNA, 20 bp, Artificial Sequence
  Description of Artificial Sequence: Synthetic oligonucleotide
  Target: ATXN1; (-) strand; PAM type: YTN; PAM sequence: TTT
ctgcatatattttgcagtgc

SEQ ID NO: 177452 - DNA, 20 bp, Artificial Sequence
  Description of Artificial Sequence: Synthetic oligonucleotide
  Target: ATXN1; (-) strand; PAM type: YTN; PAM sequence: CTG
tcaaatttctgcatatattt

SEQ ID NO: 177453 - DNA, 20 bp, Artificial Sequence
  Description of Artificial Sequence: Synthetic oligonucleotide
  Target: ATXN1; (-) strand; PAM type: YTN; PAM sequence: TTA
tcacccactgtcaaatttct

SEQ ID NO: 177454 - DNA, 20 bp, Artificial Sequence
  Description of Artificial Sequence: Synthetic oligonucleotide
  Target: ATXN1; (-) strand; PAM type: YTN; PAM sequence: CTG
ttatcacccactgtcaaatt

SEQ ID NO: 177455 - DNA, 20 bp, Artificial Sequence
  Description of Artificial Sequence: Synthetic oligonucleotide
  Target: ATXN1; (-) strand; PAM type: YTN; PAM sequence: CTC
caaacatcctgttatcaccc

SEQ ID NO: 177456 - DNA, 20 bp, Artificial Sequence
  Description of Artificial Sequence: Synthetic oligonucleotide
  Target: ATXN1; (-) strand; PAM type: YTN; PAM sequence: CTA
aaaggactccaaacatcctg

SEQ ID NO: 177457 - DNA, 20 bp, Artificial Sequence
  Description of Artificial Sequence: Synthetic oligonucleotide
  Target: ATXN1; (-) strand; PAM type: YTN; PAM sequence: TTA
atgctaaaaggactccaaac

SEQ ID NO: 177458 - DNA, 20 bp, Artificial Sequence
  Description of Artificial Sequence: Synthetic oligonucleotide
  Target: ATXN1; (-) strand; PAM type: YTN; PAM sequence: TTT
aatgctaaaaggactccaaa

SEQ ID NO: 177459 - DNA, 20 bp, Artificial Sequence
  Description of Artificial Sequence: Synthetic oligonucleotide
  Target: ATXN1; (-) strand; PAM type: YTN; PAM sequence: TTT
taatgctaaaaggactccaa

SEQ ID NO: 177460 - DNA, 20 bp, Artificial Sequence
  Description of Artificial Sequence: Synthetic oligonucleotide
  Target: ATXN1; (-) strand; PAM type: YTN; PAM sequence: TTT
ttaatgctaaaaggactcca

SEQ ID NO: 177461 - DNA, 20 bp, Artificial Sequence
  Description of Artificial Sequence: Synthetic oligonucleotide
  Target: ATXN1; (-) strand; PAM type: YTN; PAM sequence: TTT
tttaatgctaaaaggactcc

SEQ ID NO: 177462 - DNA, 20 bp, Artificial Sequence
  Description of Artificial Sequence: Synthetic oligonucleotide
  Target: ATXN1; (-) strand; PAM type: YTN; PAM sequence: TTT
ttttaatgctaaaaggactc

SEQ ID NO: 177463 - DNA, 20 bp, Artificial Sequence
  Description of Artificial Sequence: Synthetic oligonucleotide
  Target: ATXN1; (-) strand; PAM type: YTN; PAM sequence: TTT
tttttaatgctaaaaggact

SEQ ID NO: 177464 - DNA, 20 bp, Artificial Sequence
  Description of Artificial Sequence: Synthetic oligonucleotide
  Target: ATXN1; (-) strand; PAM type: YTN; PAM sequence: TTT
ttttttaatgctaaaaggac

SEQ ID NO: 177465 - DNA, 20 bp, Artificial Sequence
  Description of Artificial Sequence: Synthetic oligonucleotide
  Target: ATXN1; (-) strand; PAM type: YTN; PAM sequence: TTT
tttttttaatgctaaaagga

SEQ ID NO: 177466 - DNA, 20 bp, Artificial Sequence
  Description of Artificial Sequence: Synthetic oligonucleotide
  Target: ATXN1; (-) strand; PAM type: YTN; PAM sequence: TTT
ttttttttaatgctaaaagg

SEQ ID NO: 177467 - DNA, 20 bp, Artificial Sequence
  Description of Artificial Sequence: Synthetic oligonucleotide
  Target: ATXN1; (-) strand; PAM type: YTN; PAM sequence: TTG
tttttttttttaatgctaaa

SEQ ID NO: 177468 - DNA, 20 bp, Artificial Sequence
  Description of Artificial Sequence: Synthetic oligonucleotide
  Target: ATXN1; (-) strand; PAM type: YTN; PAM sequence: CTG
gttgtttttttttttaatgc

SEQ ID NO: 177469 - DNA, 20 bp, Artificial Sequence
  Description of Artificial Sequence: Synthetic oligonucleotide
  Target: ATXN1; (-) strand; PAM type: YTN; PAM sequence: CTA
ctggttgtttttttttttaa

SEQ ID NO: 177470 - DNA, 20 bp, Artificial Sequence
  Description of Artificial Sequence: Synthetic oligonucleotide
  Target: ATXN1; (-) strand; PAM type: YTN; PAM sequence: TTG
ctactggttgtttttttttt

SEQ ID NO: 177471 - DNA, 20 bp, Artificial Sequence
  Description of Artificial Sequence: Synthetic oligonucleotide
  Target: ATXN1; (-) strand; PAM type: YTN; PAM sequence: CTA
ttgctactggttgttttttt

SEQ ID NO: 177472 - DNA, 20 bp, Artificial Sequence
  Description of Artificial Sequence: Synthetic oligonucleotide
  Target: ATXN1; (-) strand; PAM type: YTN; PAM sequence: CTG
atgctattgctactggttgt

SEQ ID NO: 177473 - DNA, 20 bp, Artificial Sequence
  Description of Artificial Sequence: Synthetic oligonucleotide
  Target: ATXN1; (-) strand; PAM type: YTN; PAM sequence: CTC
tgatgctattgctactggtt

SEQ ID NO: 177474 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaacg

SEQ ID NO: 177475 - DNA, 20 bp, Artificial Sequence
  Description of Artificial Sequence: Synthetic oligonucleotide
  Target: ATXN1; (-) strand; PAM type: YTN; PAM sequence: TTC
tcaaaaaaaaaaaaaaaaaa

SEQ ID NO: 177476 - DNA, 20 bp, Artificial Sequence
  Description of Artificial Sequence: Synthetic oligonucleotide
  Target: ATXN1; (-) strand; PAM type: YTN; PAM sequence: TTT
ctcaaaaaaaaaaaaaaaaa

SEQ ID NO: 177477 - DNA, 20 bp, Artificial Sequence
  Description of Artificial Sequence: Synthetic oligonucleotide
  Target: ATXN1; (-) strand; PAM type: YTN; PAM sequence: CTT
tctcaaaaaaaaaaaaaaaa

SEQ ID NO: 177478 - DNA, 20 bp, Artificial Sequence
  Description of Artificial Sequence: Synthetic oligonucleotide
  Target: ATXN1; (-) strand; PAM type: YTN; PAM sequence: CTC
tttctcaaaaaaaaaaaaaa

SEQ ID NO: 177479 - DNA, 20 bp, Artificial Sequence
  Description of Artificial Sequence: Synthetic oligonucleotide
  Target: ATXN1; (-) strand; PAM type: YTN; PAM sequence: CTG
gaggagactctttctcaaaa

SEQ ID NO: 177480 - DNA, 20 bp, Artificial Sequence
  Description of Artificial Sequence: Synthetic oligonucleotide
  Target: ATXN1; (-) strand; PAM type: YTN; PAM sequence: CTC
cagcctggaggagactcttt

SEQ ID NO: 177481 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggaggagac

SEQ ID NO: 177482 - DNA, 20 bp, Artificial Sequence
  Description of Artificial Sequence: Synthetic oligonucleotide
  Target: ATXN1; (-) strand; PAM type: YTN; PAM sequence: CTG
agatcgtaccactgcactcc

SEQ ID NO: 177483 - DNA, 20 bp, Artificial Sequence
  Description of Artificial Sequence: Synthetic oligonucleotide
  Target: ATXN1; (-) strand; PAM type: YTN; PAM sequence: TTG
cagtcagctgagatcgtacc

SEQ ID NO: 177484 - DNA, 20 bp, Artificial Sequence
  Description of Artificial Sequence: Synthetic oligonucleotide
  Target: ATXN1; (-) strand; PAM type: YTN; PAM sequence: CTG
ggaggcggaggttgcagtca

SEQ ID NO: 177485 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcggaggttg

SEQ ID NO: 177486 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcggaggtt

SEQ ID NO: 177487 - DNA, 20 bp, Artificial Sequence
  Description of Artificial Sequence: Synthetic oligonucleotide
  Target: ATXN1; (-) strand; PAM type: YTN; PAM sequence: CTA
aggcatgagaatcacttgaa

SEQ ID NO: 177488 - DNA, 20 bp, Artificial Sequence
  Description of Artificial Sequence: Synthetic oligonucleotide
  Target: ATXN1; (-) strand; PAM type: YTN; PAM sequence: TTG
ggaggctaaggcatgagaat

SEQ ID NO: 177489 - DNA, 20 bp, Artificial Sequence
  Description of Artificial Sequence: Synthetic oligonucleotide
  Target: ATXN1; (-) strand; PAM type: YTN; PAM sequence: CTT
gggaggctaaggcatgagaa

SEQ ID NO: 177490 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctaaggcatga

SEQ ID NO: 177491 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 177492 - DNA, 20 bp, Artificial Sequence
  Description of Artificial Sequence: Synthetic oligonucleotide
  Target: ATXN1; (-) strand; PAM type: YTN; PAM sequence: TTA
gccaggcgtggtggtgggca

SEQ ID NO: 177493 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagccag

SEQ ID NO: 177494 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 177495 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 177496 - DNA, 20 bp, Artificial Sequence
  Description of Artificial Sequence: Synthetic oligonucleotide
  Target: ATXN1; (-) strand; PAM type: YTN; PAM sequence: CTA
tctctactaaaaatacaaaa

SEQ ID NO: 177497 - DNA, 20 bp, Artificial Sequence
  Description of Artificial Sequence: Synthetic oligonucleotide
  Target: ATXN1; (-) strand; PAM type: YTN; PAM sequence: CTG
gccaacatggcaaaacccta

SEQ ID NO: 177498 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggccaacatg

SEQ ID NO: 177499 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggccaacat

SEQ ID NO: 177500 - DNA, 20 bp, Artificial Sequence
  Description of Artificial Sequence: Synthetic oligonucleotide
  Target: ATXN1; (-) strand; PAM type: YTN; PAM sequence: CTG
aggccaggagtttgagacca

SEQ ID NO: 177501 - DNA, 20 bp, Artificial Sequence
  Description of Artificial Sequence: Synthetic oligonucleotide
  Target: ATXN1; (-) strand; PAM type: YTN; PAM sequence: TTG
ggaggccgagatgggtggat

SEQ ID NO: 177502 - DNA, 20 bp, Artificial Sequence
  Description of Artificial Sequence: Synthetic oligonucleotide
  Target: ATXN1; (-) strand; PAM type: YTN; PAM sequence: TTT
gggaggccgagatgggtgga

SEQ ID NO: 177503 - DNA, 20 bp, Artificial Sequence
  Description of Artificial Sequence: Synthetic oligonucleotide
  Target: ATXN1; (-) strand; PAM type: YTN; PAM sequence: TTT
tgggaggccgagatgggtgg

SEQ ID NO: 177504 - DNA, 20 bp, Artificial Sequence
  Description of Artificial Sequence: Synthetic oligonucleotide
  Target: ATXN1; (-) strand; PAM type: YTN; PAM sequence: CTC
agcattttgggaggccgaga

SEQ ID NO: 177505 - DNA, 20 bp, Artificial Sequence
  Description of Artificial Sequence: Synthetic oligonucleotide
  Target: ATXN1; (-) strand; PAM type: YTN; PAM sequence: CTG
taatctcagcattttgggag

SEQ ID NO: 177506 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatctcagcatt

SEQ ID NO: 177507 - DNA, 20 bp, Artificial Sequence
  Description of Artificial Sequence: Synthetic oligonucleotide
  Target: ATXN1; (-) strand; PAM type: YTN; PAM sequence: CTC
agtggctcacacctgtaatc

SEQ ID NO: 177508 - DNA, 20 bp, Artificial Sequence
  Description of Artificial Sequence: Synthetic oligonucleotide
  Target: ATXN1; (-) strand; PAM type: YTN; PAM sequence: CTC
cagccaggctcagtggctca

SEQ ID NO: 177509 - DNA, 20 bp, Artificial Sequence
  Description of Artificial Sequence: Synthetic oligonucleotide
  Target: ATXN1; (-) strand; PAM type: YTN; PAM sequence: CTA
tgataagagaaaactccagc

SEQ ID NO: 177510 - DNA, 20 bp, Artificial Sequence
  Description of Artificial Sequence: Synthetic oligonucleotide
  Target: ATXN1; (-) strand; PAM type: YTN; PAM sequence: TTC
tatgataagagaaaactcca

SEQ ID NO: 177511 - DNA, 20 bp, Artificial Sequence
  Description of Artificial Sequence: Synthetic oligonucleotide
  Target: ATXN1; (-) strand; PAM type: YTN; PAM sequence: CTT
ctatgataagagaaaactcc

SEQ ID NO: 177512 - DNA, 20 bp, Artificial Sequence
  Description of Artificial Sequence: Synthetic oligonucleotide
  Target: ATXN1; (-) strand; PAM type: YTN; PAM sequence: CTC
atagaaacacagaatgcttc

SEQ ID NO: 177513 - DNA, 20 bp, Artificial Sequence
  Description of Artificial Sequence: Synthetic oligonucleotide
  Target: ATXN1; (-) strand; PAM type: YTN; PAM sequence: CTA
aaactcatagaaacacagaa

SEQ ID NO: 177514 - DNA, 20 bp, Artificial Sequence
  Description of Artificial Sequence: Synthetic oligonucleotide
  Target: ATXN1; (-) strand; PAM type: YTN; PAM sequence: TTA
tgtggatcgaatgggcctaa

SEQ ID NO: 177515 - DNA, 20 bp, Artificial Sequence
  Description of Artificial Sequence: Synthetic oligonucleotide
  Target: ATXN1; (-) strand; PAM type: YTN; PAM sequence: TTT
atgtggatcgaatgggccta

SEQ ID NO: 177516 - DNA, 20 bp, Artificial Sequence
  Description of Artificial Sequence: Synthetic oligonucleotide
  Target: ATXN1; (-) strand; PAM type: YTN; PAM sequence: TTT
tatgtggatcgaatgggcct

SEQ ID NO: 177517 - DNA, 20 bp, Artificial Sequence
  Description of Artificial Sequence: Synthetic oligonucleotide
  Target: ATXN1; (-) strand; PAM type: YTN; PAM sequence: TTT
ttatgtggatcgaatgggcc

SEQ ID NO: 177518 - DNA, 20 bp, Artificial Sequence
  Description of Artificial Sequence: Synthetic oligonucleotide
  Target: ATXN1; (-) strand; PAM type: YTN; PAM sequence: CTG
cggtttttatgtggatcgaa

SEQ ID NO: 177519 - DNA, 20 bp, Artificial Sequence
  Description of Artificial Sequence: Synthetic oligonucleotide
  Target: ATXN1; (-) strand; PAM type: YTN; PAM sequence: CTG
ctgcggtttttatgtggatc

SEQ ID NO: 177520 - DNA, 20 bp, Artificial Sequence
  Description of Artificial Sequence: Synthetic oligonucleotide
  Target: ATXN1; (-) strand; PAM type: YTN; PAM sequence: TTG
tcaagagggaggtggtaata

SEQ ID NO: 177521 - DNA, 20 bp, Artificial Sequence
  Description of Artificial Sequence: Synthetic oligonucleotide
  Target: ATXN1; (-) strand; PAM type: YTN; PAM sequence: TTT
gtcaagagggaggtggtaat

SEQ ID NO: 177522 - DNA, 20 bp, Artificial Sequence
  Description of Artificial Sequence: Synthetic oligonucleotide
  Target: ATXN1; (-) strand; PAM type: YTN; PAM sequence: CTC
catgcccccgtttgtcaaga

SEQ ID NO: 177523 - DNA, 20 bp, Artificial Sequence
  Description of Artificial Sequence: Synthetic oligonucleotide
  Target: ATXN1; (-) strand; PAM type: YTN; PAM sequence: CTG
tgcctccatgcccccgtttg

SEQ ID NO: 177524 - DNA, 20 bp, Artificial Sequence
  Description of Artificial Sequence: Synthetic oligonucleotide
  Target: ATXN1; (-) strand; PAM type: YTN; PAM sequence: CTG
cctgtgcctccatgcccccg

SEQ ID NO: 177525 - DNA, 20 bp, Artificial Sequence
  Description of Artificial Sequence: Synthetic oligonucleotide
  Target: ATXN1; (-) strand; PAM type: YTN; PAM sequence: CTG
aactgcctgtgcctccatgc

SEQ ID NO: 177526 - DNA, 20 bp, Artificial Sequence
  Description of Artificial Sequence: Synthetic oligonucleotide
  Target: ATXN1; (-) strand; PAM type: YTN; PAM sequence: TTC
agaaaagaatcactgaactg

SEQ ID NO: 177527 - DNA, 20 bp, Artificial Sequence
  Description of Artificial Sequence: Synthetic oligonucleotide
  Target: ATXN1; (-) strand; PAM type: YTN; PAM sequence: CTT
cagaaaagaatcactgaact

SEQ ID NO: 177528 - DNA, 20 bp, Artificial Sequence
  Description of Artificial Sequence: Synthetic oligonucleotide
  Target: ATXN1; (-) strand; PAM type: YTN; PAM sequence: CTC
cacgtcccacagtcaccacg

SEQ ID NO: 177529 - DNA, 20 bp, Artificial Sequence
  Description of Artificial Sequence: Synthetic oligonucleotide
  Target: ATXN1; (-) strand; PAM type: YTN; PAM sequence: TTG
agctccacgtcccacagtca

SEQ ID NO: 177530 - DNA, 20 bp, Artificial Sequence
  Description of Artificial Sequence: Synthetic oligonucleotide
  Target: ATXN1; (-) strand; PAM type: YTN; PAM sequence: TTT
gagctccacgtcccacagtc

SEQ ID NO: 177531 - DNA, 20 bp, Artificial Sequence
  Description of Artificial Sequence: Synthetic oligonucleotide
  Target: ATXN1; (-) strand; PAM type: YTN; PAM sequence: TTG
ggtttgagctccacgtccca

SEQ ID NO: 177532 - DNA, 20 bp, Artificial Sequence
  Description of Artificial Sequence: Synthetic oligonucleotide
  Target: ATXN1; (-) strand; PAM type: YTN; PAM sequence: CTT
gggtttgagctccacgtccc

SEQ ID NO: 177533 - DNA, 20 bp, Artificial Sequence
  Description of Artificial Sequence: Synthetic oligonucleotide
  Target: ATXN1; (-) strand; PAM type: YTN; PAM sequence: CTA
ggaatccacagacttgggtt

SEQ ID NO: 177534 - DNA, 20 bp, Artificial Sequence
  Description of Artificial Sequence: Synthetic oligonucleotide
  Target: ATXN1; (-) strand; PAM type: YTN; PAM sequence: CTC
cagctaggaatccacagact

SEQ ID NO: 177535 - DNA, 20 bp, Artificial Sequence
  Description of Artificial Sequence: Synthetic oligonucleotide
  Target: ATXN1; (-) strand; PAM type: YTN; PAM sequence: TTG
cctccagctaggaatccaca

SEQ ID NO: 177536 - DNA, 20 bp, Artificial Sequence
  Description of Artificial Sequence: Synthetic oligonucleotide
  Target: ATXN1; (-) strand; PAM type: YTN; PAM sequence: TTT
gcctccagctaggaatccac

SEQ ID NO: 177537 - DNA, 20 bp, Artificial Sequence
  Description of Artificial Sequence: Synthetic oligonucleotide
  Target: ATXN1; (-) strand; PAM type: YTN; PAM sequence: TTA
aaaatgtgatgtggtagaat

SEQ ID NO: 177538 - DNA, 20 bp, Artificial Sequence
  Description of Artificial Sequence: Synthetic oligonucleotide
  Target: ATXN1; (-) strand; PAM type: YTN; PAM sequence: CTT
aaaaatgtgatgtggtagaa

SEQ ID NO: 177539 - DNA, 20 bp, Artificial Sequence
  Description of Artificial Sequence: Synthetic oligonucleotide
  Target: ATXN1; (-) strand; PAM type: YTN; PAM sequence: TTC
aggcacgtgtacttaaaaat

SEQ ID NO: 177540 - DNA, 20 bp, Artificial Sequence
  Description of Artificial Sequence: Synthetic oligonucleotide
  Target: ATXN1; (-) strand; PAM type: YTN; PAM sequence: TTT
caggcacgtgtacttaaaaa

SEQ ID NO: 177541 - DNA, 20 bp, Artificial Sequence
  Description of Artificial Sequence: Synthetic oligonucleotide
  Target: ATXN1; (-) strand; PAM type: YTN; PAM sequence: TTT
tcaggcacgtgtacttaaaa

SEQ ID NO: 177542 - DNA, 20 bp, Artificial Sequence
  Description of Artificial Sequence: Synthetic oligonucleotide
  Target: ATXN1; (-) strand; PAM type: YTN; PAM sequence: CTT
ttcaggcacgtgtacttaaa

SEQ ID NO: 177543 - DNA, 20 bp, Artificial Sequence
  Description of Artificial Sequence: Synthetic oligonucleotide
  Target: ATXN1; (-) strand; PAM type: YTN; PAM sequence: CTG
agtggcaagcttttcaggca

SEQ ID NO: 177544 - DNA, 20 bp, Artificial Sequence
  Description of Artificial Sequence: Synthetic oligonucleotide
  Target: ATXN1; (-) strand; PAM type: YTN; PAM sequence: TTG
cctgagtggcaagcttttca

SEQ ID NO: 177545 - DNA, 20 bp, Artificial Sequence
  Description of Artificial Sequence: Synthetic oligonucleotide
  Target: ATXN1; (-) strand; PAM type: YTN; PAM sequence: TTT
gcctgagtggcaagcttttc

SEQ ID NO: 177546 - DNA, 20 bp, Artificial Sequence
  Description of Artificial Sequence: Synthetic oligonucleotide
  Target: ATXN1; (-) strand; PAM type: YTN; PAM sequence: TTT
tgcctgagtggcaagctttt

SEQ ID NO: 177547 - DNA, 20 bp, Artificial Sequence
  Description of Artificial Sequence: Synthetic oligonucleotide
  Target: ATXN1; (-) strand; PAM type: YTN; PAM sequence: TTG
tgattttgcctgagtggcaa

SEQ ID NO: 177548 - DNA, 20 bp, Artificial Sequence
  Description of Artificial Sequence: Synthetic oligonucleotide
  Target: ATXN1; (-) strand; PAM type: YTN; PAM sequence: TTA
ttgtgattttgcctgagtgg

SEQ ID NO: 177549 - DNA, 20 bp, Artificial Sequence
  Description of Artificial Sequence: Synthetic oligonucleotide
  Target: ATXN1; (-) strand; PAM type: YTN; PAM sequence: CTT
attgtgattttgcctgagtg

SEQ ID NO: 177550 - DNA, 20 bp, Artificial Sequence
  Description of Artificial Sequence: Synthetic oligonucleotide
  Target: ATXN1; (-) strand; PAM type: YTN; PAM sequence: CTG
agtcttattgtgattttgcc

SEQ ID NO: 177551 - DNA, 20 bp, Artificial Sequence
  Description of Artificial Sequence: Synthetic oligonucleotide
  Target: ATXN1; (-) strand; PAM type: YTN; PAM sequence: TTC
tgagtcttattgtgattttg

SEQ ID NO: 177552 - DNA, 20 bp, Artificial Sequence
  Description of Artificial Sequence: Synthetic oligonucleotide
  Target: ATXN1; (-) strand; PAM type: YTN; PAM sequence: TTA
cggattctgagtcttattgt

SEQ ID NO: 177553 - DNA, 20 bp, Artificial Sequence
  Description of Artificial Sequence: Synthetic oligonucleotide
  Target: ATXN1; (-) strand; PAM type: YTN; PAM sequence: CTT
acggattctgagtcttattg

SEQ ID NO: 177554 - DNA, 20 bp, Artificial Sequence
  Description of Artificial Sequence: Synthetic oligonucleotide
  Target: ATXN1; (-) strand; PAM type: YTN; PAM sequence: TTA
gtcgcttacggattctgagt

SEQ ID NO: 177555 - DNA, 20 bp, Artificial Sequence
  Description of Artificial Sequence: Synthetic oligonucleotide
  Target: ATXN1; (-) strand; PAM type: YTN; PAM sequence: TTT
agtcgcttacggattctgag

SEQ ID NO: 177556 - DNA, 20 bp, Artificial Sequence
  Description of Artificial Sequence: Synthetic oligonucleotide
  Target: ATXN1; (-) strand; PAM type: YTN; PAM sequence: CTC
caggcaaatttagtcgctta

SEQ ID NO: 177557 - DNA, 20 bp, Artificial Sequence
  Description of Artificial Sequence: Synthetic oligonucleotide
  Target: ATXN1; (-) strand; PAM type: YTN; PAM sequence: CTC
aacacccgccacaaaaataa

SEQ ID NO: 177558 - DNA, 20 bp, Artificial Sequence
  Description of Artificial Sequence: Synthetic oligonucleotide
  Target: ATXN1; (-) strand; PAM type: YTN; PAM sequence: CTC
agtctcaacacccgccacaa

SEQ ID NO: 177559 - DNA, 20 bp, Artificial Sequence
  Description of Artificial Sequence: Synthetic oligonucleotide
  Target: ATXN1; (-) strand; PAM type: YTN; PAM sequence: TTC
tcagtctcaacacccgccac

SEQ ID NO: 177560 - DNA, 20 bp, Artificial Sequence
  Description of Artificial Sequence: Synthetic oligonucleotide
  Target: ATXN1; (-) strand; PAM type: YTN; PAM sequence: CTA
ttctcagtctcaacacccgc

SEQ ID NO: 177561 - DNA, 20 bp, Artificial Sequence
  Description of Artificial Sequence: Synthetic oligonucleotide
  Target: ATXN1; (-) strand; PAM type: YTN; PAM sequence: CTC
tattctcagtctcaacaccc

SEQ ID NO: 177562 - DNA, 20 bp, Artificial Sequence
  Description of Artificial Sequence: Synthetic oligonucleotide
  Target: ATXN1; (-) strand; PAM type: YTN; PAM sequence: TTA
actctattctcagtctcaac

SEQ ID NO: 177563 - DNA, 20 bp, Artificial Sequence
  Description of Artificial Sequence: Synthetic oligonucleotide
  Target: ATXN1; (-) strand; PAM type: YTN; PAM sequence: TTT
aactctattctcagtctcaa

SEQ ID NO: 177564 - DNA, 20 bp, Artificial Sequence
  Description of Artificial Sequence: Synthetic oligonucleotide
  Target: ATXN1; (-) strand; PAM type: YTN; PAM sequence: CTA
acatttaactctattctcag

SEQ ID NO: 177565 - DNA, 20 bp, Artificial Sequence
  Description of Artificial Sequence: Synthetic oligonucleotide
  Target: ATXN1; (-) strand; PAM type: YTN; PAM sequence: TTC
ctaacatttaactctattct

SEQ ID NO: 177566 - DNA, 20 bp, Artificial Sequence
  Description of Artificial Sequence: Synthetic oligonucleotide
  Target: ATXN1; (-) strand; PAM type: YTN; PAM sequence: TTT
cctaacatttaactctattc

SEQ ID NO: 177567 - DNA, 20 bp, Artificial Sequence
  Description of Artificial Sequence: Synthetic oligonucleotide
  Target: ATXN1; (-) strand; PAM type: YTN; PAM sequence: TTT
tcctaacatttaactctatt

SEQ ID NO: 177568 - DNA, 20 bp, Artificial Sequence
  Description of Artificial Sequence: Synthetic oligonucleotide
  Target: ATXN1; (-) strand; PAM type: YTN; PAM sequence: TTT
ttcctaacatttaactctat

SEQ ID NO: 177569 - DNA, 20 bp, Artificial Sequence
  Description of Artificial Sequence: Synthetic oligonucleotide
  Target: ATXN1; (-) strand; PAM type: YTN; PAM sequence: TTT
tttcctaacatttaactcta

SEQ ID NO: 177570 - DNA, 20 bp, Artificial Sequence
  Description of Artificial Sequence: Synthetic oligonucleotide
  Target: ATXN1; (-) strand; PAM type: YTN; PAM sequence: TTT
ttttcctaacatttaactct

SEQ ID NO: 177571 - DNA, 20 bp, Artificial Sequence
  Description of Artificial Sequence: Synthetic oligonucleotide
  Target: ATXN1; (-) strand; PAM type: YTN; PAM sequence: TTC
agaatttttttcctaacatt

SEQ ID NO: 177572 - DNA, 20 bp, Artificial Sequence
  Description of Artificial Sequence: Synthetic oligonucleotide
  Target: ATXN1; (-) strand; PAM type: YTN; PAM sequence: CTT
cagaatttttttcctaacat

SEQ ID NO: 177573 - DNA, 20 bp, Artificial Sequence
  Description of Artificial Sequence: Synthetic oligonucleotide
  Target: ATXN1; (-) strand; PAM type: YTN; PAM sequence: TTG
gggtccaagcaatgtatcag

SEQ ID NO: 177574 - DNA, 20 bp, Artificial Sequence
  Description of Artificial Sequence: Synthetic oligonucleotide
  Target: ATXN1; (-) strand; PAM type: YTN; PAM sequence: TTT
ggggtccaagcaatgtatca

SEQ ID NO: 177575 - DNA, 20 bp, Artificial Sequence
  Description of Artificial Sequence: Synthetic oligonucleotide
  Target: ATXN1; (-) strand; PAM type: YTN; PAM sequence: CTT
tggggtccaagcaatgtatc

SEQ ID NO: 177576 - DNA, 20 bp, Artificial Sequence
  Description of Artificial Sequence: Synthetic oligonucleotide
  Target: ATXN1; (-) strand; PAM type: YTN; PAM sequence: CTA
aggagtgcagggactttggg

SEQ ID NO: 177577 - DNA, 20 bp, Artificial Sequence
  Description of Artificial Sequence: Synthetic oligonucleotide
  Target: ATXN1; (-) strand; PAM type: YTN; PAM sequence: TTG
tctaaggagtgcagggactt

SEQ ID NO: 177578 - DNA, 20 bp, Artificial Sequence
  Description of Artificial Sequence: Synthetic oligonucleotide
  Target: ATXN1; (-) strand; PAM type: YTN; PAM sequence: CTT
gtctaaggagtgcagggact

SEQ ID NO: 177579 - DNA, 20 bp, Artificial Sequence
  Description of Artificial Sequence: Synthetic oligonucleotide
  Target: ATXN1; (-) strand; PAM type: YTN; PAM sequence: CTC
caacacttgtctaaggagtg

SEQ ID NO: 177580 - DNA, 20 bp, Artificial Sequence
  Description of Artificial Sequence: Synthetic oligonucleotide
  Target: ATXN1; (-) strand; PAM type: YTN; PAM sequence: TTC
cctccaacacttgtctaagg

SEQ ID NO: 177581 - DNA, 20 bp, Artificial Sequence
  Description of Artificial Sequence: Synthetic oligonucleotide
  Target: ATXN1; (-) strand; PAM type: YTN; PAM sequence: TTT
ccctccaacacttgtctaag

SEQ ID NO: 177582 - DNA, 20 bp, Artificial Sequence
  Description of Artificial Sequence: Synthetic oligonucleotide
  Target: ATXN1; (-) strand; PAM type: YTN; PAM sequence: CTG
atgtggccgtttccctccaa

SEQ ID NO: 177583 - DNA, 20 bp, Artificial Sequence
  Description of Artificial Sequence: Synthetic oligonucleotide
  Target: ATXN1; (-) strand; PAM type: YTN; PAM sequence: TTC
acccctgatgtggccgtttc

SEQ ID NO: 177584 - DNA, 20 bp, Artificial Sequence
  Description of Artificial Sequence: Synthetic oligonucleotide
  Target: ATXN1; (-) strand; PAM type: YTN; PAM sequence: CTT
cacccctgatgtggccgttt

SEQ ID NO: 177585 - DNA, 20 bp, Artificial Sequence
  Description of Artificial Sequence: Synthetic oligonucleotide
  Target: ATXN1; (-) strand; PAM type: YTN; PAM sequence: CTA
gtggataaatgccacttcac

SEQ ID NO: 177586 - DNA, 20 bp, Artificial Sequence
  Description of Artificial Sequence: Synthetic oligonucleotide
  Target: ATXN1; (-) strand; PAM type: YTN; PAM sequence: TTG
gagtatactagtggataaat

SEQ ID NO: 177587 - DNA, 20 bp, Artificial Sequence
  Description of Artificial Sequence: Synthetic oligonucleotide
  Target: ATXN1; (-) strand; PAM type: YTN; PAM sequence: CTT
ggagtatactagtggataaa

SEQ ID NO: 177588 - DNA, 20 bp, Artificial Sequence
  Description of Artificial Sequence: Synthetic oligonucleotide
  Target: ATXN1; (-) strand; PAM type: YTN; PAM sequence: CTC
gcgacatcttggagtatact

SEQ ID NO: 177589 - DNA, 20 bp, Artificial Sequence
  Description of Artificial Sequence: Synthetic oligonucleotide
  Target: ATXN1; (-) strand; PAM type: YTN; PAM sequence: TTC
agggactcgcgacatcttgg

SEQ ID NO: 177590 - DNA, 20 bp, Artificial Sequence
  Description of Artificial Sequence: Synthetic oligonucleotide
  Target: ATXN1; (-) strand; PAM type: YTN; PAM sequence: CTG
gaagaccaaatcagagatgt

SEQ ID NO: 177591 - DNA, 20 bp, Artificial Sequence
  Description of Artificial Sequence: Synthetic oligonucleotide
  Target: ATXN1; (-) strand; PAM type: YTN; PAM sequence: TTG
ctggaagaccaaatcagaga

SEQ ID NO: 177592 - DNA, 20 bp, Artificial Sequence
  Description of Artificial Sequence: Synthetic oligonucleotide
  Target: ATXN1; (-) strand; PAM type: YTN; PAM sequence: TTC
caatagttgctggaagacca

SEQ ID NO: 177593 - DNA, 20 bp, Artificial Sequence
  Description of Artificial Sequence: Synthetic oligonucleotide
  Target: ATXN1; (-) strand; PAM type: YTN; PAM sequence: TTA
ttccaatagttgctggaaga

SEQ ID NO: 177594 - DNA, 20 bp, Artificial Sequence
  Description of Artificial Sequence: Synthetic oligonucleotide
  Target: ATXN1; (-) strand; PAM type: YTN; PAM sequence: CTT
attccaatagttgctggaag

SEQ ID NO: 177595 - DNA, 20 bp, Artificial Sequence
  Description of Artificial Sequence: Synthetic oligonucleotide
  Target: ATXN1; (-) strand; PAM type: YTN; PAM sequence: TTG
cacaaatcatatagccttat

SEQ ID NO: 177596 - DNA, 20 bp, Artificial Sequence
  Description of Artificial Sequence: Synthetic oligonucleotide
  Target: ATXN1; (-) strand; PAM type: YTN; PAM sequence: TTG
ttgcacaaatcatatagcct

SEQ ID NO: 177597 - DNA, 20 bp, Artificial Sequence
  Description of Artificial Sequence: Synthetic oligonucleotide
  Target: ATXN1; (-) strand; PAM type: YTN; PAM sequence: TTG
ttgttgcacaaatcatatag

SEQ ID NO: 177598 - DNA, 20 bp, Artificial Sequence
  Description of Artificial Sequence: Synthetic oligonucleotide
  Target: ATXN1; (-) strand; PAM type: YTN; PAM sequence: TTC
attgttgttgcacaaatcat

SEQ ID NO: 177599 - DNA, 20 bp, Artificial Sequence
  Description of Artificial Sequence: Synthetic oligonucleotide
  Target: ATXN1; (-) strand; PAM type: YTN; PAM sequence: TTT
cattgttgttgcacaaatca

SEQ ID NO: 177600 - DNA, 20 bp, Artificial Sequence
  Description of Artificial Sequence: Synthetic oligonucleotide
  Target: ATXN1; (-) strand; PAM type: YTN; PAM sequence: TTT
tcattgttgttgcacaaatc

SEQ ID NO: 177601 - DNA, 20 bp, Artificial Sequence
  Description of Artificial Sequence: Synthetic oligonucleotide
  Target: ATXN1; (-) strand; PAM type: YTN; PAM sequence: CTT
ttcattgttgttgcacaaat

SEQ ID NO: 177602 - DNA, 20 bp, Artificial Sequence
  Description of Artificial Sequence: Synthetic oligonucleotide
  Target: ATXN1; (-) strand; PAM type: YTN; PAM sequence: TTC
ttttcattgttgttgcacaa

SEQ ID NO: 177603 - DNA, 20 bp, Artificial Sequence
  Description of Artificial Sequence: Synthetic oligonucleotide
  Target: ATXN1; (-) strand; PAM type: YTN; PAM sequence: CTT
cttttcattgttgttgcaca

SEQ ID NO: 177604 - DNA, 20 bp, Artificial Sequence
  Description of Artificial Sequence: Synthetic oligonucleotide
  Target: ATXN1; (-) strand; PAM type: YTN; PAM sequence: CTG
ccttcttttcattgttgttg

SEQ ID NO: 177605 - DNA, 20 bp, Artificial Sequence
  Description of Artificial Sequence: Synthetic oligonucleotide
  Target: ATXN1; (-) strand; PAM type: YTN; PAM sequence: TTC
ctgccttcttttcattgttg

SEQ ID NO: 177606 - DNA, 20 bp, Artificial Sequence
  Description of Artificial Sequence: Synthetic oligonucleotide
  Target: ATXN1; (-) strand; PAM type: YTN; PAM sequence: TTT
cctgccttcttttcattgtt

SEQ ID NO: 177607 - DNA, 20 bp, Artificial Sequence
  Description of Artificial Sequence: Synthetic oligonucleotide
  Target: ATXN1; (-) strand; PAM type: YTN; PAM sequence: CTT
tcctgccttcttttcattgt

SEQ ID NO: 177608 - DNA, 20 bp, Artificial Sequence
  Description of Artificial Sequence: Synthetic oligonucleotide
  Target: ATXN1; (-) strand; PAM type: YTN; PAM sequence: CTC
tttcctgccttcttttcatt

SEQ ID NO: 177609 - DNA, 20 bp, Artificial Sequence
  Description of Artificial Sequence: Synthetic oligonucleotide
  Target: ATXN1; (-) strand; PAM type: YTN; PAM sequence: TTC
cctctttcctgccttctttt

SEQ ID NO: 177610 - DNA, 20 bp, Artificial Sequence
  Description of Artificial Sequence: Synthetic oligonucleotide
  Target: ATXN1; (-) strand; PAM type: YTN; PAM sequence: CTT
ccctctttcctgccttcttt

SEQ ID NO: 177611 - DNA, 20 bp, Artificial Sequence
  Description of Artificial Sequence: Synthetic oligonucleotide
  Target: ATXN1; (-) strand; PAM type: YTN; PAM sequence: TTC
cttccctctttcctgccttc

SEQ ID NO: 177612 - DNA, 20 bp, Artificial Sequence
  Description of Artificial Sequence: Synthetic oligonucleotide
  Target: ATXN1; (-) strand; PAM type: YTN; PAM sequence: CTT
ccttccctctttcctgcctt

SEQ ID NO: 177613 - DNA, 20 bp, Artificial Sequence
  Description of Artificial Sequence: Synthetic oligonucleotide
  Target: ATXN1; (-) strand; PAM type: YTN; PAM sequence: CTA
tccttccttccctctttcct

SEQ ID NO: 177614 - DNA, 20 bp, Artificial Sequence
  Description of Artificial Sequence: Synthetic oligonucleotide
  Target: ATXN1; (-) strand; PAM type: YTN; PAM sequence: TTC
ctatccttccttccctcttt

SEQ ID NO: 177615 - DNA, 20 bp, Artificial Sequence
  Description of Artificial Sequence: Synthetic oligonucleotide
  Target: ATXN1; (-) strand; PAM type: YTN; PAM sequence: TTT
cctatccttccttccctctt

SEQ ID NO: 177616 - DNA, 20 bp, Artificial Sequence
  Description of Artificial Sequence: Synthetic oligonucleotide
  Target: ATXN1; (-) strand; PAM type: YTN; PAM sequence: TTT
tcctatccttccttccctct

SEQ ID NO: 177617 - DNA, 20 bp, Artificial Sequence
  Description of Artificial Sequence: Synthetic oligonucleotide
  Target: ATXN1; (-) strand; PAM type: YTN; PAM sequence: TTT
ttcctatccttccttccctc

SEQ ID NO: 177618 - DNA, 20 bp, Artificial Sequence
  Description of Artificial Sequence: Synthetic oligonucleotide
  Target: ATXN1; (-) strand; PAM type: YTN; PAM sequence: TTT
tttcctatccttccttccct

SEQ ID NO: 177619 - DNA, 20 bp, Artificial Sequence
  Description of Artificial Sequence: Synthetic oligonucleotide
  Target: ATXN1; (-) strand; PAM type: YTN; PAM sequence: TTT
ttttcctatccttccttccc

SEQ ID NO: 177620 - DNA, 20 bp, Artificial Sequence
  Description of Artificial Sequence: Synthetic oligonucleotide
  Target: ATXN1; (-) strand; PAM type: YTN; PAM sequence: TTT
tttttcctatccttccttcc

SEQ ID NO: 177621 - DNA, 20 bp, Artificial Sequence
  Description of Artificial Sequence: Synthetic oligonucleotide
  Target: ATXN1; (-) strand; PAM type: YTN; PAM sequence: TTT
ttttttcctatccttccttc

SEQ ID NO: 177622 - DNA, 20 bp, Artificial Sequence
  Description of Artificial Sequence: Synthetic oligonucleotide
  Target: ATXN1; (-) strand; PAM type: YTN; PAM sequence: TTT
tttttttcctatccttcctt

SEQ ID NO: 177623 - DNA, 20 bp, Artificial Sequence
  Description of Artificial Sequence: Synthetic oligonucleotide
  Target: ATXN1; (-) strand; PAM type: YTN; PAM sequence: TTT
ttttttttcctatccttcct

SEQ ID NO: 177624 - DNA, 20 bp, Artificial Sequence
  Description of Artificial Sequence: Synthetic oligonucleotide
  Target: ATXN1; (-) strand; PAM type: YTN; PAM sequence: TTT
tttttttttcctatccttcc

SEQ ID NO: 177625 - DNA, 20 bp, Artificial Sequence
  Description of Artificial Sequence: Synthetic oligonucleotide
  Target: ATXN1; (-) strand; PAM type: YTN; PAM sequence: TTT
ttttttttttcctatccttc

SEQ ID NO: 177626 - DNA, 20 bp, Artificial Sequence
  Description of Artificial Sequence: Synthetic oligonucleotide
  Target: ATXN1; (-) strand; PAM type: YTN; PAM sequence: CTT
tttttttttttcctatcctt

SEQ ID NO: 177627 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttcctatcc

SEQ ID NO: 177628 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttcctatc

SEQ ID NO: 177629 - DNA, 20 bp, Artificial Sequence
  Description of Artificial Sequence: Synthetic oligonucleotide
  Target: ATXN1; (-) strand; PAM type: YTN; PAM sequence: CTT
tctttttttttttttcctat

SEQ ID NO: 177630 - DNA, 20 bp, Artificial Sequence
  Description of Artificial Sequence: Synthetic oligonucleotide
  Target: ATXN1; (-) strand; PAM type: YTN; PAM sequence: TTC
cctttctttttttttttttc

SEQ ID NO: 177631 - DNA, 20 bp, Artificial Sequence
  Description of Artificial Sequence: Synthetic oligonucleotide
  Target: ATXN1; (-) strand; PAM type: YTN; PAM sequence: TTT
ccctttcttttttttttttt

SEQ ID NO: 177632 - DNA, 20 bp, Artificial Sequence
  Description of Artificial Sequence: Synthetic oligonucleotide
  Target: ATXN1; (-) strand; PAM type: YTN; PAM sequence: CTT
tccctttctttttttttttt

SEQ ID NO: 177633 - DNA, 20 bp, Artificial Sequence
  Description of Artificial Sequence: Synthetic oligonucleotide
  Target: ATXN1; (-) strand; PAM type: YTN; PAM sequence: TTC
tttccctttctttttttttt

SEQ ID NO: 177634 - DNA, 20 bp, Artificial Sequence
  Description of Artificial Sequence: Synthetic oligonucleotide
  Target: ATXN1; (-) strand; PAM type: YTN; PAM sequence: TTT
ctttccctttcttttttttt

SEQ ID NO: 177635 - DNA, 20 bp, Artificial Sequence
  Description of Artificial Sequence: Synthetic oligonucleotide
  Target: ATXN1; (-) strand; PAM type: YTN; PAM sequence: TTT
tctttccctttctttttttt

SEQ ID NO: 177636 - DNA, 20 bp, Artificial Sequence
  Description of Artificial Sequence: Synthetic oligonucleotide
  Target: ATXN1; (-) strand; PAM type: YTN; PAM sequence: TTT
ttctttccctttcttttttt

SEQ ID NO: 177637 - DNA, 20 bp, Artificial Sequence
  Description of Artificial Sequence: Synthetic oligonucleotide
  Target: ATXN1; (-) strand; PAM type: YTN; PAM sequence: CTT
tttctttccctttctttttt

SEQ ID NO: 177638 - DNA, 20 bp, Artificial Sequence
  Description of Artificial Sequence: Synthetic oligonucleotide
  Target: ATXN1; (-) strand; PAM type: YTN; PAM sequence: TTC
tttttctttccctttctttt

SEQ ID NO: 177639 - DNA, 20 bp, Artificial Sequence
  Description of Artificial Sequence: Synthetic oligonucleotide
  Target: ATXN1; (-) strand; PAM type: YTN; PAM sequence: CTA
gtggtcgcagtacggtgttc

SEQ ID NO: 177640 - DNA, 20 bp, Artificial Sequence
  Description of Artificial Sequence: Synthetic oligonucleotide
  Target: ATXN1; (-) strand; PAM type: YTN; PAM sequence: TTA
ataactagtggtcgcagtac

SEQ ID NO: 177641 - DNA, 20 bp, Artificial Sequence
  Description of Artificial Sequence: Synthetic oligonucleotide
  Target: ATXN1; (-) strand; PAM type: YTN; PAM sequence: CTG
ttaataactagtggtcgcag

SEQ ID NO: 177642 - DNA, 20 bp, Artificial Sequence
  Description of Artificial Sequence: Synthetic oligonucleotide
  Target: ATXN1; (-) strand; PAM type: YTN; PAM sequence: CTG
ggctgttaataactagtggt

SEQ ID NO: 177643 - DNA, 20 bp, Artificial Sequence
  Description of Artificial Sequence: Synthetic oligonucleotide
  Target: ATXN1; (-) strand; PAM type: YTN; PAM sequence: TTG
tgtaccacaggctgggctgt

SEQ ID NO: 177644 - DNA, 20 bp, Artificial Sequence
  Description of Artificial Sequence: Synthetic oligonucleotide
  Target: ATXN1; (-) strand; PAM type: YTN; PAM sequence: TTT
gtgtaccacaggctgggctg

SEQ ID NO: 177645 - DNA, 20 bp, Artificial Sequence
  Description of Artificial Sequence: Synthetic oligonucleotide
  Target: ATXN1; (-) strand; PAM type: YTN; PAM sequence: CTT
tgtgtaccacaggctgggct

SEQ ID NO: 177646 - DNA, 20 bp, Artificial Sequence
  Description of Artificial Sequence: Synthetic oligonucleotide
  Target: ATXN1; (-) strand; PAM type: YTN; PAM sequence: CTG
tcagctttgtgtaccacagg

SEQ ID NO: 177647 - DNA, 20 bp, Artificial Sequence
  Description of Artificial Sequence: Synthetic oligonucleotide
  Target: ATXN1; (-) strand; PAM type: YTN; PAM sequence: CTC
ataataactgtcagctttgt

SEQ ID NO: 177648 - DNA, 20 bp, Artificial Sequence
  Description of Artificial Sequence: Synthetic oligonucleotide
  Target: ATXN1; (-) strand; PAM type: YTN; PAM sequence: TTA
ctcataataactgtcagctt

SEQ ID NO: 177649 - DNA, 20 bp, Artificial Sequence
  Description of Artificial Sequence: Synthetic oligonucleotide
  Target: ATXN1; (-) strand; PAM type: YTN; PAM sequence: CTA
attactcataataactgtca

SEQ ID NO: 177650 - DNA, 20 bp, Artificial Sequence
  Description of Artificial Sequence: Synthetic oligonucleotide
  Target: ATXN1; (-) strand; PAM type: YTN; PAM sequence: TTG
tgctaattactcataataac

SEQ ID NO: 177651 - DNA, 20 bp, Artificial Sequence
  Description of Artificial Sequence: Synthetic oligonucleotide
  Target: ATXN1; (-) strand; PAM type: YTN; PAM sequence: TTT
gtgctaattactcataataa

SEQ ID NO: 177652 - DNA, 20 bp, Artificial Sequence
  Description of Artificial Sequence: Synthetic oligonucleotide
  Target: ATXN1; (-) strand; PAM type: YTN; PAM sequence: CTT
tgtgctaattactcataata

SEQ ID NO: 177653 - DNA, 20 bp, Artificial Sequence
  Description of Artificial Sequence: Synthetic oligonucleotide
  Target: ATXN1; (-) strand; PAM type: YTN; PAM sequence: TTC
ctttgtgctaattactcata

SEQ ID NO: 177654 - DNA, 20 bp, Artificial Sequence
  Description of Artificial Sequence: Synthetic oligonucleotide
  Target: ATXN1; (-) strand; PAM type: YTN; PAM sequence: CTT
cctttgtgctaattactcat

SEQ ID NO: 177655 - DNA, 20 bp, Artificial Sequence
  Description of Artificial Sequence: Synthetic oligonucleotide
  Target: ATXN1; (-) strand; PAM type: YTN; PAM sequence: CTG
gaaatagtgtgtatacagaa

SEQ ID NO: 177656 - DNA, 20 bp, Artificial Sequence
  Description of Artificial Sequence: Synthetic oligonucleotide
  Target: ATXN1; (-) strand; PAM type: YTN; PAM sequence: TTC
aaaaacatgtctggaaatag

SEQ ID NO: 177657 - DNA, 20 bp, Artificial Sequence
  Description of Artificial Sequence: Synthetic oligonucleotide
  Target: ATXN1; (-) strand; PAM type: YTN; PAM sequence: TTT
caaaaacatgtctggaaata

SEQ ID NO: 177658 - DNA, 20 bp, Artificial Sequence
  Description of Artificial Sequence: Synthetic oligonucleotide
  Target: ATXN1; (-) strand; PAM type: YTN; PAM sequence: TTG
tttcaaaaacatgtctggaa

SEQ ID NO: 177659 - DNA, 20 bp, Artificial Sequence
  Description of Artificial Sequence: Synthetic oligonucleotide
  Target: ATXN1; (-) strand; PAM type: YTN; PAM sequence: CTT
gtttcaaaaacatgtctgga

SEQ ID NO: 177660 - DNA, 20 bp, Artificial Sequence
  Description of Artificial Sequence: Synthetic oligonucleotide
  Target: ATXN1; (-) strand; PAM type: YTN; PAM sequence: TTG
gtggtaaaaggcaaagccct

SEQ ID NO: 177661 - DNA, 20 bp, Artificial Sequence
  Description of Artificial Sequence: Synthetic oligonucleotide
  Target: ATXN1; (-) strand; PAM type: YTN; PAM sequence: TTA
ttggtggtaaaaggcaaagc

SEQ ID NO: 177662 - DNA, 20 bp, Artificial Sequence
  Description of Artificial Sequence: Synthetic oligonucleotide
  Target: ATXN1; (-) strand; PAM type: YTN; PAM sequence: CTG
tgtaagtaacaacatacaac

SEQ ID NO: 177663 - DNA, 20 bp, Artificial Sequence
  Description of Artificial Sequence: Synthetic oligonucleotide
  Target: ATXN1; (-) strand; PAM type: YTN; PAM sequence: CTG
agccatatgcaaaaaatcat

SEQ ID NO: 177664 - DNA, 20 bp, Artificial Sequence
  Description of Artificial Sequence: Synthetic oligonucleotide
  Target: ATXN1; (-) strand; PAM type: YTN; PAM sequence: TTG
gctgagccatatgcaaaaaa

SEQ ID NO: 177665 - DNA, 20 bp, Artificial Sequence
  Description of Artificial Sequence: Synthetic oligonucleotide
  Target: ATXN1; (-) strand; PAM type: YTN; PAM sequence: TTT
ggctgagccatatgcaaaaa

SEQ ID NO: 177666 - DNA, 20 bp, Artificial Sequence
  Description of Artificial Sequence: Synthetic oligonucleotide
  Target: ATXN1; (-) strand; PAM type: YTN; PAM sequence: CTT
tggctgagccatatgcaaaa

SEQ ID NO: 177667 - DNA, 20 bp, Artificial Sequence
  Description of Artificial Sequence: Synthetic oligonucleotide
  Target: ATXN1; (-) strand; PAM type: YTN; PAM sequence: TTC
tttggctgagccatatgcaa

SEQ ID NO: 177668 - DNA, 20 bp, Artificial Sequence
  Description of Artificial Sequence: Synthetic oligonucleotide
  Target: ATXN1; (-) strand; PAM type: YTN; PAM sequence: TTT
ctttggctgagccatatgca

SEQ ID NO: 177669 - DNA, 20 bp, Artificial Sequence
  Description of Artificial Sequence: Synthetic oligonucleotide
  Target: ATXN1; (-) strand; PAM type: YTN; PAM sequence: CTT
tctttggctgagccatatgc

SEQ ID NO: 177670 - DNA, 20 bp, Artificial Sequence
  Description of Artificial Sequence: Synthetic oligonucleotide
  Target: ATXN1; (-) strand; PAM type: YTN; PAM sequence: TTC
ccaaaaatggaaggggaaaa

SEQ ID NO: 177671 - DNA, 20 bp, Artificial Sequence
  Description of Artificial Sequence: Synthetic oligonucleotide
  Target: ATXN1; (-) strand; PAM type: YTN; PAM sequence: TTT
cccaaaaatggaaggggaaa

SEQ ID NO: 177672 - DNA, 20 bp, Artificial Sequence
  Description of Artificial Sequence: Synthetic oligonucleotide
  Target: ATXN1; (-) strand; PAM type: YTN; PAM sequence: CTT
tcccaaaaatggaaggggaa

SEQ ID NO: 177673 - DNA, 20 bp, Artificial Sequence
  Description of Artificial Sequence: Synthetic oligonucleotide
  Target: ATXN1; (-) strand; PAM type: YTN; PAM sequence: TTG
catctttcccaaaaatggaa

SEQ ID NO: 177674 - DNA, 20 bp, Artificial Sequence
  Description of Artificial Sequence: Synthetic oligonucleotide
  Target: ATXN1; (-) strand; PAM type: YTN; PAM sequence: TTA
cacagtcagttgcatctttc

SEQ ID NO: 177675 - DNA, 20 bp, Artificial Sequence
  Description of Artificial Sequence: Synthetic oligonucleotide
  Target: ATXN1; (-) strand; PAM type: YTN; PAM sequence: CTT
acacagtcagttgcatcttt

SEQ ID NO: 177676 - DNA, 20 bp, Artificial Sequence
  Description of Artificial Sequence: Synthetic oligonucleotide
  Target: ATXN1; (-) strand; PAM type: YTN; PAM sequence: CTC
ccttacacagtcagttgcat

SEQ ID NO: 177677 - DNA, 20 bp, Artificial Sequence
  Description of Artificial Sequence: Synthetic oligonucleotide
  Target: ATXN1; (-) strand; PAM type: YTN; PAM sequence: CTC
tcccttacacagtcagttgc

SEQ ID NO: 177678 - DNA, 20 bp, Artificial Sequence
  Description of Artificial Sequence: Synthetic oligonucleotide
  Target: ATXN1; (-) strand; PAM type: YTN; PAM sequence: CTC
ctctcccttacacagtcagt

SEQ ID NO: 177679 - DNA, 20 bp, Artificial Sequence
  Description of Artificial Sequence: Synthetic oligonucleotide
  Target: ATXN1; (-) strand; PAM type: YTN; PAM sequence: TTC
tcctctcccttacacagtca

SEQ ID NO: 177680 - DNA, 20 bp, Artificial Sequence
  Description of Artificial Sequence: Synthetic oligonucleotide
  Target: ATXN1; (-) strand; PAM type: YTN; PAM sequence: CTA
gacattctcctctcccttac

SEQ ID NO: 177681 - DNA, 20 bp, Artificial Sequence
  Description of Artificial Sequence: Synthetic oligonucleotide
  Target: ATXN1; (-) strand; PAM type: YTN; PAM sequence: TTA
tgtaaaaactagacattctc

SEQ ID NO: 177682 - DNA, 20 bp, Artificial Sequence
  Description of Artificial Sequence: Synthetic oligonucleotide
  Target: ATXN1; (-) strand; PAM type: YTN; PAM sequence: CTA
tcatcgccatagacattatg

SEQ ID NO: 177683 - DNA, 20 bp, Artificial Sequence
  Description of Artificial Sequence: Synthetic oligonucleotide
  Target: ATXN1; (-) strand; PAM type: YTN; PAM sequence: CTG
cacccctatcatcgccatag

SEQ ID NO: 177684 - DNA, 20 bp, Artificial Sequence
  Description of Artificial Sequence: Synthetic oligonucleotide
  Target: ATXN1; (-) strand; PAM type: YTN; PAM sequence: CTA
cacacacatacacacacaca

SEQ ID NO: 177685 - DNA, 20 bp, Artificial Sequence
  Description of Artificial Sequence: Synthetic oligonucleotide
  Target: ATXN1; (-) strand; PAM type: YTN; PAM sequence: TTA
ctacacacacatacacacac

SEQ ID NO: 177686 - DNA, 20 bp, Artificial Sequence
  Description of Artificial Sequence: Synthetic oligonucleotide
  Target: ATXN1; (-) strand; PAM type: YTN; PAM sequence: TTG
ttactacacacacatacaca

SEQ ID NO: 177687 - DNA, 20 bp, Artificial Sequence
  Description of Artificial Sequence: Synthetic oligonucleotide
  Target: ATXN1; (-) strand; PAM type: YTN; PAM sequence: CTT
gttactacacacacatacac

SEQ ID NO: 177688 - DNA, 20 bp, Artificial Sequence
  Description of Artificial Sequence: Synthetic oligonucleotide
  Target: ATXN1; (-) strand; PAM type: YTN; PAM sequence: TTG
ggtggggaatcttgttacta

SEQ ID NO: 177689 - DNA, 20 bp, Artificial Sequence
  Description of Artificial Sequence: Synthetic oligonucleotide
  Target: ATXN1; (-) strand; PAM type: YTN; PAM sequence: TTG
gcaagattgggtggggaatc

SEQ ID NO: 177690 - DNA, 20 bp, Artificial Sequence
  Description of Artificial Sequence: Synthetic oligonucleotide
  Target: ATXN1; (-) strand; PAM type: YTN; PAM sequence: TTA
gatgaaatatggttggcaag

SEQ ID NO: 177691 - DNA, 20 bp, Artificial Sequence
  Description of Artificial Sequence: Synthetic oligonucleotide
  Target: ATXN1; (-) strand; PAM type: YTN; PAM sequence: CTC
agtcaagagagttagatgaa

SEQ ID NO: 177692 - DNA, 20 bp, Artificial Sequence
  Description of Artificial Sequence: Synthetic oligonucleotide
  Target: ATXN1; (-) strand; PAM type: YTN; PAM sequence: CTA
atcccataggaatgactcag

SEQ ID NO: 177693 - DNA, 20 bp, Artificial Sequence
  Description of Artificial Sequence: Synthetic oligonucleotide
  Target: ATXN1; (-) strand; PAM type: YTN; PAM sequence: CTC
cctaatcccataggaatgac

SEQ ID NO: 177694 - DNA, 20 bp, Artificial Sequence
  Description of Artificial Sequence: Synthetic oligonucleotide
  Target: ATXN1; (-) strand; PAM type: YTN; PAM sequence: TTG
gatgtacgcagtactcccta

SEQ ID NO: 177695 - DNA, 20 bp, Artificial Sequence
  Description of Artificial Sequence: Synthetic oligonucleotide
  Target: ATXN1; (-) strand; PAM type: YTN; PAM sequence: CTT
ggatgtacgcagtactccct

SEQ ID NO: 177696 - DNA, 20 bp, Artificial Sequence
  Description of Artificial Sequence: Synthetic oligonucleotide
  Target: ATXN1; (-) strand; PAM type: YTN; PAM sequence: CTC
agcaaacaccacgaaccttg

SEQ ID NO: 177697 - DNA, 20 bp, Artificial Sequence
  Description of Artificial Sequence: Synthetic oligonucleotide
  Target: ATXN1; (-) strand; PAM type: YTN; PAM sequence: TTA
tctcagcaaacaccacgaac

SEQ ID NO: 177698 - DNA, 20 bp, Artificial Sequence
  Description of Artificial Sequence: Synthetic oligonucleotide
  Target: ATXN1; (-) strand; PAM type: YTN; PAM sequence: TTG
ataatgtgttatctcagcaa

SEQ ID NO: 177699 - DNA, 20 bp, Artificial Sequence
  Description of Artificial Sequence: Synthetic oligonucleotide
  Target: ATXN1; (-) strand; PAM type: YTN; PAM sequence: TTT
gataatgtgttatctcagca

SEQ ID NO: 177700 - DNA, 20 bp, Artificial Sequence
  Description of Artificial Sequence: Synthetic oligonucleotide
  Target: ATXN1; (-) strand; PAM type: YTN; PAM sequence: TTT
tgataatgtgttatctcagc

SEQ ID NO: 177701 - DNA, 20 bp, Artificial Sequence
  Description of Artificial Sequence: Synthetic oligonucleotide
  Target: ATXN1; (-) strand; PAM type: YTN; PAM sequence: CTT
ttgataatgtgttatctcag

SEQ ID NO: 177702 - DNA, 20 bp, Artificial Sequence
  Description of Artificial Sequence: Synthetic oligonucleotide
  Target: ATXN1; (-) strand; PAM type: YTN; PAM sequence: TTA
gagaggcttttgataatgtg

SEQ ID NO: 177703 - DNA, 20 bp, Artificial Sequence
  Description of Artificial Sequence: Synthetic oligonucleotide
  Target: ATXN1; (-) strand; PAM type: YTN; PAM sequence: TTT
agagaggcttttgataatgt

SEQ ID NO: 177704 - DNA, 20 bp, Artificial Sequence
  Description of Artificial Sequence: Synthetic oligonucleotide
  Target: ATXN1; (-) strand; PAM type: YTN; PAM sequence: TTT
tagagaggcttttgataatg

SEQ ID NO: 177705 - DNA, 20 bp, Artificial Sequence
  Description of Artificial Sequence: Synthetic oligonucleotide
  Target: ATXN1; (-) strand; PAM type: YTN; PAM sequence: TTT
ttagagaggcttttgataat

SEQ ID NO: 177706 - DNA, 20 bp, Artificial Sequence
  Description of Artificial Sequence: Synthetic oligonucleotide
  Target: ATXN1; (-) strand; PAM type: YTN; PAM sequence: CTT
tttagagaggcttttgataa

SEQ ID NO: 177707 - DNA, 20 bp, Artificial Sequence
  Description of Artificial Sequence: Synthetic oligonucleotide
  Target: ATXN1; (-) strand; PAM type: YTN; PAM sequence: TTC
aaccctttttagagaggctt

SEQ ID NO: 177708 - DNA, 20 bp, Artificial Sequence
  Description of Artificial Sequence: Synthetic oligonucleotide
  Target: ATXN1; (-) strand; PAM type: YTN; PAM sequence: CTG
taaatattcaacccttttta

SEQ ID NO: 177709 - DNA, 20 bp, Artificial Sequence
  Description of Artificial Sequence: Synthetic oligonucleotide
  Target: ATXN1; (-) strand; PAM type: YTN; PAM sequence: TTC
tgtaaatattcaaccctttt

SEQ ID NO: 177710 - DNA, 20 bp, Artificial Sequence
  Description of Artificial Sequence: Synthetic oligonucleotide
  Target: ATXN1; (-) strand; PAM type: YTN; PAM sequence: CTT
ctgtaaatattcaacccttt

SEQ ID NO: 177711 - DNA, 20 bp, Artificial Sequence
  Description of Artificial Sequence: Synthetic oligonucleotide
  Target: ATXN1; (-) strand; PAM type: YTN; PAM sequence: TTC
ttctgtaaatattcaaccct

SEQ ID NO: 177712 - DNA, 20 bp, Artificial Sequence
  Description of Artificial Sequence: Synthetic oligonucleotide
  Target: ATXN1; (-) strand; PAM type: YTN; PAM sequence: TTT
cttctgtaaatattcaaccc

SEQ ID NO: 177713 - DNA, 20 bp, Artificial Sequence
  Description of Artificial Sequence: Synthetic oligonucleotide
  Target: ATXN1; (-) strand; PAM type: YTN; PAM sequence: TTT
tcttctgtaaatattcaacc

SEQ ID NO: 177714 - DNA, 20 bp, Artificial Sequence
  Description of Artificial Sequence: Synthetic oligonucleotide
  Target: ATXN1; (-) strand; PAM type: YTN; PAM sequence: TTT
ttcttctgtaaatattcaac

SEQ ID NO: 177715 - DNA, 20 bp, Artificial Sequence
  Description of Artificial Sequence: Synthetic oligonucleotide
  Target: ATXN1; (-) strand; PAM type: YTN; PAM sequence: TTT
tttcttctgtaaatattcaa

SEQ ID NO: 177716 - DNA, 20 bp, Artificial Sequence
  Description of Artificial Sequence: Synthetic oligonucleotide
  Target: ATXN1; (-) strand; PAM type: YTN; PAM sequence: CTT
ttttcttctgtaaatattca

SEQ ID NO: 177717 - DNA, 20 bp, Artificial Sequence
  Description of Artificial Sequence: Synthetic oligonucleotide
  Target: ATXN1; (-) strand; PAM type: YTN; PAM sequence: CTC
ttttttcttctgtaaatatt

SEQ ID NO: 177718 - DNA, 20 bp, Artificial Sequence
  Description of Artificial Sequence: Synthetic oligonucleotide
  Target: ATXN1; (-) strand; PAM type: YTN; PAM sequence: CTC
ccgcctcttttttcttctgt

SEQ ID NO: 177719 - DNA, 20 bp, Artificial Sequence
  Description of Artificial Sequence: Synthetic oligonucleotide
  Target: ATXN1; (-) strand; PAM type: YTN; PAM sequence: TTC
tcccgcctcttttttcttct

SEQ ID NO: 177720 - DNA, 20 bp, Artificial Sequence
  Description of Artificial Sequence: Synthetic oligonucleotide
  Target: ATXN1; (-) strand; PAM type: YTN; PAM sequence: TTT
ctcccgcctcttttttcttc

SEQ ID NO: 177721 - DNA, 20 bp, Artificial Sequence
  Description of Artificial Sequence: Synthetic oligonucleotide
  Target: ATXN1; (-) strand; PAM type: YTN; PAM sequence: TTC
acatttctcccgcctctttt

SEQ ID NO: 177722 - DNA, 20 bp, Artificial Sequence
  Description of Artificial Sequence: Synthetic oligonucleotide
  Target: ATXN1; (-) strand; PAM type: YTN; PAM sequence: CTC
aaatgcattcacatttctcc

SEQ ID NO: 177723 - DNA, 20 bp, Artificial Sequence
  Description of Artificial Sequence: Synthetic oligonucleotide
  Target: ATXN1; (-) strand; PAM type: YTN; PAM sequence: CTG
ccaagaaagaacaacaaaaa

SEQ ID NO: 177724 - DNA, 20 bp, Artificial Sequence
  Description of Artificial Sequence: Synthetic oligonucleotide
  Target: ATXN1; (-) strand; PAM type: YTN; PAM sequence: TTG
taaagactgccaagaaagaa

SEQ ID NO: 177725 - DNA, 20 bp, Artificial Sequence
  Description of Artificial Sequence: Synthetic oligonucleotide
  Target: ATXN1; (-) strand; PAM type: YTN; PAM sequence: TTG
tcagttgtaaagactgccaa

SEQ ID NO: 177726 - DNA, 20 bp, Artificial Sequence
  Description of Artificial Sequence: Synthetic oligonucleotide
  Target: ATXN1; (-) strand; PAM type: YTN; PAM sequence: CTG
ttgtcagttgtaaagactgc

SEQ ID NO: 177727 - DNA, 20 bp, Artificial Sequence
  Description of Artificial Sequence: Synthetic oligonucleotide
  Target: ATXN1; (-) strand; PAM type: YTN; PAM sequence: CTG
ctgttgtcagttgtaaagac

SEQ ID NO: 177728 - DNA, 20 bp, Artificial Sequence
  Description of Artificial Sequence: Synthetic oligonucleotide
  Target: ATXN1; (-) strand; PAM type: YTN; PAM sequence: CTC
tgctgttgtcagttgtaaag

SEQ ID NO: 177729 - DNA, 20 bp, Artificial Sequence
  Description of Artificial Sequence: Synthetic oligonucleotide
  Target: ATXN1; (-) strand; PAM type: YTN; PAM sequence: CTG
aggaaggtcatagaaacatg

SEQ ID NO: 177730 - DNA, 20 bp, Artificial Sequence
  Description of Artificial Sequence: Synthetic oligonucleotide
  Target: ATXN1; (-) strand; PAM type: YTN; PAM sequence: CTG
tgctgaggaaggtcatagaa

SEQ ID NO: 177731 - DNA, 20 bp, Artificial Sequence
  Description of Artificial Sequence: Synthetic oligonucleotide
  Target: ATXN1; (-) strand; PAM type: YTN; PAM sequence: TTC
cggactgtgctgaggaaggt

SEQ ID NO: 177732 - DNA, 20 bp, Artificial Sequence
  Description of Artificial Sequence: Synthetic oligonucleotide
  Target: ATXN1; (-) strand; PAM type: YTN; PAM sequence: CTG
ataccgtacatgtgcattcc

SEQ ID NO: 177733 - DNA, 20 bp, Artificial Sequence
  Description of Artificial Sequence: Synthetic oligonucleotide
  Target: ATXN1; (-) strand; PAM type: YTN; PAM sequence: CTC
tgataccgtacatgtgcatt

SEQ ID NO: 177734 - DNA, 20 bp, Artificial Sequence
  Description of Artificial Sequence: Synthetic oligonucleotide
  Target: ATXN1; (-) strand; PAM type: YTN; PAM sequence: CTC
tctgataccgtacatgtgca

SEQ ID NO: 177735 - DNA, 20 bp, Artificial Sequence
  Description of Artificial Sequence: Synthetic oligonucleotide
  Target: ATXN1; (-) strand; PAM type: YTN; PAM sequence: CTG
ctctctgataccgtacatgt

SEQ ID NO: 177736 - DNA, 20 bp, Artificial Sequence
  Description of Artificial Sequence: Synthetic oligonucleotide
  Target: ATXN1; (-) strand; PAM type: YTN; PAM sequence: TTC
ccaagaaaacatggaggcgg

SEQ ID NO: 177737 - DNA, 20 bp, Artificial Sequence
  Description of Artificial Sequence: Synthetic oligonucleotide
  Target: ATXN1; (-) strand; PAM type: YTN; PAM sequence: CTT
cccaagaaaacatggaggcg

SEQ ID NO: 177738 - DNA, 20 bp, Artificial Sequence
  Description of Artificial Sequence: Synthetic oligonucleotide
  Target: ATXN1; (-) strand; PAM type: YTN; PAM sequence: CTC
cttcccaagaaaacatggag

SEQ ID NO: 177739 - DNA, 20 bp, Artificial Sequence
  Description of Artificial Sequence: Synthetic oligonucleotide
  Target: ATXN1; (-) strand; PAM type: YTN; PAM sequence: CTG
cacagaccctccttcccaag

SEQ ID NO: 177740 - DNA, 20 bp, Artificial Sequence
  Description of Artificial Sequence: Synthetic oligonucleotide
  Target: ATXN1; (-) strand; PAM type: YTN; PAM sequence: TTC
ccccaaaaaaaccccacatc

SEQ ID NO: 177741 - DNA, 20 bp, Artificial Sequence
  Description of Artificial Sequence: Synthetic oligonucleotide
  Target: ATXN1; (-) strand; PAM type: YTN; PAM sequence: TTT
cccccaaaaaaaccccacat

SEQ ID NO: 177742 - DNA, 20 bp, Artificial Sequence
  Description of Artificial Sequence: Synthetic oligonucleotide
  Target: ATXN1; (-) strand; PAM type: YTN; PAM sequence: CTA
cccccacacccatttccccc

SEQ ID NO: 177743 - DNA, 20 bp, Artificial Sequence
  Description of Artificial Sequence: Synthetic oligonucleotide
  Target: ATXN1; (-) strand; PAM type: YTN; PAM sequence: CTC
ctacccccacacccatttcc

SEQ ID NO: 177744 - DNA, 20 bp, Artificial Sequence
  Description of Artificial Sequence: Synthetic oligonucleotide
  Target: ATXN1; (-) strand; PAM type: YTN; PAM sequence: CTG
ctcctacccccacacccatt

SEQ ID NO: 177745 - DNA, 20 bp, Artificial Sequence
  Description of Artificial Sequence: Synthetic oligonucleotide
  Target: ATXN1; (-) strand; PAM type: YTN; PAM sequence: CTC
ctgctcctacccccacaccc

SEQ ID NO: 177746 - DNA, 20 bp, Artificial Sequence
  Description of Artificial Sequence: Synthetic oligonucleotide
  Target: ATXN1; (-) strand; PAM type: YTN; PAM sequence: CTA
cgctcctgctcctaccccca

SEQ ID NO: 177747 - DNA, 20 bp, Artificial Sequence
  Description of Artificial Sequence: Synthetic oligonucleotide
  Target: ATXN1; (-) strand; PAM type: YTN; PAM sequence: CTA
tctacgctcctgctcctacc

SEQ ID NO: 177748 - DNA, 20 bp, Artificial Sequence
  Description of Artificial Sequence: Synthetic oligonucleotide
  Target: ATXN1; (-) strand; PAM type: YTN; PAM sequence: CTC
ctatctacgctcctgctcct

SEQ ID NO: 177749 - DNA, 20 bp, Artificial Sequence
  Description of Artificial Sequence: Synthetic oligonucleotide
  Target: ATXN1; (-) strand; PAM type: YTN; PAM sequence: CTC
accactcctatctacgctcc

SEQ ID NO: 177750 - DNA, 20 bp, Artificial Sequence
  Description of Artificial Sequence: Synthetic oligonucleotide
  Target: ATXN1; (-) strand; PAM type: YTN; PAM sequence: TTA
atctcaccactcctatctac

SEQ ID NO: 177751 - DNA, 20 bp, Artificial Sequence
  Description of Artificial Sequence: Synthetic oligonucleotide
  Target: ATXN1; (-) strand; PAM type: YTN; PAM sequence: TTT
aatctcaccactcctatcta

SEQ ID NO: 177752 - DNA, 20 bp, Artificial Sequence
  Description of Artificial Sequence: Synthetic oligonucleotide
  Target: ATXN1; (-) strand; PAM type: YTN; PAM sequence: TTG
gatttaatctcaccactcct

SEQ ID NO: 177753 - DNA, 20 bp, Artificial Sequence
  Description of Artificial Sequence: Synthetic oligonucleotide
  Target: ATXN1; (-) strand; PAM type: YTN; PAM sequence: CTT
ggatttaatctcaccactcc

SEQ ID NO: 177754 - DNA, 20 bp, Artificial Sequence
  Description of Artificial Sequence: Synthetic oligonucleotide
  Target: ATXN1; (-) strand; PAM type: YTN; PAM sequence: CTG
gtatgcttggatttaatctc

SEQ ID NO: 177755 - DNA, 20 bp, Artificial Sequence
  Description of Artificial Sequence: Synthetic oligonucleotide
  Target: ATXN1; (-) strand; PAM type: YTN; PAM sequence: CTA
aaaacctggtatgcttggat

SEQ ID NO: 177756 - DNA, 20 bp, Artificial Sequence
  Description of Artificial Sequence: Synthetic oligonucleotide
  Target: ATXN1; (-) strand; PAM type: YTN; PAM sequence: TTC
taaaaacctggtatgcttgg

SEQ ID NO: 177757 - DNA, 20 bp, Artificial Sequence
  Description of Artificial Sequence: Synthetic oligonucleotide
  Target: ATXN1; (-) strand; PAM type: YTN; PAM sequence: CTA
ttctaaaaacctggtatgct

SEQ ID NO: 177758 - DNA, 20 bp, Artificial Sequence
  Description of Artificial Sequence: Synthetic oligonucleotide
  Target: ATXN1; (-) strand; PAM type: YTN; PAM sequence: CTC
tattctaaaaacctggtatg

SEQ ID NO: 177759 - DNA, 20 bp, Artificial Sequence
  Description of Artificial Sequence: Synthetic oligonucleotide
  Target: ATXN1; (-) strand; PAM type: YTN; PAM sequence: TTC
tctattctaaaaacctggta

SEQ ID NO: 177760 - DNA, 20 bp, Artificial Sequence
  Description of Artificial Sequence: Synthetic oligonucleotide
  Target: ATXN1; (-) strand; PAM type: YTN; PAM sequence: TTT
ctctattctaaaaacctggt

SEQ ID NO: 177761 - DNA, 20 bp, Artificial Sequence
  Description of Artificial Sequence: Synthetic oligonucleotide
  Target: ATXN1; (-) strand; PAM type: YTN; PAM sequence: TTG
tatttctctattctaaaaac

SEQ ID NO: 177762 - DNA, 20 bp, Artificial Sequence
  Description of Artificial Sequence: Synthetic oligonucleotide
  Target: ATXN1; (-) strand; PAM type: YTN; PAM sequence: TTC
agccagttgtatttctctat

SEQ ID NO: 177763 - DNA, 20 bp, Artificial Sequence
  Description of Artificial Sequence: Synthetic oligonucleotide
  Target: ATXN1; (-) strand; PAM type: YTN; PAM sequence: TTT
cagccagttgtatttctcta

SEQ ID NO: 177764 - DNA, 20 bp, Artificial Sequence
  Description of Artificial Sequence: Synthetic oligonucleotide
  Target: ATXN1; (-) strand; PAM type: YTN; PAM sequence: CTG
ataatttcagccagttgtat

SEQ ID NO: 177765 - DNA, 20 bp, Artificial Sequence
  Description of Artificial Sequence: Synthetic oligonucleotide
  Target: ATXN1; (-) strand; PAM type: YTN; PAM sequence: CTC
cctgataatttcagccagtt

SEQ ID NO: 177766 - DNA, 20 bp, Artificial Sequence
  Description of Artificial Sequence: Synthetic oligonucleotide
  Target: ATXN1; (-) strand; PAM type: YTN; PAM sequence: TTC
ctccctgataatttcagcca

SEQ ID NO: 177767 - DNA, 20 bp, Artificial Sequence
  Description of Artificial Sequence: Synthetic oligonucleotide
  Target: ATXN1; (-) strand; PAM type: YTN; PAM sequence: CTT
cctccctgataatttcagcc

SEQ ID NO: 177768 - DNA, 20 bp, Artificial Sequence
  Description of Artificial Sequence: Synthetic oligonucleotide
  Target: ATXN1; (-) strand; PAM type: YTN; PAM sequence: CTC
ttcctccctgataatttcag

SEQ ID NO: 177769 - DNA, 20 bp, Artificial Sequence
  Description of Artificial Sequence: Synthetic oligonucleotide
  Target: ATXN1; (-) strand; PAM type: YTN; PAM sequence: CTG
ctcttcctccctgataattt

SEQ ID NO: 177770 - DNA, 20 bp, Artificial Sequence
  Description of Artificial Sequence: Synthetic oligonucleotide
  Target: ATXN1; (-) strand; PAM type: YTN; PAM sequence: TTA
gtctgctcttcctccctgat

SEQ ID NO: 177771 - DNA, 20 bp, Artificial Sequence
  Description of Artificial Sequence: Synthetic oligonucleotide
  Target: ATXN1; (-) strand; PAM type: YTN; PAM sequence: TTT
agtctgctcttcctccctga

SEQ ID NO: 177772 - DNA, 20 bp, Artificial Sequence
  Description of Artificial Sequence: Synthetic oligonucleotide
  Target: ATXN1; (-) strand; PAM type: YTN; PAM sequence: TTT
tagtctgctcttcctccctg

SEQ ID NO: 177773 - DNA, 20 bp, Artificial Sequence
  Description of Artificial Sequence: Synthetic oligonucleotide
  Target: ATXN1; (-) strand; PAM type: YTN; PAM sequence: TTT
ttagtctgctcttcctccct

SEQ ID NO: 177774 - DNA, 20 bp, Artificial Sequence
  Description of Artificial Sequence: Synthetic oligonucleotide
  Target: ATXN1; (-) strand; PAM type: YTN; PAM sequence: TTT
tttagtctgctcttcctccc

SEQ ID NO: 177775 - DNA, 20 bp, Artificial Sequence
  Description of Artificial Sequence: Synthetic oligonucleotide
  Target: ATXN1; (-) strand; PAM type: YTN; PAM sequence: TTG
caataaaagagatgtatatt

SEQ ID NO: 177776 - DNA, 20 bp, Artificial Sequence
  Description of Artificial Sequence: Synthetic oligonucleotide
  Target: ATXN1; (-) strand; PAM type: YTN; PAM sequence: TTG
gtggtattgcaataaaagag

SEQ ID NO: 177777 - DNA, 20 bp, Artificial Sequence
  Description of Artificial Sequence: Synthetic oligonucleotide
  Target: ATXN1; (-) strand; PAM type: YTN; PAM sequence: CTC
aattggtggtattgcaataa

SEQ ID NO: 177778 - DNA, 20 bp, Artificial Sequence
  Description of Artificial Sequence: Synthetic oligonucleotide
  Target: ATXN1; (-) strand; PAM type: YTN; PAM sequence: CTC
tcaattggtggtattgcaat

SEQ ID NO: 177779 - DNA, 20 bp, Artificial Sequence
  Description of Artificial Sequence: Synthetic oligonucleotide
  Target: ATXN1; (-) strand; PAM type: YTN; PAM sequence: TTC
tctcaattggtggtattgca

SEQ ID NO: 177780 - DNA, 20 bp, Artificial Sequence
  Description of Artificial Sequence: Synthetic oligonucleotide
  Target: ATXN1; (-) strand; PAM type: YTN; PAM sequence: TTG
gcagacatcccccccagcag

SEQ ID NO: 177781 - DNA, 20 bp, Artificial Sequence
  Description of Artificial Sequence: Synthetic oligonucleotide
  Target: ATXN1; (-) strand; PAM type: YTN; PAM sequence: CTT
ggcagacatcccccccagca

SEQ ID NO: 177782 - DNA, 20 bp, Artificial Sequence
  Description of Artificial Sequence: Synthetic oligonucleotide
  Target: ATXN1; (-) strand; PAM type: YTN; PAM sequence: TTA
gaagtccttggcagacatcc

SEQ ID NO: 177783 - DNA, 20 bp, Artificial Sequence
  Description of Artificial Sequence: Synthetic oligonucleotide
  Target: ATXN1; (-) strand; PAM type: YTN; PAM sequence: CTG
aattagaagtccttggcaga

SEQ ID NO: 177784 - DNA, 20 bp, Artificial Sequence
  Description of Artificial Sequence: Synthetic oligonucleotide
  Target: ATXN1; (-) strand; PAM type: YTN; PAM sequence: TTA
aaaataaaacgggtggaaca

SEQ ID NO: 177785 - DNA, 20 bp, Artificial Sequence
  Description of Artificial Sequence: Synthetic oligonucleotide
  Target: ATXN1; (-) strand; PAM type: YTN; PAM sequence: TTT
aaaaataaaacgggtggaac

SEQ ID NO: 177786 - DNA, 20 bp, Artificial Sequence
  Description of Artificial Sequence: Synthetic oligonucleotide
  Target: ATXN1; (-) strand; PAM type: YTN; PAM sequence: CTC
gagtttaaaaataaaacggg

SEQ ID NO: 177787 - DNA, 20 bp, Artificial Sequence
  Description of Artificial Sequence: Synthetic oligonucleotide
  Target: ATXN1; (-) strand; PAM type: YTN; PAM sequence: CTG
cactcgagtttaaaaataaa

SEQ ID NO: 177788 - DNA, 20 bp, Artificial Sequence
  Description of Artificial Sequence: Synthetic oligonucleotide
  Target: ATXN1; (-) strand; PAM type: YTN; PAM sequence: TTC
caggaataaaatctgcactc

SEQ ID NO: 177789 - DNA, 20 bp, Artificial Sequence
  Description of Artificial Sequence: Synthetic oligonucleotide
  Target: ATXN1; (-) strand; PAM type: YTN; PAM sequence: TTA
taacattccaggaataaaat

SEQ ID NO: 177790 - DNA, 20 bp, Artificial Sequence
  Description of Artificial Sequence: Synthetic oligonucleotide
  Target: ATXN1; (-) strand; PAM type: YTN; PAM sequence: CTT
ataacattccaggaataaaa

SEQ ID NO: 177791 - DNA, 20 bp, Artificial Sequence
  Description of Artificial Sequence: Synthetic oligonucleotide
  Target: ATXN1; (-) strand; PAM type: YTN; PAM sequence: CTG
cccacaccaatcttataaca

SEQ ID NO: 177792 - DNA, 20 bp, Artificial Sequence
  Description of Artificial Sequence: Synthetic oligonucleotide
  Target: ATXN1; (-) strand; PAM type: YTN; PAM sequence: TTC
tgcccacaccaatcttataa

SEQ ID NO: 177793 - DNA, 20 bp, Artificial Sequence
  Description of Artificial Sequence: Synthetic oligonucleotide
  Target: ATXN1; (-) strand; PAM type: YTN; PAM sequence: TTT
ctgcccacaccaatcttata

SEQ ID NO: 177794 - DNA, 20 bp, Artificial Sequence
  Description of Artificial Sequence: Synthetic oligonucleotide
  Target: ATXN1; (-) strand; PAM type: YTN; PAM sequence: TTG
cccatttctgcccacaccaa

SEQ ID NO: 177795 - DNA, 20 bp, Artificial Sequence
  Description of Artificial Sequence: Synthetic oligonucleotide
  Target: ATXN1; (-) strand; PAM type: YTN; PAM sequence: TTT
gcccatttctgcccacacca

SEQ ID NO: 177796 - DNA, 20 bp, Artificial Sequence
  Description of Artificial Sequence: Synthetic oligonucleotide
  Target: ATXN1; (-) strand; PAM type: YTN; PAM sequence: CTG
aagtgaatttgcccatttct

SEQ ID NO: 177797 - DNA, 20 bp, Artificial Sequence
  Description of Artificial Sequence: Synthetic oligonucleotide
  Target: ATXN1; (-) strand; PAM type: YTN; PAM sequence: TTC
tgaagtgaatttgcccattt

SEQ ID NO: 177798 - DNA, 20 bp, Artificial Sequence
  Description of Artificial Sequence: Synthetic oligonucleotide
  Target: ATXN1; (-) strand; PAM type: YTN; PAM sequence: CTT
ctgaagtgaatttgcccatt

SEQ ID NO: 177799 - DNA, 20 bp, Artificial Sequence
  Description of Artificial Sequence: Synthetic oligonucleotide
  Target: ATXN1; (-) strand; PAM type: YTN; PAM sequence: TTA
taaagcacttctgaagtgaa

SEQ ID NO: 177800 - DNA, 20 bp, Artificial Sequence
  Description of Artificial Sequence: Synthetic oligonucleotide
  Target: ATXN1; (-) strand; PAM type: YTN; PAM sequence: TTG
ttataaagcacttctgaagt

SEQ ID NO: 177801 - DNA, 20 bp, Artificial Sequence
  Description of Artificial Sequence: Synthetic oligonucleotide
  Target: ATXN1; (-) strand; PAM type: YTN; PAM sequence: TTC
caagttgttataaagcactt

SEQ ID NO: 177802 - DNA, 20 bp, Artificial Sequence
  Description of Artificial Sequence: Synthetic oligonucleotide
  Target: ATXN1; (-) strand; PAM type: YTN; PAM sequence: TTT
ccaagttgttataaagcact

SEQ ID NO: 177803 - DNA, 20 bp, Artificial Sequence
  Description of Artificial Sequence: Synthetic oligonucleotide
  Target: ATXN1; (-) strand; PAM type: YTN; PAM sequence: TTT
tccaagttgttataaagcac

SEQ ID NO: 177804 - DNA, 20 bp, Artificial Sequence
  Description of Artificial Sequence: Synthetic oligonucleotide
  Target: ATXN1; (-) strand; PAM type: YTN; PAM sequence: CTT
ttccaagttgttataaagca

SEQ ID NO: 177805 - DNA, 20 bp, Artificial Sequence
  Description of Artificial Sequence: Synthetic oligonucleotide
  Target: ATXN1; (-) strand; PAM type: YTN; PAM sequence: TTA
gagggtcttttccaagttgt

SEQ ID NO: 177806 - DNA, 20 bp, Artificial Sequence
  Description of Artificial Sequence: Synthetic oligonucleotide
  Target: ATXN1; (-) strand; PAM type: YTN; PAM sequence: TTT
agagggtcttttccaagttg

SEQ ID NO: 177807 - DNA, 20 bp, Artificial Sequence
  Description of Artificial Sequence: Synthetic oligonucleotide
  Target: ATXN1; (-) strand; PAM type: YTN; PAM sequence: TTT
tagagggtcttttccaagtt

SEQ ID NO: 177808 - DNA, 20 bp, Artificial Sequence
  Description of Artificial Sequence: Synthetic oligonucleotide
  Target: ATXN1; (-) strand; PAM type: YTN; PAM sequence: TTG
gagaattttagagggtcttt

SEQ ID NO: 177809 - DNA, 20 bp, Artificial Sequence
  Description of Artificial Sequence: Synthetic oligonucleotide
  Target: ATXN1; (-) strand; PAM type: YTN; PAM sequence: CTT
ggagaattttagagggtctt

SEQ ID NO: 177810 - DNA, 20 bp, Artificial Sequence
  Description of Artificial Sequence: Synthetic oligonucleotide
  Target: ATXN1; (-) strand; PAM type: YTN; PAM sequence: CTA
aaatgtacttggagaatttt

SEQ ID NO: 177811 - DNA, 20 bp, Artificial Sequence
  Description of Artificial Sequence: Synthetic oligonucleotide
  Target: ATXN1; (-) strand; PAM type: YTN; PAM sequence: TTC
acccctaaaatgtacttgga

SEQ ID NO: 177812 - DNA, 20 bp, Artificial Sequence
  Description of Artificial Sequence: Synthetic oligonucleotide
  Target: ATXN1; (-) strand; PAM type: YTN; PAM sequence: CTT
cacccctaaaatgtacttgg

SEQ ID NO: 177813 - DNA, 20 bp, Artificial Sequence
  Description of Artificial Sequence: Synthetic oligonucleotide
  Target: ATXN1; (-) strand; PAM type: YTN; PAM sequence: TTC
agaaaagagagaaatgaact

SEQ ID NO: 177814 - DNA, 20 bp, Artificial Sequence
  Description of Artificial Sequence: Synthetic oligonucleotide
  Target: ATXN1; (-) strand; PAM type: YTN; PAM sequence: CTT
cagaaaagagagaaatgaac

SEQ ID NO: 177815 - DNA, 20 bp, Artificial Sequence
  Description of Artificial Sequence: Synthetic oligonucleotide
  Target: ATXN1; (-) strand; PAM type: YTN; PAM sequence: TTC
ttcagaaaagagagaaatga

SEQ ID NO: 177816 - DNA, 20 bp, Artificial Sequence
  Description of Artificial Sequence: Synthetic oligonucleotide
  Target: ATXN1; (-) strand; PAM type: YTN; PAM sequence: TTT
cttcagaaaagagagaaatg

SEQ ID NO: 177817 - DNA, 20 bp, Artificial Sequence
  Description of Artificial Sequence: Synthetic oligonucleotide
  Target: ATXN1; (-) strand; PAM type: YTN; PAM sequence: CTT
tcttcagaaaagagagaaat

SEQ ID NO: 177818 - DNA, 20 bp, Artificial Sequence
  Description of Artificial Sequence: Synthetic oligonucleotide
  Target: ATXN1; (-) strand; PAM type: YTN; PAM sequence: CTG
caaaatcaaggcagctttct

SEQ ID NO: 177819 - DNA, 20 bp, Artificial Sequence
  Description of Artificial Sequence: Synthetic oligonucleotide
  Target: ATXN1; (-) strand; PAM type: YTN; PAM sequence: TTC
tgcaaaatcaaggcagcttt

SEQ ID NO: 177820 - DNA, 20 bp, Artificial Sequence
  Description of Artificial Sequence: Synthetic oligonucleotide
  Target: ATXN1; (-) strand; PAM type: YTN; PAM sequence: CTT
ctgcaaaatcaaggcagctt

SEQ ID NO: 177821 - DNA, 20 bp, Artificial Sequence
  Description of Artificial Sequence: Synthetic oligonucleotide
  Target: ATXN1; (-) strand; PAM type: YTN; PAM sequence: TTA
cttctgcaaaatcaaggcag

SEQ ID NO: 177822 - DNA, 20 bp, Artificial Sequence
  Description of Artificial Sequence: Synthetic oligonucleotide
  Target: ATXN1; (-) strand; PAM type: YTN; PAM sequence: TTT
acttctgcaaaatcaaggca

SEQ ID NO: 177823 - DNA, 20 bp, Artificial Sequence
  Description of Artificial Sequence: Synthetic oligonucleotide
  Target: ATXN1; (-) strand; PAM type: YTN; PAM sequence: TTT
tacttctgcaaaatcaaggc

SEQ ID NO: 177824 - DNA, 20 bp, Artificial Sequence
  Description of Artificial Sequence: Synthetic oligonucleotide
  Target: ATXN1; (-) strand; PAM type: YTN; PAM sequence: CTC
gagttttacttctgcaaaat

SEQ ID NO: 177825 - DNA, 20 bp, Artificial Sequence
  Description of Artificial Sequence: Synthetic oligonucleotide
  Target: ATXN1; (-) strand; PAM type: YTN; PAM sequence: TTA
tactcgagttttacttctgc

SEQ ID NO: 177826 - DNA, 20 bp, Artificial Sequence
  Description of Artificial Sequence: Synthetic oligonucleotide
  Target: ATXN1; (-) strand; PAM type: YTN; PAM sequence: TTC
aaaattatactcgagtttta

SEQ ID NO: 177827 - DNA, 20 bp, Artificial Sequence
  Description of Artificial Sequence: Synthetic oligonucleotide
  Target: ATXN1; (-) strand; PAM type: YTN; PAM sequence: TTT
caaaattatactcgagtttt

SEQ ID NO: 177828 - DNA, 20 bp, Artificial Sequence
  Description of Artificial Sequence: Synthetic oligonucleotide
  Target: ATXN1; (-) strand; PAM type: YTN; PAM sequence: CTT
tcaaaattatactcgagttt

SEQ ID NO: 177829 - DNA, 20 bp, Artificial Sequence
  Description of Artificial Sequence: Synthetic oligonucleotide
  Target: ATXN1; (-) strand; PAM type: YTN; PAM sequence: TTG
aaatgctttcaaaattatac

SEQ ID NO: 177830 - DNA, 20 bp, Artificial Sequence
  Description of Artificial Sequence: Synthetic oligonucleotide
  Target: ATXN1; (-) strand; PAM type: YTN; PAM sequence: TTT
gaaatgctttcaaaattata

SEQ ID NO: 177831 - DNA, 20 bp, Artificial Sequence
  Description of Artificial Sequence: Synthetic oligonucleotide
  Target: ATXN1; (-) strand; PAM type: YTN; PAM sequence: TTT
tgaaatgctttcaaaattat

SEQ ID NO: 177832 - DNA, 20 bp, Artificial Sequence
  Description of Artificial Sequence: Synthetic oligonucleotide
  Target: ATXN1; (-) strand; PAM type: YTN; PAM sequence: CTA
ttttgaaatgctttcaaaat

SEQ ID NO: 177833 - DNA, 20 bp, Artificial Sequence
  Description of Artificial Sequence: Synthetic oligonucleotide
  Target: ATXN1; (-) strand; PAM type: YTN; PAM sequence: TTA
aatacccaatagatagcatc

SEQ ID NO: 177834 - DNA, 20 bp, Artificial Sequence
  Description of Artificial Sequence: Synthetic oligonucleotide
  Target: ATXN1; (-) strand; PAM type: YTN; PAM sequence: CTG
gaaaatagttaaatacccaa

SEQ ID NO: 177835 - DNA, 20 bp, Artificial Sequence
  Description of Artificial Sequence: Synthetic oligonucleotide
  Target: ATXN1; (-) strand; PAM type: YTN; PAM sequence: CTC
cctggaaaatagttaaatac

SEQ ID NO: 177836 - DNA, 20 bp, Artificial Sequence
  Description of Artificial Sequence: Synthetic oligonucleotide
  Target: ATXN1; (-) strand; PAM type: YTN; PAM sequence: TTA
taatactccctggaaaatag

SEQ ID NO: 177837 - DNA, 20 bp, Artificial Sequence
  Description of Artificial Sequence: Synthetic oligonucleotide
  Target: ATXN1; (-) strand; PAM type: YTN; PAM sequence: TTG
ttataatactccctggaaaa

SEQ ID NO: 177838 - DNA, 20 bp, Artificial Sequence
  Description of Artificial Sequence: Synthetic oligonucleotide
  Target: ATXN1; (-) strand; PAM type: YTN; PAM sequence: CTA
tgcaaattgttataatactc

SEQ ID NO: 177839 - DNA, 20 bp, Artificial Sequence
  Description of Artificial Sequence: Synthetic oligonucleotide
  Target: ATXN1; (-) strand; PAM type: YTN; PAM sequence: TTA
aatgagagactatgcaaatt

SEQ ID NO: 177840 - DNA, 20 bp, Artificial Sequence
  Description of Artificial Sequence: Synthetic oligonucleotide
  Target: ATXN1; (-) strand; PAM type: YTN; PAM sequence: TTG
tgagaattaaatgagagact

SEQ ID NO: 177841 - DNA, 20 bp, Artificial Sequence
  Description of Artificial Sequence: Synthetic oligonucleotide
  Target: ATXN1; (-) strand; PAM type: YTN; PAM sequence: TTG
cccgtaaatgggggtgatga

SEQ ID NO: 177842 - DNA, 20 bp, Artificial Sequence
  Description of Artificial Sequence: Synthetic oligonucleotide
  Target: ATXN1; (-) strand; PAM type: YTN; PAM sequence: CTT
gcccgtaaatgggggtgatg

SEQ ID NO: 177843 - DNA, 20 bp, Artificial Sequence
  Description of Artificial Sequence: Synthetic oligonucleotide
  Target: ATXN1; (-) strand; PAM type: YTN; PAM sequence: TTC
ttgcccgtaaatgggggtga

SEQ ID NO: 177844 - DNA, 20 bp, Artificial Sequence
  Description of Artificial Sequence: Synthetic oligonucleotide
  Target: ATXN1; (-) strand; PAM type: YTN; PAM sequence: TTT
cttgcccgtaaatgggggtg

SEQ ID NO: 177845 - DNA, 20 bp, Artificial Sequence
  Description of Artificial Sequence: Synthetic oligonucleotide
  Target: ATXN1; (-) strand; PAM type: YTN; PAM sequence: TTA
gtttcttgcccgtaaatggg

SEQ ID NO: 177846 - DNA, 20 bp, Artificial Sequence
  Description of Artificial Sequence: Synthetic oligonucleotide
  Target: ATXN1; (-) strand; PAM type: YTN; PAM sequence: CTT
agtttcttgcccgtaaatgg

SEQ ID NO: 177847 - DNA, 20 bp, Artificial Sequence
  Description of Artificial Sequence: Synthetic oligonucleotide
  Target: ATXN1; (-) strand; PAM type: YTN; PAM sequence: CTG
ccttagtttcttgcccgtaa

SEQ ID NO: 177848 - DNA, 20 bp, Artificial Sequence
  Description of Artificial Sequence: Synthetic oligonucleotide
  Target: ATXN1; (-) strand; PAM type: YTN; PAM sequence: CTC
cctgccttagtttcttgccc

SEQ ID NO: 177849 - DNA, 20 bp, Artificial Sequence
  Description of Artificial Sequence: Synthetic oligonucleotide
  Target: ATXN1; (-) strand; PAM type: YTN; PAM sequence: TTC
tccctgccttagtttcttgc

SEQ ID NO: 177850 - DNA, 20 bp, Artificial Sequence
  Description of Artificial Sequence: Synthetic oligonucleotide
  Target: ATXN1; (-) strand; PAM type: YTN; PAM sequence: CTG
gcagttctccctgccttagt

SEQ ID NO: 177851 - DNA, 20 bp, Artificial Sequence
  Description of Artificial Sequence: Synthetic oligonucleotide
  Target: ATXN1; (-) strand; PAM type: YTN; PAM sequence: CTC
tggcagttctccctgcctta

SEQ ID NO: 177852 - DNA, 20 bp, Artificial Sequence
  Description of Artificial Sequence: Synthetic oligonucleotide
  Target: ATXN1; (-) strand; PAM type: YTN; PAM sequence: CTC
aactctggcagttctccctg

SEQ ID NO: 177853 - DNA, 20 bp, Artificial Sequence
  Description of Artificial Sequence: Synthetic oligonucleotide
  Target: ATXN1; (-) strand; PAM type: YTN; PAM sequence: TTG
aactcaactctggcagttct

SEQ ID NO: 177854 - DNA, 20 bp, Artificial Sequence
  Description of Artificial Sequence: Synthetic oligonucleotide
  Target: ATXN1; (-) strand; PAM type: YTN; PAM sequence: TTT
gaactcaactctggcagttc

SEQ ID NO: 177855 - DNA, 20 bp, Artificial Sequence
  Description of Artificial Sequence: Synthetic oligonucleotide
  Target: ATXN1; (-) strand; PAM type: YTN; PAM sequence: CTG
gatttgaactcaactctggc

SEQ ID NO: 177856 - DNA, 20 bp, Artificial Sequence
  Description of Artificial Sequence: Synthetic oligonucleotide
  Target: ATXN1; (-) strand; PAM type: YTN; PAM sequence: TTG
atatcgtggagatctggatt

SEQ ID NO: 177857 - DNA, 20 bp, Artificial Sequence
  Description of Artificial Sequence: Synthetic oligonucleotide
  Target: ATXN1; (-) strand; PAM type: YTN; PAM sequence: TTT
gatatcgtggagatctggat

SEQ ID NO: 177858 - DNA, 20 bp, Artificial Sequence
  Description of Artificial Sequence: Synthetic oligonucleotide
  Target: ATXN1; (-) strand; PAM type: YTN; PAM sequence: TTT
tgatatcgtggagatctgga

SEQ ID NO: 177859 - DNA, 20 bp, Artificial Sequence
  Description of Artificial Sequence: Synthetic oligonucleotide
  Target: ATXN1; (-) strand; PAM type: YTN; PAM sequence: TTG
catagtggcgaagaaggatt

SEQ ID NO: 177860 - DNA, 20 bp, Artificial Sequence
  Description of Artificial Sequence: Synthetic oligonucleotide
  Target: ATXN1; (-) strand; PAM type: YTN; PAM sequence: CTG
gatatgaatacacgaaagca

SEQ ID NO: 177861 - DNA, 20 bp, Artificial Sequence
  Description of Artificial Sequence: Synthetic oligonucleotide
  Target: ATXN1; (-) strand; PAM type: YTN; PAM sequence: TTA
tgatgtcctggatatgaata

SEQ ID NO: 177862 - DNA, 20 bp, Artificial Sequence
  Description of Artificial Sequence: Synthetic oligonucleotide
  Target: ATXN1; (-) strand; PAM type: YTN; PAM sequence: TTT
atgatgtcctggatatgaat

SEQ ID NO: 177863 - DNA, 20 bp, Artificial Sequence
  Description of Artificial Sequence: Synthetic oligonucleotide
  Target: ATXN1; (-) strand; PAM type: YTN; PAM sequence: TTG
atagtttatgatgtcctgga

SEQ ID NO: 177864 - DNA, 20 bp, Artificial Sequence
  Description of Artificial Sequence: Synthetic oligonucleotide
  Target: ATXN1; (-) strand; PAM type: YTN; PAM sequence: CTG
tattgatagtttatgatgtc

SEQ ID NO: 177865 - DNA, 20 bp, Artificial Sequence
  Description of Artificial Sequence: Synthetic oligonucleotide
  Target: ATXN1; (-) strand; PAM type: YTN; PAM sequence: TTA
atacatcgtctgtattgata

SEQ ID NO: 177866 - DNA, 20 bp, Artificial Sequence
  Description of Artificial Sequence: Synthetic oligonucleotide
  Target: ATXN1; (-) strand; PAM type: YTN; PAM sequence: TTT
aatacatcgtctgtattgat

SEQ ID NO: 177867 - DNA, 20 bp, Artificial Sequence
  Description of Artificial Sequence: Synthetic oligonucleotide
  Target: ATXN1; (-) strand; PAM type: YTN; PAM sequence: TTA
tttaatacatcgtctgtatt

SEQ ID NO: 177868 - DNA, 20 bp, Artificial Sequence
  Description of Artificial Sequence: Synthetic oligonucleotide
  Target: ATXN1; (-) strand; PAM type: YTN; PAM sequence: TTT
atttaatacatcgtctgtat

SEQ ID NO: 177869 - DNA, 20 bp, Artificial Sequence
  Description of Artificial Sequence: Synthetic oligonucleotide
  Target: ATXN1; (-) strand; PAM type: YTN; PAM sequence: TTG
tatatttatttaatacatcg

SEQ ID NO: 177870 - DNA, 20 bp, Artificial Sequence
  Description of Artificial Sequence: Synthetic oligonucleotide
  Target: ATXN1; (-) strand; PAM type: YTN; PAM sequence: CTG
atggccaagttgtatattta

SEQ ID NO: 177871 - DNA, 20 bp, Artificial Sequence
  Description of Artificial Sequence: Synthetic oligonucleotide
  Target: ATXN1; (-) strand; PAM type: YTN; PAM sequence: TTA
gaatgataaatagtagcctg

SEQ ID NO: 177872 - DNA, 20 bp, Artificial Sequence
  Description of Artificial Sequence: Synthetic oligonucleotide
  Target: ATXN1; (-) strand; PAM type: YTN; PAM sequence: CTG
ttagaatgataaatagtagc

SEQ ID NO: 177873 - DNA, 20 bp, Artificial Sequence
  Description of Artificial Sequence: Synthetic oligonucleotide
  Target: ATXN1; (-) strand; PAM type: YTN; PAM sequence: TTG
cccccatcctgttagaatga

SEQ ID NO: 177874 - DNA, 20 bp, Artificial Sequence
  Description of Artificial Sequence: Synthetic oligonucleotide
  Target: ATXN1; (-) strand; PAM type: YTN; PAM sequence: TTT
gcccccatcctgttagaatg

SEQ ID NO: 177875 - DNA, 20 bp, Artificial Sequence
  Description of Artificial Sequence: Synthetic oligonucleotide
  Target: ATXN1; (-) strand; PAM type: YTN; PAM sequence: TTT
tgcccccatcctgttagaat

SEQ ID NO: 177876 - DNA, 20 bp, Artificial Sequence
  Description of Artificial Sequence: Synthetic oligonucleotide
  Target: ATXN1; (-) strand; PAM type: YTN; PAM sequence: CTT
ttgcccccatcctgttagaa

SEQ ID NO: 177877 - DNA, 20 bp, Artificial Sequence
  Description of Artificial Sequence: Synthetic oligonucleotide
  Target: ATXN1; (-) strand; PAM type: YTN; PAM sequence: CTG
cttttgcccccatcctgtta

SEQ ID NO: 177878 - DNA, 20 bp, Artificial Sequence
  Description of Artificial Sequence: Synthetic oligonucleotide
  Target: ATXN1; (-) strand; PAM type: YTN; PAM sequence: CTA
aggaatctgcttttgccccc

SEQ ID NO: 177879 - DNA, 20 bp, Artificial Sequence
  Description of Artificial Sequence: Synthetic oligonucleotide
  Target: ATXN1; (-) strand; PAM type: YTN; PAM sequence: CTC
atcagaaaagcaggctaagg

SEQ ID NO: 177880 - DNA, 20 bp, Artificial Sequence
  Description of Artificial Sequence: Synthetic oligonucleotide
  Target: ATXN1; (-) strand; PAM type: YTN; PAM sequence: CTC
tcatcagaaaagcaggctaa

SEQ ID NO: 177881 - DNA, 20 bp, Artificial Sequence
  Description of Artificial Sequence: Synthetic oligonucleotide
  Target: ATXN1; (-) strand; PAM type: YTN; PAM sequence: CTC
ccccgcgatctctcatcaga

SEQ ID NO: 177882 - DNA, 20 bp, Artificial Sequence
  Description of Artificial Sequence: Synthetic oligonucleotide
  Target: ATXN1; (-) strand; PAM type: YTN; PAM sequence: TTG
gctcccccgcgatctctcat

SEQ ID NO: 177883 - DNA, 20 bp, Artificial Sequence
  Description of Artificial Sequence: Synthetic oligonucleotide
  Target: ATXN1; (-) strand; PAM type: YTN; PAM sequence: TTT
ggctcccccgcgatctctca

SEQ ID NO: 177884 - DNA, 20 bp, Artificial Sequence
  Description of Artificial Sequence: Synthetic oligonucleotide
  Target: ATXN1; (-) strand; PAM type: YTN; PAM sequence: CTT
tggctcccccgcgatctctc

SEQ ID NO: 177885 - DNA, 20 bp, Artificial Sequence
  Description of Artificial Sequence: Synthetic oligonucleotide
  Target: ATXN1; (-) strand; PAM type: YTN; PAM sequence: CTG
cctttggctcccccgcgatc

SEQ ID NO: 177886 - DNA, 20 bp, Artificial Sequence
  Description of Artificial Sequence: Synthetic oligonucleotide
  Target: ATXN1; (-) strand; PAM type: YTN; PAM sequence: TTG
caaactgcctttggctcccc

SEQ ID NO: 177887 - DNA, 20 bp, Artificial Sequence
  Description of Artificial Sequence: Synthetic oligonucleotide
  Target: ATXN1; (-) strand; PAM type: YTN; PAM sequence: TTT
gcaaactgcctttggctccc

SEQ ID NO: 177888 - DNA, 20 bp, Artificial Sequence
  Description of Artificial Sequence: Synthetic oligonucleotide
  Target: ATXN1; (-) strand; PAM type: YTN; PAM sequence: TTT
tgcaaactgcctttggctcc

SEQ ID NO: 177889 - DNA, 20 bp, Artificial Sequence
  Description of Artificial Sequence: Synthetic oligonucleotide
  Target: ATXN1; (-) strand; PAM type: YTN; PAM sequence: CTT
ttgcaaactgcctttggctc

SEQ ID NO: 177890 - DNA, 20 bp, Artificial Sequence
  Description of Artificial Sequence: Synthetic oligonucleotide
  Target: ATXN1; (-) strand; PAM type: YTN; PAM sequence: CTC
ttttgcaaactgcctttggc

SEQ ID NO: 177891 - DNA, 20 bp, Artificial Sequence
  Description of Artificial Sequence: Synthetic oligonucleotide
  Target: ATXN1; (-) strand; PAM type: YTN; PAM sequence: CTG
gtcctcttttgcaaactgcc

SEQ ID NO: 177892 - DNA, 20 bp, Artificial Sequence
  Description of Artificial Sequence: Synthetic oligonucleotide
  Target: ATXN1; (-) strand; PAM type: YTN; PAM sequence: CTG
cgcagagactggtcctcttt

SEQ ID NO: 177893 - DNA, 20 bp, Artificial Sequence
  Description of Artificial Sequence: Synthetic oligonucleotide
  Target: ATXN1; (-) strand; PAM type: YTN; PAM sequence: CTC
ctgcgcagagactggtcctc

SEQ ID NO: 177894 - DNA, 20 bp, Artificial Sequence
  Description of Artificial Sequence: Synthetic oligonucleotide
  Target: ATXN1; (-) strand; PAM type: YTN; PAM sequence: TTA
ccaccaaaactcctgcgcag

SEQ ID NO: 177895 - DNA, 20 bp, Artificial Sequence
  Description of Artificial Sequence: Synthetic oligonucleotide
  Target: ATXN1; (-) strand; PAM type: YTN; PAM sequence: TTT
accaccaaaactcctgcgca

SEQ ID NO: 177896 - DNA, 20 bp, Artificial Sequence
  Description of Artificial Sequence: Synthetic oligonucleotide
  Target: ATXN1; (-) strand; PAM type: YTN; PAM sequence: CTC
acatgtttaccaccaaaact

SEQ ID NO: 177897 - DNA, 20 bp, Artificial Sequence
  Description of Artificial Sequence: Synthetic oligonucleotide
  Target: ATXN1; (-) strand; PAM type: YTN; PAM sequence: CTG
gataccctcacatgtttacc

SEQ ID NO: 177898 - DNA, 20 bp, Artificial Sequence
  Description of Artificial Sequence: Synthetic oligonucleotide
  Target: ATXN1; (-) strand; PAM type: YTN; PAM sequence: CTC
tggataccctcacatgttta

SEQ ID NO: 177899 - DNA, 20 bp, Artificial Sequence
  Description of Artificial Sequence: Synthetic oligonucleotide
  Target: ATXN1; (-) strand; PAM type: YTN; PAM sequence: CTC
tctggataccctcacatgtt

SEQ ID NO: 177900 - DNA, 20 bp, Artificial Sequence
  Description of Artificial Sequence: Synthetic oligonucleotide
  Target: ATXN1; (-) strand; PAM type: YTN; PAM sequence: TTC
catcactctctggataccct

SEQ ID NO: 177901 - DNA, 20 bp, Artificial Sequence
  Description of Artificial Sequence: Synthetic oligonucleotide
  Target: ATXN1; (-) strand; PAM type: YTN; PAM sequence: TTT
ccatcactctctggataccc

SEQ ID NO: 177902 - DNA, 20 bp, Artificial Sequence
  Description of Artificial Sequence: Synthetic oligonucleotide
  Target: ATXN1; (-) strand; PAM type: YTN; PAM sequence: TTA
tccaccatttccatcactct

SEQ ID NO: 177903 - DNA, 20 bp, Artificial Sequence
  Description of Artificial Sequence: Synthetic oligonucleotide
  Target: ATXN1; (-) strand; PAM type: YTN; PAM sequence: TTC
aaaataaatagattatccac

SEQ ID NO: 177904 - DNA, 20 bp, Artificial Sequence
  Description of Artificial Sequence: Synthetic oligonucleotide
  Target: ATXN1; (-) strand; PAM type: YTN; PAM sequence: TTT
caaaataaatagattatcca

SEQ ID NO: 177905 - DNA, 20 bp, Artificial Sequence
  Description of Artificial Sequence: Synthetic oligonucleotide
  Target: ATXN1; (-) strand; PAM type: YTN; PAM sequence: TTG
gtatttcaaaataaatagat

SEQ ID NO: 177906 - DNA, 20 bp, Artificial Sequence
  Description of Artificial Sequence: Synthetic oligonucleotide
  Target: ATXN1; (-) strand; PAM type: YTN; PAM sequence: TTT
ggtatttcaaaataaataga

SEQ ID NO: 177907 - DNA, 20 bp, Artificial Sequence
  Description of Artificial Sequence: Synthetic oligonucleotide
  Target: ATXN1; (-) strand; PAM type: YTN; PAM sequence: TTA
gtaccatttggtatttcaaa

SEQ ID NO: 177908 - DNA, 20 bp, Artificial Sequence
  Description of Artificial Sequence: Synthetic oligonucleotide
  Target: ATXN1; (-) strand; PAM type: YTN; PAM sequence: TTA
tattagtaccatttggtatt

SEQ ID NO: 177909 - DNA, 20 bp, Artificial Sequence
  Description of Artificial Sequence: Synthetic oligonucleotide
  Target: ATXN1; (-) strand; PAM type: YTN; PAM sequence: TTT
atattagtaccatttggtat

SEQ ID NO: 177910 - DNA, 20 bp, Artificial Sequence
  Description of Artificial Sequence: Synthetic oligonucleotide
  Target: ATXN1; (-) strand; PAM type: YTN; PAM sequence: TTT
tatattagtaccatttggta

SEQ ID NO: 177911 - DNA, 20 bp, Artificial Sequence
  Description of Artificial Sequence: Synthetic oligonucleotide
  Target: ATXN1; (-) strand; PAM type: YTN; PAM sequence: TTT
ttatattagtaccatttggt

SEQ ID NO: 177912 - DNA, 20 bp, Artificial Sequence
  Description of Artificial Sequence: Synthetic oligonucleotide
  Target: ATXN1; (-) strand; PAM type: YTN; PAM sequence: TTG
aacaagtttttatattagta

SEQ ID NO: 177913 - DNA, 20 bp, Artificial Sequence
  Description of Artificial Sequence: Synthetic oligonucleotide
  Target: ATXN1; (-) strand; PAM type: YTN; PAM sequence: TTG
ccaaagtaggttgaacaagt

SEQ ID NO: 177914 - DNA, 20 bp, Artificial Sequence
  Description of Artificial Sequence: Synthetic oligonucleotide
  Target: ATXN1; (-) strand; PAM type: YTN; PAM sequence: TTA
atgttgccaaagtaggttga

SEQ ID NO: 177915 - DNA, 20 bp, Artificial Sequence
  Description of Artificial Sequence: Synthetic oligonucleotide
  Target: ATXN1; (-) strand; PAM type: YTN; PAM sequence: TTT
aatgttgccaaagtaggttg

SEQ ID NO: 177916 - DNA, 20 bp, Artificial Sequence
  Description of Artificial Sequence: Synthetic oligonucleotide
  Target: ATXN1; (-) strand; PAM type: YTN; PAM sequence: TTC
atatttaatgttgccaaagt

SEQ ID NO: 177917 - DNA, 20 bp, Artificial Sequence
  Description of Artificial Sequence: Synthetic oligonucleotide
  Target: ATXN1; (-) strand; PAM type: YTN; PAM sequence: CTT
catatttaatgttgccaaag

SEQ ID NO: 177918 - DNA, 20 bp, Artificial Sequence
  Description of Artificial Sequence: Synthetic oligonucleotide
  Target: ATXN1; (-) strand; PAM type: YTN; PAM sequence: TTC
ccttcatatttaatgttgcc

SEQ ID NO: 177919 - DNA, 20 bp, Artificial Sequence
  Description of Artificial Sequence: Synthetic oligonucleotide
  Target: ATXN1; (-) strand; PAM type: YTN; PAM sequence: TTG
gaggaggggaagaaggtaca

SEQ ID NO: 177920 - DNA, 20 bp, Artificial Sequence
  Description of Artificial Sequence: Synthetic oligonucleotide
  Target: ATXN1; (-) strand; PAM type: YTN; PAM sequence: TTT
ggaggaggggaagaaggtac

SEQ ID NO: 177921 - DNA, 20 bp, Artificial Sequence
  Description of Artificial Sequence: Synthetic oligonucleotide
  Target: ATXN1; (-) strand; PAM type: YTN; PAM sequence: TTT
tggaggaggggaagaaggta

SEQ ID NO: 177922 - DNA, 20 bp, Artificial Sequence
  Description of Artificial Sequence: Synthetic oligonucleotide
  Target: ATXN1; (-) strand; PAM type: YTN; PAM sequence: CTT
ttggaggaggggaagaaggt

SEQ ID NO: 177923 - DNA, 20 bp, Artificial Sequence
  Description of Artificial Sequence: Synthetic oligonucleotide
  Target: ATXN1; (-) strand; PAM type: YTN; PAM sequence: TTG
aagtaaatacttttggagga

SEQ ID NO: 177924 - DNA, 20 bp, Artificial Sequence
  Description of Artificial Sequence: Synthetic oligonucleotide
  Target: ATXN1; (-) strand; PAM type: YTN; PAM sequence: TTT
gaagtaaatacttttggagg

SEQ ID NO: 177925 - DNA, 20 bp, Artificial Sequence
  Description of Artificial Sequence: Synthetic oligonucleotide
  Target: ATXN1; (-) strand; PAM type: YTN; PAM sequence: TTT
tgaagtaaatacttttggag

SEQ ID NO: 177926 - DNA, 20 bp, Artificial Sequence
  Description of Artificial Sequence: Synthetic oligonucleotide
  Target: ATXN1; (-) strand; PAM type: YTN; PAM sequence: TTT
ttgaagtaaatacttttgga

SEQ ID NO: 177927 - DNA, 20 bp, Artificial Sequence
  Description of Artificial Sequence: Synthetic oligonucleotide
  Target: ATXN1; (-) strand; PAM type: YTN; PAM sequence: CTG
agcaaaatgcagcaataacc

SEQ ID NO: 177928 - DNA, 20 bp, Artificial Sequence
  Description of Artificial Sequence: Synthetic oligonucleotide
  Target: ATXN1; (-) strand; PAM type: YTN; PAM sequence: CTC
agaaccactgagcaaaatgc

SEQ ID NO: 177929 - DNA, 20 bp, Artificial Sequence
  Description of Artificial Sequence: Synthetic oligonucleotide
  Target: ATXN1; (-) strand; PAM type: YTN; PAM sequence: TTC
tcagaaccactgagcaaaat

SEQ ID NO: 177930 - DNA, 20 bp, Artificial Sequence
  Description of Artificial Sequence: Synthetic oligonucleotide
  Target: ATXN1; (-) strand; PAM type: YTN; PAM sequence: TTT
ctcagaaccactgagcaaaa

SEQ ID NO: 177931 - DNA, 20 bp, Artificial Sequence
  Description of Artificial Sequence: Synthetic oligonucleotide
  Target: ATXN1; (-) strand; PAM type: YTN; PAM sequence: TTC
catgcggtttctcagaacca

SEQ ID NO: 177932 - DNA, 20 bp, Artificial Sequence
  Description of Artificial Sequence: Synthetic oligonucleotide
  Target: ATXN1; (-) strand; PAM type: YTN; PAM sequence: TTT
ccatgcggtttctcagaacc

SEQ ID NO: 177933 - DNA, 20 bp, Artificial Sequence
  Description of Artificial Sequence: Synthetic oligonucleotide
  Target: ATXN1; (-) strand; PAM type: YTN; PAM sequence: TTT
tccatgcggtttctcagaac

SEQ ID NO: 177934 - DNA, 20 bp, Artificial Sequence
  Description of Artificial Sequence: Synthetic oligonucleotide
  Target: ATXN1; (-) strand; PAM type: YTN; PAM sequence: TTG
tgattttccatgcggtttct

SEQ ID NO: 177935 - DNA, 20 bp, Artificial Sequence
  Description of Artificial Sequence: Synthetic oligonucleotide
  Target: ATXN1; (-) strand; PAM type: YTN; PAM sequence: TTA
acgagtgtaacattgtgatt

SEQ ID NO: 177936 - DNA, 20 bp, Artificial Sequence
  Description of Artificial Sequence: Synthetic oligonucleotide
  Target: ATXN1; (-) strand; PAM type: YTN; PAM sequence: TTT
aacgagtgtaacattgtgat

SEQ ID NO: 177937 - DNA, 20 bp, Artificial Sequence
  Description of Artificial Sequence: Synthetic oligonucleotide
  Target: ATXN1; (-) strand; PAM type: YTN; PAM sequence: CTG
cagggtcaatttaacgagtg

SEQ ID NO: 177938 - DNA, 20 bp, Artificial Sequence
  Description of Artificial Sequence: Synthetic oligonucleotide
  Target: ATXN1; (-) strand; PAM type: YTN; PAM sequence: CTG
gtggtagagccctgcagggt

SEQ ID NO: 177939 - DNA, 20 bp, Artificial Sequence
  Description of Artificial Sequence: Synthetic oligonucleotide
  Target: ATXN1; (-) strand; PAM type: YTN; PAM sequence: TTG
ggatgatgcatgtactggtg

SEQ ID NO: 177940 - DNA, 20 bp, Artificial Sequence
  Description of Artificial Sequence: Synthetic oligonucleotide
  Target: ATXN1; (-) strand; PAM type: YTN; PAM sequence: CTT
gggatgatgcatgtactggt

SEQ ID NO: 177941 - DNA, 20 bp, Artificial Sequence
  Description of Artificial Sequence: Synthetic oligonucleotide
  Target: ATXN1; (-) strand; PAM type: YTN; PAM sequence: CTC
ttgggatgatgcatgtactg

SEQ ID NO: 177942 - DNA, 20 bp, Artificial Sequence
  Description of Artificial Sequence: Synthetic oligonucleotide
  Target: ATXN1; (-) strand; PAM type: YTN; PAM sequence: TTA
cctcttgggatgatgcatgt

SEQ ID NO: 177943 - DNA, 20 bp, Artificial Sequence
  Description of Artificial Sequence: Synthetic oligonucleotide
  Target: ATXN1; (-) strand; PAM type: YTN; PAM sequence: TTT
acctcttgggatgatgcatg

SEQ ID NO: 177944 - DNA, 20 bp, Artificial Sequence
  Description of Artificial Sequence: Synthetic oligonucleotide
  Target: ATXN1; (-) strand; PAM type: YTN; PAM sequence: TTT
tacctcttgggatgatgcat

SEQ ID NO: 177945 - DNA, 20 bp, Artificial Sequence
  Description of Artificial Sequence: Synthetic oligonucleotide
  Target: ATXN1; (-) strand; PAM type: YTN; PAM sequence: TTT
ttacctcttgggatgatgca

SEQ ID NO: 177946 - DNA, 20 bp, Artificial Sequence
  Description of Artificial Sequence: Synthetic oligonucleotide
  Target: ATXN1; (-) strand; PAM type: YTN; PAM sequence: CTT
tttacctcttgggatgatgc

SEQ ID NO: 177947 - DNA, 20 bp, Artificial Sequence
  Description of Artificial Sequence: Synthetic oligonucleotide
  Target: ATXN1; (-) strand; PAM type: YTN; PAM sequence: TTG
cctttttacctcttgggatg

SEQ ID NO: 177948 - DNA, 20 bp, Artificial Sequence
  Description of Artificial Sequence: Synthetic oligonucleotide
  Target: ATXN1; (-) strand; PAM type: YTN; PAM sequence: CTT
gcctttttacctcttgggat

SEQ ID NO: 177949 - DNA, 20 bp, Artificial Sequence
  Description of Artificial Sequence: Synthetic oligonucleotide
  Target: ATXN1; (-) strand; PAM type: YTN; PAM sequence: CTG
gcagccttgcctttttacct

SEQ ID NO: 177950 - DNA, 20 bp, Artificial Sequence
  Description of Artificial Sequence: Synthetic oligonucleotide
  Target: ATXN1; (-) strand; PAM type: YTN; PAM sequence: CTC
agcatgagcctggcagcctt

SEQ ID NO: 177951 - DNA, 20 bp, Artificial Sequence
  Description of Artificial Sequence: Synthetic oligonucleotide
  Target: ATXN1; (-) strand; PAM type: YTN; PAM sequence: TTC
tcagcatgagcctggcagcc

SEQ ID NO: 177952 - DNA, 20 bp, Artificial Sequence
  Description of Artificial Sequence: Synthetic oligonucleotide
  Target: ATXN1; (-) strand; PAM type: YTN; PAM sequence: TTC
atgatgatattctcagcatg

SEQ ID NO: 177953 - DNA, 20 bp, Artificial Sequence
  Description of Artificial Sequence: Synthetic oligonucleotide
  Target: ATXN1; (-) strand; PAM type: YTN; PAM sequence: TTT
catgatgatattctcagcat

SEQ ID NO: 177954 - DNA, 20 bp, Artificial Sequence
  Description of Artificial Sequence: Synthetic oligonucleotide
  Target: ATXN1; (-) strand; PAM type: YTN; PAM sequence: TTG
atttcatgatgatattctca

SEQ ID NO: 177955 - DNA, 20 bp, Artificial Sequence
  Description of Artificial Sequence: Synthetic oligonucleotide
  Target: ATXN1; (-) strand; PAM type: YTN; PAM sequence: CTC
gttgatttcatgatgatatt

SEQ ID NO: 177956 - DNA, 20 bp, Artificial Sequence
  Description of Artificial Sequence: Synthetic oligonucleotide
  Target: ATXN1; (-) strand; PAM type: YTN; PAM sequence: TTG
catatcctcgttgatttcat

SEQ ID NO: 177957 - DNA, 20 bp, Artificial Sequence
  Description of Artificial Sequence: Synthetic oligonucleotide
  Target: ATXN1; (-) strand; PAM type: YTN; PAM sequence: TTT
gcatatcctcgttgatttca

SEQ ID NO: 177958 - DNA, 20 bp, Artificial Sequence
  Description of Artificial Sequence: Synthetic oligonucleotide
  Target: ATXN1; (-) strand; PAM type: YTN; PAM sequence: CTA
tggaacagagagatttgcat

SEQ ID NO: 177959 - DNA, 20 bp, Artificial Sequence
  Description of Artificial Sequence: Synthetic oligonucleotide
  Target: ATXN1; (-) strand; PAM type: YTN; PAM sequence: CTA
caaaaccaatgaaaaccatg

SEQ ID NO: 177960 - DNA, 20 bp, Artificial Sequence
  Description of Artificial Sequence: Synthetic oligonucleotide
  Target: ATXN1; (-) strand; PAM type: YTN; PAM sequence: TTC
tacaaaaccaatgaaaacca

SEQ ID NO: 177961 - DNA, 20 bp, Artificial Sequence
  Description of Artificial Sequence: Synthetic oligonucleotide
  Target: ATXN1; (-) strand; PAM type: YTN; PAM sequence: TTA
gtatagaggttctacaaaac

SEQ ID NO: 177962 - DNA, 20 bp, Artificial Sequence
  Description of Artificial Sequence: Synthetic oligonucleotide
  Target: ATXN1; (-) strand; PAM type: YTN; PAM sequence: TTT
agtatagaggttctacaaaa

SEQ ID NO: 177963 - DNA, 20 bp, Artificial Sequence
  Description of Artificial Sequence: Synthetic oligonucleotide
  Target: ATXN1; (-) strand; PAM type: YTN; PAM sequence: TTG
acatttagtatagaggttct

SEQ ID NO: 177964 - DNA, 20 bp, Artificial Sequence
  Description of Artificial Sequence: Synthetic oligonucleotide
  Target: ATXN1; (-) strand; PAM type: YTN; PAM sequence: TTA
ggaaagaaaaggaaattgac

SEQ ID NO: 177965 - DNA, 20 bp, Artificial Sequence
  Description of Artificial Sequence: Synthetic oligonucleotide
  Target: ATXN1; (-) strand; PAM type: YTN; PAM sequence: TTT
aggaaagaaaaggaaattga

SEQ ID NO: 177966 - DNA, 20 bp, Artificial Sequence
  Description of Artificial Sequence: Synthetic oligonucleotide
  Target: ATXN1; (-) strand; PAM type: YTN; PAM sequence: CTT
taggaaagaaaaggaaattg

SEQ ID NO: 177967 - DNA, 20 bp, Artificial Sequence
  Description of Artificial Sequence: Synthetic oligonucleotide
  Target: ATXN1; (-) strand; PAM type: YTN; PAM sequence: CTA
ataagctttaggaaagaaaa

SEQ ID NO: 177968 - DNA, 20 bp, Artificial Sequence
  Description of Artificial Sequence: Synthetic oligonucleotide
  Target: ATXN1; (-) strand; PAM type: YTN; PAM sequence: CTG
taaacatcacacacagctaa

SEQ ID NO: 177969 - DNA, 20 bp, Artificial Sequence
  Description of Artificial Sequence: Synthetic oligonucleotide
  Target: ATXN1; (-) strand; PAM type: YTN; PAM sequence: TTC
aagctgtaaacatcacacac

SEQ ID NO: 177970 - DNA, 20 bp, Artificial Sequence
  Description of Artificial Sequence: Synthetic oligonucleotide
  Target: ATXN1; (-) strand; PAM type: YTN; PAM sequence: CTT
caagctgtaaacatcacaca

SEQ ID NO: 177971 - DNA, 20 bp, Artificial Sequence
  Description of Artificial Sequence: Synthetic oligonucleotide
  Target: ATXN1; (-) strand; PAM type: YTN; PAM sequence: TTG
gtcttcaagctgtaaacatc

SEQ ID NO: 177972 - DNA, 20 bp, Artificial Sequence
  Description of Artificial Sequence: Synthetic oligonucleotide
  Target: ATXN1; (-) strand; PAM type: YTN; PAM sequence: TTT
ggtcttcaagctgtaaacat

SEQ ID NO: 177973 - DNA, 20 bp, Artificial Sequence
  Description of Artificial Sequence: Synthetic oligonucleotide
  Target: ATXN1; (-) strand; PAM type: YTN; PAM sequence: CTG
tttggtcttcaagctgtaaa

SEQ ID NO: 177974 - DNA, 20 bp, Artificial Sequence
  Description of Artificial Sequence: Synthetic oligonucleotide
  Target: ATXN1; (-) strand; PAM type: YTN; PAM sequence: TTA
aatctgtttggtcttcaagc

SEQ ID NO: 177975 - DNA, 20 bp, Artificial Sequence
  Description of Artificial Sequence: Synthetic oligonucleotide
  Target: ATXN1; (-) strand; PAM type: YTN; PAM sequence: CTA
ttaaatctgtttggtcttca

SEQ ID NO: 177976 - DNA, 20 bp, Artificial Sequence
  Description of Artificial Sequence: Synthetic oligonucleotide
  Target: ATXN1; (-) strand; PAM type: YTN; PAM sequence: TTA
actattaaatctgtttggtc

SEQ ID NO: 177977 - DNA, 20 bp, Artificial Sequence
  Description of Artificial Sequence: Synthetic oligonucleotide
  Target: ATXN1; (-) strand; PAM type: YTN; PAM sequence: TTT
aactattaaatctgtttggt

SEQ ID NO: 177978 - DNA, 20 bp, Artificial Sequence
  Description of Artificial Sequence: Synthetic oligonucleotide
  Target: ATXN1; (-) strand; PAM type: YTN; PAM sequence: TTT
taactattaaatctgtttgg

SEQ ID NO: 177979 - DNA, 20 bp, Artificial Sequence
  Description of Artificial Sequence: Synthetic oligonucleotide
  Target: ATXN1; (-) strand; PAM type: YTN; PAM sequence: TTA
aatgttttaactattaaatc

SEQ ID NO: 177980 - DNA, 20 bp, Artificial Sequence
  Description of Artificial Sequence: Synthetic oligonucleotide
  Target: ATXN1; (-) strand; PAM type: YTN; PAM sequence: TTT
aaatgttttaactattaaat

SEQ ID NO: 177981 - DNA, 20 bp, Artificial Sequence
  Description of Artificial Sequence: Synthetic oligonucleotide
  Target: ATXN1; (-) strand; PAM type: YTN; PAM sequence: TTA
tatagtttaaatgttttaac

SEQ ID NO: 177982 - DNA, 20 bp, Artificial Sequence
  Description of Artificial Sequence: Synthetic oligonucleotide
  Target: ATXN1; (-) strand; PAM type: YTN; PAM sequence: TTA
aattatatagtttaaatgtt

SEQ ID NO: 177983 - DNA, 20 bp, Artificial Sequence
  Description of Artificial Sequence: Synthetic oligonucleotide
  Target: ATXN1; (-) strand; PAM type: YTN; PAM sequence: TTT
aaattatatagtttaaatgt

SEQ ID NO: 177984 - DNA, 20 bp, Artificial Sequence
  Description of Artificial Sequence: Synthetic oligonucleotide
  Target: ATXN1; (-) strand; PAM type: YTN; PAM sequence: TTT
taaattatatagtttaaatg

SEQ ID NO: 177985 - DNA, 20 bp, Artificial Sequence
  Description of Artificial Sequence: Synthetic oligonucleotide
  Target: ATXN1; (-) strand; PAM type: YTN; PAM sequence: CTT
ttaaattatatagtttaaat

SEQ ID NO: 177986 - DNA, 20 bp, Artificial Sequence
  Description of Artificial Sequence: Synthetic oligonucleotide
  Target: ATXN1; (-) strand; PAM type: YTN; PAM sequence: TTG
catgcttttaaattatatag

SEQ ID NO: 177987 - DNA, 20 bp, Artificial Sequence
  Description of Artificial Sequence: Synthetic oligonucleotide
  Target: ATXN1; (-) strand; PAM type: YTN; PAM sequence: CTT
gcatgcttttaaattatata

SEQ ID NO: 177988 - DNA, 20 bp, Artificial Sequence
  Description of Artificial Sequence: Synthetic oligonucleotide
  Target: ATXN1; (-) strand; PAM type: YTN; PAM sequence: TTC
cttgcatgcttttaaattat

SEQ ID NO: 177989 - DNA, 20 bp, Artificial Sequence
  Description of Artificial Sequence: Synthetic oligonucleotide
  Target: ATXN1; (-) strand; PAM type: YTN; PAM sequence: CTT
ccttgcatgcttttaaatta

SEQ ID NO: 177990 - DNA, 20 bp, Artificial Sequence
  Description of Artificial Sequence: Synthetic oligonucleotide
  Target: ATXN1; (-) strand; PAM type: YTN; PAM sequence: CTC
ttccttgcatgcttttaaat

SEQ ID NO: 177991 - DNA, 20 bp, Artificial Sequence
  Description of Artificial Sequence: Synthetic oligonucleotide
  Target: ATXN1; (-) strand; PAM type: YTN; PAM sequence: TTC
cctcttccttgcatgctttt

SEQ ID NO: 177992 - DNA, 20 bp, Artificial Sequence
  Description of Artificial Sequence: Synthetic oligonucleotide
  Target: ATXN1; (-) strand; PAM type: YTN; PAM sequence: TTT
ccctcttccttgcatgcttt

SEQ ID NO: 177993 - DNA, 20 bp, Artificial Sequence
  Description of Artificial Sequence: Synthetic oligonucleotide
  Target: ATXN1; (-) strand; PAM type: YTN; PAM sequence: TTT
tccctcttccttgcatgctt

SEQ ID NO: 177994 - DNA, 20 bp, Artificial Sequence
  Description of Artificial Sequence: Synthetic oligonucleotide
  Target: ATXN1; (-) strand; PAM type: YTN; PAM sequence: TTT
ttccctcttccttgcatgct

SEQ ID NO: 177995 - DNA, 20 bp, Artificial Sequence
  Description of Artificial Sequence: Synthetic oligonucleotide
  Target: ATXN1; (-) strand; PAM type: YTN; PAM sequence: TTT
tttccctcttccttgcatgc

SEQ ID NO: 177996 - DNA, 20 bp, Artificial Sequence
  Description of Artificial Sequence: Synthetic oligonucleotide
  Target: ATXN1; (-) strand; PAM type: YTN; PAM sequence: TTT
ttttccctcttccttgcatg

SEQ ID NO: 177997 - DNA, 20 bp, Artificial Sequence
  Description of Artificial Sequence: Synthetic oligonucleotide
  Target: ATXN1; (-) strand; PAM type: YTN; PAM sequence: CTT
tttttccctcttccttgcat

SEQ ID NO: 177998 - DNA, 20 bp, Artificial Sequence
  Description of Artificial Sequence: Synthetic oligonucleotide
  Target: ATXN1; (-) strand; PAM type: YTN; PAM sequence: CTC
tttttttccctcttccttgc

SEQ ID NO: 177999 - DNA, 20 bp, Artificial Sequence
  Description of Artificial Sequence: Synthetic oligonucleotide
  Target: ATXN1; (-) strand; PAM type: YTN; PAM sequence: CTA
catcagagcctctttttttc

SEQ ID NO: 178000 - DNA, 20 bp, Artificial Sequence
  Description of Artificial Sequence: Synthetic oligonucleotide
  Target: ATXN1; (-) strand; PAM type: YTN; PAM sequence: TTG
atctacatcagagcctcttt

SEQ ID NO: 178001 - DNA, 20 bp, Artificial Sequence
  Description of Artificial Sequence: Synthetic oligonucleotide
  Target: ATXN1; (-) strand; PAM type: YTN; PAM sequence: TTT
gatctacatcagagcctctt

SEQ ID NO: 178002 - DNA, 20 bp, Artificial Sequence
  Description of Artificial Sequence: Synthetic oligonucleotide
  Target: ATXN1; (-) strand; PAM type: YTN; PAM sequence: CTA
catgtttgatctacatcaga

SEQ ID NO: 178003 - DNA, 20 bp, Artificial Sequence
  Description of Artificial Sequence: Synthetic oligonucleotide
  Target: ATXN1; (-) strand; PAM type: YTN; PAM sequence: TTA
acagcacaaatatatctaca

SEQ ID NO: 178004 - DNA, 20 bp, Artificial Sequence
  Description of Artificial Sequence: Synthetic oligonucleotide
  Target: ATXN1; (-) strand; PAM type: YTN; PAM sequence: TTT
aacagcacaaatatatctac

SEQ ID NO: 178005 - DNA, 20 bp, Artificial Sequence
  Description of Artificial Sequence: Synthetic oligonucleotide
  Target: ATXN1; (-) strand; PAM type: YTN; PAM sequence: TTT
taacagcacaaatatatcta

SEQ ID NO: 178006 - DNA, 20 bp, Artificial Sequence
  Description of Artificial Sequence: Synthetic oligonucleotide
  Target: ATXN1; (-) strand; PAM type: YTN; PAM sequence: TTG
gaaagcatattttaacagca

SEQ ID NO: 178007 - DNA, 20 bp, Artificial Sequence
  Description of Artificial Sequence: Synthetic oligonucleotide
  Target: ATXN1; (-) strand; PAM type: YTN; PAM sequence: CTT
ggaaagcatattttaacagc

SEQ ID NO: 178008 - DNA, 20 bp, Artificial Sequence
  Description of Artificial Sequence: Synthetic oligonucleotide
  Target: ATXN1; (-) strand; PAM type: YTN; PAM sequence: TTC
caaacttggaaagcatattt

SEQ ID NO: 178009 - DNA, 20 bp, Artificial Sequence
  Description of Artificial Sequence: Synthetic oligonucleotide
  Target: ATXN1; (-) strand; PAM type: YTN; PAM sequence: CTT
ccaaacttggaaagcatatt

SEQ ID NO: 178010 - DNA, 20 bp, Artificial Sequence
  Description of Artificial Sequence: Synthetic oligonucleotide
  Target: ATXN1; (-) strand; PAM type: YTN; PAM sequence: CTC
cgcatcttccaaacttggaa

SEQ ID NO: 178011 - DNA, 20 bp, Artificial Sequence
  Description of Artificial Sequence: Synthetic oligonucleotide
  Target: ATXN1; (-) strand; PAM type: YTN; PAM sequence: TTA
tgtgtgcacagacatgcatg

SEQ ID NO: 178012 - DNA, 20 bp, Artificial Sequence
  Description of Artificial Sequence: Synthetic oligonucleotide
  Target: ATXN1; (-) strand; PAM type: YTN; PAM sequence: CTT
atgtgtgcacagacatgcat

SEQ ID NO: 178013 - DNA, 20 bp, Artificial Sequence
  Description of Artificial Sequence: Synthetic oligonucleotide
  Target: ATXN1; (-) strand; PAM type: YTN; PAM sequence: TTG
tggtggtgcttatgtgtgca

SEQ ID NO: 178014 - DNA, 20 bp, Artificial Sequence
  Description of Artificial Sequence: Synthetic oligonucleotide
  Target: ATXN1; (-) strand; PAM type: YTN; PAM sequence: TTT
gtggtggtgcttatgtgtgc

SEQ ID NO: 178015 - DNA, 20 bp, Artificial Sequence
  Description of Artificial Sequence: Synthetic oligonucleotide
  Target: ATXN1; (-) strand; PAM type: YTN; PAM sequence: TTT
tgtggtggtgcttatgtgtg

SEQ ID NO: 178016 - DNA, 20 bp, Artificial Sequence
  Description of Artificial Sequence: Synthetic oligonucleotide
  Target: ATXN1; (-) strand; PAM type: YTN; PAM sequence: TTA
agcaaattttgtggtggtgc

SEQ ID NO: 178017 - DNA, 20 bp, Artificial Sequence
  Description of Artificial Sequence: Synthetic oligonucleotide
  Target: ATXN1; (-) strand; PAM type: YTN; PAM sequence: TTG
caaaaaaaaaaaagaagaag

SEQ ID NO: 178018 - DNA, 20 bp, Artificial Sequence
  Description of Artificial Sequence: Synthetic oligonucleotide
  Target: ATXN1; (-) strand; PAM type: YTN; PAM sequence: CTA
gatcattgcaaaaaaaaaaa

SEQ ID NO: 178019 - DNA, 20 bp, Artificial Sequence
  Description of Artificial Sequence: Synthetic oligonucleotide
  Target: ATXN1; (-) strand; PAM type: YTN; PAM sequence: TTC
tagatcattgcaaaaaaaaa

SEQ ID NO: 178020 - DNA, 20 bp, Artificial Sequence
  Description of Artificial Sequence: Synthetic oligonucleotide
  Target: ATXN1; (-) strand; PAM type: YTN; PAM sequence: CTT
ctagatcattgcaaaaaaaa

SEQ ID NO: 178021 - DNA, 20 bp, Artificial Sequence
  Description of Artificial Sequence: Synthetic oligonucleotide
  Target: ATXN1; (-) strand; PAM type: YTN; PAM sequence: TTC
ttctagatcattgcaaaaaa

SEQ ID NO: 178022 - DNA, 20 bp, Artificial Sequence
  Description of Artificial Sequence: Synthetic oligonucleotide
  Target: ATXN1; (-) strand; PAM type: YTN; PAM sequence: CTT
cttctagatcattgcaaaaa

SEQ ID NO: 178023 - DNA, 20 bp, Artificial Sequence
  Description of Artificial Sequence: Synthetic oligonucleotide
  Target: ATXN1; (-) strand; PAM type: YTN; PAM sequence: CTG
cttcttctagatcattgcaa

SEQ ID NO: 178024 - DNA, 20 bp, Artificial Sequence
  Description of Artificial Sequence: Synthetic oligonucleotide
  Target: ATXN1; (-) strand; PAM type: YTN; PAM sequence: CTC
tgcttcttctagatcattgc

SEQ ID NO: 178025 - DNA, 20 bp, Artificial Sequence
  Description of Artificial Sequence: Synthetic oligonucleotide
  Target: ATXN1; (-) strand; PAM type: YTN; PAM sequence: TTA
taagcaaatgtctctgcttc

SEQ ID NO: 178026 - DNA, 20 bp, Artificial Sequence
  Description of Artificial Sequence: Synthetic oligonucleotide
  Target: ATXN1; (-) strand; PAM type: YTN; PAM sequence: TTT
ataagcaaatgtctctgctt

SEQ ID NO: 178027 - DNA, 20 bp, Artificial Sequence
  Description of Artificial Sequence: Synthetic oligonucleotide
  Target: ATXN1; (-) strand; PAM type: YTN; PAM sequence: TTC
atagtttataagcaaatgtc

SEQ ID NO: 178028 - DNA, 20 bp, Artificial Sequence
  Description of Artificial Sequence: Synthetic oligonucleotide
  Target: ATXN1; (-) strand; PAM type: YTN; PAM sequence: CTT
catagtttataagcaaatgt

SEQ ID NO: 178029 - DNA, 20 bp, Artificial Sequence
  Description of Artificial Sequence: Synthetic oligonucleotide
  Target: ATXN1; (-) strand; PAM type: YTN; PAM sequence: TTC
aagcccttcatagtttataa

SEQ ID NO: 178030 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcccttcatagtt

SEQ ID NO: 178031 - DNA, 20 bp, Artificial Sequence
  Description of Artificial Sequence: Synthetic oligonucleotide
  Target: ATXN1; (-) strand; PAM type: YTN; PAM sequence: CTC
agtggctgggttcaagccct

SEQ ID NO: 178032 - DNA, 20 bp, Artificial Sequence
  Description of Artificial Sequence: Synthetic oligonucleotide
  Target: ATXN1; (-) strand; PAM type: YTN; PAM sequence: TTG
tgagtaaaatgtgtactcag

SEQ ID NO: 178033 - DNA, 20 bp, Artificial Sequence
  Description of Artificial Sequence: Synthetic oligonucleotide
  Target: ATXN1; (-) strand; PAM type: YTN; PAM sequence: TTC
attgtgagtaaaatgtgtac

SEQ ID NO: 178034 - DNA, 20 bp, Artificial Sequence
  Description of Artificial Sequence: Synthetic oligonucleotide
  Target: ATXN1; (-) strand; PAM type: YTN; PAM sequence: TTT
cattgtgagtaaaatgtgta

SEQ ID NO: 178035 - DNA, 20 bp, Artificial Sequence
  Description of Artificial Sequence: Synthetic oligonucleotide
  Target: ATXN1; (-) strand; PAM type: YTN; PAM sequence: TTC
catgcagatttcattgtgag

SEQ ID NO: 178036 - DNA, 20 bp, Artificial Sequence
  Description of Artificial Sequence: Synthetic oligonucleotide
  Target: ATXN1; (-) strand; PAM type: YTN; PAM sequence: CTT
ccatgcagatttcattgtga

SEQ ID NO: 178037 - DNA, 20 bp, Artificial Sequence
  Description of Artificial Sequence: Synthetic oligonucleotide
  Target: ATXN1; (-) strand; PAM type: YTN; PAM sequence: TTG
gcaggcttccatgcagattt

SEQ ID NO: 178038 - DNA, 20 bp, Artificial Sequence
  Description of Artificial Sequence: Synthetic oligonucleotide
  Target: ATXN1; (-) strand; PAM type: YTN; PAM sequence: TTG
aatgtcagcccagacattgg

SEQ ID NO: 178039 - DNA, 20 bp, Artificial Sequence
  Description of Artificial Sequence: Synthetic oligonucleotide
  Target: ATXN1; (-) strand; PAM type: YTN; PAM sequence: TTT
gaatgtcagcccagacattg

SEQ ID NO: 178040 - DNA, 20 bp, Artificial Sequence
  Description of Artificial Sequence: Synthetic oligonucleotide
  Target: ATXN1; (-) strand; PAM type: YTN; PAM sequence: TTG
gaatgtttgaatgtcagccc

SEQ ID NO: 178041 - DNA, 20 bp, Artificial Sequence
  Description of Artificial Sequence: Synthetic oligonucleotide
  Target: ATXN1; (-) strand; PAM type: YTN; PAM sequence: CTT
ggaatgtttgaatgtcagcc

SEQ ID NO: 178042 - DNA, 20 bp, Artificial Sequence
  Description of Artificial Sequence: Synthetic oligonucleotide
  Target: ATXN1; (-) strand; PAM type: YTN; PAM sequence: TTG
aaatacatagaaacttggaa

SEQ ID NO: 178043 - DNA, 20 bp, Artificial Sequence
  Description of Artificial Sequence: Synthetic oligonucleotide
  Target: ATXN1; (-) strand; PAM type: YTN; PAM sequence: TTG
agagattgaaatacatagaa

SEQ ID NO: 178044 - DNA, 20 bp, Artificial Sequence
  Description of Artificial Sequence: Synthetic oligonucleotide
  Target: ATXN1; (-) strand; PAM type: YTN; PAM sequence: TTT
gagagattgaaatacataga

SEQ ID NO: 178045 - DNA, 20 bp, Artificial Sequence
  Description of Artificial Sequence: Synthetic oligonucleotide
  Target: ATXN1; (-) strand; PAM type: YTN; PAM sequence: TTT
tgagagattgaaatacatag

SEQ ID NO: 178046 - DNA, 20 bp, Artificial Sequence
  Description of Artificial Sequence: Synthetic oligonucleotide
  Target: ATXN1; (-) strand; PAM type: YTN; PAM sequence: TTA
gttttgagagattgaaatac

SEQ ID NO: 178047 - DNA, 20 bp, Artificial Sequence
  Description of Artificial Sequence: Synthetic oligonucleotide
  Target: ATXN1; (-) strand; PAM type: YTN; PAM sequence: TTA
aaacattagttttgagagat

SEQ ID NO: 178048 - DNA, 20 bp, Artificial Sequence
  Description of Artificial Sequence: Synthetic oligonucleotide
  Target: ATXN1; (-) strand; PAM type: YTN; PAM sequence: TTT
aaaacattagttttgagaga

SEQ ID NO: 178049 - DNA, 20 bp, Artificial Sequence
  Description of Artificial Sequence: Synthetic oligonucleotide
  Target: ATXN1; (-) strand; PAM type: YTN; PAM sequence: TTT
taaaacattagttttgagag

SEQ ID NO: 178050 - DNA, 20 bp, Artificial Sequence
  Description of Artificial Sequence: Synthetic oligonucleotide
  Target: ATXN1; (-) strand; PAM type: YTN; PAM sequence: CTC
agaaaatatcaagagtttta

SEQ ID NO: 178051 - DNA, 20 bp, Artificial Sequence
  Description of Artificial Sequence: Synthetic oligonucleotide
  Target: ATXN1; (-) strand; PAM type: YTN; PAM sequence: CTG
tgtagtgcctcagaaaatat

SEQ ID NO: 178052 - DNA, 20 bp, Artificial Sequence
  Description of Artificial Sequence: Synthetic oligonucleotide
  Target: ATXN1; (-) strand; PAM type: YTN; PAM sequence: TTG
aactgtgtagtgcctcagaa

SEQ ID NO: 178053 - DNA, 20 bp, Artificial Sequence
  Description of Artificial Sequence: Synthetic oligonucleotide
  Target: ATXN1; (-) strand; PAM type: YTN; PAM sequence: CTG
agaggtgaggattgaactgt

SEQ ID NO: 178054 - DNA, 20 bp, Artificial Sequence
  Description of Artificial Sequence: Synthetic oligonucleotide
  Target: ATXN1; (-) strand; PAM type: YTN; PAM sequence: CTG
aactgagaggtgaggattga

SEQ ID NO: 178055 - DNA, 20 bp, Artificial Sequence
  Description of Artificial Sequence: Synthetic oligonucleotide
  Target: ATXN1; (-) strand; PAM type: YTN; PAM sequence: CTC
tgaactgagaggtgaggatt

SEQ ID NO: 178056 - DNA, 20 bp, Artificial Sequence
  Description of Artificial Sequence: Synthetic oligonucleotide
  Target: ATXN1; (-) strand; PAM type: YTN; PAM sequence: TTC
actctgaactgagaggtgag

SEQ ID NO: 178057 - DNA, 20 bp, Artificial Sequence
  Description of Artificial Sequence: Synthetic oligonucleotide
  Target: ATXN1; (-) strand; PAM type: YTN; PAM sequence: CTG
tatattcactctgaactgag

SEQ ID NO: 178058 - DNA, 20 bp, Artificial Sequence
  Description of Artificial Sequence: Synthetic oligonucleotide
  Target: ATXN1; (-) strand; PAM type: YTN; PAM sequence: TTG
ctgtatattcactctgaact

SEQ ID NO: 178059 - DNA, 20 bp, Artificial Sequence
  Description of Artificial Sequence: Synthetic oligonucleotide
  Target: ATXN1; (-) strand; PAM type: YTN; PAM sequence: TTA
ttgctgtatattcactctga

SEQ ID NO: 178060 - DNA, 20 bp, Artificial Sequence
  Description of Artificial Sequence: Synthetic oligonucleotide
  Target: ATXN1; (-) strand; PAM type: YTN; PAM sequence: TTC
aagcagaattattgctgtat

SEQ ID NO: 178061 - DNA, 20 bp, Artificial Sequence
  Description of Artificial Sequence: Synthetic oligonucleotide
  Target: ATXN1; (-) strand; PAM type: YTN; PAM sequence: TTT
caagcagaattattgctgta

SEQ ID NO: 178062 - DNA, 20 bp, Artificial Sequence
  Description of Artificial Sequence: Synthetic oligonucleotide
  Target: ATXN1; (-) strand; PAM type: YTN; PAM sequence: CTT
tcaagcagaattattgctgt

SEQ ID NO: 178063 - DNA, 20 bp, Artificial Sequence
  Description of Artificial Sequence: Synthetic oligonucleotide
  Target: ATXN1; (-) strand; PAM type: YTN; PAM sequence: TTC
tttcaagcagaattattgct

SEQ ID NO: 178064 - DNA, 20 bp, Artificial Sequence
  Description of Artificial Sequence: Synthetic oligonucleotide
  Target: ATXN1; (-) strand; PAM type: YTN; PAM sequence: CTT
ctttcaagcagaattattgc

SEQ ID NO: 178065 - DNA, 20 bp, Artificial Sequence
  Description of Artificial Sequence: Synthetic oligonucleotide
  Target: ATXN1; (-) strand; PAM type: YTN; PAM sequence: TTG
cacttctttcaagcagaatt

SEQ ID NO: 178066 - DNA, 20 bp, Artificial Sequence
  Description of Artificial Sequence: Synthetic oligonucleotide
  Target: ATXN1; (-) strand; PAM type: YTN; PAM sequence: TTT
gcacttctttcaagcagaat

SEQ ID NO: 178067 - DNA, 20 bp, Artificial Sequence
  Description of Artificial Sequence: Synthetic oligonucleotide
  Target: ATXN1; (-) strand; PAM type: YTN; PAM sequence: CTT
tgcacttctttcaagcagaa

SEQ ID NO: 178068 - DNA, 20 bp, Artificial Sequence
  Description of Artificial Sequence: Synthetic oligonucleotide
  Target: ATXN1; (-) strand; PAM type: YTN; PAM sequence: TTC
tttgcacttctttcaagcag

SEQ ID NO: 178069 - DNA, 20 bp, Artificial Sequence
  Description of Artificial Sequence: Synthetic oligonucleotide
  Target: ATXN1; (-) strand; PAM type: YTN; PAM sequence: CTT
ctttgcacttctttcaagca

SEQ ID NO: 178070 - DNA, 20 bp, Artificial Sequence
  Description of Artificial Sequence: Synthetic oligonucleotide
  Target: ATXN1; (-) strand; PAM type: YTN; PAM sequence: CTG
cacagcaaaagaccttcttt

SEQ ID NO: 178071 - DNA, 20 bp, Artificial Sequence
  Description of Artificial Sequence: Synthetic oligonucleotide
  Target: ATXN1; (-) strand; PAM type: YTN; PAM sequence: CTA
catgctgcacagcaaaagac

SEQ ID NO: 178072 - DNA, 20 bp, Artificial Sequence
  Description of Artificial Sequence: Synthetic oligonucleotide
  Target: ATXN1; (-) strand; PAM type: YTN; PAM sequence: TTG
cggtagatcgagctacatgc

SEQ ID NO: 178073 - DNA, 20 bp, Artificial Sequence
  Description of Artificial Sequence: Synthetic oligonucleotide
  Target: ATXN1; (-) strand; PAM type: YTN; PAM sequence: TTG
ttgcggtagatcgagctaca

SEQ ID NO: 178074 - DNA, 20 bp, Artificial Sequence
  Description of Artificial Sequence: Synthetic oligonucleotide
  Target: ATXN1; (-) strand; PAM type: YTN; PAM sequence: TTG
tattgttgcggtagatcgag

SEQ ID NO: 178075 - DNA, 20 bp, Artificial Sequence
  Description of Artificial Sequence: Synthetic oligonucleotide
  Target: ATXN1; (-) strand; PAM type: YTN; PAM sequence: TTC
attgtattgttgcggtagat

SEQ ID NO: 178076 - DNA, 20 bp, Artificial Sequence
  Description of Artificial Sequence: Synthetic oligonucleotide
  Target: ATXN1; (-) strand; PAM type: YTN; PAM sequence: CTA
ttcattgtattgttgcggta

SEQ ID NO: 178077 - DNA, 20 bp, Artificial Sequence
  Description of Artificial Sequence: Synthetic oligonucleotide
  Target: ATXN1; (-) strand; PAM type: YTN; PAM sequence: CTG
atgcacaaaggaaaataata

SEQ ID NO: 178078 - DNA, 20 bp, Artificial Sequence
  Description of Artificial Sequence: Synthetic oligonucleotide
  Target: ATXN1; (-) strand; PAM type: YTN; PAM sequence: CTA
gatctgatgcacaaaggaaa

SEQ ID NO: 178079 - DNA, 20 bp, Artificial Sequence
  Description of Artificial Sequence: Synthetic oligonucleotide
  Target: ATXN1; (-) strand; PAM type: YTN; PAM sequence: TTC
tagatctgatgcacaaagga

SEQ ID NO: 178080 - DNA, 20 bp, Artificial Sequence
  Description of Artificial Sequence: Synthetic oligonucleotide
  Target: ATXN1; (-) strand; PAM type: YTN; PAM sequence: TTT
ctagatctgatgcacaaagg

SEQ ID NO: 178081 - DNA, 20 bp, Artificial Sequence
  Description of Artificial Sequence: Synthetic oligonucleotide
  Target: ATXN1; (-) strand; PAM type: YTN; PAM sequence: CTG
tttctagatctgatgcacaa

SEQ ID NO: 178082 - DNA, 20 bp, Artificial Sequence
  Description of Artificial Sequence: Synthetic oligonucleotide
  Target: ATXN1; (-) strand; PAM type: YTN; PAM sequence: CTC
accctgtttctagatctgat

SEQ ID NO: 178083 - DNA, 20 bp, Artificial Sequence
  Description of Artificial Sequence: Synthetic oligonucleotide
  Target: ATXN1; (-) strand; PAM type: YTN; PAM sequence: TTC
tcaccctgtttctagatctg

SEQ ID NO: 178084 - DNA, 20 bp, Artificial Sequence
  Description of Artificial Sequence: Synthetic oligonucleotide
  Target: ATXN1; (-) strand; PAM type: YTN; PAM sequence: TTT
ctcaccctgtttctagatct

SEQ ID NO: 178085 - DNA, 20 bp, Artificial Sequence
  Description of Artificial Sequence: Synthetic oligonucleotide
  Target: ATXN1; (-) strand; PAM type: YTN; PAM sequence: TTT
tctcaccctgtttctagatc

SEQ ID NO: 178086 - DNA, 20 bp, Artificial Sequence
  Description of Artificial Sequence: Synthetic oligonucleotide
  Target: ATXN1; (-) strand; PAM type: YTN; PAM sequence: CTT
ttctcaccctgtttctagat

SEQ ID NO: 178087 - DNA, 20 bp, Artificial Sequence
  Description of Artificial Sequence: Synthetic oligonucleotide
  Target: ATXN1; (-) strand; PAM type: YTN; PAM sequence: TTC
ttttctcaccctgtttctag

SEQ ID NO: 178088 - DNA, 20 bp, Artificial Sequence
  Description of Artificial Sequence: Synthetic oligonucleotide
  Target: ATXN1; (-) strand; PAM type: YTN; PAM sequence: CTT
cttttctcaccctgtttcta

SEQ ID NO: 178089 - DNA, 20 bp, Artificial Sequence
  Description of Artificial Sequence: Synthetic oligonucleotide
  Target: ATXN1; (-) strand; PAM type: YTN; PAM sequence: TTC
aaccttcttttctcaccctg

SEQ ID NO: 178090 - DNA, 20 bp, Artificial Sequence
  Description of Artificial Sequence: Synthetic oligonucleotide
  Target: ATXN1; (-) strand; PAM type: YTN; PAM sequence: CTT
caaccttcttttctcaccct

SEQ ID NO: 178091 - DNA, 20 bp, Artificial Sequence
  Description of Artificial Sequence: Synthetic oligonucleotide
  Target: ATXN1; (-) strand; PAM type: YTN; PAM sequence: TTC
ttcaaccttcttttctcacc

SEQ ID NO: 178092 - DNA, 20 bp, Artificial Sequence
  Description of Artificial Sequence: Synthetic oligonucleotide
  Target: ATXN1; (-) strand; PAM type: YTN; PAM sequence: TTT
cttcaaccttcttttctcac

SEQ ID NO: 178093 - DNA, 20 bp, Artificial Sequence
  Description of Artificial Sequence: Synthetic oligonucleotide
  Target: ATXN1; (-) strand; PAM type: YTN; PAM sequence: TTA
aaagatttcttcaaccttct

SEQ ID NO: 178094 - DNA, 20 bp, Artificial Sequence
  Description of Artificial Sequence: Synthetic oligonucleotide
  Target: ATXN1; (-) strand; PAM type: YTN; PAM sequence: TTT
aaaagatttcttcaaccttc

SEQ ID NO: 178095 - DNA, 20 bp, Artificial Sequence
  Description of Artificial Sequence: Synthetic oligonucleotide
  Target: ATXN1; (-) strand; PAM type: YTN; PAM sequence: TTT
taaaagatttcttcaacctt

SEQ ID NO: 178096 - DNA, 20 bp, Artificial Sequence
  Description of Artificial Sequence: Synthetic oligonucleotide
  Target: ATXN1; (-) strand; PAM type: YTN; PAM sequence: TTT
ttaaaagatttcttcaacct

SEQ ID NO: 178097 - DNA, 20 bp, Artificial Sequence
  Description of Artificial Sequence: Synthetic oligonucleotide
  Target: ATXN1; (-) strand; PAM type: YTN; PAM sequence: TTA
tagatttttaaaagatttct

SEQ ID NO: 178098 - DNA, 20 bp, Artificial Sequence
  Description of Artificial Sequence: Synthetic oligonucleotide
  Target: ATXN1; (-) strand; PAM type: YTN; PAM sequence: TTT
atagatttttaaaagatttc

SEQ ID NO: 178099 - DNA, 20 bp, Artificial Sequence
  Description of Artificial Sequence: Synthetic oligonucleotide
  Target: ATXN1; (-) strand; PAM type: YTN; PAM sequence: TTA
aatatttatagatttttaaa

SEQ ID NO: 178100 - DNA, 20 bp, Artificial Sequence
  Description of Artificial Sequence: Synthetic oligonucleotide
  Target: ATXN1; (-) strand; PAM type: YTN; PAM sequence: TTT
aaatatttatagatttttaa

SEQ ID NO: 178101 - DNA, 20 bp, Artificial Sequence
  Description of Artificial Sequence: Synthetic oligonucleotide
  Target: ATXN1; (-) strand; PAM type: YTN; PAM sequence: CTA
atatttaaatatttatagat

SEQ ID NO: 178102 - DNA, 20 bp, Artificial Sequence
  Description of Artificial Sequence: Synthetic oligonucleotide
  Target: ATXN1; (-) strand; PAM type: YTN; PAM sequence: CTA
tgtaactaatatttaaatat

SEQ ID NO: 178103 - DNA, 20 bp, Artificial Sequence
  Description of Artificial Sequence: Synthetic oligonucleotide
  Target: ATXN1; (-) strand; PAM type: YTN; PAM sequence: CTA
ctatgtaactaatatttaaa

SEQ ID NO: 178104 - DNA, 20 bp, Artificial Sequence
  Description of Artificial Sequence: Synthetic oligonucleotide
  Target: ATXN1; (-) strand; PAM type: YTN; PAM sequence: TTG
tctactatgtaactaatatt

SEQ ID NO: 178105 - DNA, 20 bp, Artificial Sequence
  Description of Artificial Sequence: Synthetic oligonucleotide
  Target: ATXN1; (-) strand; PAM type: YTN; PAM sequence: CTA
taggacattgtctactatgt

SEQ ID NO: 178106 - DNA, 20 bp, Artificial Sequence
  Description of Artificial Sequence: Synthetic oligonucleotide
  Target: ATXN1; (-) strand; PAM type: YTN; PAM sequence: TTC
cataaagcatggctatagga

SEQ ID NO: 178107 - DNA, 20 bp, Artificial Sequence
  Description of Artificial Sequence: Synthetic oligonucleotide
  Target: ATXN1; (-) strand; PAM type: YTN; PAM sequence: TTA
ttccataaagcatggctata

SEQ ID NO: 178108 - DNA, 20 bp, Artificial Sequence
  Description of Artificial Sequence: Synthetic oligonucleotide
  Target: ATXN1; (-) strand; PAM type: YTN; PAM sequence: TTT
attccataaagcatggctat

SEQ ID NO: 178109 - DNA, 20 bp, Artificial Sequence
  Description of Artificial Sequence: Synthetic oligonucleotide
  Target: ATXN1; (-) strand; PAM type: YTN; PAM sequence: CTT
tattccataaagcatggcta

SEQ ID NO: 178110 - DNA, 20 bp, Artificial Sequence
  Description of Artificial Sequence: Synthetic oligonucleotide
  Target: ATXN1; (-) strand; PAM type: YTN; PAM sequence: CTA
tgctttattccataaagcat

SEQ ID NO: 178111 - DNA, 20 bp, Artificial Sequence
  Description of Artificial Sequence: Synthetic oligonucleotide
  Target: ATXN1; (-) strand; PAM type: YTN; PAM sequence: TTC
tatgctttattccataaagc

SEQ ID NO: 178112 - DNA, 20 bp, Artificial Sequence
  Description of Artificial Sequence: Synthetic oligonucleotide
  Target: ATXN1; (-) strand; PAM type: YTN; PAM sequence: CTC
agatgccacatgaaatgcaa

SEQ ID NO: 178113 - DNA, 20 bp, Artificial Sequence
  Description of Artificial Sequence: Synthetic oligonucleotide
  Target: ATXN1; (-) strand; PAM type: YTN; PAM sequence: CTA
gtagcagtagataatgtact

SEQ ID NO: 178114 - DNA, 20 bp, Artificial Sequence
  Description of Artificial Sequence: Synthetic oligonucleotide
  Target: ATXN1; (-) strand; PAM type: YTN; PAM sequence: CTA
ataactagtagcagtagata

SEQ ID NO: 178115 - DNA, 20 bp, Artificial Sequence
  Description of Artificial Sequence: Synthetic oligonucleotide
  Target: ATXN1; (-) strand; PAM type: YTN; PAM sequence: CTG
tgaactaataactagtagca

SEQ ID NO: 178116 - DNA, 20 bp, Artificial Sequence
  Description of Artificial Sequence: Synthetic oligonucleotide
  Target: ATXN1; (-) strand; PAM type: YTN; PAM sequence: TTG
gcagagctgtgaactaataa

SEQ ID NO: 178117 - DNA, 20 bp, Artificial Sequence
  Description of Artificial Sequence: Synthetic oligonucleotide
  Target: ATXN1; (-) strand; PAM type: YTN; PAM sequence: CTT
ggcagagctgtgaactaata

SEQ ID NO: 178118 - DNA, 20 bp, Artificial Sequence
  Description of Artificial Sequence: Synthetic oligonucleotide
  Target: ATXN1; (-) strand; PAM type: YTN; PAM sequence: CTC
ttggcagagctgtgaactaa

SEQ ID NO: 178119 - DNA, 20 bp, Artificial Sequence
  Description of Artificial Sequence: Synthetic oligonucleotide
  Target: ATXN1; (-) strand; PAM type: YTN; PAM sequence: TTA
cctcttggcagagctgtgaa

SEQ ID NO: 178120 - DNA, 20 bp, Artificial Sequence
  Description of Artificial Sequence: Synthetic oligonucleotide
  Target: ATXN1; (-) strand; PAM type: YTN; PAM sequence: TTC
agaaggtgtggatcaccaat

SEQ ID NO: 178121 - DNA, 20 bp, Artificial Sequence
  Description of Artificial Sequence: Synthetic oligonucleotide
  Target: ATXN1; (-) strand; PAM type: YTN; PAM sequence: TTC
ccaaaaagaagtattcagaa

SEQ ID NO: 178122 - DNA, 20 bp, Artificial Sequence
  Description of Artificial Sequence: Synthetic oligonucleotide
  Target: ATXN1; (-) strand; PAM type: YTN; PAM sequence: CTA
aagttcccaaaaagaagtat

SEQ ID NO: 178123 - DNA, 20 bp, Artificial Sequence
  Description of Artificial Sequence: Synthetic oligonucleotide
  Target: ATXN1; (-) strand; PAM type: YTN; PAM sequence: TTG
tgctaaagttcccaaaaaga

SEQ ID NO: 178124 - DNA, 20 bp, Artificial Sequence
  Description of Artificial Sequence: Synthetic oligonucleotide
  Target: ATXN1; (-) strand; PAM type: YTN; PAM sequence: CTA
attgtgctaaagttcccaaa

SEQ ID NO: 178125 - DNA, 20 bp, Artificial Sequence
  Description of Artificial Sequence: Synthetic oligonucleotide
  Target: ATXN1; (-) strand; PAM type: YTN; PAM sequence: TTG
aggtatcagctaattgtgct

SEQ ID NO: 178126 - DNA, 20 bp, Artificial Sequence
  Description of Artificial Sequence: Synthetic oligonucleotide
  Target: ATXN1; (-) strand; PAM type: YTN; PAM sequence: TTT
gaggtatcagctaattgtgc

SEQ ID NO: 178127 - DNA, 20 bp, Artificial Sequence
  Description of Artificial Sequence: Synthetic oligonucleotide
  Target: ATXN1; (-) strand; PAM type: YTN; PAM sequence: TTG
cggtccaggtgaaatttgag

SEQ ID NO: 178128 - DNA, 20 bp, Artificial Sequence
  Description of Artificial Sequence: Synthetic oligonucleotide
  Target: ATXN1; (-) strand; PAM type: YTN; PAM sequence: CTG
ttgcggtccaggtgaaattt

SEQ ID NO: 178129 - DNA, 20 bp, Artificial Sequence
  Description of Artificial Sequence: Synthetic oligonucleotide
  Target: ATXN1; (-) strand; PAM type: YTN; PAM sequence: TTC
tgttgcggtccaggtgaaat

SEQ ID NO: 178130 - DNA, 20 bp, Artificial Sequence
  Description of Artificial Sequence: Synthetic oligonucleotide
  Target: ATXN1; (-) strand; PAM type: YTN; PAM sequence: TTT
ctgttgcggtccaggtgaaa

SEQ ID NO: 178131 - DNA, 20 bp, Artificial Sequence
  Description of Artificial Sequence: Synthetic oligonucleotide
  Target: ATXN1; (-) strand; PAM type: YTN; PAM sequence: CTG
tttctgttgcggtccaggtg

SEQ ID NO: 178132 - DNA, 20 bp, Artificial Sequence
  Description of Artificial Sequence: Synthetic oligonucleotide
  Target: ATXN1; (-) strand; PAM type: YTN; PAM sequence: TTG
aacagctgtttctgttgcgg

SEQ ID NO: 178133 - DNA, 20 bp, Artificial Sequence
  Description of Artificial Sequence: Synthetic oligonucleotide
  Target: ATXN1; (-) strand; PAM type: YTN; PAM sequence: TTA
atgttgaacagctgtttctg

SEQ ID NO: 178134 - DNA, 20 bp, Artificial Sequence
  Description of Artificial Sequence: Synthetic oligonucleotide
  Target: ATXN1; (-) strand; PAM type: YTN; PAM sequence: TTT
aatgttgaacagctgtttct

SEQ ID NO: 178135 - DNA, 20 bp, Artificial Sequence
  Description of Artificial Sequence: Synthetic oligonucleotide
  Target: ATXN1; (-) strand; PAM type: YTN; PAM sequence: TTA
atttaatgttgaacagctgt

SEQ ID NO: 178136 - DNA, 20 bp, Artificial Sequence
  Description of Artificial Sequence: Synthetic oligonucleotide
  Target: ATXN1; (-) strand; PAM type: YTN; PAM sequence: TTT
aatttaatgttgaacagctg

SEQ ID NO: 178137 - DNA, 20 bp, Artificial Sequence
  Description of Artificial Sequence: Synthetic oligonucleotide
  Target: ATXN1; (-) strand; PAM type: YTN; PAM sequence: CTA
taaaatttaatttaatgttg

SEQ ID NO: 178138 - DNA, 20 bp, Artificial Sequence
  Description of Artificial Sequence: Synthetic oligonucleotide
  Target: ATXN1; (-) strand; PAM type: YTN; PAM sequence: TTA
aagccaacaactataaaatt

SEQ ID NO: 178139 - DNA, 20 bp, Artificial Sequence
  Description of Artificial Sequence: Synthetic oligonucleotide
  Target: ATXN1; (-) strand; PAM type: YTN; PAM sequence: CTT
aaagccaacaactataaaat

SEQ ID NO: 178140 - DNA, 20 bp, Artificial Sequence
  Description of Artificial Sequence: Synthetic oligonucleotide
  Target: ATXN1; (-) strand; PAM type: YTN; PAM sequence: CTC
cttaaagccaacaactataa

SEQ ID NO: 178141 - DNA, 20 bp, Artificial Sequence
  Description of Artificial Sequence: Synthetic oligonucleotide
  Target: ATXN1; (-) strand; PAM type: YTN; PAM sequence: TTA
tcctccttaaagccaacaac

SEQ ID NO: 178142 - DNA, 20 bp, Artificial Sequence
  Description of Artificial Sequence: Synthetic oligonucleotide
  Target: ATXN1; (-) strand; PAM type: YTN; PAM sequence: CTT
atcctccttaaagccaacaa

SEQ ID NO: 178143 - DNA, 20 bp, Artificial Sequence
  Description of Artificial Sequence: Synthetic oligonucleotide
  Target: ATXN1; (-) strand; PAM type: YTN; PAM sequence: TTC
ttatcctccttaaagccaac

SEQ ID NO: 178144 - DNA, 20 bp, Artificial Sequence
  Description of Artificial Sequence: Synthetic oligonucleotide
  Target: ATXN1; (-) strand; PAM type: YTN; PAM sequence: CTT
cttatcctccttaaagccaa

SEQ ID NO: 178145 - DNA, 20 bp, Artificial Sequence
  Description of Artificial Sequence: Synthetic oligonucleotide
  Target: ATXN1; (-) strand; PAM type: YTN; PAM sequence: TTC
ttcttatcctccttaaagcc

SEQ ID NO: 178146 - DNA, 20 bp, Artificial Sequence
  Description of Artificial Sequence: Synthetic oligonucleotide
  Target: ATXN1; (-) strand; PAM type: YTN; PAM sequence: CTC
agttcttcttatcctcctta

SEQ ID NO: 178147 - DNA, 20 bp, Artificial Sequence
  Description of Artificial Sequence: Synthetic oligonucleotide
  Target: ATXN1; (-) strand; PAM type: YTN; PAM sequence: TTG
gagcactcagttcttcttat

SEQ ID NO: 178148 - DNA, 20 bp, Artificial Sequence
  Description of Artificial Sequence: Synthetic oligonucleotide
  Target: ATXN1; (-) strand; PAM type: YTN; PAM sequence: CTT
ggagcactcagttcttctta

SEQ ID NO: 178149 - DNA, 20 bp, Artificial Sequence
  Description of Artificial Sequence: Synthetic oligonucleotide
  Target: ATXN1; (-) strand; PAM type: YTN; PAM sequence: CTC
cttggagcactcagttcttc

SEQ ID NO: 178150 - DNA, 20 bp, Artificial Sequence
  Description of Artificial Sequence: Synthetic oligonucleotide
  Target: ATXN1; (-) strand; PAM type: YTN; PAM sequence: CTA
aaatctccttggagcactca

SEQ ID NO: 178151 - DNA, 20 bp, Artificial Sequence
  Description of Artificial Sequence: Synthetic oligonucleotide
  Target: ATXN1; (-) strand; PAM type: YTN; PAM sequence: CTC
taaaatctccttggagcact

SEQ ID NO: 178152 - DNA, 20 bp, Artificial Sequence
  Description of Artificial Sequence: Synthetic oligonucleotide
  Target: ATXN1; (-) strand; PAM type: YTN; PAM sequence: TTG
cccacctctaaaatctcctt

SEQ ID NO: 178153 - DNA, 20 bp, Artificial Sequence
  Description of Artificial Sequence: Synthetic oligonucleotide
  Target: ATXN1; (-) strand; PAM type: YTN; PAM sequence: TTT
gcccacctctaaaatctcct

SEQ ID NO: 178154 - DNA, 20 bp, Artificial Sequence
  Description of Artificial Sequence: Synthetic oligonucleotide
  Target: ATXN1; (-) strand; PAM type: YTN; PAM sequence: TTT
tgcccacctctaaaatctcc

SEQ ID NO: 178155 - DNA, 20 bp, Artificial Sequence
  Description of Artificial Sequence: Synthetic oligonucleotide
  Target: ATXN1; (-) strand; PAM type: YTN; PAM sequence: TTT
ttgcccacctctaaaatctc

SEQ ID NO: 178156 - DNA, 20 bp, Artificial Sequence
  Description of Artificial Sequence: Synthetic oligonucleotide
  Target: ATXN1; (-) strand; PAM type: YTN; PAM sequence: TTT
tttgcccacctctaaaatct

SEQ ID NO: 178157 - DNA, 20 bp, Artificial Sequence
  Description of Artificial Sequence: Synthetic oligonucleotide
  Target: ATXN1; (-) strand; PAM type: YTN; PAM sequence: CTG
ttttttgcccacctctaaaa

SEQ ID NO: 178158 - DNA, 20 bp, Artificial Sequence
  Description of Artificial Sequence: Synthetic oligonucleotide
  Target: ATXN1; (-) strand; PAM type: YTN; PAM sequence: TTG
ctgttttttgcccacctcta

SEQ ID NO: 178159 - DNA, 20 bp, Artificial Sequence
  Description of Artificial Sequence: Synthetic oligonucleotide
  Target: ATXN1; (-) strand; PAM type: YTN; PAM sequence: TTG
taggggcaggttgctgtttt

SEQ ID NO: 178160 - DNA, 20 bp, Artificial Sequence
  Description of Artificial Sequence: Synthetic oligonucleotide
  Target: ATXN1; (-) strand; PAM type: YTN; PAM sequence: CTT
gtaggggcaggttgctgttt

SEQ ID NO: 178161 - DNA, 20 bp, Artificial Sequence
  Description of Artificial Sequence: Synthetic oligonucleotide
  Target: ATXN1; (-) strand; PAM type: YTN; PAM sequence: TTG
cttgtaggggcaggttgctg

SEQ ID NO: 178162 - DNA, 20 bp, Artificial Sequence
  Description of Artificial Sequence: Synthetic oligonucleotide
  Target: ATXN1; (-) strand; PAM type: YTN; PAM sequence: TTT
gcttgtaggggcaggttgct

SEQ ID NO: 178163 - DNA, 20 bp, Artificial Sequence
  Description of Artificial Sequence: Synthetic oligonucleotide
  Target: ATXN1; (-) strand; PAM type: YTN; PAM sequence: CTT
tgcttgtaggggcaggttgc

SEQ ID NO: 178164 - DNA, 20 bp, Artificial Sequence
  Description of Artificial Sequence: Synthetic oligonucleotide
  Target: ATXN1; (-) strand; PAM type: YTN; PAM sequence: CTC
tttgcttgtaggggcaggtt

SEQ ID NO: 178165 - DNA, 20 bp, Artificial Sequence
  Description of Artificial Sequence: Synthetic oligonucleotide
  Target: ATXN1; (-) strand; PAM type: YTN; PAM sequence: CTC
tctttgcttgtaggggcagg

SEQ ID NO: 178166 - DNA, 20 bp, Artificial Sequence
  Description of Artificial Sequence: Synthetic oligonucleotide
  Target: ATXN1; (-) strand; PAM type: YTN; PAM sequence: TTA
accaggagggacatctctct

SEQ ID NO: 178167 - DNA, 20 bp, Artificial Sequence
  Description of Artificial Sequence: Synthetic oligonucleotide
  Target: ATXN1; (-) strand; PAM type: YTN; PAM sequence: CTT
aaccaggagggacatctctc

SEQ ID NO: 178168 - DNA, 20 bp, Artificial Sequence
  Description of Artificial Sequence: Synthetic oligonucleotide
  Target: ATXN1; (-) strand; PAM type: YTN; PAM sequence: CTG
cacgtgacaaaggggtgctt

SEQ ID NO: 178169 - DNA, 20 bp, Artificial Sequence
  Description of Artificial Sequence: Synthetic oligonucleotide
  Target: ATXN1; (-) strand; PAM type: YTN; PAM sequence: CTG
ggctgcacgtgacaaagggg

SEQ ID NO: 178170 - DNA, 20 bp, Artificial Sequence
  Description of Artificial Sequence: Synthetic oligonucleotide
  Target: ATXN1; (-) strand; PAM type: YTN; PAM sequence: CTC
tgggctgcacgtgacaaagg

SEQ ID NO: 178171 - DNA, 20 bp, Artificial Sequence
  Description of Artificial Sequence: Synthetic oligonucleotide
  Target: ATXN1; (-) strand; PAM type: YTN; PAM sequence: TTC
ctctgggctgcacgtgacaa

SEQ ID NO: 178172 - DNA, 20 bp, Artificial Sequence
  Description of Artificial Sequence: Synthetic oligonucleotide
  Target: ATXN1; (-) strand; PAM type: YTN; PAM sequence: CTT
cctctgggctgcacgtgaca

SEQ ID NO: 178173 - DNA, 20 bp, Artificial Sequence
  Description of Artificial Sequence: Synthetic oligonucleotide
  Target: ATXN1; (-) strand; PAM type: YTN; PAM sequence: TTA
tcacaacttcctctgggctg

SEQ ID NO: 178174 - DNA, 20 bp, Artificial Sequence
  Description of Artificial Sequence: Synthetic oligonucleotide
  Target: ATXN1; (-) strand; PAM type: YTN; PAM sequence: TTT
atcacaacttcctctgggct

SEQ ID NO: 178175 - DNA, 20 bp, Artificial Sequence
  Description of Artificial Sequence: Synthetic oligonucleotide
  Target: ATXN1; (-) strand; PAM type: YTN; PAM sequence: CTT
tatcacaacttcctctgggc

SEQ ID NO: 178176 - DNA, 20 bp, Artificial Sequence
  Description of Artificial Sequence: Synthetic oligonucleotide
  Target: ATXN1; (-) strand; PAM type: YTN; PAM sequence: TTC
aaatgatgctttatcacaac

SEQ ID NO: 178177 - DNA, 20 bp, Artificial Sequence
  Description of Artificial Sequence: Synthetic oligonucleotide
  Target: ATXN1; (-) strand; PAM type: YTN; PAM sequence: TTT
caaatgatgctttatcacaa

SEQ ID NO: 178178 - DNA, 20 bp, Artificial Sequence
  Description of Artificial Sequence: Synthetic oligonucleotide
  Target: ATXN1; (-) strand; PAM type: YTN; PAM sequence: CTT
tcaaatgatgctttatcaca

SEQ ID NO: 178179 - DNA, 20 bp, Artificial Sequence
  Description of Artificial Sequence: Synthetic oligonucleotide
  Target: ATXN1; (-) strand; PAM type: YTN; PAM sequence: TTA
aaactttcaaatgatgcttt

SEQ ID NO: 178180 - DNA, 20 bp, Artificial Sequence
  Description of Artificial Sequence: Synthetic oligonucleotide
  Target: ATXN1; (-) strand; PAM type: YTN; PAM sequence: TTG
tagccccaacggcattaaaa

SEQ ID NO: 178181 - DNA, 20 bp, Artificial Sequence
  Description of Artificial Sequence: Synthetic oligonucleotide
  Target: ATXN1; (-) strand; PAM type: YTN; PAM sequence: CTT
gtagccccaacggcattaaa

SEQ ID NO: 178182 - DNA, 20 bp, Artificial Sequence
  Description of Artificial Sequence: Synthetic oligonucleotide
  Target: ATXN1; (-) strand; PAM type: YTN; PAM sequence: TTC
catcaagacaatgtgcttgt

SEQ ID NO: 178183 - DNA, 20 bp, Artificial Sequence
  Description of Artificial Sequence: Synthetic oligonucleotide
  Target: ATXN1; (-) strand; PAM type: YTN; PAM sequence: CTG
aattccatcaagacaatgtg

SEQ ID NO: 178184 - DNA, 20 bp, Artificial Sequence
  Description of Artificial Sequence: Synthetic oligonucleotide
  Target: ATXN1; (-) strand; PAM type: YTN; PAM sequence: CTG
tacagctgaattccatcaag

SEQ ID NO: 178185 - DNA, 20 bp, Artificial Sequence
  Description of Artificial Sequence: Synthetic oligonucleotide
  Target: ATXN1; (-) strand; PAM type: YTN; PAM sequence: TTG
acagtaaggagctgtacagc

SEQ ID NO: 178186 - DNA, 20 bp, Artificial Sequence
  Description of Artificial Sequence: Synthetic oligonucleotide
  Target: ATXN1; (-) strand; PAM type: YTN; PAM sequence: TTT
gacagtaaggagctgtacag

SEQ ID NO: 178187 - DNA, 20 bp, Artificial Sequence
  Description of Artificial Sequence: Synthetic oligonucleotide
  Target: ATXN1; (-) strand; PAM type: YTN; PAM sequence: TTA
aaacagaatggatcgtattt

SEQ ID NO: 178188 - DNA, 20 bp, Artificial Sequence
  Description of Artificial Sequence: Synthetic oligonucleotide
  Target: ATXN1; (-) strand; PAM type: YTN; PAM sequence: TTT
aaaacagaatggatcgtatt

SEQ ID NO: 178189 - DNA, 20 bp, Artificial Sequence
  Description of Artificial Sequence: Synthetic oligonucleotide
  Target: ATXN1; (-) strand; PAM type: YTN; PAM sequence: TTA
aaggaatttaaaacagaatg

SEQ ID NO: 178190 - DNA, 20 bp, Artificial Sequence
  Description of Artificial Sequence: Synthetic oligonucleotide
  Target: ATXN1; (-) strand; PAM type: YTN; PAM sequence: CTG
tcacagttaaaggaatttaa

SEQ ID NO: 178191 - DNA, 20 bp, Artificial Sequence
  Description of Artificial Sequence: Synthetic oligonucleotide
  Target: ATXN1; (-) strand; PAM type: YTN; PAM sequence: CTG
cctgtcacagttaaaggaat

SEQ ID NO: 178192 - DNA, 20 bp, Artificial Sequence
  Description of Artificial Sequence: Synthetic oligonucleotide
  Target: ATXN1; (-) strand; PAM type: YTN; PAM sequence: TTC
atcatgctgcctgtcacagt

SEQ ID NO: 178193 - DNA, 20 bp, Artificial Sequence
  Description of Artificial Sequence: Synthetic oligonucleotide
  Target: ATXN1; (-) strand; PAM type: YTN; PAM sequence: TTT
catcatgctgcctgtcacag

SEQ ID NO: 178194 - DNA, 20 bp, Artificial Sequence
  Description of Artificial Sequence: Synthetic oligonucleotide
  Target: ATXN1; (-) strand; PAM type: YTN; PAM sequence: CTG
tttcatcatgctgcctgtca

SEQ ID NO: 178195 - DNA, 20 bp, Artificial Sequence
  Description of Artificial Sequence: Synthetic oligonucleotide
  Target: ATXN1; (-) strand; PAM type: YTN; PAM sequence: TTA
atgcacctgtttcatcatgc

SEQ ID NO: 178196 - DNA, 20 bp, Artificial Sequence
  Description of Artificial Sequence: Synthetic oligonucleotide
  Target: ATXN1; (-) strand; PAM type: YTN; PAM sequence: CTT
aatgcacctgtttcatcatg

SEQ ID NO: 178197 - DNA, 20 bp, Artificial Sequence
  Description of Artificial Sequence: Synthetic oligonucleotide
  Target: ATXN1; (-) strand; PAM type: YTN; PAM sequence: TTC
atgcacttaatgcacctgtt

SEQ ID NO: 178198 - DNA, 20 bp, Artificial Sequence
  Description of Artificial Sequence: Synthetic oligonucleotide
  Target: ATXN1; (-) strand; PAM type: YTN; PAM sequence: TTT
catgcacttaatgcacctgt

SEQ ID NO: 178199 - DNA, 20 bp, Artificial Sequence
  Description of Artificial Sequence: Synthetic oligonucleotide
  Target: ATXN1; (-) strand; PAM type: YTN; PAM sequence: CTG
tttcatgcacttaatgcacc

SEQ ID NO: 178200 - DNA, 20 bp, Artificial Sequence
  Description of Artificial Sequence: Synthetic oligonucleotide
  Target: ATXN1; (-) strand; PAM type: YTN; PAM sequence: TTC
tgtttcatgcacttaatgca

SEQ ID NO: 178201 - DNA, 20 bp, Artificial Sequence
  Description of Artificial Sequence: Synthetic oligonucleotide
  Target: ATXN1; (-) strand; PAM type: YTN; PAM sequence: TTG
ttctgtttcatgcacttaat

SEQ ID NO: 178202 - DNA, 20 bp, Artificial Sequence
  Description of Artificial Sequence: Synthetic oligonucleotide
  Target: ATXN1; (-) strand; PAM type: YTN; PAM sequence: TTT
gttctgtttcatgcacttaa

SEQ ID NO: 178203 - DNA, 20 bp, Artificial Sequence
  Description of Artificial Sequence: Synthetic oligonucleotide
  Target: ATXN1; (-) strand; PAM type: YTN; PAM sequence: TTT
tgttctgtttcatgcactta

SEQ ID NO: 178204 - DNA, 20 bp, Artificial Sequence
  Description of Artificial Sequence: Synthetic oligonucleotide
  Target: ATXN1; (-) strand; PAM type: YTN; PAM sequence: CTT
ttgttctgtttcatgcactt

SEQ ID NO: 178205 - DNA, 20 bp, Artificial Sequence
  Description of Artificial Sequence: Synthetic oligonucleotide
  Target: ATXN1; (-) strand; PAM type: YTN; PAM sequence: TTA
cttttgttctgtttcatgca

SEQ ID NO: 178206 - DNA, 20 bp, Artificial Sequence
  Description of Artificial Sequence: Synthetic oligonucleotide
  Target: ATXN1; (-) strand; PAM type: YTN; PAM sequence: CTT
acttttgttctgtttcatgc

SEQ ID NO: 178207 - DNA, 20 bp, Artificial Sequence
  Description of Artificial Sequence: Synthetic oligonucleotide
  Target: ATXN1; (-) strand; PAM type: YTN; PAM sequence: TTC
ttacttttgttctgtttcat

SEQ ID NO: 178208 - DNA, 20 bp, Artificial Sequence
  Description of Artificial Sequence: Synthetic oligonucleotide
  Target: ATXN1; (-) strand; PAM type: YTN; PAM sequence: TTT
cttacttttgttctgtttca

SEQ ID NO: 178209 - DNA, 20 bp, Artificial Sequence
  Description of Artificial Sequence: Synthetic oligonucleotide
  Target: ATXN1; (-) strand; PAM type: YTN; PAM sequence: TTT
tcttacttttgttctgtttc

SEQ ID NO: 178210 - DNA, 20 bp, Artificial Sequence
  Description of Artificial Sequence: Synthetic oligonucleotide
  Target: ATXN1; (-) strand; PAM type: YTN; PAM sequence: CTT
ttcttacttttgttctgttt

SEQ ID NO: 178211 - DNA, 20 bp, Artificial Sequence
  Description of Artificial Sequence: Synthetic oligonucleotide
  Target: ATXN1; (-) strand; PAM type: YTN; PAM sequence: TTG
agcacttttcttacttttgt

SEQ ID NO: 178212 - DNA, 20 bp, Artificial Sequence
  Description of Artificial Sequence: Synthetic oligonucleotide
  Target: ATXN1; (-) strand; PAM type: YTN; PAM sequence: TTT
gagcacttttcttacttttg

SEQ ID NO: 178213 - DNA, 20 bp, Artificial Sequence
  Description of Artificial Sequence: Synthetic oligonucleotide
  Target: ATXN1; (-) strand; PAM type: YTN; PAM sequence: CTT
tgagcacttttcttactttt

SEQ ID NO: 178214 - DNA, 20 bp, Artificial Sequence
  Description of Artificial Sequence: Synthetic oligonucleotide
  Target: ATXN1; (-) strand; PAM type: YTN; PAM sequence: TTC
ctttgagcacttttcttact

SEQ ID NO: 178215 - DNA, 20 bp, Artificial Sequence
  Description of Artificial Sequence: Synthetic oligonucleotide
  Target: ATXN1; (-) strand; PAM type: YTN; PAM sequence: CTT
cctttgagcacttttcttac

SEQ ID NO: 178216 - DNA, 20 bp, Artificial Sequence
  Description of Artificial Sequence: Synthetic oligonucleotide
  Target: ATXN1; (-) strand; PAM type: YTN; PAM sequence: CTG
gccttcctttgagcactttt

SEQ ID NO: 178217 - DNA, 20 bp, Artificial Sequence
  Description of Artificial Sequence: Synthetic oligonucleotide
  Target: ATXN1; (-) strand; PAM type: YTN; PAM sequence: TTC
tggccttcctttgagcactt

SEQ ID NO: 178218 - DNA, 20 bp, Artificial Sequence
  Description of Artificial Sequence: Synthetic oligonucleotide
  Target: ATXN1; (-) strand; PAM type: YTN; PAM sequence: TTT
ctggccttcctttgagcact

SEQ ID NO: 178219 - DNA, 20 bp, Artificial Sequence
  Description of Artificial Sequence: Synthetic oligonucleotide
  Target: ATXN1; (-) strand; PAM type: YTN; PAM sequence: CTA
tttctggccttcctttgagc

SEQ ID NO: 178220 - DNA, 20 bp, Artificial Sequence
  Description of Artificial Sequence: Synthetic oligonucleotide
  Target: ATXN1; (-) strand; PAM type: YTN; PAM sequence: TTC
actatttctggccttccttt

SEQ ID NO: 178221 - DNA, 20 bp, Artificial Sequence
  Description of Artificial Sequence: Synthetic oligonucleotide
  Target: ATXN1; (-) strand; PAM type: YTN; PAM sequence: CTT
cactatttctggccttcctt

SEQ ID NO: 178222 - DNA, 20 bp, Artificial Sequence
  Description of Artificial Sequence: Synthetic oligonucleotide
  Target: ATXN1; (-) strand; PAM type: YTN; PAM sequence: CTG
gcttcactatttctggcctt

SEQ ID NO: 178223 - DNA, 20 bp, Artificial Sequence
  Description of Artificial Sequence: Synthetic oligonucleotide
  Target: ATXN1; (-) strand; PAM type: YTN; PAM sequence: CTC
tggcttcactatttctggcc

SEQ ID NO: 178224 - DNA, 20 bp, Artificial Sequence
  Description of Artificial Sequence: Synthetic oligonucleotide
  Target: ATXN1; (-) strand; PAM type: YTN; PAM sequence: CTG
tcactctggcttcactattt

SEQ ID NO: 178225 - DNA, 20 bp, Artificial Sequence
  Description of Artificial Sequence: Synthetic oligonucleotide
  Target: ATXN1; (-) strand; PAM type: YTN; PAM sequence: CTG
cagactgtcactctggcttc

SEQ ID NO: 178226 - DNA, 20 bp, Artificial Sequence
  Description of Artificial Sequence: Synthetic oligonucleotide
  Target: ATXN1; (-) strand; PAM type: YTN; PAM sequence: CTG
agacccaggtctgcagactg

SEQ ID NO: 178227 - DNA, 20 bp, Artificial Sequence
  Description of Artificial Sequence: Synthetic oligonucleotide
  Target: ATXN1; (-) strand; PAM type: YTN; PAM sequence: CTG
ctgagacccaggtctgcaga

SEQ ID NO: 178228 - DNA, 20 bp, Artificial Sequence
  Description of Artificial Sequence: Synthetic oligonucleotide
  Target: ATXN1; (-) strand; PAM type: YTN; PAM sequence: CTG
ggcggagctgctgagaccca

SEQ ID NO: 178229 - DNA, 20 bp, Artificial Sequence
  Description of Artificial Sequence: Synthetic oligonucleotide
  Target: ATXN1; (-) strand; PAM type: YTN; PAM sequence: CTC
ctgggcggagctgctgagac

SEQ ID NO: 178230 - DNA, 20 bp, Artificial Sequence
  Description of Artificial Sequence: Synthetic oligonucleotide
  Target: ATXN1; (-) strand; PAM type: YTN; PAM sequence: CTC
cggcaggaactcctgggcgg

SEQ ID NO: 178231 - DNA, 20 bp, Artificial Sequence
  Description of Artificial Sequence: Synthetic oligonucleotide
  Target: ATXN1; (-) strand; PAM type: YTN; PAM sequence: CTG
agctccggcaggaactcctg

SEQ ID NO: 178232 - DNA, 20 bp, Artificial Sequence
  Description of Artificial Sequence: Synthetic oligonucleotide
  Target: ATXN1; (-) strand; PAM type: YTN; PAM sequence: CTC
gcctgagctccggcaggaac

SEQ ID NO: 178233 - DNA, 20 bp, Artificial Sequence
  Description of Artificial Sequence: Synthetic oligonucleotide
  Target: ATXN1; (-) strand; PAM type: YTN; PAM sequence: TTG
gcaggtgaggaggtagcggc

SEQ ID NO: 178234 - DNA, 20 bp, Artificial Sequence
  Description of Artificial Sequence: Synthetic oligonucleotide
  Target: ATXN1; (-) strand; PAM type: YTN; PAM sequence: TTT
ggcaggtgaggaggtagcgg

SEQ ID NO: 178235 - DNA, 20 bp, Artificial Sequence
  Description of Artificial Sequence: Synthetic oligonucleotide
  Target: ATXN1; (-) strand; PAM type: YTN; PAM sequence: CTC
gtttggcaggtgaggaggta

SEQ ID NO: 178236 - DNA, 20 bp, Artificial Sequence
  Description of Artificial Sequence: Synthetic oligonucleotide
  Target: ATXN1; (-) strand; PAM type: YTN; PAM sequence: TTA
gaggacgcgtcgtgaccctc

SEQ ID NO: 178237 - DNA, 20 bp, Artificial Sequence
  Description of Artificial Sequence: Synthetic oligonucleotide
  Target: ATXN1; (-) strand; PAM type: YTN; PAM sequence: CTG
aggttagaggacgcgtcgtg

SEQ ID NO: 178238 - DNA, 20 bp, Artificial Sequence
  Description of Artificial Sequence: Synthetic oligonucleotide
  Target: ATXN1; (-) strand; PAM type: YTN; PAM sequence: CTC
tgaggttagaggacgcgtcg

SEQ ID NO: 178239 - DNA, 20 bp, Artificial Sequence
  Description of Artificial Sequence: Synthetic oligonucleotide
  Target: ATXN1; (-) strand; PAM type: YTN; PAM sequence: TTC
tctgaggttagaggacgcgt

SEQ ID NO: 178240 - DNA, 20 bp, Artificial Sequence
  Description of Artificial Sequence: Synthetic oligonucleotide
  Target: ATXN1; (-) strand; PAM type: YTN; PAM sequence: TTC
acaaaaattctctgaggtta

SEQ ID NO: 178241 - DNA, 20 bp, Artificial Sequence
  Description of Artificial Sequence: Synthetic oligonucleotide
  Target: ATXN1; (-) strand; PAM type: YTN; PAM sequence: TTT
cacaaaaattctctgaggtt

SEQ ID NO: 178242 - DNA, 20 bp, Artificial Sequence
  Description of Artificial Sequence: Synthetic oligonucleotide
  Target: ATXN1; (-) strand; PAM type: YTN; PAM sequence: CTC
aatttcacaaaaattctctg

SEQ ID NO: 178243 - DNA, 20 bp, Artificial Sequence
  Description of Artificial Sequence: Synthetic oligonucleotide
  Target: ATXN1; (-) strand; PAM type: YTN; PAM sequence: TTC
tcaatttcacaaaaattctc

SEQ ID NO: 178244 - DNA, 20 bp, Artificial Sequence
  Description of Artificial Sequence: Synthetic oligonucleotide
  Target: ATXN1; (-) strand; PAM type: YTN; PAM sequence: TTT
ctcaatttcacaaaaattct

SEQ ID NO: 178245 - DNA, 20 bp, Artificial Sequence
  Description of Artificial Sequence: Synthetic oligonucleotide
  Target: ATXN1; (-) strand; PAM type: YTN; PAM sequence: TTG
taagtttctcaatttcacaa

SEQ ID NO: 178246 - DNA, 20 bp, Artificial Sequence
  Description of Artificial Sequence: Synthetic oligonucleotide
  Target: ATXN1; (-) strand; PAM type: YTN; PAM sequence: TTG
ttgtaagtttctcaatttca

SEQ ID NO: 178247 - DNA, 20 bp, Artificial Sequence
  Description of Artificial Sequence: Synthetic oligonucleotide
  Target: ATXN1; (-) strand; PAM type: YTN; PAM sequence: CTT
gttgtaagtttctcaatttc

SEQ ID NO: 178248 - DNA, 20 bp, Artificial Sequence
  Description of Artificial Sequence: Synthetic oligonucleotide
  Target: ATXN1; (-) strand; PAM type: YTN; PAM sequence: CTG
agtgcttgttgtaagtttct

SEQ ID NO: 178249 - DNA, 20 bp, Artificial Sequence
  Description of Artificial Sequence: Synthetic oligonucleotide
  Target: ATXN1; (-) strand; PAM type: YTN; PAM sequence: TTG
ctgagtgcttgttgtaagtt

SEQ ID NO: 178250 - DNA, 20 bp, Artificial Sequence
  Description of Artificial Sequence: Synthetic oligonucleotide
  Target: ATXN1; (-) strand; PAM type: YTN; PAM sequence: TTT
gctgagtgcttgttgtaagt

SEQ ID NO: 178251 - DNA, 20 bp, Artificial Sequence
  Description of Artificial Sequence: Synthetic oligonucleotide
  Target: ATXN1; (-) strand; PAM type: YTN; PAM sequence: TTG
gcatccatgtttgctgagtg

SEQ ID NO: 178252 - DNA, 20 bp, Artificial Sequence
  Description of Artificial Sequence: Synthetic oligonucleotide
  Target: ATXN1; (-) strand; PAM type: YTN; PAM sequence: TTT
ggcatccatgtttgctgagt

SEQ ID NO: 178253 - DNA, 20 bp, Artificial Sequence
  Description of Artificial Sequence: Synthetic oligonucleotide
  Target: ATXN1; (-) strand; PAM type: YTN; PAM sequence: TTA
tgagataatagtttggcatc

SEQ ID NO: 178254 - DNA, 20 bp, Artificial Sequence
  Description of Artificial Sequence: Synthetic oligonucleotide
  Target: ATXN1; (-) strand; PAM type: YTN; PAM sequence: TTG
aattatgagataatagtttg

SEQ ID NO: 178255 - DNA, 20 bp, Artificial Sequence
  Description of Artificial Sequence: Synthetic oligonucleotide
  Target: ATXN1; (-) strand; PAM type: YTN; PAM sequence: TTG
ggcacattgaattatgagat

SEQ ID NO: 178256 - DNA, 20 bp, Artificial Sequence
  Description of Artificial Sequence: Synthetic oligonucleotide
  Target: ATXN1; (-) strand; PAM type: YTN; PAM sequence: TTT
gggcacattgaattatgaga

SEQ ID NO: 178257 - DNA, 20 bp, Artificial Sequence
  Description of Artificial Sequence: Synthetic oligonucleotide
  Target: ATXN1; (-) strand; PAM type: YTN; PAM sequence: CTG
atttgggcacattgaattat

SEQ ID NO: 178258 - DNA, 20 bp, Artificial Sequence
  Description of Artificial Sequence: Synthetic oligonucleotide
  Target: ATXN1; (-) strand; PAM type: YTN; PAM sequence: TTC
agtctgatttgggcacattg

SEQ ID NO: 178259 - DNA, 20 bp, Artificial Sequence
  Description of Artificial Sequence: Synthetic oligonucleotide
  Target: ATXN1; (-) strand; PAM type: YTN; PAM sequence: TTT
cagtctgatttgggcacatt

SEQ ID NO: 178260 - DNA, 20 bp, Artificial Sequence
  Description of Artificial Sequence: Synthetic oligonucleotide
  Target: ATXN1; (-) strand; PAM type: YTN; PAM sequence: TTG
tttcagtctgatttgggcac

SEQ ID NO: 178261 - DNA, 20 bp, Artificial Sequence
  Description of Artificial Sequence: Synthetic oligonucleotide
  Target: ATXN1; (-) strand; PAM type: YTN; PAM sequence: CTT
gtttcagtctgatttgggca

SEQ ID NO: 178262 - DNA, 20 bp, Artificial Sequence
  Description of Artificial Sequence: Synthetic oligonucleotide
  Target: ATXN1; (-) strand; PAM type: YTN; PAM sequence: TTA
cttgtttcagtctgatttgg

SEQ ID NO: 178263 - DNA, 20 bp, Artificial Sequence
  Description of Artificial Sequence: Synthetic oligonucleotide
  Target: ATXN1; (-) strand; PAM type: YTN; PAM sequence: TTT
acttgtttcagtctgatttg

SEQ ID NO: 178264 - DNA, 20 bp, Artificial Sequence
  Description of Artificial Sequence: Synthetic oligonucleotide
  Target: ATXN1; (-) strand; PAM type: YTN; PAM sequence: TTT
tacttgtttcagtctgattt

SEQ ID NO: 178265 - DNA, 20 bp, Artificial Sequence
  Description of Artificial Sequence: Synthetic oligonucleotide
  Target: ATXN1; (-) strand; PAM type: YTN; PAM sequence: TTG
gggttttacttgtttcagtc

SEQ ID NO: 178266 - DNA, 20 bp, Artificial Sequence
  Description of Artificial Sequence: Synthetic oligonucleotide
  Target: ATXN1; (-) strand; PAM type: YTN; PAM sequence: TTT
ggggttttacttgtttcagt

SEQ ID NO: 178267 - DNA, 20 bp, Artificial Sequence
  Description of Artificial Sequence: Synthetic oligonucleotide
  Target: ATXN1; (-) strand; PAM type: YTN; PAM sequence: TTA
atttggggttttacttgttt

SEQ ID NO: 178268 - DNA, 20 bp, Artificial Sequence
  Description of Artificial Sequence: Synthetic oligonucleotide
  Target: ATXN1; (-) strand; PAM type: YTN; PAM sequence: TTG
gaaaatgtaacccatagcat

SEQ ID NO: 178269 - DNA, 20 bp, Artificial Sequence
  Description of Artificial Sequence: Synthetic oligonucleotide
  Target: ATXN1; (-) strand; PAM type: YTN; PAM sequence: TTT
ggaaaatgtaacccatagca

SEQ ID NO: 178270 - DNA, 20 bp, Artificial Sequence
  Description of Artificial Sequence: Synthetic oligonucleotide
  Target: ATXN1; (-) strand; PAM type: YTN; PAM sequence: TTT
tggaaaatgtaacccatagc

SEQ ID NO: 178271 - DNA, 20 bp, Artificial Sequence
  Description of Artificial Sequence: Synthetic oligonucleotide
  Target: ATXN1; (-) strand; PAM type: YTN; PAM sequence: CTT
ttggaaaatgtaacccatag

SEQ ID NO: 178272 - DNA, 20 bp, Artificial Sequence
  Description of Artificial Sequence: Synthetic oligonucleotide
  Target: ATXN1; (-) strand; PAM type: YTN; PAM sequence: TTC
cgaaggcttttggaaaatgt

SEQ ID NO: 178273 - DNA, 20 bp, Artificial Sequence
  Description of Artificial Sequence: Synthetic oligonucleotide
  Target: ATXN1; (-) strand; PAM type: YTN; PAM sequence: TTT
ccgaaggcttttggaaaatg

SEQ ID NO: 178274 - DNA, 20 bp, Artificial Sequence
  Description of Artificial Sequence: Synthetic oligonucleotide
  Target: ATXN1; (-) strand; PAM type: YTN; PAM sequence: TTA
taaatgccaatttccgaagg

SEQ ID NO: 178275 - DNA, 20 bp, Artificial Sequence
  Description of Artificial Sequence: Synthetic oligonucleotide
  Target: ATXN1; (-) strand; PAM type: YTN; PAM sequence: CTG
tacatggagaaggatgaacc

SEQ ID NO: 178276 - DNA, 20 bp, Artificial Sequence
  Description of Artificial Sequence: Synthetic oligonucleotide
  Target: ATXN1; (-) strand; PAM type: YTN; PAM sequence: TTC
tgtacatggagaaggatgaa

SEQ ID NO: 178277 - DNA, 20 bp, Artificial Sequence
  Description of Artificial Sequence: Synthetic oligonucleotide
  Target: ATXN1; (-) strand; PAM type: YTN; PAM sequence: TTT
ctgtacatggagaaggatga

SEQ ID NO: 178278 - DNA, 20 bp, Artificial Sequence
  Description of Artificial Sequence: Synthetic oligonucleotide
  Target: ATXN1; (-) strand; PAM type: YTN; PAM sequence: TTG
atgtgtgcacatgtttctgt

SEQ ID NO: 178279 - DNA, 20 bp, Artificial Sequence
  Description of Artificial Sequence: Synthetic oligonucleotide
  Target: ATXN1; (-) strand; PAM type: YTN; PAM sequence: TTT
gatgtgtgcacatgtttctg

SEQ ID NO: 178280 - DNA, 20 bp, Artificial Sequence
  Description of Artificial Sequence: Synthetic oligonucleotide
  Target: ATXN1; (-) strand; PAM type: YTN; PAM sequence: TTT
tgatgtgtgcacatgtttct

SEQ ID NO: 178281 - DNA, 20 bp, Artificial Sequence
  Description of Artificial Sequence: Synthetic oligonucleotide
  Target: ATXN1; (-) strand; PAM type: YTN; PAM sequence: CTG
ttttgatgtgtgcacatgtt

SEQ ID NO: 178282 - DNA, 20 bp, Artificial Sequence
  Description of Artificial Sequence: Synthetic oligonucleotide
  Target: ATXN1; (-) strand; PAM type: YTN; PAM sequence: CTG
ggtctgttttgatgtgtgca

SEQ ID NO: 178283 - DNA, 20 bp, Artificial Sequence
  Description of Artificial Sequence: Synthetic oligonucleotide
  Target: ATXN1; (-) strand; PAM type: YTN; PAM sequence: TTA
actgggtctgttttgatgtg

SEQ ID NO: 178284 - DNA, 20 bp, Artificial Sequence
  Description of Artificial Sequence: Synthetic oligonucleotide
  Target: ATXN1; (-) strand; PAM type: YTN; PAM sequence: CTT
aactgggtctgttttgatgt

SEQ ID NO: 178285 - DNA, 20 bp, Artificial Sequence
  Description of Artificial Sequence: Synthetic oligonucleotide
  Target: ATXN1; (-) strand; PAM type: YTN; PAM sequence: TTA
agacttaactgggtctgttt

SEQ ID NO: 178286 - DNA, 20 bp, Artificial Sequence
  Description of Artificial Sequence: Synthetic oligonucleotide
  Target: ATXN1; (-) strand; PAM type: YTN; PAM sequence: CTA
gataattaagacttaactgg

SEQ ID NO: 178287 - DNA, 20 bp, Artificial Sequence
  Description of Artificial Sequence: Synthetic oligonucleotide
  Target: ATXN1; (-) strand; PAM type: YTN; PAM sequence: TTC
cactagataattaagactta

SEQ ID NO: 178288 - DNA, 20 bp, Artificial Sequence
  Description of Artificial Sequence: Synthetic oligonucleotide
  Target: ATXN1; (-) strand; PAM type: YTN; PAM sequence: CTT
ccactagataattaagactt

SEQ ID NO: 178289 - DNA, 20 bp, Artificial Sequence
  Description of Artificial Sequence: Synthetic oligonucleotide
  Target: ATXN1; (-) strand; PAM type: YTN; PAM sequence: TTG
gataatcttccactagataa

SEQ ID NO: 178290 - DNA, 20 bp, Artificial Sequence
  Description of Artificial Sequence: Synthetic oligonucleotide
  Target: ATXN1; (-) strand; PAM type: YTN; PAM sequence: CTT
ggataatcttccactagata

SEQ ID NO: 178291 - DNA, 20 bp, Artificial Sequence
  Description of Artificial Sequence: Synthetic oligonucleotide
  Target: ATXN1; (-) strand; PAM type: YTN; PAM sequence: CTA
aaaatgggcaacaggaaaag

SEQ ID NO: 178292 - DNA, 20 bp, Artificial Sequence
  Description of Artificial Sequence: Synthetic oligonucleotide
  Target: ATXN1; (-) strand; PAM type: YTN; PAM sequence: TTG
ccaaaaaaggctaaaaatgg

SEQ ID NO: 178293 - DNA, 20 bp, Artificial Sequence
  Description of Artificial Sequence: Synthetic oligonucleotide
  Target: ATXN1; (-) strand; PAM type: YTN; PAM sequence: TTA
atagtggaggaattgccaaa

SEQ ID NO: 178294 - DNA, 20 bp, Artificial Sequence
  Description of Artificial Sequence: Synthetic oligonucleotide
  Target: ATXN1; (-) strand; PAM type: YTN; PAM sequence: TTT
aatagtggaggaattgccaa

SEQ ID NO: 178295 - DNA, 20 bp, Artificial Sequence
  Description of Artificial Sequence: Synthetic oligonucleotide
  Target: ATXN1; (-) strand; PAM type: YTN; PAM sequence: CTT
taatagtggaggaattgcca

SEQ ID NO: 178296 - DNA, 20 bp, Artificial Sequence
  Description of Artificial Sequence: Synthetic oligonucleotide
  Target: ATXN1; (-) strand; PAM type: YTN; PAM sequence: TTC
tttaatagtggaggaattgc

SEQ ID NO: 178297 - DNA, 20 bp, Artificial Sequence
  Description of Artificial Sequence: Synthetic oligonucleotide
  Target: ATXN1; (-) strand; PAM type: YTN; PAM sequence: TTT
ctttaatagtggaggaattg

SEQ ID NO: 178298 - DNA, 20 bp, Artificial Sequence
  Description of Artificial Sequence: Synthetic oligonucleotide
  Target: ATXN1; (-) strand; PAM type: YTN; PAM sequence: TTT
tctttaatagtggaggaatt

SEQ ID NO: 178299 - DNA, 20 bp, Artificial Sequence
  Description of Artificial Sequence: Synthetic oligonucleotide
  Target: ATXN1; (-) strand; PAM type: YTN; PAM sequence: CTT
ttctttaatagtggaggaat

SEQ ID NO: 178300 - DNA, 20 bp, Artificial Sequence
  Description of Artificial Sequence: Synthetic oligonucleotide
  Target: ATXN1; (-) strand; PAM type: YTN; PAM sequence: CTC
ttttctttaatagtggagga

SEQ ID NO: 178301 - DNA, 20 bp, Artificial Sequence
  Description of Artificial Sequence: Synthetic oligonucleotide
  Target: ATXN1; (-) strand; PAM type: YTN; PAM sequence: TTG
catgccatctcttttcttta

SEQ ID NO: 178302 - DNA, 20 bp, Artificial Sequence
  Description of Artificial Sequence: Synthetic oligonucleotide
  Target: ATXN1; (-) strand; PAM type: YTN; PAM sequence: TTT
gcatgccatctcttttcttt

SEQ ID NO: 178303 - DNA, 20 bp, Artificial Sequence
  Description of Artificial Sequence: Synthetic oligonucleotide
  Target: ATXN1; (-) strand; PAM type: YTN; PAM sequence: TTG
atttgcatgccatctctttt

SEQ ID NO: 178304 - DNA, 20 bp, Artificial Sequence
  Description of Artificial Sequence: Synthetic oligonucleotide
  Target: ATXN1; (-) strand; PAM type: YTN; PAM sequence: TTG
attgatttgcatgccatctc

SEQ ID NO: 178305 - DNA, 20 bp, Artificial Sequence
  Description of Artificial Sequence: Synthetic oligonucleotide
  Target: ATXN1; (-) strand; PAM type: YTN; PAM sequence: TTA
cagtgaagaaggaaaggggt

SEQ ID NO: 178306 - DNA, 20 bp, Artificial Sequence
  Description of Artificial Sequence: Synthetic oligonucleotide
  Target: ATXN1; (-) strand; PAM type: YTN; PAM sequence: TTG
aaattacagtgaagaaggaa

SEQ ID NO: 178307 - DNA, 20 bp, Artificial Sequence
  Description of Artificial Sequence: Synthetic oligonucleotide
  Target: ATXN1; (-) strand; PAM type: YTN; PAM sequence: CTG
aggtagcacagataattgaa

SEQ ID NO: 178308 - DNA, 20 bp, Artificial Sequence
  Description of Artificial Sequence: Synthetic oligonucleotide
  Target: ATXN1; (-) strand; PAM type: YTN; PAM sequence: CTC
gcccatccatgccaacggag

SEQ ID NO: 178309 - DNA, 20 bp, Artificial Sequence
  Description of Artificial Sequence: Synthetic oligonucleotide
  Target: ATXN1; (-) strand; PAM type: YTN; PAM sequence: CTC
ctcgcccatccatgccaacg

SEQ ID NO: 178310 - DNA, 20 bp, Artificial Sequence
  Description of Artificial Sequence: Synthetic oligonucleotide
  Target: ATXN1; (-) strand; PAM type: YTN; PAM sequence: CTG
aggacaaagatagcacctcc

SEQ ID NO: 178311 - DNA, 20 bp, Artificial Sequence
  Description of Artificial Sequence: Synthetic oligonucleotide
  Target: ATXN1; (-) strand; PAM type: YTN; PAM sequence: TTC
tgaggacaaagatagcacct

SEQ ID NO: 178312 - DNA, 20 bp, Artificial Sequence
  Description of Artificial Sequence: Synthetic oligonucleotide
  Target: ATXN1; (-) strand; PAM type: YTN; PAM sequence: TTC
catccaattctgaggacaaa

SEQ ID NO: 178313 - DNA, 20 bp, Artificial Sequence
  Description of Artificial Sequence: Synthetic oligonucleotide
  Target: ATXN1; (-) strand; PAM type: YTN; PAM sequence: TTT
ccatccaattctgaggacaa

SEQ ID NO: 178314 - DNA, 20 bp, Artificial Sequence
  Description of Artificial Sequence: Synthetic oligonucleotide
  Target: ATXN1; (-) strand; PAM type: YTN; PAM sequence: TTT
tccatccaattctgaggaca

SEQ ID NO: 178315 - DNA, 20 bp, Artificial Sequence
  Description of Artificial Sequence: Synthetic oligonucleotide
  Target: ATXN1; (-) strand; PAM type: YTN; PAM sequence: TTC
ccaataacacagatgaatgt

SEQ ID NO: 178316 - DNA, 20 bp, Artificial Sequence
  Description of Artificial Sequence: Synthetic oligonucleotide
  Target: ATXN1; (-) strand; PAM type: YTN; PAM sequence: TTT
cccaataacacagatgaatg

SEQ ID NO: 178317 - DNA, 20 bp, Artificial Sequence
  Description of Artificial Sequence: Synthetic oligonucleotide
  Target: ATXN1; (-) strand; PAM type: YTN; PAM sequence: TTC
acatcatttcccaataacac

SEQ ID NO: 178318 - DNA, 20 bp, Artificial Sequence
  Description of Artificial Sequence: Synthetic oligonucleotide
  Target: ATXN1; (-) strand; PAM type: YTN; PAM sequence: TTA
agttcacatcatttcccaat

SEQ ID NO: 178319 - DNA, 20 bp, Artificial Sequence
  Description of Artificial Sequence: Synthetic oligonucleotide
  Target: ATXN1; (-) strand; PAM type: YTN; PAM sequence: TTA
gaagggaaagagaaattaag

SEQ ID NO: 178320 - DNA, 20 bp, Artificial Sequence
  Description of Artificial Sequence: Synthetic oligonucleotide
  Target: ATXN1; (-) strand; PAM type: YTN; PAM sequence: TTT
agaagggaaagagaaattaa

SEQ ID NO: 178321 - DNA, 20 bp, Artificial Sequence
  Description of Artificial Sequence: Synthetic oligonucleotide
  Target: ATXN1; (-) strand; PAM type: YTN; PAM sequence: TTT
tagaagggaaagagaaatta

SEQ ID NO: 178322 - DNA, 20 bp, Artificial Sequence
  Description of Artificial Sequence: Synthetic oligonucleotide
  Target: ATXN1; (-) strand; PAM type: YTN; PAM sequence: TTC
agtaagcaaagttttagaag

SEQ ID NO: 178323 - DNA, 20 bp, Artificial Sequence
  Description of Artificial Sequence: Synthetic oligonucleotide
  Target: ATXN1; (-) strand; PAM type: YTN; PAM sequence: TTC
cattcagtaagcaaagtttt

SEQ ID NO: 178324 - DNA, 20 bp, Artificial Sequence
  Description of Artificial Sequence: Synthetic oligonucleotide
  Target: ATXN1; (-) strand; PAM type: YTN; PAM sequence: TTT
ccattcagtaagcaaagttt

SEQ ID NO: 178325 - DNA, 20 bp, Artificial Sequence
  Description of Artificial Sequence: Synthetic oligonucleotide
  Target: ATXN1; (-) strand; PAM type: YTN; PAM sequence: CTC
aggaacatttccattcagta

SEQ ID NO: 178326 - DNA, 20 bp, Artificial Sequence
  Description of Artificial Sequence: Synthetic oligonucleotide
  Target: ATXN1; (-) strand; PAM type: YTN; PAM sequence: TTA
aaagggaggtacataaatat

SEQ ID NO: 178327 - DNA, 20 bp, Artificial Sequence
  Description of Artificial Sequence: Synthetic oligonucleotide
  Target: ATXN1; (-) strand; PAM type: YTN; PAM sequence: TTT
aaaagggaggtacataaata

SEQ ID NO: 178328 - DNA, 20 bp, Artificial Sequence
  Description of Artificial Sequence: Synthetic oligonucleotide
  Target: ATXN1; (-) strand; PAM type: YTN; PAM sequence: TTT
taaaagggaggtacataaat

SEQ ID NO: 178329 - DNA, 20 bp, Artificial Sequence
  Description of Artificial Sequence: Synthetic oligonucleotide
  Target: ATXN1; (-) strand; PAM type: YTN; PAM sequence: CTA
ttttaaaagggaggtacata

SEQ ID NO: 178330 - DNA, 20 bp, Artificial Sequence
  Description of Artificial Sequence: Synthetic oligonucleotide
  Target: ATXN1; (-) strand; PAM type: YTN; PAM sequence: CTC
tattttaaaagggaggtaca

SEQ ID NO: 178331 - DNA, 20 bp, Artificial Sequence
  Description of Artificial Sequence: Synthetic oligonucleotide
  Target: ATXN1; (-) strand; PAM type: YTN; PAM sequence: TTC
tctattttaaaagggaggta

SEQ ID NO: 178332 - DNA, 20 bp, Artificial Sequence
  Description of Artificial Sequence: Synthetic oligonucleotide
  Target: ATXN1; (-) strand; PAM type: YTN; PAM sequence: TTA
acatgtattctctattttaa

SEQ ID NO: 178333 - DNA, 20 bp, Artificial Sequence
  Description of Artificial Sequence: Synthetic oligonucleotide
  Target: ATXN1; (-) strand; PAM type: YTN; PAM sequence: CTG
agtcatcaaagaaacattaa

SEQ ID NO: 178334 - DNA, 20 bp, Artificial Sequence
  Description of Artificial Sequence: Synthetic oligonucleotide
  Target: ATXN1; (-) strand; PAM type: YTN; PAM sequence: TTA
ccgataatacacactgagtc

SEQ ID NO: 178335 - DNA, 20 bp, Artificial Sequence
  Description of Artificial Sequence: Synthetic oligonucleotide
  Target: ATXN1; (-) strand; PAM type: YTN; PAM sequence: CTG
ttaccgataatacacactga

SEQ ID NO: 178336 - DNA, 20 bp, Artificial Sequence
  Description of Artificial Sequence: Synthetic oligonucleotide
  Target: ATXN1; (-) strand; PAM type: YTN; PAM sequence: CTG
tgtggtatggcaacatcatg

SEQ ID NO: 178337 - DNA, 20 bp, Artificial Sequence
  Description of Artificial Sequence: Synthetic oligonucleotide
  Target: ATXN1; (-) strand; PAM type: YTN; PAM sequence: TTA
tgctgtgtggtatggcaaca

SEQ ID NO: 178338 - DNA, 20 bp, Artificial Sequence
  Description of Artificial Sequence: Synthetic oligonucleotide
  Target: ATXN1; (-) strand; PAM type: YTN; PAM sequence: CTG
agatcaagggagaatgaaga

SEQ ID NO: 178339 - DNA, 20 bp, Artificial Sequence
  Description of Artificial Sequence: Synthetic oligonucleotide
  Target: ATXN1; (-) strand; PAM type: YTN; PAM sequence: TTA
aatgacaaactgagatcaag

SEQ ID NO: 178340 - DNA, 20 bp, Artificial Sequence
  Description of Artificial Sequence: Synthetic oligonucleotide
  Target: ATXN1; (-) strand; PAM type: YTN; PAM sequence: TTA
gatgtattaaatgacaaact

SEQ ID NO: 178341 - DNA, 20 bp, Artificial Sequence
  Description of Artificial Sequence: Synthetic oligonucleotide
  Target: ATXN1; (-) strand; PAM type: YTN; PAM sequence: CTT
agatgtattaaatgacaaac

SEQ ID NO: 178342 - DNA, 20 bp, Artificial Sequence
  Description of Artificial Sequence: Synthetic oligonucleotide
  Target: ATXN1; (-) strand; PAM type: YTN; PAM sequence: TTG
agtgaaaaacttagatgtat

SEQ ID NO: 178343 - DNA, 20 bp, Artificial Sequence
  Description of Artificial Sequence: Synthetic oligonucleotide
  Target: ATXN1; (-) strand; PAM type: YTN; PAM sequence: TTG
ttgagtgaaaaacttagatg

SEQ ID NO: 178344 - DNA, 20 bp, Artificial Sequence
  Description of Artificial Sequence: Synthetic oligonucleotide
  Target: ATXN1; (-) strand; PAM type: YTN; PAM sequence: TTT
gttgagtgaaaaacttagat

SEQ ID NO: 178345 - DNA, 20 bp, Artificial Sequence
  Description of Artificial Sequence: Synthetic oligonucleotide
  Target: ATXN1; (-) strand; PAM type: YTN; PAM sequence: TTG
atttgttgagtgaaaaactt

SEQ ID NO: 178346 - DNA, 20 bp, Artificial Sequence
  Description of Artificial Sequence: Synthetic oligonucleotide
  Target: ATXN1; (-) strand; PAM type: YTN; PAM sequence: TTT
gatttgttgagtgaaaaact

SEQ ID NO: 178347 - DNA, 20 bp, Artificial Sequence
  Description of Artificial Sequence: Synthetic oligonucleotide
  Target: ATXN1; (-) strand; PAM type: YTN; PAM sequence: CTC
catcagtatttgatttgttg

SEQ ID NO: 178348 - DNA, 20 bp, Artificial Sequence
  Description of Artificial Sequence: Synthetic oligonucleotide
  Target: ATXN1; (-) strand; PAM type: YTN; PAM sequence: TTC
tccatcagtatttgatttgt

SEQ ID NO: 178349 - DNA, 20 bp, Artificial Sequence
  Description of Artificial Sequence: Synthetic oligonucleotide
  Target: ATXN1; (-) strand; PAM type: YTN; PAM sequence: CTG
gtgtatagcagattctccat

SEQ ID NO: 178350 - DNA, 20 bp, Artificial Sequence
  Description of Artificial Sequence: Synthetic oligonucleotide
  Target: ATXN1; (-) strand; PAM type: YTN; PAM sequence: CTA
gcagcacagtgcctggtgta

SEQ ID NO: 178351 - DNA, 20 bp, Artificial Sequence
  Description of Artificial Sequence: Synthetic oligonucleotide
  Target: ATXN1; (-) strand; PAM type: YTN; PAM sequence: CTC
ctagcagcacagtgcctggt

SEQ ID NO: 178352 - DNA, 20 bp, Artificial Sequence
  Description of Artificial Sequence: Synthetic oligonucleotide
  Target: ATXN1; (-) strand; PAM type: YTN; PAM sequence: CTC
agctcctagcagcacagtgc

SEQ ID NO: 178353 - DNA, 20 bp, Artificial Sequence
  Description of Artificial Sequence: Synthetic oligonucleotide
  Target: ATXN1; (-) strand; PAM type: YTN; PAM sequence: TTC
aatcctcagctcctagcagc

SEQ ID NO: 178354 - DNA, 20 bp, Artificial Sequence
  Description of Artificial Sequence: Synthetic oligonucleotide
  Target: ATXN1; (-) strand; PAM type: YTN; PAM sequence: CTC
cccgttcaatcctcagctcc

SEQ ID NO: 178355 - DNA, 20 bp, Artificial Sequence
  Description of Artificial Sequence: Synthetic oligonucleotide
  Target: ATXN1; (-) strand; PAM type: YTN; PAM sequence: TTC
tccccgttcaatcctcagct

SEQ ID NO: 178356 - DNA, 20 bp, Artificial Sequence
  Description of Artificial Sequence: Synthetic oligonucleotide
  Target: ATXN1; (-) strand; PAM type: YTN; PAM sequence: TTT
ctccccgttcaatcctcagc

SEQ ID NO: 178357 - DNA, 20 bp, Artificial Sequence
  Description of Artificial Sequence: Synthetic oligonucleotide
  Target: ATXN1; (-) strand; PAM type: YTN; PAM sequence: CTG
tttctccccgttcaatcctc

SEQ ID NO: 178358 - DNA, 20 bp, Artificial Sequence
  Description of Artificial Sequence: Synthetic oligonucleotide
  Target: ATXN1; (-) strand; PAM type: YTN; PAM sequence: TTC
ctgtttctccccgttcaatc

SEQ ID NO: 178359 - DNA, 20 bp, Artificial Sequence
  Description of Artificial Sequence: Synthetic oligonucleotide
  Target: ATXN1; (-) strand; PAM type: YTN; PAM sequence: CTT
cctgtttctccccgttcaat

SEQ ID NO: 178360 - DNA, 20 bp, Artificial Sequence
  Description of Artificial Sequence: Synthetic oligonucleotide
  Target: ATXN1; (-) strand; PAM type: YTN; PAM sequence: CTA
tgagagcagggagcttcctg

SEQ ID NO: 178361 - DNA, 20 bp, Artificial Sequence
  Description of Artificial Sequence: Synthetic oligonucleotide
  Target: ATXN1; (-) strand; PAM type: YTN; PAM sequence: CTA
agaagcactatgagagcagg

SEQ ID NO: 178362 - DNA, 20 bp, Artificial Sequence
  Description of Artificial Sequence: Synthetic oligonucleotide
  Target: ATXN1; (-) strand; PAM type: YTN; PAM sequence: CTC
cccaactaagaagcactatg

SEQ ID NO: 178363 - DNA, 20 bp, Artificial Sequence
  Description of Artificial Sequence: Synthetic oligonucleotide
  Target: ATXN1; (-) strand; PAM type: YTN; PAM sequence: TTC
tccccaactaagaagcacta

SEQ ID NO: 178364 - DNA, 20 bp, Artificial Sequence
  Description of Artificial Sequence: Synthetic oligonucleotide
  Target: ATXN1; (-) strand; PAM type: YTN; PAM sequence: TTT
ctccccaactaagaagcact

SEQ ID NO: 178365 - DNA, 20 bp, Artificial Sequence
  Description of Artificial Sequence: Synthetic oligonucleotide
  Target: ATXN1; (-) strand; PAM type: YTN; PAM sequence: TTT
tctccccaactaagaagcac

SEQ ID NO: 178366 - DNA, 20 bp, Artificial Sequence
  Description of Artificial Sequence: Synthetic oligonucleotide
  Target: ATXN1; (-) strand; PAM type: YTN; PAM sequence: CTT
ttctccccaactaagaagca

SEQ ID NO: 178367 - DNA, 20 bp, Artificial Sequence
  Description of Artificial Sequence: Synthetic oligonucleotide
  Target: ATXN1; (-) strand; PAM type: YTN; PAM sequence: TTA
tatcatgaatgtcttttctc

SEQ ID NO: 178368 - DNA, 20 bp, Artificial Sequence
  Description of Artificial Sequence: Synthetic oligonucleotide
  Target: ATXN1; (-) strand; PAM type: YTN; PAM sequence: TTA
tgtgattatatcatgaatgt

SEQ ID NO: 178369 - DNA, 20 bp, Artificial Sequence
  Description of Artificial Sequence: Synthetic oligonucleotide
  Target: ATXN1; (-) strand; PAM type: YTN; PAM sequence: TTT
atgtgattatatcatgaatg

SEQ ID NO: 178370 - DNA, 20 bp, Artificial Sequence
  Description of Artificial Sequence: Synthetic oligonucleotide
  Target: ATXN1; (-) strand; PAM type: YTN; PAM sequence: TTA
catataaaaataggtattta

SEQ ID NO: 178371 - DNA, 20 bp, Artificial Sequence
  Description of Artificial Sequence: Synthetic oligonucleotide
  Target: ATXN1; (-) strand; PAM type: YTN; PAM sequence: TTT
acatataaaaataggtattt

SEQ ID NO: 178372 - DNA, 20 bp, Artificial Sequence
  Description of Artificial Sequence: Synthetic oligonucleotide
  Target: ATXN1; (-) strand; PAM type: YTN; PAM sequence: TTT
tacatataaaaataggtatt

SEQ ID NO: 178373 - DNA, 20 bp, Artificial Sequence
  Description of Artificial Sequence: Synthetic oligonucleotide
  Target: ATXN1; (-) strand; PAM type: YTN; PAM sequence: TTT
ttacatataaaaataggtat

SEQ ID NO: 178374 - DNA, 20 bp, Artificial Sequence
  Description of Artificial Sequence: Synthetic oligonucleotide
  Target: ATXN1; (-) strand; PAM type: YTN; PAM sequence: TTT
tttacatataaaaataggta

SEQ ID NO: 178375 - DNA, 20 bp, Artificial Sequence
  Description of Artificial Sequence: Synthetic oligonucleotide
  Target: ATXN1; (-) strand; PAM type: YTN; PAM sequence: TTG
acaacattttttacatataa

SEQ ID NO: 178376 - DNA, 20 bp, Artificial Sequence
  Description of Artificial Sequence: Synthetic oligonucleotide
  Target: ATXN1; (-) strand; PAM type: YTN; PAM sequence: TTT
gacaacattttttacatata

SEQ ID NO: 178377 - DNA, 20 bp, Artificial Sequence
  Description of Artificial Sequence: Synthetic oligonucleotide
  Target: ATXN1; (-) strand; PAM type: YTN; PAM sequence: CTT
tgacaacattttttacatat

SEQ ID NO: 178378 - DNA, 20 bp, Artificial Sequence
  Description of Artificial Sequence: Synthetic oligonucleotide
  Target: ATXN1; (-) strand; PAM type: YTN; PAM sequence: TTC
tttgacaacattttttacat

SEQ ID NO: 178379 - DNA, 20 bp, Artificial Sequence
  Description of Artificial Sequence: Synthetic oligonucleotide
  Target: ATXN1; (-) strand; PAM type: YTN; PAM sequence: TTT
ctttgacaacattttttaca

SEQ ID NO: 178380 - DNA, 20 bp, Artificial Sequence
  Description of Artificial Sequence: Synthetic oligonucleotide
  Target: ATXN1; (-) strand; PAM type: YTN; PAM sequence: TTT
tctttgacaacattttttac

SEQ ID NO: 178381 - DNA, 20 bp, Artificial Sequence
  Description of Artificial Sequence: Synthetic oligonucleotide
  Target: ATXN1; (-) strand; PAM type: YTN; PAM sequence: CTT
ttctttgacaacatttttta

SEQ ID NO: 178382 - DNA, 20 bp, Artificial Sequence
  Description of Artificial Sequence: Synthetic oligonucleotide
  Target: ATXN1; (-) strand; PAM type: YTN; PAM sequence: TTC
ttttctttgacaacattttt

SEQ ID NO: 178383 - DNA, 20 bp, Artificial Sequence
  Description of Artificial Sequence: Synthetic oligonucleotide
  Target: ATXN1; (-) strand; PAM type: YTN; PAM sequence: TTC
ccatcaccccgttcttttct

SEQ ID NO: 178384 - DNA, 20 bp, Artificial Sequence
  Description of Artificial Sequence: Synthetic oligonucleotide
  Target: ATXN1; (-) strand; PAM type: YTN; PAM sequence: CTG
ttcccatcaccccgttcttt

SEQ ID NO: 178385 - DNA, 20 bp, Artificial Sequence
  Description of Artificial Sequence: Synthetic oligonucleotide
  Target: ATXN1; (-) strand; PAM type: YTN; PAM sequence: TTC
caactgttcccatcaccccg

SEQ ID NO: 178386 - DNA, 20 bp, Artificial Sequence
  Description of Artificial Sequence: Synthetic oligonucleotide
  Target: ATXN1; (-) strand; PAM type: YTN; PAM sequence: CTT
ccaactgttcccatcacccc

SEQ ID NO: 178387 - DNA, 20 bp, Artificial Sequence
  Description of Artificial Sequence: Synthetic oligonucleotide
  Target: ATXN1; (-) strand; PAM type: YTN; PAM sequence: CTC
ttccaactgttcccatcacc

SEQ ID NO: 178388 - DNA, 20 bp, Artificial Sequence
  Description of Artificial Sequence: Synthetic oligonucleotide
  Target: ATXN1; (-) strand; PAM type: YTN; PAM sequence: TTA
cacctcttccaactgttccc

SEQ ID NO: 178389 - DNA, 20 bp, Artificial Sequence
  Description of Artificial Sequence: Synthetic oligonucleotide
  Target: ATXN1; (-) strand; PAM type: YTN; PAM sequence: TTT
acacctcttccaactgttcc

SEQ ID NO: 178390 - DNA, 20 bp, Artificial Sequence
  Description of Artificial Sequence: Synthetic oligonucleotide
  Target: ATXN1; (-) strand; PAM type: YTN; PAM sequence: TTT
tacacctcttccaactgttc

SEQ ID NO: 178391 - DNA, 20 bp, Artificial Sequence
  Description of Artificial Sequence: Synthetic oligonucleotide
  Target: ATXN1; (-) strand; PAM type: YTN; PAM sequence: TTT
ttacacctcttccaactgtt

SEQ ID NO: 178392 - DNA, 20 bp, Artificial Sequence
  Description of Artificial Sequence: Synthetic oligonucleotide
  Target: ATXN1; (-) strand; PAM type: YTN; PAM sequence: CTG
gagtttttacacctcttcca

SEQ ID NO: 178393 - DNA, 20 bp, Artificial Sequence
  Description of Artificial Sequence: Synthetic oligonucleotide
  Target: ATXN1; (-) strand; PAM type: YTN; PAM sequence: CTC
tggagtttttacacctcttc

SEQ ID NO: 178394 - DNA, 20 bp, Artificial Sequence
  Description of Artificial Sequence: Synthetic oligonucleotide
  Target: ATXN1; (-) strand; PAM type: YTN; PAM sequence: TTC
tctggagtttttacacctct

SEQ ID NO: 178395 - DNA, 20 bp, Artificial Sequence
  Description of Artificial Sequence: Synthetic oligonucleotide
  Target: ATXN1; (-) strand; PAM type: YTN; PAM sequence: CTT
ctctggagtttttacacctc

SEQ ID NO: 178396 - DNA, 20 bp, Artificial Sequence
  Description of Artificial Sequence: Synthetic oligonucleotide
  Target: ATXN1; (-) strand; PAM type: YTN; PAM sequence: CTA
ggagccacagcttctctgga

SEQ ID NO: 178397 - DNA, 20 bp, Artificial Sequence
  Description of Artificial Sequence: Synthetic oligonucleotide
  Target: ATXN1; (-) strand; PAM type: YTN; PAM sequence: TTC
taggagccacagcttctctg

SEQ ID NO: 178398 - DNA, 20 bp, Artificial Sequence
  Description of Artificial Sequence: Synthetic oligonucleotide
  Target: ATXN1; (-) strand; PAM type: YTN; PAM sequence: TTT
ctaggagccacagcttctct

SEQ ID NO: 178399 - DNA, 20 bp, Artificial Sequence
  Description of Artificial Sequence: Synthetic oligonucleotide
  Target: ATXN1; (-) strand; PAM type: YTN; PAM sequence: CTT
tctaggagccacagcttctc

SEQ ID NO: 178400 - DNA, 20 bp, Artificial Sequence
  Description of Artificial Sequence: Synthetic oligonucleotide
  Target: ATXN1; (-) strand; PAM type: YTN; PAM sequence: TTC
tttctaggagccacagcttc

SEQ ID NO: 178401 - DNA, 20 bp, Artificial Sequence
  Description of Artificial Sequence: Synthetic oligonucleotide
  Target: ATXN1; (-) strand; PAM type: YTN; PAM sequence: CTT
ctttctaggagccacagctt

SEQ ID NO: 178402 - DNA, 20 bp, Artificial Sequence
  Description of Artificial Sequence: Synthetic oligonucleotide
  Target: ATXN1; (-) strand; PAM type: YTN; PAM sequence: CTA
ccttctttctaggagccaca

SEQ ID NO: 178403 - DNA, 20 bp, Artificial Sequence
  Description of Artificial Sequence: Synthetic oligonucleotide
  Target: ATXN1; (-) strand; PAM type: YTN; PAM sequence: CTA
aaacctaccttctttctagg

SEQ ID NO: 178404 - DNA, 20 bp, Artificial Sequence
  Description of Artificial Sequence: Synthetic oligonucleotide
  Target: ATXN1; (-) strand; PAM type: YTN; PAM sequence: CTA
gtcctaaaacctaccttctt

SEQ ID NO: 178405 - DNA, 20 bp, Artificial Sequence
  Description of Artificial Sequence: Synthetic oligonucleotide
  Target: ATXN1; (-) strand; PAM type: YTN; PAM sequence: TTC
tagtcctaaaacctaccttc

SEQ ID NO: 178406 - DNA, 20 bp, Artificial Sequence
  Description of Artificial Sequence: Synthetic oligonucleotide
  Target: ATXN1; (-) strand; PAM type: YTN; PAM sequence: CTA
tcaccattctagtcctaaaa

SEQ ID NO: 178407 - DNA, 20 bp, Artificial Sequence
  Description of Artificial Sequence: Synthetic oligonucleotide
  Target: ATXN1; (-) strand; PAM type: YTN; PAM sequence: TTC
cggcccactatcaccattct

SEQ ID NO: 178408 - DNA, 20 bp, Artificial Sequence
  Description of Artificial Sequence: Synthetic oligonucleotide
  Target: ATXN1; (-) strand; PAM type: YTN; PAM sequence: CTT
ccggcccactatcaccattc

SEQ ID NO: 178409 - DNA, 20 bp, Artificial Sequence
  Description of Artificial Sequence: Synthetic oligonucleotide
  Target: ATXN1; (-) strand; PAM type: YTN; PAM sequence: CTC
ttccggcccactatcaccat

SEQ ID NO: 178410 - DNA, 20 bp, Artificial Sequence
  Description of Artificial Sequence: Synthetic oligonucleotide
  Target: ATXN1; (-) strand; PAM type: YTN; PAM sequence: CTC
tcttccggcccactatcacc

SEQ ID NO: 178411 - DNA, 20 bp, Artificial Sequence
  Description of Artificial Sequence: Synthetic oligonucleotide
  Target: ATXN1; (-) strand; PAM type: YTN; PAM sequence: CTC
tctcttccggcccactatca

SEQ ID NO: 178412 - DNA, 20 bp, Artificial Sequence
  Description of Artificial Sequence: Synthetic oligonucleotide
  Target: ATXN1; (-) strand; PAM type: YTN; PAM sequence: CTC
tctctcttccggcccactat

SEQ ID NO: 178413 - DNA, 20 bp, Artificial Sequence
  Description of Artificial Sequence: Synthetic oligonucleotide
  Target: ATXN1; (-) strand; PAM type: YTN; PAM sequence: TTC
gaatgcactctctctcttcc

SEQ ID NO: 178414 - DNA, 20 bp, Artificial Sequence
  Description of Artificial Sequence: Synthetic oligonucleotide
  Target: ATXN1; (-) strand; PAM type: YTN; PAM sequence: TTT
cgaatgcactctctctcttc

SEQ ID NO: 178415 - DNA, 20 bp, Artificial Sequence
  Description of Artificial Sequence: Synthetic oligonucleotide
  Target: ATXN1; (-) strand; PAM type: YTN; PAM sequence: CTT
tcgaatgcactctctctctt

SEQ ID NO: 178416 - DNA, 20 bp, Artificial Sequence
  Description of Artificial Sequence: Synthetic oligonucleotide
  Target: ATXN1; (-) strand; PAM type: YTN; PAM sequence: CTC
agtgtctttcgaatgcactc

SEQ ID NO: 178417 - DNA, 20 bp, Artificial Sequence
  Description of Artificial Sequence: Synthetic oligonucleotide
  Target: ATXN1; (-) strand; PAM type: YTN; PAM sequence: CTC
ctcagtgtctttcgaatgca

SEQ ID NO: 178418 - DNA, 20 bp, Artificial Sequence
  Description of Artificial Sequence: Synthetic oligonucleotide
  Target: ATXN1; (-) strand; PAM type: YTN; PAM sequence: CTG
atgcaatctcctcagtgtct

SEQ ID NO: 178419 - DNA, 20 bp, Artificial Sequence
  Description of Artificial Sequence: Synthetic oligonucleotide
  Target: ATXN1; (-) strand; PAM type: YTN; PAM sequence: CTA
ctgatgcaatctcctcagtg

SEQ ID NO: 178420 - DNA, 20 bp, Artificial Sequence
  Description of Artificial Sequence: Synthetic oligonucleotide
  Target: ATXN1; (-) strand; PAM type: YTN; PAM sequence: CTA
atgtgtcaccaagtcctact

SEQ ID NO: 178421 - DNA, 20 bp, Artificial Sequence
  Description of Artificial Sequence: Synthetic oligonucleotide
  Target: ATXN1; (-) strand; PAM type: YTN; PAM sequence: CTG
catctaatgtgtcaccaagt

SEQ ID NO: 178422 - DNA, 20 bp, Artificial Sequence
  Description of Artificial Sequence: Synthetic oligonucleotide
  Target: ATXN1; (-) strand; PAM type: YTN; PAM sequence: CTC
tgcatctaatgtgtcaccaa

SEQ ID NO: 178423 - DNA, 20 bp, Artificial Sequence
  Description of Artificial Sequence: Synthetic oligonucleotide
  Target: ATXN1; (-) strand; PAM type: YTN; PAM sequence: TTC
ctctgcatctaatgtgtcac

SEQ ID NO: 178424 - DNA, 20 bp, Artificial Sequence
  Description of Artificial Sequence: Synthetic oligonucleotide
  Target: ATXN1; (-) strand; PAM type: YTN; PAM sequence: CTT
cctctgcatctaatgtgtca

SEQ ID NO: 178425 - DNA, 20 bp, Artificial Sequence
  Description of Artificial Sequence: Synthetic oligonucleotide
  Target: ATXN1; (-) strand; PAM type: YTN; PAM sequence: CTC
ttcctctgcatctaatgtgt

SEQ ID NO: 178426 - DNA, 20 bp, Artificial Sequence
  Description of Artificial Sequence: Synthetic oligonucleotide
  Target: ATXN1; (-) strand; PAM type: YTN; PAM sequence: CTG
tccctcttcctctgcatcta

SEQ ID NO: 178427 - DNA, 20 bp, Artificial Sequence
  Description of Artificial Sequence: Synthetic oligonucleotide
  Target: ATXN1; (-) strand; PAM type: YTN; PAM sequence: TTC
tgtccctcttcctctgcatc

SEQ ID NO: 178428 - DNA, 20 bp, Artificial Sequence
  Description of Artificial Sequence: Synthetic oligonucleotide
  Target: ATXN1; (-) strand; PAM type: YTN; PAM sequence: TTT
ctgtccctcttcctctgcat

SEQ ID NO: 178429 - DNA, 20 bp, Artificial Sequence
  Description of Artificial Sequence: Synthetic oligonucleotide
  Target: ATXN1; (-) strand; PAM type: YTN; PAM sequence: TTG
aagcatttctgtccctcttc

SEQ ID NO: 178430 - DNA, 20 bp, Artificial Sequence
  Description of Artificial Sequence: Synthetic oligonucleotide
  Target: ATXN1; (-) strand; PAM type: YTN; PAM sequence: CTT
gaagcatttctgtccctctt

SEQ ID NO: 178431 - DNA, 20 bp, Artificial Sequence
  Description of Artificial Sequence: Synthetic oligonucleotide
  Target: ATXN1; (-) strand; PAM type: YTN; PAM sequence: CTC
cttgaagcatttctgtccct

SEQ ID NO: 178432 - DNA, 20 bp, Artificial Sequence
  Description of Artificial Sequence: Synthetic oligonucleotide
  Target: ATXN1; (-) strand; PAM type: YTN; PAM sequence: CTA
aaagtcctccttgaagcatt

SEQ ID NO: 178433 - DNA, 20 bp, Artificial Sequence
  Description of Artificial Sequence: Synthetic oligonucleotide
  Target: ATXN1; (-) strand; PAM type: YTN; PAM sequence: TTA
cccaagacagatgcctaaaa

SEQ ID NO: 178434 - DNA, 20 bp, Artificial Sequence
  Description of Artificial Sequence: Synthetic oligonucleotide
  Target: ATXN1; (-) strand; PAM type: YTN; PAM sequence: CTA
gttacccaagacagatgcct

SEQ ID NO: 178435 - DNA, 20 bp, Artificial Sequence
  Description of Artificial Sequence: Synthetic oligonucleotide
  Target: ATXN1; (-) strand; PAM type: YTN; PAM sequence: TTG
gcatcatctagttacccaag

SEQ ID NO: 178436 - DNA, 20 bp, Artificial Sequence
  Description of Artificial Sequence: Synthetic oligonucleotide
  Target: ATXN1; (-) strand; PAM type: YTN; PAM sequence: CTC
agccattggcatcatctagt

SEQ ID NO: 178437 - DNA, 20 bp, Artificial Sequence
  Description of Artificial Sequence: Synthetic oligonucleotide
  Target: ATXN1; (-) strand; PAM type: YTN; PAM sequence: TTC
cccatctcagccattggcat

SEQ ID NO: 178438 - DNA, 20 bp, Artificial Sequence
  Description of Artificial Sequence: Synthetic oligonucleotide
  Target: ATXN1; (-) strand; PAM type: YTN; PAM sequence: CTA
cccaagaattccccatctca

SEQ ID NO: 178439 - DNA, 20 bp, Artificial Sequence
  Description of Artificial Sequence: Synthetic oligonucleotide
  Target: ATXN1; (-) strand; PAM type: YTN; PAM sequence: CTC
atctacccaagaattcccca

SEQ ID NO: 178440 - DNA, 20 bp, Artificial Sequence
  Description of Artificial Sequence: Synthetic oligonucleotide
  Target: ATXN1; (-) strand; PAM type: YTN; PAM sequence: TTA
taacaatcaccatcccacca

SEQ ID NO: 178441 - DNA, 20 bp, Artificial Sequence
  Description of Artificial Sequence: Synthetic oligonucleotide
  Target: ATXN1; (-) strand; PAM type: YTN; PAM sequence: TTC
aaagtcaaagttataacaat

SEQ ID NO: 178442 - DNA, 20 bp, Artificial Sequence
  Description of Artificial Sequence: Synthetic oligonucleotide
  Target: ATXN1; (-) strand; PAM type: YTN; PAM sequence: CTC
agcacgttcaaagtcaaagt

SEQ ID NO: 178443 - DNA, 20 bp, Artificial Sequence
  Description of Artificial Sequence: Synthetic oligonucleotide
  Target: ATXN1; (-) strand; PAM type: YTN; PAM sequence: CTG
aactcagcacgttcaaagtc

SEQ ID NO: 178444 - DNA, 20 bp, Artificial Sequence
  Description of Artificial Sequence: Synthetic oligonucleotide
  Target: ATXN1; (-) strand; PAM type: YTN; PAM sequence: TTG
gggtatcacaatgtcacctg

SEQ ID NO: 178445 - DNA, 20 bp, Artificial Sequence
  Description of Artificial Sequence: Synthetic oligonucleotide
  Target: ATXN1; (-) strand; PAM type: YTN; PAM sequence: TTT
ggggtatcacaatgtcacct

SEQ ID NO: 178446 - DNA, 20 bp, Artificial Sequence
  Description of Artificial Sequence: Synthetic oligonucleotide
  Target: ATXN1; (-) strand; PAM type: YTN; PAM sequence: CTT
tggggtatcacaatgtcacc

SEQ ID NO: 178447 - DNA, 20 bp, Artificial Sequence
  Description of Artificial Sequence: Synthetic oligonucleotide
  Target: ATXN1; (-) strand; PAM type: YTN; PAM sequence: CTC
ctttggggtatcacaatgtc

SEQ ID NO: 178448 - DNA, 20 bp, Artificial Sequence
  Description of Artificial Sequence: Synthetic oligonucleotide
  Target: ATXN1; (-) strand; PAM type: YTN; PAM sequence: CTG
cacctcctttggggtatcac

SEQ ID NO: 178449 - DNA, 20 bp, Artificial Sequence
  Description of Artificial Sequence: Synthetic oligonucleotide
  Target: ATXN1; (-) strand; PAM type: YTN; PAM sequence: CTC
tgcacctcctttggggtatc

SEQ ID NO: 178450 - DNA, 20 bp, Artificial Sequence
  Description of Artificial Sequence: Synthetic oligonucleotide
  Target: ATXN1; (-) strand; PAM type: YTN; PAM sequence: CTA
ctctgcacctcctttggggt

SEQ ID NO: 178451 - DNA, 20 bp, Artificial Sequence
  Description of Artificial Sequence: Synthetic oligonucleotide
  Target: ATXN1; (-) strand; PAM type: YTN; PAM sequence: CTA
cctactctgcacctcctttg

SEQ ID NO: 178452 - DNA, 20 bp, Artificial Sequence
  Description of Artificial Sequence: Synthetic oligonucleotide
  Target: ATXN1; (-) strand; PAM type: YTN; PAM sequence: CTC
cagctacctactctgcacct

SEQ ID NO: 178453 - DNA, 20 bp, Artificial Sequence
  Description of Artificial Sequence: Synthetic oligonucleotide
  Target: ATXN1; (-) strand; PAM type: YTN; PAM sequence: CTG
tgtctccagctacctactct

SEQ ID NO: 178454 - DNA, 20 bp, Artificial Sequence
  Description of Artificial Sequence: Synthetic oligonucleotide
  Target: ATXN1; (-) strand; PAM type: YTN; PAM sequence: TTC
gggcctgtgtctccagctac

SEQ ID NO: 178455 - DNA, 20 bp, Artificial Sequence
  Description of Artificial Sequence: Synthetic oligonucleotide
  Target: ATXN1; (-) strand; PAM type: YTN; PAM sequence: CTT
cgggcctgtgtctccagcta

SEQ ID NO: 178456 - DNA, 20 bp, Artificial Sequence
  Description of Artificial Sequence: Synthetic oligonucleotide
  Target: ATXN1; (-) strand; PAM type: YTN; PAM sequence: CTC
atcatcttcgggcctgtgtc

SEQ ID NO: 178457 - DNA, 20 bp, Artificial Sequence
  Description of Artificial Sequence: Synthetic oligonucleotide
  Target: ATXN1; (-) strand; PAM type: YTN; PAM sequence: CTC
tcatcatcttcgggcctgtg

SEQ ID NO: 178458 - DNA, 20 bp, Artificial Sequence
  Description of Artificial Sequence: Synthetic oligonucleotide
  Target: ATXN1; (-) strand; PAM type: YTN; PAM sequence: CTA
ggccagacctctcatcatct

SEQ ID NO: 178459 - DNA, 20 bp, Artificial Sequence
  Description of Artificial Sequence: Synthetic oligonucleotide
  Target: ATXN1; (-) strand; PAM type: YTN; PAM sequence: TTC
taggccagacctctcatcat

SEQ ID NO: 178460 - DNA, 20 bp, Artificial Sequence
  Description of Artificial Sequence: Synthetic oligonucleotide
  Target: ATXN1; (-) strand; PAM type: YTN; PAM sequence: TTT
ctaggccagacctctcatca

SEQ ID NO: 178461 - DNA, 20 bp, Artificial Sequence
  Description of Artificial Sequence: Synthetic oligonucleotide
  Target: ATXN1; (-) strand; PAM type: YTN; PAM sequence: CTG
catccatgtttctaggccag

SEQ ID NO: 178462 - DNA, 20 bp, Artificial Sequence
  Description of Artificial Sequence: Synthetic oligonucleotide
  Target: ATXN1; (-) strand; PAM type: YTN; PAM sequence: CTC
ctgcatccatgtttctaggc

SEQ ID NO: 178463 - DNA, 20 bp, Artificial Sequence
  Description of Artificial Sequence: Synthetic oligonucleotide
  Target: ATXN1; (-) strand; PAM type: YTN; PAM sequence: TTG
atggatccatgactcctgca

SEQ ID NO: 178464 - DNA, 20 bp, Artificial Sequence
  Description of Artificial Sequence: Synthetic oligonucleotide
  Target: ATXN1; (-) strand; PAM type: YTN; PAM sequence: CTT
gatggatccatgactcctgc

SEQ ID NO: 178465 - DNA, 20 bp, Artificial Sequence
  Description of Artificial Sequence: Synthetic oligonucleotide
  Target: ATXN1; (-) strand; PAM type: YTN; PAM sequence: CTC
acagtgccttgatggatcca

SEQ ID NO: 178466 - DNA, 20 bp, Artificial Sequence
  Description of Artificial Sequence: Synthetic oligonucleotide
  Target: ATXN1; (-) strand; PAM type: YTN; PAM sequence: CTC
atccaaactcacagtgcctt

SEQ ID NO: 178467 - DNA, 20 bp, Artificial Sequence
  Description of Artificial Sequence: Synthetic oligonucleotide
  Target: ATXN1; (-) strand; PAM type: YTN; PAM sequence: CTA
gatgatctcatccaaactca

SEQ ID NO: 178468 - DNA, 20 bp, Artificial Sequence
  Description of Artificial Sequence: Synthetic oligonucleotide
  Target: ATXN1; (-) strand; PAM type: YTN; PAM sequence: CTG
ctagatgatctcatccaaac

SEQ ID NO: 178469 - DNA, 20 bp, Artificial Sequence
  Description of Artificial Sequence: Synthetic oligonucleotide
  Target: ATXN1; (-) strand; PAM type: YTN; PAM sequence: TTC
tgctagatgatctcatccaa

SEQ ID NO: 178470 - DNA, 20 bp, Artificial Sequence
  Description of Artificial Sequence: Synthetic oligonucleotide
  Target: ATXN1; (-) strand; PAM type: YTN; PAM sequence: TTA
agtgttctgctagatgatct

SEQ ID NO: 178471 - DNA, 20 bp, Artificial Sequence
  Description of Artificial Sequence: Synthetic oligonucleotide
  Target: ATXN1; (-) strand; PAM type: YTN; PAM sequence: CTT
aagtgttctgctagatgatc

SEQ ID NO: 178472 - DNA, 20 bp, Artificial Sequence
  Description of Artificial Sequence: Synthetic oligonucleotide
  Target: ATXN1; (-) strand; PAM type: YTN; PAM sequence: CTC
cacttaagtgttctgctaga

SEQ ID NO: 178473 - DNA, 20 bp, Artificial Sequence
  Description of Artificial Sequence: Synthetic oligonucleotide
  Target: ATXN1; (-) strand; PAM type: YTN; PAM sequence: TTC
tccacttaagtgttctgcta

SEQ ID NO: 178474 - DNA, 20 bp, Artificial Sequence
  Description of Artificial Sequence: Synthetic oligonucleotide
  Target: ATXN1; (-) strand; PAM type: YTN; PAM sequence: CTT
ctccacttaagtgttctgct

SEQ ID NO: 178475 - DNA, 20 bp, Artificial Sequence
  Description of Artificial Sequence: Synthetic oligonucleotide
  Target: ATXN1; (-) strand; PAM type: YTN; PAM sequence: TTG
cttctccacttaagtgttct

SEQ ID NO: 178476 - DNA, 20 bp, Artificial Sequence
  Description of Artificial Sequence: Synthetic oligonucleotide
  Target: ATXN1; (-) strand; PAM type: YTN; PAM sequence: TTT
gcttctccacttaagtgttc

SEQ ID NO: 178477 - DNA, 20 bp, Artificial Sequence
  Description of Artificial Sequence: Synthetic oligonucleotide
  Target: ATXN1; (-) strand; PAM type: YTN; PAM sequence: CTT
tgcttctccacttaagtgtt

SEQ ID NO: 178478 - DNA, 20 bp, Artificial Sequence
  Description of Artificial Sequence: Synthetic oligonucleotide
  Target: ATXN1; (-) strand; PAM type: YTN; PAM sequence: CTA
gaccactttgcttctccact

SEQ ID NO: 178479 - DNA, 20 bp, Artificial Sequence
  Description of Artificial Sequence: Synthetic oligonucleotide
  Target: ATXN1; (-) strand; PAM type: YTN; PAM sequence: CTC
tagaccactttgcttctcca

SEQ ID NO: 178480 - DNA, 20 bp, Artificial Sequence
  Description of Artificial Sequence: Synthetic oligonucleotide
  Target: ATXN1; (-) strand; PAM type: YTN; PAM sequence: TTA
gtctctagaccactttgctt

SEQ ID NO: 178481 - DNA, 20 bp, Artificial Sequence
  Description of Artificial Sequence: Synthetic oligonucleotide
  Target: ATXN1; (-) strand; PAM type: YTN; PAM sequence: CTT
agtctctagaccactttgct

SEQ ID NO: 178482 - DNA, 20 bp, Artificial Sequence
  Description of Artificial Sequence: Synthetic oligonucleotide
  Target: ATXN1; (-) strand; PAM type: YTN; PAM sequence: CTC
atggcttagtctctagacca

SEQ ID NO: 178483 - DNA, 20 bp, Artificial Sequence
  Description of Artificial Sequence: Synthetic oligonucleotide
  Target: ATXN1; (-) strand; PAM type: YTN; PAM sequence: TTC
ctcatggcttagtctctaga

SEQ ID NO: 178484 - DNA, 20 bp, Artificial Sequence
  Description of Artificial Sequence: Synthetic oligonucleotide
  Target: ATXN1; (-) strand; PAM type: YTN; PAM sequence: TTG
gagttcctcatggcttagtc

SEQ ID NO: 178485 - DNA, 20 bp, Artificial Sequence
  Description of Artificial Sequence: Synthetic oligonucleotide
  Target: ATXN1; (-) strand; PAM type: YTN; PAM sequence: CTA
agtgttggagttcctcatgg

SEQ ID NO: 178486 - DNA, 20 bp, Artificial Sequence
  Description of Artificial Sequence: Synthetic oligonucleotide
  Target: ATXN1; (-) strand; PAM type: YTN; PAM sequence: CTC
taagtgttggagttcctcat

SEQ ID NO: 178487 - DNA, 20 bp, Artificial Sequence
  Description of Artificial Sequence: Synthetic oligonucleotide
  Target: ATXN1; (-) strand; PAM type: YTN; PAM sequence: CTA
cgcctctaagtgttggagtt

SEQ ID NO: 178488 - DNA, 20 bp, Artificial Sequence
  Description of Artificial Sequence: Synthetic oligonucleotide
  Target: ATXN1; (-) strand; PAM type: YTN; PAM sequence: TTC
tacgcctctaagtgttggag

SEQ ID NO: 178489 - DNA, 20 bp, Artificial Sequence
  Description of Artificial Sequence: Synthetic oligonucleotide
  Target: ATXN1; (-) strand; PAM type: YTN; PAM sequence: TTT
ctacgcctctaagtgttgga

SEQ ID NO: 178490 - DNA, 20 bp, Artificial Sequence
  Description of Artificial Sequence: Synthetic oligonucleotide
  Target: ATXN1; (-) strand; PAM type: YTN; PAM sequence: CTT
tctacgcctctaagtgttgg

SEQ ID NO: 178491 - DNA, 20 bp, Artificial Sequence
  Description of Artificial Sequence: Synthetic oligonucleotide
  Target: ATXN1; (-) strand; PAM type: YTN; PAM sequence: CTG
ctttctacgcctctaagtgt

SEQ ID NO: 178492 - DNA, 20 bp, Artificial Sequence
  Description of Artificial Sequence: Synthetic oligonucleotide
  Target: ATXN1; (-) strand; PAM type: YTN; PAM sequence: CTA
cctgctttctacgcctctaa

SEQ ID NO: 178493 - DNA, 20 bp, Artificial Sequence
  Description of Artificial Sequence: Synthetic oligonucleotide
  Target: ATXN1; (-) strand; PAM type: YTN; PAM sequence: TTC
tacctgctttctacgcctct

SEQ ID NO: 178494 - DNA, 20 bp, Artificial Sequence
  Description of Artificial Sequence: Synthetic oligonucleotide
  Target: ATXN1; (-) strand; PAM type: YTN; PAM sequence: TTT
ctacctgctttctacgcctc

SEQ ID NO: 178495 - DNA, 20 bp, Artificial Sequence
  Description of Artificial Sequence: Synthetic oligonucleotide
  Target: ATXN1; (-) strand; PAM type: YTN; PAM sequence: CTT
tctacctgctttctacgcct

SEQ ID NO: 178496 - DNA, 20 bp, Artificial Sequence
  Description of Artificial Sequence: Synthetic oligonucleotide
  Target: ATXN1; (-) strand; PAM type: YTN; PAM sequence: TTC
cctttctacctgctttctac

SEQ ID NO: 178497 - DNA, 20 bp, Artificial Sequence
  Description of Artificial Sequence: Synthetic oligonucleotide
  Target: ATXN1; (-) strand; PAM type: YTN; PAM sequence: TTC
aggtgttccctttctacctg

SEQ ID NO: 178498 - DNA, 20 bp, Artificial Sequence
  Description of Artificial Sequence: Synthetic oligonucleotide
  Target: ATXN1; (-) strand; PAM type: YTN; PAM sequence: CTT
caggtgttccctttctacct

SEQ ID NO: 178499 - DNA, 20 bp, Artificial Sequence
  Description of Artificial Sequence: Synthetic oligonucleotide
  Target: ATXN1; (-) strand; PAM type: YTN; PAM sequence: CTA
agtcttcaggtgttcccttt

SEQ ID NO: 178500 - DNA, 20 bp, Artificial Sequence
  Description of Artificial Sequence: Synthetic oligonucleotide
  Target: ATXN1; (-) strand; PAM type: YTN; PAM sequence: TTC
ctaagtcttcaggtgttccc

SEQ ID NO: 178501 - DNA, 20 bp, Artificial Sequence
  Description of Artificial Sequence: Synthetic oligonucleotide
  Target: ATXN1; (-) strand; PAM type: YTN; PAM sequence: CTT
cctaagtcttcaggtgttcc

SEQ ID NO: 178502 - DNA, 20 bp, Artificial Sequence
  Description of Artificial Sequence: Synthetic oligonucleotide
  Target: ATXN1; (-) strand; PAM type: YTN; PAM sequence: CTC
cttcctaagtcttcaggtgt

SEQ ID NO: 178503 - DNA, 20 bp, Artificial Sequence
  Description of Artificial Sequence: Synthetic oligonucleotide
  Target: ATXN1; (-) strand; PAM type: YTN; PAM sequence: CTG
gcccctccttcctaagtctt

SEQ ID NO: 178504 - DNA, 20 bp, Artificial Sequence
  Description of Artificial Sequence: Synthetic oligonucleotide
  Target: ATXN1; (-) strand; PAM type: YTN; PAM sequence: TTC
tggcccctccttcctaagtc

SEQ ID NO: 178505 - DNA, 20 bp, Artificial Sequence
  Description of Artificial Sequence: Synthetic oligonucleotide
  Target: ATXN1; (-) strand; PAM type: YTN; PAM sequence: TTT
ctggcccctccttcctaagt

SEQ ID NO: 178506 - DNA, 20 bp, Artificial Sequence
  Description of Artificial Sequence: Synthetic oligonucleotide
  Target: ATXN1; (-) strand; PAM type: YTN; PAM sequence: CTT
tctggcccctccttcctaag

SEQ ID NO: 178507 - DNA, 20 bp, Artificial Sequence
  Description of Artificial Sequence: Synthetic oligonucleotide
  Target: ATXN1; (-) strand; PAM type: YTN; PAM sequence: TTC
gggtgccatcatccctttct

SEQ ID NO: 178508 - DNA, 20 bp, Artificial Sequence
  Description of Artificial Sequence: Synthetic oligonucleotide
  Target: ATXN1; (-) strand; PAM type: YTN; PAM sequence: CTT
cgggtgccatcatccctttc

SEQ ID NO: 178509 - DNA, 20 bp, Artificial Sequence
  Description of Artificial Sequence: Synthetic oligonucleotide
  Target: ATXN1; (-) strand; PAM type: YTN; PAM sequence: CTG
tcttcgggtgccatcatccc

SEQ ID NO: 178510 - DNA, 20 bp, Artificial Sequence
  Description of Artificial Sequence: Synthetic oligonucleotide
  Target: ATXN1; (-) strand; PAM type: YTN; PAM sequence: CTG
aacaccactgtcttcgggtg

SEQ ID NO: 178511 - DNA, 20 bp, Artificial Sequence
  Description of Artificial Sequence: Synthetic oligonucleotide
  Target: ATXN1; (-) strand; PAM type: YTN; PAM sequence: TTC
ctgaacaccactgtcttcgg

SEQ ID NO: 178512 - DNA, 20 bp, Artificial Sequence
  Description of Artificial Sequence: Synthetic oligonucleotide
  Target: ATXN1; (-) strand; PAM type: YTN; PAM sequence: CTT
cctgaacaccactgtcttcg

SEQ ID NO: 178513 - DNA, 20 bp, Artificial Sequence
  Description of Artificial Sequence: Synthetic oligonucleotide
  Target: ATXN1; (-) strand; PAM type: YTN; PAM sequence: TTG
gcttcctgaacaccactgtc

SEQ ID NO: 178514 - DNA, 20 bp, Artificial Sequence
  Description of Artificial Sequence: Synthetic oligonucleotide
  Target: ATXN1; (-) strand; PAM type: YTN; PAM sequence: CTT
ggcttcctgaacaccactgt

SEQ ID NO: 178515 - DNA, 20 bp, Artificial Sequence
  Description of Artificial Sequence: Synthetic oligonucleotide
  Target: ATXN1; (-) strand; PAM type: YTN; PAM sequence: CTC
ccttggcttcctgaacacca

SEQ ID NO: 178516 - DNA, 20 bp, Artificial Sequence
  Description of Artificial Sequence: Synthetic oligonucleotide
  Target: ATXN1; (-) strand; PAM type: YTN; PAM sequence: TTC
ctcccttggcttcctgaaca

SEQ ID NO: 178517 - DNA, 20 bp, Artificial Sequence
  Description of Artificial Sequence: Synthetic oligonucleotide
  Target: ATXN1; (-) strand; PAM type: YTN; PAM sequence: CTT
cctcccttggcttcctgaac

SEQ ID NO: 178518 - DNA, 20 bp, Artificial Sequence
  Description of Artificial Sequence: Synthetic oligonucleotide
  Target: ATXN1; (-) strand; PAM type: YTN; PAM sequence: CTA
aataccttcctcccttggct

SEQ ID NO: 178519 - DNA, 20 bp, Artificial Sequence
  Description of Artificial Sequence: Synthetic oligonucleotide
  Target: ATXN1; (-) strand; PAM type: YTN; PAM sequence: CTG
tctaaataccttcctccctt

SEQ ID NO: 178520 - DNA, 20 bp, Artificial Sequence
  Description of Artificial Sequence: Synthetic oligonucleotide
  Target: ATXN1; (-) strand; PAM type: YTN; PAM sequence: CTC
ctgtctaaataccttcctcc

SEQ ID NO: 178521 - DNA, 20 bp, Artificial Sequence
  Description of Artificial Sequence: Synthetic oligonucleotide
  Target: ATXN1; (-) strand; PAM type: YTN; PAM sequence: CTC
cccctcctgtctaaatacct

SEQ ID NO: 178522 - DNA, 20 bp, Artificial Sequence
  Description of Artificial Sequence: Synthetic oligonucleotide
  Target: ATXN1; (-) strand; PAM type: YTN; PAM sequence: CTC
tccccctcctgtctaaatac

SEQ ID NO: 178523 - DNA, 20 bp, Artificial Sequence
  Description of Artificial Sequence: Synthetic oligonucleotide
  Target: ATXN1; (-) strand; PAM type: YTN; PAM sequence: CTG
ctctccccctcctgtctaaa

SEQ ID NO: 178524 - DNA, 20 bp, Artificial Sequence
  Description of Artificial Sequence: Synthetic oligonucleotide
  Target: ATXN1; (-) strand; PAM type: YTN; PAM sequence: TTC
tgctctccccctcctgtcta

SEQ ID NO: 178525 - DNA, 20 bp, Artificial Sequence
  Description of Artificial Sequence: Synthetic oligonucleotide
  Target: ATXN1; (-) strand; PAM type: YTN; PAM sequence: TTG
ccaattctgctctccccctc

SEQ ID NO: 178526 - DNA, 20 bp, Artificial Sequence
  Description of Artificial Sequence: Synthetic oligonucleotide
  Target: ATXN1; (-) strand; PAM type: YTN; PAM sequence: TTT
gccaattctgctctccccct

SEQ ID NO: 178527 - DNA, 20 bp, Artificial Sequence
  Description of Artificial Sequence: Synthetic oligonucleotide
  Target: ATXN1; (-) strand; PAM type: YTN; PAM sequence: CTT
tgccaattctgctctccccc

SEQ ID NO: 178528 - DNA, 20 bp, Artificial Sequence
  Description of Artificial Sequence: Synthetic oligonucleotide
  Target: ATXN1; (-) strand; PAM type: YTN; PAM sequence: CTC
cacagctttgccaattctgc

SEQ ID NO: 178529 - DNA, 20 bp, Artificial Sequence
  Description of Artificial Sequence: Synthetic oligonucleotide
  Target: ATXN1; (-) strand; PAM type: YTN; PAM sequence: TTC
tccacagctttgccaattct

SEQ ID NO: 178530 - DNA, 20 bp, Artificial Sequence
  Description of Artificial Sequence: Synthetic oligonucleotide
  Target: ATXN1; (-) strand; PAM type: YTN; PAM sequence: TTT
ctccacagctttgccaattc

SEQ ID NO: 178531 - DNA, 20 bp, Artificial Sequence
  Description of Artificial Sequence: Synthetic oligonucleotide
  Target: ATXN1; (-) strand; PAM type: YTN; PAM sequence: CTT
tctccacagctttgccaatt

SEQ ID NO: 178532 - DNA, 20 bp, Artificial Sequence
  Description of Artificial Sequence: Synthetic oligonucleotide
  Target: ATXN1; (-) strand; PAM type: YTN; PAM sequence: CTC
actttctccacagctttgcc

SEQ ID NO: 178533 - DNA, 20 bp, Artificial Sequence
  Description of Artificial Sequence: Synthetic oligonucleotide
  Target: ATXN1; (-) strand; PAM type: YTN; PAM sequence: CTC
atctcactttctccacagct

SEQ ID NO: 178534 - DNA, 20 bp, Artificial Sequence
  Description of Artificial Sequence: Synthetic oligonucleotide
  Target: ATXN1; (-) strand; PAM type: YTN; PAM sequence: TTC
tcatctcactttctccacag

SEQ ID NO: 178535 - DNA, 20 bp, Artificial Sequence
  Description of Artificial Sequence: Synthetic oligonucleotide
  Target: ATXN1; (-) strand; PAM type: YTN; PAM sequence: TTA
ataggagttctcatctcact

SEQ ID NO: 178536 - DNA, 20 bp, Artificial Sequence
  Description of Artificial Sequence: Synthetic oligonucleotide
  Target: ATXN1; (-) strand; PAM type: YTN; PAM sequence: TTT
aataggagttctcatctcac

SEQ ID NO: 178537 - DNA, 20 bp, Artificial Sequence
  Description of Artificial Sequence: Synthetic oligonucleotide
  Target: ATXN1; (-) strand; PAM type: YTN; PAM sequence: TTT
taataggagttctcatctca

SEQ ID NO: 178538 - DNA, 20 bp, Artificial Sequence
  Description of Artificial Sequence: Synthetic oligonucleotide
  Target: ATXN1; (-) strand; PAM type: YTN; PAM sequence: TTT
ttaataggagttctcatctc

SEQ ID NO: 178539 - DNA, 20 bp, Artificial Sequence
  Description of Artificial Sequence: Synthetic oligonucleotide
  Target: ATXN1; (-) strand; PAM type: YTN; PAM sequence: TTG
tgtgtttttaataggagttc

SEQ ID NO: 178540 - DNA, 20 bp, Artificial Sequence
  Description of Artificial Sequence: Synthetic oligonucleotide
  Target: ATXN1; (-) strand; PAM type: YTN; PAM sequence: TTG
gaccagttgtgtgtttttaa

SEQ ID NO: 178541 - DNA, 20 bp, Artificial Sequence
  Description of Artificial Sequence: Synthetic oligonucleotide
  Target: ATXN1; (-) strand; PAM type: YTN; PAM sequence: TTC
catgccatcccatgtcattg

SEQ ID NO: 178542 - DNA, 20 bp, Artificial Sequence
  Description of Artificial Sequence: Synthetic oligonucleotide
  Target: ATXN1; (-) strand; PAM type: YTN; PAM sequence: TTT
ccatgccatcccatgtcatt

SEQ ID NO: 178543 - DNA, 20 bp, Artificial Sequence
  Description of Artificial Sequence: Synthetic oligonucleotide
  Target: ATXN1; (-) strand; PAM type: YTN; PAM sequence: TTG
gtcatcagtgatttccatgc

SEQ ID NO: 178544 - DNA, 20 bp, Artificial Sequence
  Description of Artificial Sequence: Synthetic oligonucleotide
  Target: ATXN1; (-) strand; PAM type: YTN; PAM sequence: CTT
ggtcatcagtgatttccatg

SEQ ID NO: 178545 - DNA, 20 bp, Artificial Sequence
  Description of Artificial Sequence: Synthetic oligonucleotide
  Target: ATXN1; (-) strand; PAM type: YTN; PAM sequence: CTG
cttggtcatcagtgatttcc

SEQ ID NO: 178546 - DNA, 20 bp, Artificial Sequence
  Description of Artificial Sequence: Synthetic oligonucleotide
  Target: ATXN1; (-) strand; PAM type: YTN; PAM sequence: CTC
ctgcttggtcatcagtgatt

SEQ ID NO: 178547 - DNA, 20 bp, Artificial Sequence
  Description of Artificial Sequence: Synthetic oligonucleotide
  Target: ATXN1; (-) strand; PAM type: YTN; PAM sequence: CTG
tctcctgcttggtcatcagt

SEQ ID NO: 178548 - DNA, 20 bp, Artificial Sequence
  Description of Artificial Sequence: Synthetic oligonucleotide
  Target: ATXN1; (-) strand; PAM type: YTN; PAM sequence: CTG
cggtccacccctgtctcctg

SEQ ID NO: 178549 - DNA, 20 bp, Artificial Sequence
  Description of Artificial Sequence: Synthetic oligonucleotide
  Target: ATXN1; (-) strand; PAM type: YTN; PAM sequence: TTC
ccctgcggtccacccctgtc

SEQ ID NO: 178550 - DNA, 20 bp, Artificial Sequence
  Description of Artificial Sequence: Synthetic oligonucleotide
  Target: ATXN1; (-) strand; PAM type: YTN; PAM sequence: TTT
cccctgcggtccacccctgt

SEQ ID NO: 178551 - DNA, 20 bp, Artificial Sequence
  Description of Artificial Sequence: Synthetic oligonucleotide
  Target: ATXN1; (-) strand; PAM type: YTN; PAM sequence: TTT
tcccctgcggtccacccctg

SEQ ID NO: 178552 - DNA, 20 bp, Artificial Sequence
  Description of Artificial Sequence: Synthetic oligonucleotide
  Target: ATXN1; (-) strand; PAM type: YTN; PAM sequence: TTT
ttcccctgcggtccacccct

SEQ ID NO: 178553 - DNA, 20 bp, Artificial Sequence
  Description of Artificial Sequence: Synthetic oligonucleotide
  Target: ATXN1; (-) strand; PAM type: YTN; PAM sequence: CTT
tttcccctgcggtccacccc

SEQ ID NO: 178554 - DNA, 20 bp, Artificial Sequence
  Description of Artificial Sequence: Synthetic oligonucleotide
  Target: ATXN1; (-) strand; PAM type: YTN; PAM sequence: CTC
tttttcccctgcggtccacc

SEQ ID NO: 178555 - DNA, 20 bp, Artificial Sequence
  Description of Artificial Sequence: Synthetic oligonucleotide
  Target: ATXN1; (-) strand; PAM type: YTN; PAM sequence: TTG
ctctttttcccctgcggtcc

SEQ ID NO: 178556 - DNA, 20 bp, Artificial Sequence
  Description of Artificial Sequence: Synthetic oligonucleotide
  Target: ATXN1; (-) strand; PAM type: YTN; PAM sequence: CTT
gctctttttcccctgcggtc

SEQ ID NO: 178557 - DNA, 20 bp, Artificial Sequence
  Description of Artificial Sequence: Synthetic oligonucleotide
  Target: ATXN1; (-) strand; PAM type: YTN; PAM sequence: TTC
agcttgctctttttcccctg

SEQ ID NO: 178558 - DNA, 20 bp, Artificial Sequence
  Description of Artificial Sequence: Synthetic oligonucleotide
  Target: ATXN1; (-) strand; PAM type: YTN; PAM sequence: CTT
cagcttgctctttttcccct

SEQ ID NO: 178559 - DNA, 20 bp, Artificial Sequence
  Description of Artificial Sequence: Synthetic oligonucleotide
  Target: ATXN1; (-) strand; PAM type: YTN; PAM sequence: CTG
gcttcagcttgctctttttc

SEQ ID NO: 178560 - DNA, 20 bp, Artificial Sequence
  Description of Artificial Sequence: Synthetic oligonucleotide
  Target: ATXN1; (-) strand; PAM type: YTN; PAM sequence: TTA
gctggcttcagcttgctctt

SEQ ID NO: 178561 - DNA, 20 bp, Artificial Sequence
  Description of Artificial Sequence: Synthetic oligonucleotide
  Target: ATXN1; (-) strand; PAM type: YTN; PAM sequence: CTT
agctggcttcagcttgctct

SEQ ID NO: 178562 - DNA, 20 bp, Artificial Sequence
  Description of Artificial Sequence: Synthetic oligonucleotide
  Target: ATXN1; (-) strand; PAM type: YTN; PAM sequence: TTC
cttagctggcttcagcttgc

SEQ ID NO: 178563 - DNA, 20 bp, Artificial Sequence
  Description of Artificial Sequence: Synthetic oligonucleotide
  Target: ATXN1; (-) strand; PAM type: YTN; PAM sequence: CTA
ggagatggcccgaggacatt

SEQ ID NO: 178564 - DNA, 20 bp, Artificial Sequence
  Description of Artificial Sequence: Synthetic oligonucleotide
  Target: ATXN1; (-) strand; PAM type: YTN; PAM sequence: CTC
cgctaggagatggcccgagg

SEQ ID NO: 178565 - DNA, 20 bp, Artificial Sequence
  Description of Artificial Sequence: Synthetic oligonucleotide
  Target: ATXN1; (-) strand; PAM type: YTN; PAM sequence: CTA
ccgcctccgctaggagatgg

SEQ ID NO: 178566 - DNA, 20 bp, Artificial Sequence
  Description of Artificial Sequence: Synthetic oligonucleotide
  Target: ATXN1; (-) strand; PAM type: YTN; PAM sequence: CTC
taccgcctccgctaggagat

SEQ ID NO: 178567 - DNA, 20 bp, Artificial Sequence
  Description of Artificial Sequence: Synthetic oligonucleotide
  Target: ATXN1; (-) strand; PAM type: YTN; PAM sequence: TTC
aaccacggctctaccgcctc

SEQ ID NO: 178568 - DNA, 20 bp, Artificial Sequence
  Description of Artificial Sequence: Synthetic oligonucleotide
  Target: ATXN1; (-) strand; PAM type: YTN; PAM sequence: CTT
caaccacggctctaccgcct

SEQ ID NO: 178569 - DNA, 20 bp, Artificial Sequence
  Description of Artificial Sequence: Synthetic oligonucleotide
  Target: ATXN1; (-) strand; PAM type: YTN; PAM sequence: CTG
taccttcaaccacggctcta

SEQ ID NO: 178570 - DNA, 20 bp, Artificial Sequence
  Description of Artificial Sequence: Synthetic oligonucleotide
  Target: ATXN1; (-) strand; PAM type: YTN; PAM sequence: TTC
ctgtaccttcaaccacggct

SEQ ID NO: 178571 - DNA, 20 bp, Artificial Sequence
  Description of Artificial Sequence: Synthetic oligonucleotide
  Target: ATXN1; (-) strand; PAM type: YTN; PAM sequence: CTT
cctgtaccttcaaccacggc

SEQ ID NO: 178572 - DNA, 20 bp, Artificial Sequence
  Description of Artificial Sequence: Synthetic oligonucleotide
  Target: ATXN1; (-) strand; PAM type: YTN; PAM sequence: CTA
acagtccacttcctgtacct

SEQ ID NO: 178573 - DNA, 20 bp, Artificial Sequence
  Description of Artificial Sequence: Synthetic oligonucleotide
  Target: ATXN1; (-) strand; PAM type: YTN; PAM sequence: CTG
ggccctaacagtccacttcc

SEQ ID NO: 178574 - DNA, 20 bp, Artificial Sequence
  Description of Artificial Sequence: Synthetic oligonucleotide
  Target: ATXN1; (-) strand; PAM type: YTN; PAM sequence: TTA
aggggaacctgggccctaac

SEQ ID NO: 178575 - DNA, 20 bp, Artificial Sequence
  Description of Artificial Sequence: Synthetic oligonucleotide
  Target: ATXN1; (-) strand; PAM type: YTN; PAM sequence: CTC
atggttaaggggaacctggg

SEQ ID NO: 178576 - DNA, 20 bp, Artificial Sequence
  Description of Artificial Sequence: Synthetic oligonucleotide
  Target: ATXN1; (-) strand; PAM type: YTN; PAM sequence: TTC
aggtctcatggttaagggga

SEQ ID NO: 178577 - DNA, 20 bp, Artificial Sequence
  Description of Artificial Sequence: Synthetic oligonucleotide
  Target: ATXN1; (-) strand; PAM type: YTN; PAM sequence: CTT
caggtctcatggttaagggg

SEQ ID NO: 178578 - DNA, 20 bp, Artificial Sequence
  Description of Artificial Sequence: Synthetic oligonucleotide
  Target: ATXN1; (-) strand; PAM type: YTN; PAM sequence: TTG
cttcaggtctcatggttaag

SEQ ID NO: 178579 - DNA, 20 bp, Artificial Sequence
  Description of Artificial Sequence: Synthetic oligonucleotide
  Target: ATXN1; (-) strand; PAM type: YTN; PAM sequence: CTT
gcttcaggtctcatggttaa

SEQ ID NO: 178580 - DNA, 20 bp, Artificial Sequence
  Description of Artificial Sequence: Synthetic oligonucleotide
  Target: ATXN1; (-) strand; PAM type: YTN; PAM sequence: CTA
gagaaataaagtaacttgct

SEQ ID NO: 178581 - DNA, 20 bp, Artificial Sequence
  Description of Artificial Sequence: Synthetic oligonucleotide
  Target: ATXN1; (-) strand; PAM type: YTN; PAM sequence: TTG
agccctagagaaataaagta

SEQ ID NO: 178582 - DNA, 20 bp, Artificial Sequence
  Description of Artificial Sequence: Synthetic oligonucleotide
  Target: ATXN1; (-) strand; PAM type: YTN; PAM sequence: TTA
caggtgagaaaattgagccc

SEQ ID NO: 178583 - DNA, 20 bp, Artificial Sequence
  Description of Artificial Sequence: Synthetic oligonucleotide
  Target: ATXN1; (-) strand; PAM type: YTN; PAM sequence: TTT
acaggtgagaaaattgagcc

SEQ ID NO: 178584 - DNA, 20 bp, Artificial Sequence
  Description of Artificial Sequence: Synthetic oligonucleotide
  Target: ATXN1; (-) strand; PAM type: YTN; PAM sequence: TTT
tacaggtgagaaaattgagc

SEQ ID NO: 178585 - DNA, 20 bp, Artificial Sequence
  Description of Artificial Sequence: Synthetic oligonucleotide
  Target: ATXN1; (-) strand; PAM type: YTN; PAM sequence: TTG
ttttacaggtgagaaaattg

SEQ ID NO: 178586 - DNA, 20 bp, Artificial Sequence
  Description of Artificial Sequence: Synthetic oligonucleotide
  Target: ATXN1; (-) strand; PAM type: YTN; PAM sequence: CTT
gttttacaggtgagaaaatt

SEQ ID NO: 178587 - DNA, 20 bp, Artificial Sequence
  Description of Artificial Sequence: Synthetic oligonucleotide
  Target: ATXN1; (-) strand; PAM type: YTN; PAM sequence: CTC
ttgttttacaggtgagaaaa

SEQ ID NO: 178588 - DNA, 20 bp, Artificial Sequence
  Description of Artificial Sequence: Synthetic oligonucleotide
  Target: ATXN1; (-) strand; PAM type: YTN; PAM sequence: TTA
ctcttgttttacaggtgaga

SEQ ID NO: 178589 - DNA, 20 bp, Artificial Sequence
  Description of Artificial Sequence: Synthetic oligonucleotide
  Target: ATXN1; (-) strand; PAM type: YTN; PAM sequence: CTG
ttactcttgttttacaggtg

SEQ ID NO: 178590 - DNA, 20 bp, Artificial Sequence
  Description of Artificial Sequence: Synthetic oligonucleotide
  Target: ATXN1; (-) strand; PAM type: YTN; PAM sequence: CTA
gtaggtgagcactgttactc

SEQ ID NO: 178591 - DNA, 20 bp, Artificial Sequence
  Description of Artificial Sequence: Synthetic oligonucleotide
  Target: ATXN1; (-) strand; PAM type: YTN; PAM sequence: CTC
acagcaacctagtaggtgag

SEQ ID NO: 178592 - DNA, 20 bp, Artificial Sequence
  Description of Artificial Sequence: Synthetic oligonucleotide
  Target: ATXN1; (-) strand; PAM type: YTN; PAM sequence: CTC
caaaaaaaaaagaaaaagaa

SEQ ID NO: 178593 - DNA, 20 bp, Artificial Sequence
  Description of Artificial Sequence: Synthetic oligonucleotide
  Target: ATXN1; (-) strand; PAM type: YTN; PAM sequence: CTG
tctccaaaaaaaaaagaaaa

SEQ ID NO: 178594 - DNA, 20 bp, Artificial Sequence
  Description of Artificial Sequence: Synthetic oligonucleotide
  Target: ATXN1; (-) strand; PAM type: YTN; PAM sequence: CTC
tgtctccaaaaaaaaaagaa

SEQ ID NO: 178595 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagactctg

SEQ ID NO: 178596 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 178597 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgacag

SEQ ID NO: 178598 - DNA, 20 bp, Artificial Sequence
  Description of Artificial Sequence: Synthetic oligonucleotide
  Target: ATXN1; (-) strand; PAM type: YTN; PAM sequence: TTG
caccactgcactccagcctg

SEQ ID NO: 178599 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagattgcacc

SEQ ID NO: 178600 - DNA, 20 bp, Artificial Sequence
  Description of Artificial Sequence: Synthetic oligonucleotide
  Target: ATXN1; (-) strand; PAM type: YTN; PAM sequence: CTG
gaacccgggaggtggagatt

SEQ ID NO: 178601 - DNA, 20 bp, Artificial Sequence
  Description of Artificial Sequence: Synthetic oligonucleotide
  Target: ATXN1; (-) strand; PAM type: YTN; PAM sequence: CTA
aggcaggagaatagctggaa

SEQ ID NO: 178602 - DNA, 20 bp, Artificial Sequence
  Description of Artificial Sequence: Synthetic oligonucleotide
  Target: ATXN1; (-) strand; PAM type: YTN; PAM sequence: CTC
aggaggctaaggcaggagaa

SEQ ID NO: 178603 - DNA, 20 bp, Artificial Sequence
  Description of Artificial Sequence: Synthetic oligonucleotide
  Target: ATXN1; (-) strand; PAM type: YTN; PAM sequence: CTG
tagtcccagccactcaggag

SEQ ID NO: 178604 - DNA, 20 bp, Artificial Sequence
  Description of Artificial Sequence: Synthetic oligonucleotide
  Target: ATXN1; (-) strand; PAM type: YTN; PAM sequence: TTG
tggtggcaggcgcctgtagt

SEQ ID NO: 178605 - DNA, 20 bp, Artificial Sequence
  Description of Artificial Sequence: Synthetic oligonucleotide
  Target: ATXN1; (-) strand; PAM type: YTN; PAM sequence: TTA
gccagttgtggtggcaggcg

SEQ ID NO: 178606 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagccag

SEQ ID NO: 178607 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 178608 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 178609 - DNA, 20 bp, Artificial Sequence
  Description of Artificial Sequence: Synthetic oligonucleotide
  Target: ATXN1; (-) strand; PAM type: YTN; PAM sequence: CTG
gccaacgtggtgaaacccca

SEQ ID NO: 178610 - DNA, 20 bp, Artificial Sequence
  Description of Artificial Sequence: Synthetic oligonucleotide
  Target: ATXN1; (-) strand; PAM type: YTN; PAM sequence: TTG
agtccaggctggccaacgtg

SEQ ID NO: 178611 - DNA, 20 bp, Artificial Sequence
  Description of Artificial Sequence: Synthetic oligonucleotide
  Target: ATXN1; (-) strand; PAM type: YTN; PAM sequence: TTT
gagtccaggctggccaacgt

SEQ ID NO: 178612 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagtttgagtcca

SEQ ID NO: 178613 - DNA, 20 bp, Artificial Sequence
  Description of Artificial Sequence: Synthetic oligonucleotide
  Target: ATXN1; (-) strand; PAM type: YTN; PAM sequence: CTG
aagcaggcagatcacctgag

SEQ ID NO: 178614 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaagcaggcagat

SEQ ID NO: 178615 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaagcaggcaga

SEQ ID NO: 178616 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaagcaggcag

SEQ ID NO: 178617 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 178618 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 178619 - DNA, 20 bp, Artificial Sequence
  Description of Artificial Sequence: Synthetic oligonucleotide
  Target: ATXN1; (-) strand; PAM type: YTN; PAM sequence: CTC
acagaaggccaggtgtggtg

SEQ ID NO: 178620 - DNA, 20 bp, Artificial Sequence
  Description of Artificial Sequence: Synthetic oligonucleotide
  Target: ATXN1; (-) strand; PAM type: YTN; PAM sequence: TTA
agaacctcacagaaggccag

SEQ ID NO: 178621 - DNA, 20 bp, Artificial Sequence
  Description of Artificial Sequence: Synthetic oligonucleotide
  Target: ATXN1; (-) strand; PAM type: YTN; PAM sequence: TTA
catgttaagaacctcacaga

SEQ ID NO: 178622 - DNA, 20 bp, Artificial Sequence
  Description of Artificial Sequence: Synthetic oligonucleotide
  Target: ATXN1; (-) strand; PAM type: YTN; PAM sequence: CTT
acatgttaagaacctcacag

SEQ ID NO: 178623 - DNA, 20 bp, Artificial Sequence
  Description of Artificial Sequence: Synthetic oligonucleotide
  Target: ATXN1; (-) strand; PAM type: YTN; PAM sequence: CTA
agtggcttacatgttaagaa

SEQ ID NO: 178624 - DNA, 20 bp, Artificial Sequence
  Description of Artificial Sequence: Synthetic oligonucleotide
  Target: ATXN1; (-) strand; PAM type: YTN; PAM sequence: CTG
ggctaagtggcttacatgtt

SEQ ID NO: 178625 - DNA, 20 bp, Artificial Sequence
  Description of Artificial Sequence: Synthetic oligonucleotide
  Target: ATXN1; (-) strand; PAM type: YTN; PAM sequence: CTA
tgagtcagccactgggctaa

SEQ ID NO: 178626 - DNA, 20 bp, Artificial Sequence
  Description of Artificial Sequence: Synthetic oligonucleotide
  Target: ATXN1; (-) strand; PAM type: YTN; PAM sequence: CTA
ctatgagtcagccactgggc

SEQ ID NO: 178627 - DNA, 20 bp, Artificial Sequence
  Description of Artificial Sequence: Synthetic oligonucleotide
  Target: ATXN1; (-) strand; PAM type: YTN; PAM sequence: TTC
agcaactactatgagtcagc

SEQ ID NO: 178628 - DNA, 20 bp, Artificial Sequence
  Description of Artificial Sequence: Synthetic oligonucleotide
  Target: ATXN1; (-) strand; PAM type: YTN; PAM sequence: TTA
ttcagcaactactatgagtc

SEQ ID NO: 178629 - DNA, 20 bp, Artificial Sequence
  Description of Artificial Sequence: Synthetic oligonucleotide
  Target: ATXN1; (-) strand; PAM type: YTN; PAM sequence: TTT
attcagcaactactatgagt

SEQ ID NO: 178630 - DNA, 20 bp, Artificial Sequence
  Description of Artificial Sequence: Synthetic oligonucleotide
  Target: ATXN1; (-) strand; PAM type: YTN; PAM sequence: TTA
gcatttattcagcaactact

SEQ ID NO: 178631 - DNA, 20 bp, Artificial Sequence
  Description of Artificial Sequence: Synthetic oligonucleotide
  Target: ATXN1; (-) strand; PAM type: YTN; PAM sequence: TTA
atataaaattagcatttatt

SEQ ID NO: 178632 - DNA, 20 bp, Artificial Sequence
  Description of Artificial Sequence: Synthetic oligonucleotide
  Target: ATXN1; (-) strand; PAM type: YTN; PAM sequence: TTA
tgagggtgttaatataaaat

SEQ ID NO: 178633 - DNA, 20 bp, Artificial Sequence
  Description of Artificial Sequence: Synthetic oligonucleotide
  Target: ATXN1; (-) strand; PAM type: YTN; PAM sequence: TTA
atgggttatgagggtgttaa

SEQ ID NO: 178634 - DNA, 20 bp, Artificial Sequence
  Description of Artificial Sequence: Synthetic oligonucleotide
  Target: ATXN1; (-) strand; PAM type: YTN; PAM sequence: TTT
aatgggttatgagggtgtta

SEQ ID NO: 178635 - DNA, 20 bp, Artificial Sequence
  Description of Artificial Sequence: Synthetic oligonucleotide
  Target: ATXN1; (-) strand; PAM type: YTN; PAM sequence: TTG
atttaatgggttatgagggt

SEQ ID NO: 178636 - DNA, 20 bp, Artificial Sequence
  Description of Artificial Sequence: Synthetic oligonucleotide
  Target: ATXN1; (-) strand; PAM type: YTN; PAM sequence: CTC
aataaatattgatttaatgg

SEQ ID NO: 178637 - DNA, 20 bp, Artificial Sequence
  Description of Artificial Sequence: Synthetic oligonucleotide
  Target: ATXN1; (-) strand; PAM type: YTN; PAM sequence: CTG
gcagatggatgctcaataaa

SEQ ID NO: 178638 - DNA, 20 bp, Artificial Sequence
  Description of Artificial Sequence: Synthetic oligonucleotide
  Target: ATXN1; (-) strand; PAM type: YTN; PAM sequence: CTA
gtacagtgcctggcagatgg

SEQ ID NO: 178639 - DNA, 20 bp, Artificial Sequence
  Description of Artificial Sequence: Synthetic oligonucleotide
  Target: ATXN1; (-) strand; PAM type: YTN; PAM sequence: TTG
tcagcatctagtacagtgcc

SEQ ID NO: 178640 - DNA, 20 bp, Artificial Sequence
  Description of Artificial Sequence: Synthetic oligonucleotide
  Target: ATXN1; (-) strand; PAM type: YTN; PAM sequence: TTT
gtcagcatctagtacagtgc

SEQ ID NO: 178641 - DNA, 20 bp, Artificial Sequence
  Description of Artificial Sequence: Synthetic oligonucleotide
  Target: ATXN1; (-) strand; PAM type: YTN; PAM sequence: CTT
tgtcagcatctagtacagtg

SEQ ID NO: 178642 - DNA, 20 bp, Artificial Sequence
  Description of Artificial Sequence: Synthetic oligonucleotide
  Target: ATXN1; (-) strand; PAM type: YTN; PAM sequence: TTG
ggggtgtctttgtcagcatc

SEQ ID NO: 178643 - DNA, 20 bp, Artificial Sequence
  Description of Artificial Sequence: Synthetic oligonucleotide
  Target: ATXN1; (-) strand; PAM type: YTN; PAM sequence: TTG
ttgggggtgtctttgtcagc

SEQ ID NO: 178644 - DNA, 20 bp, Artificial Sequence
  Description of Artificial Sequence: Synthetic oligonucleotide
  Target: ATXN1; (-) strand; PAM type: YTN; PAM sequence: TTG
ttgttgggggtgtctttgtc

SEQ ID NO: 178645 - DNA, 20 bp, Artificial Sequence
  Description of Artificial Sequence: Synthetic oligonucleotide
  Target: ATXN1; (-) strand; PAM type: YTN; PAM sequence: TTT
gttgttgggggtgtctttgt

SEQ ID NO: 178646 - DNA, 20 bp, Artificial Sequence
  Description of Artificial Sequence: Synthetic oligonucleotide
  Target: ATXN1; (-) strand; PAM type: YTN; PAM sequence: TTA
tttgttgttgggggtgtctt

SEQ ID NO: 178647 - DNA, 20 bp, Artificial Sequence
  Description of Artificial Sequence: Synthetic oligonucleotide
  Target: ATXN1; (-) strand; PAM type: YTN; PAM sequence: TTC
catgaggataggtaattatt

SEQ ID NO: 178648 - DNA, 20 bp, Artificial Sequence
  Description of Artificial Sequence: Synthetic oligonucleotide
  Target: ATXN1; (-) strand; PAM type: YTN; PAM sequence: TTT
ccatgaggataggtaattat

SEQ ID NO: 178649 - DNA, 20 bp, Artificial Sequence
  Description of Artificial Sequence: Synthetic oligonucleotide
  Target: ATXN1; (-) strand; PAM type: YTN; PAM sequence: TTA
tttccatgaggataggtaat

SEQ ID NO: 178650 - DNA, 20 bp, Artificial Sequence
  Description of Artificial Sequence: Synthetic oligonucleotide
  Target: ATXN1; (-) strand; PAM type: YTN; PAM sequence: TTT
atttccatgaggataggtaa

SEQ ID NO: 178651 - DNA, 20 bp, Artificial Sequence
  Description of Artificial Sequence: Synthetic oligonucleotide
  Target: ATXN1; (-) strand; PAM type: YTN; PAM sequence: TTT
tatttccatgaggataggta

SEQ ID NO: 178652 - DNA, 20 bp, Artificial Sequence
  Description of Artificial Sequence: Synthetic oligonucleotide
  Target: ATXN1; (-) strand; PAM type: YTN; PAM sequence: CTT
ttatttccatgaggataggt

SEQ ID NO: 178653 - DNA, 20 bp, Artificial Sequence
  Description of Artificial Sequence: Synthetic oligonucleotide
  Target: ATXN1; (-) strand; PAM type: YTN; PAM sequence: TTA
taaatcttttatttccatga

SEQ ID NO: 178654 - DNA, 20 bp, Artificial Sequence
  Description of Artificial Sequence: Synthetic oligonucleotide
  Target: ATXN1; (-) strand; PAM type: YTN; PAM sequence: TTC
attataaatcttttatttcc

SEQ ID NO: 178655 - DNA, 20 bp, Artificial Sequence
  Description of Artificial Sequence: Synthetic oligonucleotide
  Target: ATXN1; (-) strand; PAM type: YTN; PAM sequence: CTT
cattataaatcttttatttc

SEQ ID NO: 178656 - DNA, 20 bp, Artificial Sequence
  Description of Artificial Sequence: Synthetic oligonucleotide
  Target: ATXN1; (-) strand; PAM type: YTN; PAM sequence: TTA
atggaaaatacttcattata

SEQ ID NO: 178657 - DNA, 20 bp, Artificial Sequence
  Description of Artificial Sequence: Synthetic oligonucleotide
  Target: ATXN1; (-) strand; PAM type: YTN; PAM sequence: TTT
aatggaaaatacttcattat

SEQ ID NO: 178658 - DNA, 20 bp, Artificial Sequence
  Description of Artificial Sequence: Synthetic oligonucleotide
  Target: ATXN1; (-) strand; PAM type: YTN; PAM sequence: CTA
tcaccatttaatggaaaata

SEQ ID NO: 178659 - DNA, 20 bp, Artificial Sequence
  Description of Artificial Sequence: Synthetic oligonucleotide
  Target: ATXN1; (-) strand; PAM type: YTN; PAM sequence: TTA
gcatctatcaccatttaatg

SEQ ID NO: 178660 - DNA, 20 bp, Artificial Sequence
  Description of Artificial Sequence: Synthetic oligonucleotide
  Target: ATXN1; (-) strand; PAM type: YTN; PAM sequence: TTT
agcatctatcaccatttaat

SEQ ID NO: 178661 - DNA, 20 bp, Artificial Sequence
  Description of Artificial Sequence: Synthetic oligonucleotide
  Target: ATXN1; (-) strand; PAM type: YTN; PAM sequence: TTT
tagcatctatcaccatttaa

SEQ ID NO: 178662 - DNA, 20 bp, Artificial Sequence
  Description of Artificial Sequence: Synthetic oligonucleotide
  Target: ATXN1; (-) strand; PAM type: YTN; PAM sequence: TTT
ttagcatctatcaccattta

SEQ ID NO: 178663 - DNA, 20 bp, Artificial Sequence
  Description of Artificial Sequence: Synthetic oligonucleotide
  Target: ATXN1; (-) strand; PAM type: YTN; PAM sequence: CTT
tttagcatctatcaccattt

SEQ ID NO: 178664 - DNA, 20 bp, Artificial Sequence
  Description of Artificial Sequence: Synthetic oligonucleotide
  Target: ATXN1; (-) strand; PAM type: YTN; PAM sequence: TTA
actttttagcatctatcacc

SEQ ID NO: 178665 - DNA, 20 bp, Artificial Sequence
  Description of Artificial Sequence: Synthetic oligonucleotide
  Target: ATXN1; (-) strand; PAM type: YTN; PAM sequence: CTT
aactttttagcatctatcac

SEQ ID NO: 178666 - DNA, 20 bp, Artificial Sequence
  Description of Artificial Sequence: Synthetic oligonucleotide
  Target: ATXN1; (-) strand; PAM type: YTN; PAM sequence: CTG
cttaactttttagcatctat

SEQ ID NO: 178667 - DNA, 20 bp, Artificial Sequence
  Description of Artificial Sequence: Synthetic oligonucleotide
  Target: ATXN1; (-) strand; PAM type: YTN; PAM sequence: TTC
tgcttaactttttagcatct

SEQ ID NO: 178668 - DNA, 20 bp, Artificial Sequence
  Description of Artificial Sequence: Synthetic oligonucleotide
  Target: ATXN1; (-) strand; PAM type: YTN; PAM sequence: TTT
ctgcttaactttttagcatc

SEQ ID NO: 178669 - DNA, 20 bp, Artificial Sequence
  Description of Artificial Sequence: Synthetic oligonucleotide
  Target: ATXN1; (-) strand; PAM type: YTN; PAM sequence: TTT
tctgcttaactttttagcat

SEQ ID NO: 178670 - DNA, 20 bp, Artificial Sequence
  Description of Artificial Sequence: Synthetic oligonucleotide
  Target: ATXN1; (-) strand; PAM type: YTN; PAM sequence: CTT
ttctgcttaactttttagca

SEQ ID NO: 178671 - DNA, 20 bp, Artificial Sequence
  Description of Artificial Sequence: Synthetic oligonucleotide
  Target: ATXN1; (-) strand; PAM type: YTN; PAM sequence: CTA
gcccccttttctgcttaact

SEQ ID NO: 178672 - DNA, 20 bp, Artificial Sequence
  Description of Artificial Sequence: Synthetic oligonucleotide
  Target: ATXN1; (-) strand; PAM type: YTN; PAM sequence: TTG
aaaaaatggtcaccagacca

SEQ ID NO: 178673 - DNA, 20 bp, Artificial Sequence
  Description of Artificial Sequence: Synthetic oligonucleotide
  Target: ATXN1; (-) strand; PAM type: YTN; PAM sequence: CTT
gaaaaaatggtcaccagacc

SEQ ID NO: 178674 - DNA, 20 bp, Artificial Sequence
  Description of Artificial Sequence: Synthetic oligonucleotide
  Target: ATXN1; (-) strand; PAM type: YTN; PAM sequence: CTG
acaagcttgaaaaaatggtc

SEQ ID NO: 178675 - DNA, 20 bp, Artificial Sequence
  Description of Artificial Sequence: Synthetic oligonucleotide
  Target: ATXN1; (-) strand; PAM type: YTN; PAM sequence: TTG
actgacaagcttgaaaaaat

SEQ ID NO: 178676 - DNA, 20 bp, Artificial Sequence
  Description of Artificial Sequence: Synthetic oligonucleotide
  Target: ATXN1; (-) strand; PAM type: YTN; PAM sequence: TTT
gactgacaagcttgaaaaaa

SEQ ID NO: 178677 - DNA, 20 bp, Artificial Sequence
  Description of Artificial Sequence: Synthetic oligonucleotide
  Target: ATXN1; (-) strand; PAM type: YTN; PAM sequence: TTT
tgactgacaagcttgaaaaa

SEQ ID NO: 178678 - DNA, 20 bp, Artificial Sequence
  Description of Artificial Sequence: Synthetic oligonucleotide
  Target: ATXN1; (-) strand; PAM type: YTN; PAM sequence: TTT
ttgactgacaagcttgaaaa

SEQ ID NO: 178679 - DNA, 20 bp, Artificial Sequence
  Description of Artificial Sequence: Synthetic oligonucleotide
  Target: ATXN1; (-) strand; PAM type: YTN; PAM sequence: TTT
tttgactgacaagcttgaaa

SEQ ID NO: 178680 - DNA, 20 bp, Artificial Sequence
  Description of Artificial Sequence: Synthetic oligonucleotide
  Target: ATXN1; (-) strand; PAM type: YTN; PAM sequence: CTT
ttttgactgacaagcttgaa

SEQ ID NO: 178681 - DNA, 20 bp, Artificial Sequence
  Description of Artificial Sequence: Synthetic oligonucleotide
  Target: ATXN1; (-) strand; PAM type: YTN; PAM sequence: CTG
tgaggtcttttttgactgac

SEQ ID NO: 178682 - DNA, 20 bp, Artificial Sequence
  Description of Artificial Sequence: Synthetic oligonucleotide
  Target: ATXN1; (-) strand; PAM type: YTN; PAM sequence: CTC
tgtgaggtcttttttgactg

SEQ ID NO: 178683 - DNA, 20 bp, Artificial Sequence
  Description of Artificial Sequence: Synthetic oligonucleotide
  Target: ATXN1; (-) strand; PAM type: YTN; PAM sequence: CTG
tctctgtgaggtcttttttg

SEQ ID NO: 178684 - DNA, 20 bp, Artificial Sequence
  Description of Artificial Sequence: Synthetic oligonucleotide
  Target: ATXN1; (-) strand; PAM type: YTN; PAM sequence: TTA
ctgtctctgtgaggtctttt

SEQ ID NO: 178685 - DNA, 20 bp, Artificial Sequence
  Description of Artificial Sequence: Synthetic oligonucleotide
  Target: ATXN1; (-) strand; PAM type: YTN; PAM sequence: TTC
cccaaaagttactgtctctg

SEQ ID NO: 178686 - DNA, 20 bp, Artificial Sequence
  Description of Artificial Sequence: Synthetic oligonucleotide
  Target: ATXN1; (-) strand; PAM type: YTN; PAM sequence: TTT
ccccaaaagttactgtctct

SEQ ID NO: 178687 - DNA, 20 bp, Artificial Sequence
  Description of Artificial Sequence: Synthetic oligonucleotide
  Target: ATXN1; (-) strand; PAM type: YTN; PAM sequence: TTT
tccccaaaagttactgtctc

SEQ ID NO: 178688 - DNA, 20 bp, Artificial Sequence
  Description of Artificial Sequence: Synthetic oligonucleotide
  Target: ATXN1; (-) strand; PAM type: YTN; PAM sequence: CTT
ttccccaaaagttactgtct

SEQ ID NO: 178689 - DNA, 20 bp, Artificial Sequence
  Description of Artificial Sequence: Synthetic oligonucleotide
  Target: ATXN1; (-) strand; PAM type: YTN; PAM sequence: TTC
aggcttttccccaaaagtta

SEQ ID NO: 178690 - DNA, 20 bp, Artificial Sequence
  Description of Artificial Sequence: Synthetic oligonucleotide
  Target: ATXN1; (-) strand; PAM type: YTN; PAM sequence: CTT
caggcttttccccaaaagtt

SEQ ID NO: 178691 - DNA, 20 bp, Artificial Sequence
  Description of Artificial Sequence: Synthetic oligonucleotide
  Target: ATXN1; (-) strand; PAM type: YTN; PAM sequence: TTC
ttcaggcttttccccaaaag

SEQ ID NO: 178692 - DNA, 20 bp, Artificial Sequence
  Description of Artificial Sequence: Synthetic oligonucleotide
  Target: ATXN1; (-) strand; PAM type: YTN; PAM sequence: TTT
cttcaggcttttccccaaaa

SEQ ID NO: 178693 - DNA, 20 bp, Artificial Sequence
  Description of Artificial Sequence: Synthetic oligonucleotide
  Target: ATXN1; (-) strand; PAM type: YTN; PAM sequence: CTT
tcttcaggcttttccccaaa

SEQ ID NO: 178694 - DNA, 20 bp, Artificial Sequence
  Description of Artificial Sequence: Synthetic oligonucleotide
  Target: ATXN1; (-) strand; PAM type: YTN; PAM sequence: TTC
cctttcttcaggcttttccc

SEQ ID NO: 178695 - DNA, 20 bp, Artificial Sequence
  Description of Artificial Sequence: Synthetic oligonucleotide
  Target: ATXN1; (-) strand; PAM type: YTN; PAM sequence: TTT
ccctttcttcaggcttttcc

SEQ ID NO: 178696 - DNA, 20 bp, Artificial Sequence
  Description of Artificial Sequence: Synthetic oligonucleotide
  Target: ATXN1; (-) strand; PAM type: YTN; PAM sequence: CTA
tttccctttcttcaggcttt

SEQ ID NO: 178697 - DNA, 20 bp, Artificial Sequence
  Description of Artificial Sequence: Synthetic oligonucleotide
  Target: ATXN1; (-) strand; PAM type: YTN; PAM sequence: TTC
tatttccctttcttcaggct

SEQ ID NO: 178698 - DNA, 20 bp, Artificial Sequence
  Description of Artificial Sequence: Synthetic oligonucleotide
  Target: ATXN1; (-) strand; PAM type: YTN; PAM sequence: TTT
ctatttccctttcttcaggc

SEQ ID NO: 178699 - DNA, 20 bp, Artificial Sequence
  Description of Artificial Sequence: Synthetic oligonucleotide
  Target: ATXN1; (-) strand; PAM type: YTN; PAM sequence: CTT
tctatttccctttcttcagg

SEQ ID NO: 178700 - DNA, 20 bp, Artificial Sequence
  Description of Artificial Sequence: Synthetic oligonucleotide
  Target: ATXN1; (-) strand; PAM type: YTN; PAM sequence: TTG
ctttctatttccctttcttc

SEQ ID NO: 178701 - DNA, 20 bp, Artificial Sequence
  Description of Artificial Sequence: Synthetic oligonucleotide
  Target: ATXN1; (-) strand; PAM type: YTN; PAM sequence: TTC
ccccagtcaccacattgctt

SEQ ID NO: 178702 - DNA, 20 bp, Artificial Sequence
  Description of Artificial Sequence: Synthetic oligonucleotide
  Target: ATXN1; (-) strand; PAM type: YTN; PAM sequence: CTT
cccccagtcaccacattgct

SEQ ID NO: 178703 - DNA, 20 bp, Artificial Sequence
  Description of Artificial Sequence: Synthetic oligonucleotide
  Target: ATXN1; (-) strand; PAM type: YTN; PAM sequence: CTC
ttcccccagtcaccacattg

SEQ ID NO: 178704 - DNA, 20 bp, Artificial Sequence
  Description of Artificial Sequence: Synthetic oligonucleotide
  Target: ATXN1; (-) strand; PAM type: YTN; PAM sequence: CTG
tcaggaaggctcttccccca

SEQ ID NO: 178705 - DNA, 20 bp, Artificial Sequence
  Description of Artificial Sequence: Synthetic oligonucleotide
  Target: ATXN1; (-) strand; PAM type: YTN; PAM sequence: TTC
tgtcaggaaggctcttcccc

SEQ ID NO: 178706 - DNA, 20 bp, Artificial Sequence
  Description of Artificial Sequence: Synthetic oligonucleotide
  Target: ATXN1; (-) strand; PAM type: YTN; PAM sequence: TTT
ctgtcaggaaggctcttccc

SEQ ID NO: 178707 - DNA, 20 bp, Artificial Sequence
  Description of Artificial Sequence: Synthetic oligonucleotide
  Target: ATXN1; (-) strand; PAM type: YTN; PAM sequence: CTT
tctgtcaggaaggctcttcc

SEQ ID NO: 178708 - DNA, 20 bp, Artificial Sequence
  Description of Artificial Sequence: Synthetic oligonucleotide
  Target: ATXN1; (-) strand; PAM type: YTN; PAM sequence: TTC
tttctgtcaggaaggctctt

SEQ ID NO: 178709 - DNA, 20 bp, Artificial Sequence
  Description of Artificial Sequence: Synthetic oligonucleotide
  Target: ATXN1; (-) strand; PAM type: YTN; PAM sequence: CTG
ttctttctgtcaggaaggct

SEQ ID NO: 178710 - DNA, 20 bp, Artificial Sequence
  Description of Artificial Sequence: Synthetic oligonucleotide
  Target: ATXN1; (-) strand; PAM type: YTN; PAM sequence: TTC
tgttctttctgtcaggaagg

SEQ ID NO: 178711 - DNA, 20 bp, Artificial Sequence
  Description of Artificial Sequence: Synthetic oligonucleotide
  Target: ATXN1; (-) strand; PAM type: YTN; PAM sequence: CTT
ctgttctttctgtcaggaag

SEQ ID NO: 178712 - DNA, 20 bp, Artificial Sequence
  Description of Artificial Sequence: Synthetic oligonucleotide
  Target: ATXN1; (-) strand; PAM type: YTN; PAM sequence: TTG
gtaccttctgttctttctgt

SEQ ID NO: 178713 - DNA, 20 bp, Artificial Sequence
  Description of Artificial Sequence: Synthetic oligonucleotide
  Target: ATXN1; (-) strand; PAM type: YTN; PAM sequence: CTT
ggtaccttctgttctttctg

SEQ ID NO: 178714 - DNA, 20 bp, Artificial Sequence
  Description of Artificial Sequence: Synthetic oligonucleotide
  Target: ATXN1; (-) strand; PAM type: YTN; PAM sequence: CTC
caacacaccacacaggagcc

SEQ ID NO: 178715 - DNA, 20 bp, Artificial Sequence
  Description of Artificial Sequence: Synthetic oligonucleotide
  Target: ATXN1; (-) strand; PAM type: YTN; PAM sequence: TTC
ctccaacacaccacacagga

SEQ ID NO: 178716 - DNA, 20 bp, Artificial Sequence
  Description of Artificial Sequence: Synthetic oligonucleotide
  Target: ATXN1; (-) strand; PAM type: YTN; PAM sequence: CTC
gatggtgttcctccaacaca

SEQ ID NO: 178717 - DNA, 20 bp, Artificial Sequence
  Description of Artificial Sequence: Synthetic oligonucleotide
  Target: ATXN1; (-) strand; PAM type: YTN; PAM sequence: CTC
agtgccaggaacaccacctc

SEQ ID NO: 178718 - DNA, 20 bp, Artificial Sequence
  Description of Artificial Sequence: Synthetic oligonucleotide
  Target: ATXN1; (-) strand; PAM type: YTN; PAM sequence: TTA
ctcagtgccaggaacaccac

SEQ ID NO: 178719 - DNA, 20 bp, Artificial Sequence
  Description of Artificial Sequence: Synthetic oligonucleotide
  Target: ATXN1; (-) strand; PAM type: YTN; PAM sequence: TTT
actcagtgccaggaacacca

SEQ ID NO: 178720 - DNA, 20 bp, Artificial Sequence
  Description of Artificial Sequence: Synthetic oligonucleotide
  Target: ATXN1; (-) strand; PAM type: YTN; PAM sequence: CTT
tactcagtgccaggaacacc

SEQ ID NO: 178721 - DNA, 20 bp, Artificial Sequence
  Description of Artificial Sequence: Synthetic oligonucleotide
  Target: ATXN1; (-) strand; PAM type: YTN; PAM sequence: CTC
cccaccccctttactcagtg

SEQ ID NO: 178722 - DNA, 20 bp, Artificial Sequence
  Description of Artificial Sequence: Synthetic oligonucleotide
  Target: ATXN1; (-) strand; PAM type: YTN; PAM sequence: CTG
ctccccaccccctttactca

SEQ ID NO: 178723 - DNA, 20 bp, Artificial Sequence
  Description of Artificial Sequence: Synthetic oligonucleotide
  Target: ATXN1; (-) strand; PAM type: YTN; PAM sequence: TTC
ctgctccccaccccctttac

SEQ ID NO: 178724 - DNA, 20 bp, Artificial Sequence
  Description of Artificial Sequence: Synthetic oligonucleotide
  Target: ATXN1; (-) strand; PAM type: YTN; PAM sequence: TTT
cctgctccccacccccttta

SEQ ID NO: 178725 - DNA, 20 bp, Artificial Sequence
  Description of Artificial Sequence: Synthetic oligonucleotide
  Target: ATXN1; (-) strand; PAM type: YTN; PAM sequence: TTC
atttcctgctccccaccccc

SEQ ID NO: 178726 - DNA, 20 bp, Artificial Sequence
  Description of Artificial Sequence: Synthetic oligonucleotide
  Target: ATXN1; (-) strand; PAM type: YTN; PAM sequence: CTT
catttcctgctccccacccc

SEQ ID NO: 178727 - DNA, 20 bp, Artificial Sequence
  Description of Artificial Sequence: Synthetic oligonucleotide
  Target: ATXN1; (-) strand; PAM type: YTN; PAM sequence: CTG
acttcatttcctgctcccca

SEQ ID NO: 178728 - DNA, 20 bp, Artificial Sequence
  Description of Artificial Sequence: Synthetic oligonucleotide
  Target: ATXN1; (-) strand; PAM type: YTN; PAM sequence: CTC
tgacttcatttcctgctccc

SEQ ID NO: 178729 - DNA, 20 bp, Artificial Sequence
  Description of Artificial Sequence: Synthetic oligonucleotide
  Target: ATXN1; (-) strand; PAM type: YTN; PAM sequence: TTG
tcacccccaccctctgactt

SEQ ID NO: 178730 - DNA, 20 bp, Artificial Sequence
  Description of Artificial Sequence: Synthetic oligonucleotide
  Target: ATXN1; (-) strand; PAM type: YTN; PAM sequence: CTT
gtcacccccaccctctgact

SEQ ID NO: 178731 - DNA, 20 bp, Artificial Sequence
  Description of Artificial Sequence: Synthetic oligonucleotide
  Target: ATXN1; (-) strand; PAM type: YTN; PAM sequence: CTC
aaagaacttgtcacccccac

SEQ ID NO: 178732 - DNA, 20 bp, Artificial Sequence
  Description of Artificial Sequence: Synthetic oligonucleotide
  Target: ATXN1; (-) strand; PAM type: YTN; PAM sequence: TTG
tggctcaaagaacttgtcac

SEQ ID NO: 178733 - DNA, 20 bp, Artificial Sequence
  Description of Artificial Sequence: Synthetic oligonucleotide
  Target: ATXN1; (-) strand; PAM type: YTN; PAM sequence: TTA
ttgtggctcaaagaacttgt

SEQ ID NO: 178734 - DNA, 20 bp, Artificial Sequence
  Description of Artificial Sequence: Synthetic oligonucleotide
  Target: ATXN1; (-) strand; PAM type: YTN; PAM sequence: TTT
attgtggctcaaagaacttg

SEQ ID NO: 178735 - DNA, 20 bp, Artificial Sequence
  Description of Artificial Sequence: Synthetic oligonucleotide
  Target: ATXN1; (-) strand; PAM type: YTN; PAM sequence: CTT
tattgtggctcaaagaactt

SEQ ID NO: 178736 - DNA, 20 bp, Artificial Sequence
  Description of Artificial Sequence: Synthetic oligonucleotide
  Target: ATXN1; (-) strand; PAM type: YTN; PAM sequence: CTC
agactttattgtggctcaaa

SEQ ID NO: 178737 - DNA, 20 bp, Artificial Sequence
  Description of Artificial Sequence: Synthetic oligonucleotide
  Target: ATXN1; (-) strand; PAM type: YTN; PAM sequence: CTC
agagtaaggacctcagactt

SEQ ID NO: 178738 - DNA, 20 bp, Artificial Sequence
  Description of Artificial Sequence: Synthetic oligonucleotide
  Target: ATXN1; (-) strand; PAM type: YTN; PAM sequence: CTC
actcagagtaaggacctcag

SEQ ID NO: 178739 - DNA, 20 bp, Artificial Sequence
  Description of Artificial Sequence: Synthetic oligonucleotide
  Target: ATXN1; (-) strand; PAM type: YTN; PAM sequence: CTC
agctcactcagagtaaggac

SEQ ID NO: 178740 - DNA, 20 bp, Artificial Sequence
  Description of Artificial Sequence: Synthetic oligonucleotide
  Target: ATXN1; (-) strand; PAM type: YTN; PAM sequence: CTC
tcagctcactcagagtaagg

SEQ ID NO: 178741 - DNA, 20 bp, Artificial Sequence
  Description of Artificial Sequence: Synthetic oligonucleotide
  Target: ATXN1; (-) strand; PAM type: YTN; PAM sequence: CTC
cagtgcctctcagctcactc

SEQ ID NO: 178742 - DNA, 20 bp, Artificial Sequence
  Description of Artificial Sequence: Synthetic oligonucleotide
  Target: ATXN1; (-) strand; PAM type: YTN; PAM sequence: CTG
atcaaaaccctccagtgcct

SEQ ID NO: 178743 - DNA, 20 bp, Artificial Sequence
  Description of Artificial Sequence: Synthetic oligonucleotide
  Target: ATXN1; (-) strand; PAM type: YTN; PAM sequence: CTC
tgatcaaaaccctccagtgc

SEQ ID NO: 178744 - DNA, 20 bp, Artificial Sequence
  Description of Artificial Sequence: Synthetic oligonucleotide
  Target: ATXN1; (-) strand; PAM type: YTN; PAM sequence: CTC
ctctgatcaaaaccctccag

SEQ ID NO: 178745 - DNA, 20 bp, Artificial Sequence
  Description of Artificial Sequence: Synthetic oligonucleotide
  Target: ATXN1; (-) strand; PAM type: YTN; PAM sequence: CTG
tacctcctctgatcaaaacc

SEQ ID NO: 178746 - DNA, 20 bp, Artificial Sequence
  Description of Artificial Sequence: Synthetic oligonucleotide
  Target: ATXN1; (-) strand; PAM type: YTN; PAM sequence: CTG
gtgaaaatgtagtccagacc

SEQ ID NO: 178747 - DNA, 20 bp, Artificial Sequence
  Description of Artificial Sequence: Synthetic oligonucleotide
  Target: ATXN1; (-) strand; PAM type: YTN; PAM sequence: CTC
catgcaacagccagcatgaa

SEQ ID NO: 178748 - DNA, 20 bp, Artificial Sequence
  Description of Artificial Sequence: Synthetic oligonucleotide
  Target: ATXN1; (-) strand; PAM type: YTN; PAM sequence: CTC
ctccatgcaacagccagcat

SEQ ID NO: 178749 - DNA, 20 bp, Artificial Sequence
  Description of Artificial Sequence: Synthetic oligonucleotide
  Target: ATXN1; (-) strand; PAM type: YTN; PAM sequence: CTC
agaatatctcctccatgcaa

SEQ ID NO: 178750 - DNA, 20 bp, Artificial Sequence
  Description of Artificial Sequence: Synthetic oligonucleotide
  Target: ATXN1; (-) strand; PAM type: YTN; PAM sequence: TTC
tcagaatatctcctccatgc

SEQ ID NO: 178751 - DNA, 20 bp, Artificial Sequence
  Description of Artificial Sequence: Synthetic oligonucleotide
  Target: ATXN1; (-) strand; PAM type: YTN; PAM sequence: CTT
ctcagaatatctcctccatg

SEQ ID NO: 178752 - DNA, 20 bp, Artificial Sequence
  Description of Artificial Sequence: Synthetic oligonucleotide
  Target: ATXN1; (-) strand; PAM type: YTN; PAM sequence: TTC
ttctcagaatatctcctcca

SEQ ID NO: 178753 - DNA, 20 bp, Artificial Sequence
  Description of Artificial Sequence: Synthetic oligonucleotide
  Target: ATXN1; (-) strand; PAM type: YTN; PAM sequence: CTT
cttctcagaatatctcctcc

SEQ ID NO: 178754 - DNA, 20 bp, Artificial Sequence
  Description of Artificial Sequence: Synthetic oligonucleotide
  Target: ATXN1; (-) strand; PAM type: YTN; PAM sequence: CTG
cttcttctcagaatatctcc

SEQ ID NO: 178755 - DNA, 20 bp, Artificial Sequence
  Description of Artificial Sequence: Synthetic oligonucleotide
  Target: ATXN1; (-) strand; PAM type: YTN; PAM sequence: CTC
tgcttcttctcagaatatct

SEQ ID NO: 178756 - DNA, 20 bp, Artificial Sequence
  Description of Artificial Sequence: Synthetic oligonucleotide
  Target: ATXN1; (-) strand; PAM type: YTN; PAM sequence: CTC
tctgcttcttctcagaatat

SEQ ID NO: 178757 - DNA, 20 bp, Artificial Sequence
  Description of Artificial Sequence: Synthetic oligonucleotide
  Target: ATXN1; (-) strand; PAM type: YTN; PAM sequence: CTG
agtagtctctctgcttcttc

SEQ ID NO: 178758 - DNA, 20 bp, Artificial Sequence
  Description of Artificial Sequence: Synthetic oligonucleotide
  Target: ATXN1; (-) strand; PAM type: YTN; PAM sequence: CTC
ctgagtagtctctctgcttc

SEQ ID NO: 178759 - DNA, 20 bp, Artificial Sequence
  Description of Artificial Sequence: Synthetic oligonucleotide
  Target: ATXN1; (-) strand; PAM type: YTN; PAM sequence: TTC
atcagtaacctcctgagtag

SEQ ID NO: 178760 - DNA, 20 bp, Artificial Sequence
  Description of Artificial Sequence: Synthetic oligonucleotide
  Target: ATXN1; (-) strand; PAM type: YTN; PAM sequence: CTG
gagttcatcagtaacctcct

SEQ ID NO: 178761 - DNA, 20 bp, Artificial Sequence
  Description of Artificial Sequence: Synthetic oligonucleotide
  Target: ATXN1; (-) strand; PAM type: YTN; PAM sequence: TTG
gctggagttcatcagtaacc

SEQ ID NO: 178762 - DNA, 20 bp, Artificial Sequence
  Description of Artificial Sequence: Synthetic oligonucleotide
  Target: ATXN1; (-) strand; PAM type: YTN; PAM sequence: CTT
ggctggagttcatcagtaac

SEQ ID NO: 178763 - DNA, 20 bp, Artificial Sequence
  Description of Artificial Sequence: Synthetic oligonucleotide
  Target: ATXN1; (-) strand; PAM type: YTN; PAM sequence: CTC
ttggctggagttcatcagta

SEQ ID NO: 178764 - DNA, 20 bp, Artificial Sequence
  Description of Artificial Sequence: Synthetic oligonucleotide
  Target: ATXN1; (-) strand; PAM type: YTN; PAM sequence: CTG
gtccacggtgccaccatctc

SEQ ID NO: 178765 - DNA, 20 bp, Artificial Sequence
  Description of Artificial Sequence: Synthetic oligonucleotide
  Target: ATXN1; (-) strand; PAM type: YTN; PAM sequence: CTG
ctggtccacggtgccaccat

SEQ ID NO: 178766 - DNA, 20 bp, Artificial Sequence
  Description of Artificial Sequence: Synthetic oligonucleotide
  Target: ATXN1; (-) strand; PAM type: YTN; PAM sequence: TTC
tgctggtccacggtgccacc

SEQ ID NO: 178767 - DNA, 20 bp, Artificial Sequence
  Description of Artificial Sequence: Synthetic oligonucleotide
  Target: ATXN1; (-) strand; PAM type: YTN; PAM sequence: CTA
cacaattctgctggtccacg

SEQ ID NO: 178768 - DNA, 20 bp, Artificial Sequence
  Description of Artificial Sequence: Synthetic oligonucleotide
  Target: ATXN1; (-) strand; PAM type: YTN; PAM sequence: CTC
ctacacaattctgctggtcc

SEQ ID NO: 178769 - DNA, 20 bp, Artificial Sequence
  Description of Artificial Sequence: Synthetic oligonucleotide
  Target: ATXN1; (-) strand; PAM type: YTN; PAM sequence: TTC
tcctacacaattctgctggt

SEQ ID NO: 178770 - DNA, 20 bp, Artificial Sequence
  Description of Artificial Sequence: Synthetic oligonucleotide
  Target: ATXN1; (-) strand; PAM type: YTN; PAM sequence: TTT
ctcctacacaattctgctgg

SEQ ID NO: 178771 - DNA, 20 bp, Artificial Sequence
  Description of Artificial Sequence: Synthetic oligonucleotide
  Target: ATXN1; (-) strand; PAM type: YTN; PAM sequence: TTT
tctcctacacaattctgctg

SEQ ID NO: 178772 - DNA, 20 bp, Artificial Sequence
  Description of Artificial Sequence: Synthetic oligonucleotide
  Target: ATXN1; (-) strand; PAM type: YTN; PAM sequence: TTT
ttctcctacacaattctgct

SEQ ID NO: 178773 - DNA, 20 bp, Artificial Sequence
  Description of Artificial Sequence: Synthetic oligonucleotide
  Target: ATXN1; (-) strand; PAM type: YTN; PAM sequence: CTT
tttctcctacacaattctgc

SEQ ID NO: 178774 - DNA, 20 bp, Artificial Sequence
  Description of Artificial Sequence: Synthetic oligonucleotide
  Target: ATXN1; (-) strand; PAM type: YTN; PAM sequence: CTC
tttttctcctacacaattct

SEQ ID NO: 178775 - DNA, 20 bp, Artificial Sequence
  Description of Artificial Sequence: Synthetic oligonucleotide
  Target: ATXN1; (-) strand; PAM type: YTN; PAM sequence: TTG
atgcctctttttctcctaca

SEQ ID NO: 178776 - DNA, 20 bp, Artificial Sequence
  Description of Artificial Sequence: Synthetic oligonucleotide
  Target: ATXN1; (-) strand; PAM type: YTN; PAM sequence: CTT
gatgcctctttttctcctac

SEQ ID NO: 178777 - DNA, 20 bp, Artificial Sequence
  Description of Artificial Sequence: Synthetic oligonucleotide
  Target: ATXN1; (-) strand; PAM type: YTN; PAM sequence: TTG
tccttgatgcctctttttct

SEQ ID NO: 178778 - DNA, 20 bp, Artificial Sequence
  Description of Artificial Sequence: Synthetic oligonucleotide
  Target: ATXN1; (-) strand; PAM type: YTN; PAM sequence: TTG
acgttgtccttgatgcctct

SEQ ID NO: 178779 - DNA, 20 bp, Artificial Sequence
  Description of Artificial Sequence: Synthetic oligonucleotide
  Target: ATXN1; (-) strand; PAM type: YTN; PAM sequence: TTG
ttgacgttgtccttgatgcc

SEQ ID NO: 178780 - DNA, 20 bp, Artificial Sequence
  Description of Artificial Sequence: Synthetic oligonucleotide
  Target: ATXN1; (-) strand; PAM type: YTN; PAM sequence: CTC
aggccacagttgttgacgtt

SEQ ID NO: 178781 - DNA, 20 bp, Artificial Sequence
  Description of Artificial Sequence: Synthetic oligonucleotide
  Target: ATXN1; (-) strand; PAM type: YTN; PAM sequence: TTA
ctcaggccacagttgttgac

SEQ ID NO: 178782 - DNA, 20 bp, Artificial Sequence
  Description of Artificial Sequence: Synthetic oligonucleotide
  Target: ATXN1; (-) strand; PAM type: YTN; PAM sequence: TTC
cagttactcaggccacagtt

SEQ ID NO: 178783 - DNA, 20 bp, Artificial Sequence
  Description of Artificial Sequence: Synthetic oligonucleotide
  Target: ATXN1; (-) strand; PAM type: YTN; PAM sequence: CTT
ccagttactcaggccacagt

SEQ ID NO: 178784 - DNA, 20 bp, Artificial Sequence
  Description of Artificial Sequence: Synthetic oligonucleotide
  Target: ATXN1; (-) strand; PAM type: YTN; PAM sequence: CTC
cttccagttactcaggccac

SEQ ID NO: 178785 - DNA, 20 bp, Artificial Sequence
  Description of Artificial Sequence: Synthetic oligonucleotide
  Target: ATXN1; (-) strand; PAM type: YTN; PAM sequence: TTC
ccatctccttccagttactc

SEQ ID NO: 178786 - DNA, 20 bp, Artificial Sequence
  Description of Artificial Sequence: Synthetic oligonucleotide
  Target: ATXN1; (-) strand; PAM type: YTN; PAM sequence: CTT
cccatctccttccagttact

SEQ ID NO: 178787 - DNA, 20 bp, Artificial Sequence
  Description of Artificial Sequence: Synthetic oligonucleotide
  Target: ATXN1; (-) strand; PAM type: YTN; PAM sequence: CTG
ccttcccatctccttccagt

SEQ ID NO: 178788 - DNA, 20 bp, Artificial Sequence
  Description of Artificial Sequence: Synthetic oligonucleotide
  Target: ATXN1; (-) strand; PAM type: YTN; PAM sequence: CTC
ccactgccttcccatctcct

SEQ ID NO: 178789 - DNA, 20 bp, Artificial Sequence
  Description of Artificial Sequence: Synthetic oligonucleotide
  Target: ATXN1; (-) strand; PAM type: YTN; PAM sequence: TTC
tcccactgccttcccatctc

SEQ ID NO: 178790 - DNA, 20 bp, Artificial Sequence
  Description of Artificial Sequence: Synthetic oligonucleotide
  Target: ATXN1; (-) strand; PAM type: YTN; PAM sequence: CTT
ctcccactgccttcccatct

SEQ ID NO: 178791 - DNA, 20 bp, Artificial Sequence
  Description of Artificial Sequence: Synthetic oligonucleotide
  Target: ATXN1; (-) strand; PAM type: YTN; PAM sequence: CTG
cttctcccactgccttccca

SEQ ID NO: 178792 - DNA, 20 bp, Artificial Sequence
  Description of Artificial Sequence: Synthetic oligonucleotide
  Target: ATXN1; (-) strand; PAM type: YTN; PAM sequence: CTA
ccccaacctgcttctcccac

SEQ ID NO: 178793 - DNA, 20 bp, Artificial Sequence
  Description of Artificial Sequence: Synthetic oligonucleotide
  Target: ATXN1; (-) strand; PAM type: YTN; PAM sequence: TTC
taccccaacctgcttctccc

SEQ ID NO: 178794 - DNA, 20 bp, Artificial Sequence
  Description of Artificial Sequence: Synthetic oligonucleotide
  Target: ATXN1; (-) strand; PAM type: YTN; PAM sequence: TTG
atattctaccccaacctgct

SEQ ID NO: 178795 - DNA, 20 bp, Artificial Sequence
  Description of Artificial Sequence: Synthetic oligonucleotide
  Target: ATXN1; (-) strand; PAM type: YTN; PAM sequence: CTT
gatattctaccccaacctgc

SEQ ID NO: 178796 - DNA, 20 bp, Artificial Sequence
  Description of Artificial Sequence: Synthetic oligonucleotide
  Target: ATXN1; (-) strand; PAM type: YTN; PAM sequence: CTC
ttgatattctaccccaacct

SEQ ID NO: 178797 - DNA, 20 bp, Artificial Sequence
  Description of Artificial Sequence: Synthetic oligonucleotide
  Target: ATXN1; (-) strand; PAM type: YTN; PAM sequence: TTC
agtgggatgaactcttgata

SEQ ID NO: 178798 - DNA, 20 bp, Artificial Sequence
  Description of Artificial Sequence: Synthetic oligonucleotide
  Target: ATXN1; (-) strand; PAM type: YTN; PAM sequence: CTT
cagtgggatgaactcttgat

SEQ ID NO: 178799 - DNA, 20 bp, Artificial Sequence
  Description of Artificial Sequence: Synthetic oligonucleotide
  Target: ATXN1; (-) strand; PAM type: YTN; PAM sequence: CTG
ccttcagtgggatgaactct

SEQ ID NO: 178800 - DNA, 20 bp, Artificial Sequence
  Description of Artificial Sequence: Synthetic oligonucleotide
  Target: ATXN1; (-) strand; PAM type: YTN; PAM sequence: TTA
actgccttcagtgggatgaa

SEQ ID NO: 178801 - DNA, 20 bp, Artificial Sequence
  Description of Artificial Sequence: Synthetic oligonucleotide
  Target: ATXN1; (-) strand; PAM type: YTN; PAM sequence: CTT
aactgccttcagtgggatga

SEQ ID NO: 178802 - DNA, 20 bp, Artificial Sequence
  Description of Artificial Sequence: Synthetic oligonucleotide
  Target: ATXN1; (-) strand; PAM type: YTN; PAM sequence: CTC
ttaactgccttcagtgggat

SEQ ID NO: 178803 - DNA, 20 bp, Artificial Sequence
  Description of Artificial Sequence: Synthetic oligonucleotide
  Target: ATXN1; (-) strand; PAM type: YTN; PAM sequence: CTG
tctcttaactgccttcagtg

SEQ ID NO: 178804 - DNA, 20 bp, Artificial Sequence
  Description of Artificial Sequence: Synthetic oligonucleotide
  Target: ATXN1; (-) strand; PAM type: YTN; PAM sequence: TTG
catatcccactgtctcttaa

SEQ ID NO: 178805 - DNA, 20 bp, Artificial Sequence
  Description of Artificial Sequence: Synthetic oligonucleotide
  Target: ATXN1; (-) strand; PAM type: YTN; PAM sequence: CTT
gcatatcccactgtctctta

SEQ ID NO: 178806 - DNA, 20 bp, Artificial Sequence
  Description of Artificial Sequence: Synthetic oligonucleotide
  Target: ATXN1; (-) strand; PAM type: YTN; PAM sequence: CTC
aggcttgcatatcccactgt

SEQ ID NO: 178807 - DNA, 20 bp, Artificial Sequence
  Description of Artificial Sequence: Synthetic oligonucleotide
  Target: ATXN1; (-) strand; PAM type: YTN; PAM sequence: TTG
aacctcaggcttgcatatcc

SEQ ID NO: 178808 - DNA, 20 bp, Artificial Sequence
  Description of Artificial Sequence: Synthetic oligonucleotide
  Target: ATXN1; (-) strand; PAM type: YTN; PAM sequence: TTT
gaacctcaggcttgcatatc

SEQ ID NO: 178809 - DNA, 20 bp, Artificial Sequence
  Description of Artificial Sequence: Synthetic oligonucleotide
  Target: ATXN1; (-) strand; PAM type: YTN; PAM sequence: CTT
tgaacctcaggcttgcatat

SEQ ID NO: 178810 - DNA, 20 bp, Artificial Sequence
  Description of Artificial Sequence: Synthetic oligonucleotide
  Target: ATXN1; (-) strand; PAM type: YTN; PAM sequence: TTC
tttgaacctcaggcttgcat

SEQ ID NO: 178811 - DNA, 20 bp, Artificial Sequence
  Description of Artificial Sequence: Synthetic oligonucleotide
  Target: ATXN1; (-) strand; PAM type: YTN; PAM sequence: TTT
ctttgaacctcaggcttgca

SEQ ID NO: 178812 - DNA, 20 bp, Artificial Sequence
  Description of Artificial Sequence: Synthetic oligonucleotide
  Target: ATXN1; (-) strand; PAM type: YTN; PAM sequence: TTT
tctttgaacctcaggcttgc

SEQ ID NO: 178813 - DNA, 20 bp, Artificial Sequence
  Description of Artificial Sequence: Synthetic oligonucleotide
  Target: ATXN1; (-) strand; PAM type: YTN; PAM sequence: CTT
ttctttgaacctcaggcttg

SEQ ID NO: 178814 - DNA, 20 bp, Artificial Sequence
  Description of Artificial Sequence: Synthetic oligonucleotide
  Target: ATXN1; (-) strand; PAM type: YTN; PAM sequence: CTG
ggccttttctttgaacctca

SEQ ID NO: 178815 - DNA, 20 bp, Artificial Sequence
  Description of Artificial Sequence: Synthetic oligonucleotide
  Target: ATXN1; (-) strand; PAM type: YTN; PAM sequence: CTC
cagcctgggccttttctttg

SEQ ID NO: 178816 - DNA, 20 bp, Artificial Sequence
  Description of Artificial Sequence: Synthetic oligonucleotide
  Target: ATXN1; (-) strand; PAM type: YTN; PAM sequence: TTC
tccagcctgggccttttctt

SEQ ID NO: 178817 - DNA, 20 bp, Artificial Sequence
  Description of Artificial Sequence: Synthetic oligonucleotide
  Target: ATXN1; (-) strand; PAM type: YTN; PAM sequence: CTT
ctccagcctgggccttttct

SEQ ID NO: 178818 - DNA, 20 bp, Artificial Sequence
  Description of Artificial Sequence: Synthetic oligonucleotide
  Target: ATXN1; (-) strand; PAM type: YTN; PAM sequence: CTG
acaccttctccagcctgggc

SEQ ID NO: 178819 - DNA, 20 bp, Artificial Sequence
  Description of Artificial Sequence: Synthetic oligonucleotide
  Target: ATXN1; (-) strand; PAM type: YTN; PAM sequence: CTC
aaaactgacaccttctccag

SEQ ID NO: 178820 - DNA, 20 bp, Artificial Sequence
  Description of Artificial Sequence: Synthetic oligonucleotide
  Target: ATXN1; (-) strand; PAM type: YTN; PAM sequence: TTC
aaaccatctcaaaactgaca

SEQ ID NO: 178821 - DNA, 20 bp, Artificial Sequence
  Description of Artificial Sequence: Synthetic oligonucleotide
  Target: ATXN1; (-) strand; PAM type: YTN; PAM sequence: CTT
caaaccatctcaaaactgac

SEQ ID NO: 178822 - DNA, 20 bp, Artificial Sequence
  Description of Artificial Sequence: Synthetic oligonucleotide
  Target: ATXN1; (-) strand; PAM type: YTN; PAM sequence: TTG
atgccttcaaaccatctcaa

SEQ ID NO: 178823 - DNA, 20 bp, Artificial Sequence
  Description of Artificial Sequence: Synthetic oligonucleotide
  Target: ATXN1; (-) strand; PAM type: YTN; PAM sequence: TTG
ttgatgccttcaaaccatct

SEQ ID NO: 178824 - DNA, 20 bp, Artificial Sequence
  Description of Artificial Sequence: Synthetic oligonucleotide
  Target: ATXN1; (-) strand; PAM type: YTN; PAM sequence: TTT
gttgatgccttcaaaccatc

SEQ ID NO: 178825 - DNA, 20 bp, Artificial Sequence
  Description of Artificial Sequence: Synthetic oligonucleotide
  Target: ATXN1; (-) strand; PAM type: YTN; PAM sequence: TTT
tgttgatgccttcaaaccat

SEQ ID NO: 178826 - DNA, 20 bp, Artificial Sequence
  Description of Artificial Sequence: Synthetic oligonucleotide
  Target: ATXN1; (-) strand; PAM type: YTN; PAM sequence: TTT
ttgttgatgccttcaaacca

SEQ ID NO: 178827 - DNA, 20 bp, Artificial Sequence
  Description of Artificial Sequence: Synthetic oligonucleotide
  Target: ATXN1; (-) strand; PAM type: YTN; PAM sequence: TTT
tttgttgatgccttcaaacc

SEQ ID NO: 178828 - DNA, 20 bp, Artificial Sequence
  Description of Artificial Sequence: Synthetic oligonucleotide
  Target: ATXN1; (-) strand; PAM type: YTN; PAM sequence: CTG
ttttttgttgatgccttcaa

SEQ ID NO: 178829 - DNA, 20 bp, Artificial Sequence
  Description of Artificial Sequence: Synthetic oligonucleotide
  Target: ATXN1; (-) strand; PAM type: YTN; PAM sequence: CTG
gtctgttttttgttgatgcc

SEQ ID NO: 178830 - DNA, 20 bp, Artificial Sequence
  Description of Artificial Sequence: Synthetic oligonucleotide
  Target: ATXN1; (-) strand; PAM type: YTN; PAM sequence: CTC
aaacctggtctgttttttgt

SEQ ID NO: 178831 - DNA, 20 bp, Artificial Sequence
  Description of Artificial Sequence: Synthetic oligonucleotide
  Target: ATXN1; (-) strand; PAM type: YTN; PAM sequence: CTC
agtcctcaaacctggtctgt

SEQ ID NO: 178832 - DNA, 20 bp, Artificial Sequence
  Description of Artificial Sequence: Synthetic oligonucleotide
  Target: ATXN1; (-) strand; PAM type: YTN; PAM sequence: CTC
agggctcagtcctcaaacct

SEQ ID NO: 178833 - DNA, 20 bp, Artificial Sequence
  Description of Artificial Sequence: Synthetic oligonucleotide
  Target: ATXN1; (-) strand; PAM type: YTN; PAM sequence: TTC
caaatgtgagagagcctcag

SEQ ID NO: 178834 - DNA, 20 bp, Artificial Sequence
  Description of Artificial Sequence: Synthetic oligonucleotide
  Target: ATXN1; (-) strand; PAM type: YTN; PAM sequence: TTT
ccaaatgtgagagagcctca

SEQ ID NO: 178835 - DNA, 20 bp, Artificial Sequence
  Description of Artificial Sequence: Synthetic oligonucleotide
  Target: ATXN1; (-) strand; PAM type: YTN; PAM sequence: CTG
gtttccaaatgtgagagagc

SEQ ID NO: 178836 - DNA, 20 bp, Artificial Sequence
  Description of Artificial Sequence: Synthetic oligonucleotide
  Target: ATXN1; (-) strand; PAM type: YTN; PAM sequence: CTC
tggtttccaaatgtgagaga

SEQ ID NO: 178837 - DNA, 20 bp, Artificial Sequence
  Description of Artificial Sequence: Synthetic oligonucleotide
  Target: ATXN1; (-) strand; PAM type: YTN; PAM sequence: CTA
atcacaagtggaacaatcag

SEQ ID NO: 178838 - DNA, 20 bp, Artificial Sequence
  Description of Artificial Sequence: Synthetic oligonucleotide
  Target: ATXN1; (-) strand; PAM type: YTN; PAM sequence: CTC
ccacccacagccgatacagc

SEQ ID NO: 178839 - DNA, 20 bp, Artificial Sequence
  Description of Artificial Sequence: Synthetic oligonucleotide
  Target: ATXN1; (-) strand; PAM type: YTN; PAM sequence: CTG
atacgcactcccacccacag

SEQ ID NO: 178840 - DNA, 20 bp, Artificial Sequence
  Description of Artificial Sequence: Synthetic oligonucleotide
  Target: ATXN1; (-) strand; PAM type: YTN; PAM sequence: TTC
cacgggggtggtgctgatac

SEQ ID NO: 178841 - DNA, 20 bp, Artificial Sequence
  Description of Artificial Sequence: Synthetic oligonucleotide
  Target: ATXN1; (-) strand; PAM type: YTN; PAM sequence: CTT
ccacgggggtggtgctgata

SEQ ID NO: 178842 - DNA, 20 bp, Artificial Sequence
  Description of Artificial Sequence: Synthetic oligonucleotide
  Target: ATXN1; (-) strand; PAM type: YTN; PAM sequence: TTA
tccgcatcaagtagccttcc

SEQ ID NO: 178843 - DNA, 20 bp, Artificial Sequence
  Description of Artificial Sequence: Synthetic oligonucleotide
  Target: ATXN1; (-) strand; PAM type: YTN; PAM sequence: CTT
atccgcatcaagtagccttc

SEQ ID NO: 178844 - DNA, 20 bp, Artificial Sequence
  Description of Artificial Sequence: Synthetic oligonucleotide
  Target: ATXN1; (-) strand; PAM type: YTN; PAM sequence: TTG
ccagtggatggaacttatcc

SEQ ID NO: 178845 - DNA, 20 bp, Artificial Sequence
  Description of Artificial Sequence: Synthetic oligonucleotide
  Target: ATXN1; (-) strand; PAM type: YTN; PAM sequence: TTT
gccagtggatggaacttatc

SEQ ID NO: 178846 - DNA, 20 bp, Artificial Sequence
  Description of Artificial Sequence: Synthetic oligonucleotide
  Target: ATXN1; (-) strand; PAM type: YTN; PAM sequence: TTG
ggtttgccagtggatggaac

SEQ ID NO: 178847 - DNA, 20 bp, Artificial Sequence
  Description of Artificial Sequence: Synthetic oligonucleotide
  Target: ATXN1; (-) strand; PAM type: YTN; PAM sequence: TTT
gggtttgccagtggatggaa

SEQ ID NO: 178848 - DNA, 20 bp, Artificial Sequence
  Description of Artificial Sequence: Synthetic oligonucleotide
  Target: ATXN1; (-) strand; PAM type: YTN; PAM sequence: TTT
tgggtttgccagtggatgga

SEQ ID NO: 178849 - DNA, 20 bp, Artificial Sequence
  Description of Artificial Sequence: Synthetic oligonucleotide
  Target: ATXN1; (-) strand; PAM type: YTN; PAM sequence: CTT
ttgggtttgccagtggatgg

SEQ ID NO: 178850 - DNA, 20 bp, Artificial Sequence
  Description of Artificial Sequence: Synthetic oligonucleotide
  Target: ATXN1; (-) strand; PAM type: YTN; PAM sequence: TTC
ccatgtagacatgtgtagct

SEQ ID NO: 178851 - DNA, 20 bp, Artificial Sequence
  Description of Artificial Sequence: Synthetic oligonucleotide
  Target: ATXN1; (-) strand; PAM type: YTN; PAM sequence: CTT
cccatgtagacatgtgtagc

SEQ ID NO: 178852 - DNA, 20 bp, Artificial Sequence
  Description of Artificial Sequence: Synthetic oligonucleotide
  Target: ATXN1; (-) strand; PAM type: YTN; PAM sequence: CTG
tgccgcacagcccttcccat

SEQ ID NO: 178853 - DNA, 20 bp, Artificial Sequence
  Description of Artificial Sequence: Synthetic oligonucleotide
  Target: ATXN1; (-) strand; PAM type: YTN; PAM sequence: CTG
tgcacctgtgccgcacagcc

SEQ ID NO: 178854 - DNA, 20 bp, Artificial Sequence
  Description of Artificial Sequence: Synthetic oligonucleotide
  Target: ATXN1; (-) strand; PAM type: YTN; PAM sequence: CTG
ctgtgcacctgtgccgcaca

SEQ ID NO: 178855 - DNA, 20 bp, Artificial Sequence
  Description of Artificial Sequence: Synthetic oligonucleotide
  Target: ATXN1; (-) strand; PAM type: YTN; PAM sequence: CTG
agatctgctgtgcacctgtg

SEQ ID NO: 178856 - DNA, 20 bp, Artificial Sequence
  Description of Artificial Sequence: Synthetic oligonucleotide
  Target: ATXN1; (-) strand; PAM type: YTN; PAM sequence: TTA
gtgcatgggaagagcagaaa

SEQ ID NO: 178857 - DNA, 20 bp, Artificial Sequence
  Description of Artificial Sequence: Synthetic oligonucleotide
  Target: ATXN1; (-) strand; PAM type: YTN; PAM sequence: CTT
agtgcatgggaagagcagaa

SEQ ID NO: 178858 - DNA, 20 bp, Artificial Sequence
  Description of Artificial Sequence: Synthetic oligonucleotide
  Target: ATXN1; (-) strand; PAM type: YTN; PAM sequence: CTC
cttagtgcatgggaagagca

SEQ ID NO: 178859 - DNA, 20 bp, Artificial Sequence
  Description of Artificial Sequence: Synthetic oligonucleotide
  Target: ATXN1; (-) strand; PAM type: YTN; PAM sequence: CTC
agctccttagtgcatgggaa

SEQ ID NO: 178860 - DNA, 20 bp, Artificial Sequence
  Description of Artificial Sequence: Synthetic oligonucleotide
  Target: ATXN1; (-) strand; PAM type: YTN; PAM sequence: TTG
ctcagctccttagtgcatgg

SEQ ID NO: 178861 - DNA, 20 bp, Artificial Sequence
  Description of Artificial Sequence: Synthetic oligonucleotide
  Target: ATXN1; (-) strand; PAM type: YTN; PAM sequence: TTT
gctcagctccttagtgcatg

SEQ ID NO: 178862 - DNA, 20 bp, Artificial Sequence
  Description of Artificial Sequence: Synthetic oligonucleotide
  Target: ATXN1; (-) strand; PAM type: YTN; PAM sequence: CTG
tttgctcagctccttagtgc

SEQ ID NO: 178863 - DNA, 20 bp, Artificial Sequence
  Description of Artificial Sequence: Synthetic oligonucleotide
  Target: ATXN1; (-) strand; PAM type: YTN; PAM sequence: TTG
ctgtttgctcagctccttag

SEQ ID NO: 178864 - DNA, 20 bp, Artificial Sequence
  Description of Artificial Sequence: Synthetic oligonucleotide
  Target: ATXN1; (-) strand; PAM type: YTN; PAM sequence: CTT
gctgtttgctcagctcctta

SEQ ID NO: 178865 - DNA, 20 bp, Artificial Sequence
  Description of Artificial Sequence: Synthetic oligonucleotide
  Target: ATXN1; (-) strand; PAM type: YTN; PAM sequence: CTG
acttgctgtttgctcagctc

SEQ ID NO: 178866 - DNA, 20 bp, Artificial Sequence
  Description of Artificial Sequence: Synthetic oligonucleotide
  Target: ATXN1; (-) strand; PAM type: YTN; PAM sequence: TTC
tgacttgctgtttgctcagc

SEQ ID NO: 178867 - DNA, 20 bp, Artificial Sequence
  Description of Artificial Sequence: Synthetic oligonucleotide
  Target: ATXN1; (-) strand; PAM type: YTN; PAM sequence: CTT
ctgacttgctgtttgctcag

SEQ ID NO: 178868 - DNA, 20 bp, Artificial Sequence
  Description of Artificial Sequence: Synthetic oligonucleotide
  Target: ATXN1; (-) strand; PAM type: YTN; PAM sequence: CTG
ccttctgacttgctgtttgc

SEQ ID NO: 178869 - DNA, 20 bp, Artificial Sequence
  Description of Artificial Sequence: Synthetic oligonucleotide
  Target: ATXN1; (-) strand; PAM type: YTN; PAM sequence: TTA
ccatggccctgccttctgac

SEQ ID NO: 178870 - DNA, 20 bp, Artificial Sequence
  Description of Artificial Sequence: Synthetic oligonucleotide
  Target: ATXN1; (-) strand; PAM type: YTN; PAM sequence: CTT
accatggccctgccttctga

SEQ ID NO: 178871 - DNA, 20 bp, Artificial Sequence
  Description of Artificial Sequence: Synthetic oligonucleotide
  Target: ATXN1; (-) strand; PAM type: YTN; PAM sequence: CTG
cttaccatggccctgccttc

SEQ ID NO: 178872 - DNA, 20 bp, Artificial Sequence
  Description of Artificial Sequence: Synthetic oligonucleotide
  Target: ATXN1; (-) strand; PAM type: YTN; PAM sequence: CTC
tgcttaccatggccctgcct

SEQ ID NO: 178873 - DNA, 20 bp, Artificial Sequence
  Description of Artificial Sequence: Synthetic oligonucleotide
  Target: ATXN1; (-) strand; PAM type: YTN; PAM sequence: CTG
gcctctgcttaccatggccc

SEQ ID NO: 178874 - DNA, 20 bp, Artificial Sequence
  Description of Artificial Sequence: Synthetic oligonucleotide
  Target: ATXN1; (-) strand; PAM type: YTN; PAM sequence: CTC
tggcctctgcttaccatggc

SEQ ID NO: 178875 - DNA, 20 bp, Artificial Sequence
  Description of Artificial Sequence: Synthetic oligonucleotide
  Target: ATXN1; (-) strand; PAM type: YTN; PAM sequence: TTC
ccagccacctctggcctctg

SEQ ID NO: 178876 - DNA, 20 bp, Artificial Sequence
  Description of Artificial Sequence: Synthetic oligonucleotide
  Target: ATXN1; (-) strand; PAM type: YTN; PAM sequence: TTA
attcccagccacctctggcc

SEQ ID NO: 178877 - DNA, 20 bp, Artificial Sequence
  Description of Artificial Sequence: Synthetic oligonucleotide
  Target: ATXN1; (-) strand; PAM type: YTN; PAM sequence: TTT
aattcccagccacctctggc

SEQ ID NO: 178878 - DNA, 20 bp, Artificial Sequence
  Description of Artificial Sequence: Synthetic oligonucleotide
  Target: ATXN1; (-) strand; PAM type: YTN; PAM sequence: TTT
taattcccagccacctctgg

SEQ ID NO: 178879 - DNA, 20 bp, Artificial Sequence
  Description of Artificial Sequence: Synthetic oligonucleotide
  Target: ATXN1; (-) strand; PAM type: YTN; PAM sequence: CTT
ttaattcccagccacctctg

SEQ ID NO: 178880 - DNA, 20 bp, Artificial Sequence
  Description of Artificial Sequence: Synthetic oligonucleotide
  Target: ATXN1; (-) strand; PAM type: YTN; PAM sequence: TTG
tccttttaattcccagccac

SEQ ID NO: 178881 - DNA, 20 bp, Artificial Sequence
  Description of Artificial Sequence: Synthetic oligonucleotide
  Target: ATXN1; (-) strand; PAM type: YTN; PAM sequence: TTA
taagttgtccttttaattcc

SEQ ID NO: 178882 - DNA, 20 bp, Artificial Sequence
  Description of Artificial Sequence: Synthetic oligonucleotide
  Target: ATXN1; (-) strand; PAM type: YTN; PAM sequence: TTG
gcagaacagtaaggttataa

SEQ ID NO: 178883 - DNA, 20 bp, Artificial Sequence
  Description of Artificial Sequence: Synthetic oligonucleotide
  Target: ATXN1; (-) strand; PAM type: YTN; PAM sequence: TTT
ggcagaacagtaaggttata

SEQ ID NO: 178884 - DNA, 20 bp, Artificial Sequence
  Description of Artificial Sequence: Synthetic oligonucleotide
  Target: ATXN1; (-) strand; PAM type: YTN; PAM sequence: CTG
taggaatttggcagaacagt

SEQ ID NO: 178885 - DNA, 20 bp, Artificial Sequence
  Description of Artificial Sequence: Synthetic oligonucleotide
  Target: ATXN1; (-) strand; PAM type: YTN; PAM sequence: TTC
tgtaggaatttggcagaaca

SEQ ID NO: 178886 - DNA, 20 bp, Artificial Sequence
  Description of Artificial Sequence: Synthetic oligonucleotide
  Target: ATXN1; (-) strand; PAM type: YTN; PAM sequence: TTA
tcagttctgtaggaatttgg

SEQ ID NO: 178887 - DNA, 20 bp, Artificial Sequence
  Description of Artificial Sequence: Synthetic oligonucleotide
  Target: ATXN1; (-) strand; PAM type: YTN; PAM sequence: CTT
atcagttctgtaggaatttg

SEQ ID NO: 178888 - DNA, 20 bp, Artificial Sequence
  Description of Artificial Sequence: Synthetic oligonucleotide
  Target: ATXN1; (-) strand; PAM type: YTN; PAM sequence: TTA
gaaaataatacaacaaaagt

SEQ ID NO: 178889 - DNA, 20 bp, Artificial Sequence
  Description of Artificial Sequence: Synthetic oligonucleotide
  Target: ATXN1; (-) strand; PAM type: YTN; PAM sequence: CTG
ttagaaaataatacaacaaa

SEQ ID NO: 178890 - DNA, 20 bp, Artificial Sequence
  Description of Artificial Sequence: Synthetic oligonucleotide
  Target: ATXN1; (-) strand; PAM type: YTN; PAM sequence: TTC
tgttagaaaataatacaaca

SEQ ID NO: 178891 - DNA, 20 bp, Artificial Sequence
  Description of Artificial Sequence: Synthetic oligonucleotide
  Target: ATXN1; (-) strand; PAM type: YTN; PAM sequence: TTT
ctgttagaaaataatacaac

SEQ ID NO: 178892 - DNA, 20 bp, Artificial Sequence
  Description of Artificial Sequence: Synthetic oligonucleotide
  Target: ATXN1; (-) strand; PAM type: YTN; PAM sequence: TTT
tctgttagaaaataatacaa

SEQ ID NO: 178893 - DNA, 20 bp, Artificial Sequence
  Description of Artificial Sequence: Synthetic oligonucleotide
  Target: ATXN1; (-) strand; PAM type: YTN; PAM sequence: CTA
tgttttctgttagaaaataa

SEQ ID NO: 178894 - DNA, 20 bp, Artificial Sequence
  Description of Artificial Sequence: Synthetic oligonucleotide
  Target: ATXN1; (-) strand; PAM type: YTN; PAM sequence: TTA
tctatgttttctgttagaaa

SEQ ID NO: 178895 - DNA, 20 bp, Artificial Sequence
  Description of Artificial Sequence: Synthetic oligonucleotide
  Target: ATXN1; (-) strand; PAM type: YTN; PAM sequence: TTG
gattatctatgttttctgtt

SEQ ID NO: 178896 - DNA, 20 bp, Artificial Sequence
  Description of Artificial Sequence: Synthetic oligonucleotide
  Target: ATXN1; (-) strand; PAM type: YTN; PAM sequence: CTT
ggattatctatgttttctgt

SEQ ID NO: 178897 - DNA, 20 bp, Artificial Sequence
  Description of Artificial Sequence: Synthetic oligonucleotide
  Target: ATXN1; (-) strand; PAM type: YTN; PAM sequence: TTA
aagcaggaagagacacaagg

SEQ ID NO: 178898 - DNA, 20 bp, Artificial Sequence
  Description of Artificial Sequence: Synthetic oligonucleotide
  Target: ATXN1; (-) strand; PAM type: YTN; PAM sequence: TTA
taattaaagcaggaagagac

SEQ ID NO: 178899 - DNA, 20 bp, Artificial Sequence
  Description of Artificial Sequence: Synthetic oligonucleotide
  Target: ATXN1; (-) strand; PAM type: YTN; PAM sequence: TTA
atcaaattataattaaagca

SEQ ID NO: 178900 - DNA, 20 bp, Artificial Sequence
  Description of Artificial Sequence: Synthetic oligonucleotide
  Target: ATXN1; (-) strand; PAM type: YTN; PAM sequence: TTG
taagttaatcaaattataat

SEQ ID NO: 178901 - DNA, 20 bp, Artificial Sequence
  Description of Artificial Sequence: Synthetic oligonucleotide
  Target: ATXN1; (-) strand; PAM type: YTN; PAM sequence: TTT
gtaagttaatcaaattataa

SEQ ID NO: 178902 - DNA, 20 bp, Artificial Sequence
  Description of Artificial Sequence: Synthetic oligonucleotide
  Target: ATXN1; (-) strand; PAM type: YTN; PAM sequence: CTG
gaacaaaagggaataccaat

SEQ ID NO: 178903 - DNA, 20 bp, Artificial Sequence
  Description of Artificial Sequence: Synthetic oligonucleotide
  Target: ATXN1; (-) strand; PAM type: YTN; PAM sequence: CTC
aaatgggctggaacaaaagg

SEQ ID NO: 178904 - DNA, 20 bp, Artificial Sequence
  Description of Artificial Sequence: Synthetic oligonucleotide
  Target: ATXN1; (-) strand; PAM type: YTN; PAM sequence: TTA
tatcctcaaatgggctggaa

SEQ ID NO: 178905 - DNA, 20 bp, Artificial Sequence
  Description of Artificial Sequence: Synthetic oligonucleotide
  Target: ATXN1; (-) strand; PAM type: YTN; PAM sequence: TTA
ggaagagatgaagagaaatt

SEQ ID NO: 178906 - DNA, 20 bp, Artificial Sequence
  Description of Artificial Sequence: Synthetic oligonucleotide
  Target: ATXN1; (-) strand; PAM type: YTN; PAM sequence: TTT
aggaagagatgaagagaaat

SEQ ID NO: 178907 - DNA, 20 bp, Artificial Sequence
  Description of Artificial Sequence: Synthetic oligonucleotide
  Target: ATXN1; (-) strand; PAM type: YTN; PAM sequence: TTA
tgcatttaggaagagatgaa

SEQ ID NO: 178908 - DNA, 20 bp, Artificial Sequence
  Description of Artificial Sequence: Synthetic oligonucleotide
  Target: ATXN1; (-) strand; PAM type: YTN; PAM sequence: CTT
atgcatttaggaagagatga

SEQ ID NO: 178909 - DNA, 20 bp, Artificial Sequence
  Description of Artificial Sequence: Synthetic oligonucleotide
  Target: ATXN1; (-) strand; PAM type: YTN; PAM sequence: CTG
agccaacttatgcatttagg

SEQ ID NO: 178910 - DNA, 20 bp, Artificial Sequence
  Description of Artificial Sequence: Synthetic oligonucleotide
  Target: ATXN1; (-) strand; PAM type: YTN; PAM sequence: TTA
tgctgagccaacttatgcat

SEQ ID NO: 178911 - DNA, 20 bp, Artificial Sequence
  Description of Artificial Sequence: Synthetic oligonucleotide
  Target: ATXN1; (-) strand; PAM type: YTN; PAM sequence: TTT
atgctgagccaacttatgca

SEQ ID NO: 178912 - DNA, 20 bp, Artificial Sequence
  Description of Artificial Sequence: Synthetic oligonucleotide
  Target: ATXN1; (-) strand; PAM type: YTN; PAM sequence: CTT
tatgctgagccaacttatgc

SEQ ID NO: 178913 - DNA, 20 bp, Artificial Sequence
  Description of Artificial Sequence: Synthetic oligonucleotide
  Target: ATXN1; (-) strand; PAM type: YTN; PAM sequence: TTA
tactttatgctgagccaact

SEQ ID NO: 178914 - DNA, 20 bp, Artificial Sequence
  Description of Artificial Sequence: Synthetic oligonucleotide
  Target: ATXN1; (-) strand; PAM type: YTN; PAM sequence: TTA
tcaagtaattatactttatg

SEQ ID NO: 178915 - DNA, 20 bp, Artificial Sequence
  Description of Artificial Sequence: Synthetic oligonucleotide
  Target: ATXN1; (-) strand; PAM type: YTN; PAM sequence: TTC
catggttatcaagtaattat

SEQ ID NO: 178916 - DNA, 20 bp, Artificial Sequence
  Description of Artificial Sequence: Synthetic oligonucleotide
  Target: ATXN1; (-) strand; PAM type: YTN; PAM sequence: CTT
ccatggttatcaagtaatta

SEQ ID NO: 178917 - DNA, 20 bp, Artificial Sequence
  Description of Artificial Sequence: Synthetic oligonucleotide
  Target: ATXN1; (-) strand; PAM type: YTN; PAM sequence: CTA
gcttccatggttatcaagta

SEQ ID NO: 178918 - DNA, 20 bp, Artificial Sequence
  Description of Artificial Sequence: Synthetic oligonucleotide
  Target: ATXN1; (-) strand; PAM type: YTN; PAM sequence: CTA
cctagcttccatggttatca

SEQ ID NO: 178919 - DNA, 20 bp, Artificial Sequence
  Description of Artificial Sequence: Synthetic oligonucleotide
  Target: ATXN1; (-) strand; PAM type: YTN; PAM sequence: CTG
ctacctagcttccatggtta

SEQ ID NO: 178920 - DNA, 20 bp, Artificial Sequence
  Description of Artificial Sequence: Synthetic oligonucleotide
  Target: ATXN1; (-) strand; PAM type: YTN; PAM sequence: CTC
tgctacctagcttccatggt

SEQ ID NO: 178921 - DNA, 20 bp, Artificial Sequence
  Description of Artificial Sequence: Synthetic oligonucleotide
  Target: ATXN1; (-) strand; PAM type: YTN; PAM sequence: CTC
tctgctacctagcttccatg

SEQ ID NO: 178922 - DNA, 20 bp, Artificial Sequence
  Description of Artificial Sequence: Synthetic oligonucleotide
  Target: ATXN1; (-) strand; PAM type: YTN; PAM sequence: TTA
cactctctgctacctagctt

SEQ ID NO: 178923 - DNA, 20 bp, Artificial Sequence
  Description of Artificial Sequence: Synthetic oligonucleotide
  Target: ATXN1; (-) strand; PAM type: YTN; PAM sequence: CTT
acactctctgctacctagct

SEQ ID NO: 178924 - DNA, 20 bp, Artificial Sequence
  Description of Artificial Sequence: Synthetic oligonucleotide
  Target: ATXN1; (-) strand; PAM type: YTN; PAM sequence: CTC
cttacactctctgctaccta

SEQ ID NO: 178925 - DNA, 20 bp, Artificial Sequence
  Description of Artificial Sequence: Synthetic oligonucleotide
  Target: ATXN1; (-) strand; PAM type: YTN; PAM sequence: CTC
tccttacactctctgctacc

SEQ ID NO: 178926 - DNA, 20 bp, Artificial Sequence
  Description of Artificial Sequence: Synthetic oligonucleotide
  Target: ATXN1; (-) strand; PAM type: YTN; PAM sequence: TTC
aaaatacaggaagctctcct

SEQ ID NO: 178927 - DNA, 20 bp, Artificial Sequence
  Description of Artificial Sequence: Synthetic oligonucleotide
  Target: ATXN1; (-) strand; PAM type: YTN; PAM sequence: TTT
caaaatacaggaagctctcc

SEQ ID NO: 178928 - DNA, 20 bp, Artificial Sequence
  Description of Artificial Sequence: Synthetic oligonucleotide
  Target: ATXN1; (-) strand; PAM type: YTN; PAM sequence: TTC
cccagacaaggtccatggac

SEQ ID NO: 178929 - DNA, 20 bp, Artificial Sequence
  Description of Artificial Sequence: Synthetic oligonucleotide
  Target: ATXN1; (-) strand; PAM type: YTN; PAM sequence: CTT
ccccagacaaggtccatgga

SEQ ID NO: 178930 - DNA, 20 bp, Artificial Sequence
  Description of Artificial Sequence: Synthetic oligonucleotide
  Target: ATXN1; (-) strand; PAM type: YTN; PAM sequence: CTC
ttccccagacaaggtccatg

SEQ ID NO: 178931 - DNA, 20 bp, Artificial Sequence
  Description of Artificial Sequence: Synthetic oligonucleotide
  Target: ATXN1; (-) strand; PAM type: YTN; PAM sequence: TTA
gtgtggcaccctcttcccca

SEQ ID NO: 178932 - DNA, 20 bp, Artificial Sequence
  Description of Artificial Sequence: Synthetic oligonucleotide
  Target: ATXN1; (-) strand; PAM type: YTN; PAM sequence: TTG
aacacccatagtagccaagg

SEQ ID NO: 178933 - DNA, 20 bp, Artificial Sequence
  Description of Artificial Sequence: Synthetic oligonucleotide
  Target: ATXN1; (-) strand; PAM type: YTN; PAM sequence: CTT
gaacacccatagtagccaag

SEQ ID NO: 178934 - DNA, 20 bp, Artificial Sequence
  Description of Artificial Sequence: Synthetic oligonucleotide
  Target: ATXN1; (-) strand; PAM type: YTN; PAM sequence: TTC
ttgaacacccatagtagcca

SEQ ID NO: 178935 - DNA, 20 bp, Artificial Sequence
  Description of Artificial Sequence: Synthetic oligonucleotide
  Target: ATXN1; (-) strand; PAM type: YTN; PAM sequence: CTT
cttgaacacccatagtagcc

SEQ ID NO: 178936 - DNA, 20 bp, Artificial Sequence
  Description of Artificial Sequence: Synthetic oligonucleotide
  Target: ATXN1; (-) strand; PAM type: YTN; PAM sequence: CTG
cttcttgaacacccatagta

SEQ ID NO: 178937 - DNA, 20 bp, Artificial Sequence
  Description of Artificial Sequence: Synthetic oligonucleotide
  Target: ATXN1; (-) strand; PAM type: YTN; PAM sequence: TTG
catgatgctgcttcttgaac

SEQ ID NO: 178938 - DNA, 20 bp, Artificial Sequence
  Description of Artificial Sequence: Synthetic oligonucleotide
  Target: ATXN1; (-) strand; PAM type: YTN; PAM sequence: CTA
ttgcatgatgctgcttcttg

SEQ ID NO: 178939 - DNA, 20 bp, Artificial Sequence
  Description of Artificial Sequence: Synthetic oligonucleotide
  Target: ATXN1; (-) strand; PAM type: YTN; PAM sequence: TTC
tattgcatgatgctgcttct

SEQ ID NO: 178940 - DNA, 20 bp, Artificial Sequence
  Description of Artificial Sequence: Synthetic oligonucleotide
  Target: ATXN1; (-) strand; PAM type: YTN; PAM sequence: TTT
ctattgcatgatgctgcttc

SEQ ID NO: 178941 - DNA, 20 bp, Artificial Sequence
  Description of Artificial Sequence: Synthetic oligonucleotide
  Target: ATXN1; (-) strand; PAM type: YTN; PAM sequence: CTT
tctattgcatgatgctgctt

SEQ ID NO: 178942 - DNA, 20 bp, Artificial Sequence
  Description of Artificial Sequence: Synthetic oligonucleotide
  Target: ATXN1; (-) strand; PAM type: YTN; PAM sequence: CTG
ccataagaagtcccgaccag

SEQ ID NO: 178943 - DNA, 20 bp, Artificial Sequence
  Description of Artificial Sequence: Synthetic oligonucleotide
  Target: ATXN1; (-) strand; PAM type: YTN; PAM sequence: TTG
gggaccactgccataagaag

SEQ ID NO: 178944 - DNA, 20 bp, Artificial Sequence
  Description of Artificial Sequence: Synthetic oligonucleotide
  Target: ATXN1; (-) strand; PAM type: YTN; PAM sequence: TTT
ggggaccactgccataagaa

SEQ ID NO: 178945 - DNA, 20 bp, Artificial Sequence
  Description of Artificial Sequence: Synthetic oligonucleotide
  Target: ATXN1; (-) strand; PAM type: YTN; PAM sequence: CTC
atggaccagtgccaaaaagt

SEQ ID NO: 178946 - DNA, 20 bp, Artificial Sequence
  Description of Artificial Sequence: Synthetic oligonucleotide
  Target: ATXN1; (-) strand; PAM type: YTN; PAM sequence: CTA
gcctcatggaccagtgccaa

SEQ ID NO: 178947 - DNA, 20 bp, Artificial Sequence
  Description of Artificial Sequence: Synthetic oligonucleotide
  Target: ATXN1; (-) strand; PAM type: YTN; PAM sequence: CTA
cccctagcctcatggaccag

SEQ ID NO: 178948 - DNA, 20 bp, Artificial Sequence
  Description of Artificial Sequence: Synthetic oligonucleotide
  Target: ATXN1; (-) strand; PAM type: YTN; PAM sequence: CTG
atccccctacccctagcctc

SEQ ID NO: 178949 - DNA, 20 bp, Artificial Sequence
  Description of Artificial Sequence: Synthetic oligonucleotide
  Target: ATXN1; (-) strand; PAM type: YTN; PAM sequence: CTA
atgcctgatccccctacccc

SEQ ID NO: 178950 - DNA, 20 bp, Artificial Sequence
  Description of Artificial Sequence: Synthetic oligonucleotide
  Target: ATXN1; (-) strand; PAM type: YTN; PAM sequence: TTA
tgagaatctaatgcctgatc

SEQ ID NO: 178951 - DNA, 20 bp, Artificial Sequence
  Description of Artificial Sequence: Synthetic oligonucleotide
  Target: ATXN1; (-) strand; PAM type: YTN; PAM sequence: CTT
atgagaatctaatgcctgat

SEQ ID NO: 178952 - DNA, 20 bp, Artificial Sequence
  Description of Artificial Sequence: Synthetic oligonucleotide
  Target: ATXN1; (-) strand; PAM type: YTN; PAM sequence: TTC
cttatgagaatctaatgcct

SEQ ID NO: 178953 - DNA, 20 bp, Artificial Sequence
  Description of Artificial Sequence: Synthetic oligonucleotide
  Target: ATXN1; (-) strand; PAM type: YTN; PAM sequence: CTT
ccttatgagaatctaatgcc

SEQ ID NO: 178954 - DNA, 20 bp, Artificial Sequence
  Description of Artificial Sequence: Synthetic oligonucleotide
  Target: ATXN1; (-) strand; PAM type: YTN; PAM sequence: TTG
taccttccttatgagaatct

SEQ ID NO: 178955 - DNA, 20 bp, Artificial Sequence
  Description of Artificial Sequence: Synthetic oligonucleotide
  Target: ATXN1; (-) strand; PAM type: YTN; PAM sequence: CTA
ggttgtaccttccttatgag

SEQ ID NO: 178956 - DNA, 20 bp, Artificial Sequence
  Description of Artificial Sequence: Synthetic oligonucleotide
  Target: ATXN1; (-) strand; PAM type: YTN; PAM sequence: CTG
cacatgtgagggatctaggt

SEQ ID NO: 178957 - DNA, 20 bp, Artificial Sequence
  Description of Artificial Sequence: Synthetic oligonucleotide
  Target: ATXN1; (-) strand; PAM type: YTN; PAM sequence: CTG
tgaactgcacatgtgaggga

SEQ ID NO: 178958 - DNA, 20 bp, Artificial Sequence
  Description of Artificial Sequence: Synthetic oligonucleotide
  Target: ATXN1; (-) strand; PAM type: YTN; PAM sequence: CTC
ataggaaagtgaaccgtact

SEQ ID NO: 178959 - DNA, 20 bp, Artificial Sequence
  Description of Artificial Sequence: Synthetic oligonucleotide
  Target: ATXN1; (-) strand; PAM type: YTN; PAM sequence: TTC
tcataggaaagtgaaccgta

SEQ ID NO: 178960 - DNA, 20 bp, Artificial Sequence
  Description of Artificial Sequence: Synthetic oligonucleotide
  Target: ATXN1; (-) strand; PAM type: YTN; PAM sequence: TTT
ctcataggaaagtgaaccgt

SEQ ID NO: 178961 - DNA, 20 bp, Artificial Sequence
  Description of Artificial Sequence: Synthetic oligonucleotide
  Target: ATXN1; (-) strand; PAM type: YTN; PAM sequence: CTT
tctcataggaaagtgaaccg

SEQ ID NO: 178962 - DNA, 20 bp, Artificial Sequence
  Description of Artificial Sequence: Synthetic oligonucleotide
  Target: ATXN1; (-) strand; PAM type: YTN; PAM sequence: TTC
tttctcataggaaagtgaac

SEQ ID NO: 178963 - DNA, 20 bp, Artificial Sequence
  Description of Artificial Sequence: Synthetic oligonucleotide
  Target: ATXN1; (-) strand; PAM type: YTN; PAM sequence: TTA
gattctttctcataggaaag

SEQ ID NO: 178964 - DNA, 20 bp, Artificial Sequence
  Description of Artificial Sequence: Synthetic oligonucleotide
  Target: ATXN1; (-) strand; PAM type: YTN; PAM sequence: CTG
tcagatcagtggcagcatta

SEQ ID NO: 178965 - DNA, 20 bp, Artificial Sequence
  Description of Artificial Sequence: Synthetic oligonucleotide
  Target: ATXN1; (-) strand; PAM type: YTN; PAM sequence: CTC
ctgtcagatcagtggcagca

SEQ ID NO: 178966 - DNA, 20 bp, Artificial Sequence
  Description of Artificial Sequence: Synthetic oligonucleotide
  Target: ATXN1; (-) strand; PAM type: YTN; PAM sequence: CTC
cacctcctgtcagatcagtg

SEQ ID NO: 178967 - DNA, 20 bp, Artificial Sequence
  Description of Artificial Sequence: Synthetic oligonucleotide
  Target: ATXN1; (-) strand; PAM type: YTN; PAM sequence: CTA
agctccacctcctgtcagat

SEQ ID NO: 178968 - DNA, 20 bp, Artificial Sequence
  Description of Artificial Sequence: Synthetic oligonucleotide
  Target: ATXN1; (-) strand; PAM type: YTN; PAM sequence: CTC
agccagcctaagctccacct

SEQ ID NO: 178969 - DNA, 20 bp, Artificial Sequence
  Description of Artificial Sequence: Synthetic oligonucleotide
  Target: ATXN1; (-) strand; PAM type: YTN; PAM sequence: TTA
gccagctcagccagcctaag

SEQ ID NO: 178970 - DNA, 20 bp, Artificial Sequence
  Description of Artificial Sequence: Synthetic oligonucleotide
  Target: ATXN1; (-) strand; PAM type: YTN; PAM sequence: CTG
ggtggcacaccagtaggtga

SEQ ID NO: 178971 - DNA, 20 bp, Artificial Sequence
  Description of Artificial Sequence: Synthetic oligonucleotide
  Target: ATXN1; (-) strand; PAM type: YTN; PAM sequence: TTA
ggaactgggtggcacaccag

SEQ ID NO: 178972 - DNA, 20 bp, Artificial Sequence
  Description of Artificial Sequence: Synthetic oligonucleotide
  Target: ATXN1; (-) strand; PAM type: YTN; PAM sequence: CTG
ttaggaactgggtggcacac

SEQ ID NO: 178973 - DNA, 20 bp, Artificial Sequence
  Description of Artificial Sequence: Synthetic oligonucleotide
  Target: ATXN1; (-) strand; PAM type: YTN; PAM sequence: CTG
tggcctgttaggaactgggt

SEQ ID NO: 178974 - DNA, 20 bp, Artificial Sequence
  Description of Artificial Sequence: Synthetic oligonucleotide
  Target: ATXN1; (-) strand; PAM type: YTN; PAM sequence: TTA
tgggtctgtggcctgttagg

SEQ ID NO: 178975 - DNA, 20 bp, Artificial Sequence
  Description of Artificial Sequence: Synthetic oligonucleotide
  Target: ATXN1; (-) strand; PAM type: YTN; PAM sequence: CTG
ggccatggaccattatgggt

SEQ ID NO: 178976 - DNA, 20 bp, Artificial Sequence
  Description of Artificial Sequence: Synthetic oligonucleotide
  Target: ATXN1; (-) strand; PAM type: YTN; PAM sequence: TTC
ccaacccctgggccatggac

SEQ ID NO: 178977 - DNA, 20 bp, Artificial Sequence
  Description of Artificial Sequence: Synthetic oligonucleotide
  Target: ATXN1; (-) strand; PAM type: YTN; PAM sequence: CTA
taacacaggggttcccaacc

SEQ ID NO: 178978 - DNA, 20 bp, Artificial Sequence
  Description of Artificial Sequence: Synthetic oligonucleotide
  Target: ATXN1; (-) strand; PAM type: YTN; PAM sequence: TTG
ggtgtcaggtcctataacac

SEQ ID NO: 178979 - DNA, 20 bp, Artificial Sequence
  Description of Artificial Sequence: Synthetic oligonucleotide
  Target: ATXN1; (-) strand; PAM type: YTN; PAM sequence: TTC
agatggcagaaattgggtgt

SEQ ID NO: 178980 - DNA, 20 bp, Artificial Sequence
  Description of Artificial Sequence: Synthetic oligonucleotide
  Target: ATXN1; (-) strand; PAM type: YTN; PAM sequence: TTT
cagatggcagaaattgggtg

SEQ ID NO: 178981 - DNA, 20 bp, Artificial Sequence
  Description of Artificial Sequence: Synthetic oligonucleotide
  Target: ATXN1; (-) strand; PAM type: YTN; PAM sequence: TTT
tcagatggcagaaattgggt

SEQ ID NO: 178982 - DNA, 20 bp, Artificial Sequence
  Description of Artificial Sequence: Synthetic oligonucleotide
  Target: ATXN1; (-) strand; PAM type: YTN; PAM sequence: CTT
ttcagatggcagaaattggg

SEQ ID NO: 178983 - DNA, 20 bp, Artificial Sequence
  Description of Artificial Sequence: Synthetic oligonucleotide
  Target: ATXN1; (-) strand; PAM type: YTN; PAM sequence: TTG
cttttcagatggcagaaatt

SEQ ID NO: 178984 - DNA, 20 bp, Artificial Sequence
  Description of Artificial Sequence: Synthetic oligonucleotide
  Target: ATXN1; (-) strand; PAM type: YTN; PAM sequence: TTT
gcttttcagatggcagaaat

SEQ ID NO: 178985 - DNA, 20 bp, Artificial Sequence
  Description of Artificial Sequence: Synthetic oligonucleotide
  Target: ATXN1; (-) strand; PAM type: YTN; PAM sequence: CTT
tgcttttcagatggcagaaa

SEQ ID NO: 178986 - DNA, 20 bp, Artificial Sequence
  Description of Artificial Sequence: Synthetic oligonucleotide
  Target: ATXN1; (-) strand; PAM type: YTN; PAM sequence: TTC
tttgcttttcagatggcaga

SEQ ID NO: 178987 - DNA, 20 bp, Artificial Sequence
  Description of Artificial Sequence: Synthetic oligonucleotide
  Target: ATXN1; (-) strand; PAM type: YTN; PAM sequence: TTT
ctttgcttttcagatggcag

SEQ ID NO: 178988 - DNA, 20 bp, Artificial Sequence
  Description of Artificial Sequence: Synthetic oligonucleotide
  Target: ATXN1; (-) strand; PAM type: YTN; PAM sequence: CTT
tctttgcttttcagatggca

SEQ ID NO: 178989 - DNA, 20 bp, Artificial Sequence
  Description of Artificial Sequence: Synthetic oligonucleotide
  Target: ATXN1; (-) strand; PAM type: YTN; PAM sequence: TTA
tctttctttgcttttcagat

SEQ ID NO: 178990 - DNA, 20 bp, Artificial Sequence
  Description of Artificial Sequence: Synthetic oligonucleotide
  Target: ATXN1; (-) strand; PAM type: YTN; PAM sequence: TTG
ttatctttctttgcttttca

SEQ ID NO: 178991 - DNA, 20 bp, Artificial Sequence
  Description of Artificial Sequence: Synthetic oligonucleotide
  Target: ATXN1; (-) strand; PAM type: YTN; PAM sequence: CTA
aaaagtcaacagagtccatt

SEQ ID NO: 178992 - DNA, 20 bp, Artificial Sequence
  Description of Artificial Sequence: Synthetic oligonucleotide
  Target: ATXN1; (-) strand; PAM type: YTN; PAM sequence: CTG
ctaaaaagtcaacagagtcc

SEQ ID NO: 178993 - DNA, 20 bp, Artificial Sequence
  Description of Artificial Sequence: Synthetic oligonucleotide
  Target: ATXN1; (-) strand; PAM type: YTN; PAM sequence: TTC
tgctaaaaagtcaacagagt

SEQ ID NO: 178994 - DNA, 20 bp, Artificial Sequence
  Description of Artificial Sequence: Synthetic oligonucleotide
  Target: ATXN1; (-) strand; PAM type: YTN; PAM sequence: TTT
ctgctaaaaagtcaacagag

SEQ ID NO: 178995 - DNA, 20 bp, Artificial Sequence
  Description of Artificial Sequence: Synthetic oligonucleotide
  Target: ATXN1; (-) strand; PAM type: YTN; PAM sequence: TTA
tttctgctaaaaagtcaaca

SEQ ID NO: 178996 - DNA, 20 bp, Artificial Sequence
  Description of Artificial Sequence: Synthetic oligonucleotide
  Target: ATXN1; (-) strand; PAM type: YTN; PAM sequence: TTT
atttctgctaaaaagtcaac

SEQ ID NO: 178997 - DNA, 20 bp, Artificial Sequence
  Description of Artificial Sequence: Synthetic oligonucleotide
  Target: ATXN1; (-) strand; PAM type: YTN; PAM sequence: TTT
tatttctgctaaaaagtcaa

SEQ ID NO: 178998 - DNA, 20 bp, Artificial Sequence
  Description of Artificial Sequence: Synthetic oligonucleotide
  Target: ATXN1; (-) strand; PAM type: YTN; PAM sequence: TTT
ttatttctgctaaaaagtca

SEQ ID NO: 178999 - DNA, 20 bp, Artificial Sequence
  Description of Artificial Sequence: Synthetic oligonucleotide
  Target: ATXN1; (-) strand; PAM type: YTN; PAM sequence: TTA
aaaaatggagaaaaaataaa

SEQ ID NO: 179000 - DNA, 20 bp, Artificial Sequence
  Description of Artificial Sequence: Synthetic oligonucleotide
  Target: ATXN1; (-) strand; PAM type: YTN; PAM sequence: TTG
gattaaaaaatggagaaaaa

SEQ ID NO: 179001 - DNA, 20 bp, Artificial Sequence
  Description of Artificial Sequence: Synthetic oligonucleotide
  Target: ATXN1; (-) strand; PAM type: YTN; PAM sequence: TTT
ggattaaaaaatggagaaaa

SEQ ID NO: 179002 - DNA, 20 bp, Artificial Sequence
  Description of Artificial Sequence: Synthetic oligonucleotide
  Target: ATXN1; (-) strand; PAM type: YTN; PAM sequence: TTT
tggattaaaaaatggagaaa

SEQ ID NO: 179003 - DNA, 20 bp, Artificial Sequence
  Description of Artificial Sequence: Synthetic oligonucleotide
  Target: ATXN1; (-) strand; PAM type: YTN; PAM sequence: TTG
taatattttggattaaaaaa

SEQ ID NO: 179004 - DNA, 20 bp, Artificial Sequence
  Description of Artificial Sequence: Synthetic oligonucleotide
  Target: ATXN1; (-) strand; PAM type: YTN; PAM sequence: TTA
tgtgttgtaatattttggat

SEQ ID NO: 179005 - DNA, 20 bp, Artificial Sequence
  Description of Artificial Sequence: Synthetic oligonucleotide
  Target: ATXN1; (-) strand; PAM type: YTN; PAM sequence: CTA
ttatgtgttgtaatattttg

SEQ ID NO: 179006 - DNA, 20 bp, Artificial Sequence
  Description of Artificial Sequence: Synthetic oligonucleotide
  Target: ATXN1; (-) strand; PAM type: YTN; PAM sequence: CTG
tgtcctattatgtgttgtaa

SEQ ID NO: 179007 - DNA, 20 bp, Artificial Sequence
  Description of Artificial Sequence: Synthetic oligonucleotide
  Target: ATXN1; (-) strand; PAM type: YTN; PAM sequence: TTC
agtatctgtgtcctattatg

SEQ ID NO: 179008 - DNA, 20 bp, Artificial Sequence
  Description of Artificial Sequence: Synthetic oligonucleotide
  Target: ATXN1; (-) strand; PAM type: YTN; PAM sequence: TTT
cagtatctgtgtcctattat

SEQ ID NO: 179009 - DNA, 20 bp, Artificial Sequence
  Description of Artificial Sequence: Synthetic oligonucleotide
  Target: ATXN1; (-) strand; PAM type: YTN; PAM sequence: TTA
tttcagtatctgtgtcctat

SEQ ID NO: 179010 - DNA, 20 bp, Artificial Sequence
  Description of Artificial Sequence: Synthetic oligonucleotide
  Target: ATXN1; (-) strand; PAM type: YTN; PAM sequence: CTA
aatgtattatttcagtatct

SEQ ID NO: 179011 - DNA, 20 bp, Artificial Sequence
  Description of Artificial Sequence: Synthetic oligonucleotide
  Target: ATXN1; (-) strand; PAM type: YTN; PAM sequence: CTG
gcactaaatgtattatttca

SEQ ID NO: 179012 - DNA, 20 bp, Artificial Sequence
  Description of Artificial Sequence: Synthetic oligonucleotide
  Target: ATXN1; (-) strand; PAM type: YTN; PAM sequence: CTC
aaagctggcactaaatgtat

SEQ ID NO: 179013 - DNA, 20 bp, Artificial Sequence
  Description of Artificial Sequence: Synthetic oligonucleotide
  Target: ATXN1; (-) strand; PAM type: YTN; PAM sequence: CTG
actcaaagctggcactaaat

SEQ ID NO: 179014 - DNA, 20 bp, Artificial Sequence
  Description of Artificial Sequence: Synthetic oligonucleotide
  Target: ATXN1; (-) strand; PAM type: YTN; PAM sequence: TTG
acagcaatgaaacctgactc

SEQ ID NO: 179015 - DNA, 20 bp, Artificial Sequence
  Description of Artificial Sequence: Synthetic oligonucleotide
  Target: ATXN1; (-) strand; PAM type: YTN; PAM sequence: CTT
gacagcaatgaaacctgact

SEQ ID NO: 179016 - DNA, 20 bp, Artificial Sequence
  Description of Artificial Sequence: Synthetic oligonucleotide
  Target: ATXN1; (-) strand; PAM type: YTN; PAM sequence: CTC
ttgacagcaatgaaacctga

SEQ ID NO: 179017 - DNA, 20 bp, Artificial Sequence
  Description of Artificial Sequence: Synthetic oligonucleotide
  Target: ATXN1; (-) strand; PAM type: YTN; PAM sequence: TTC
tcttgacagcaatgaaacct

SEQ ID NO: 179018 - DNA, 20 bp, Artificial Sequence
  Description of Artificial Sequence: Synthetic oligonucleotide
  Target: ATXN1; (-) strand; PAM type: YTN; PAM sequence: TTT
ctcttgacagcaatgaaacc

SEQ ID NO: 179019 - DNA, 20 bp, Artificial Sequence
  Description of Artificial Sequence: Synthetic oligonucleotide
  Target: ATXN1; (-) strand; PAM type: YTN; PAM sequence: CTT
tctcttgacagcaatgaaac

SEQ ID NO: 179020 - DNA, 20 bp, Artificial Sequence
  Description of Artificial Sequence: Synthetic oligonucleotide
  Target: ATXN1; (-) strand; PAM type: YTN; PAM sequence: TTA
cctttctcttgacagcaatg

SEQ ID NO: 179021 - DNA, 20 bp, Artificial Sequence
  Description of Artificial Sequence: Synthetic oligonucleotide
  Target: ATXN1; (-) strand; PAM type: YTN; PAM sequence: TTT
acctttctcttgacagcaat

SEQ ID NO: 179022 - DNA, 20 bp, Artificial Sequence
  Description of Artificial Sequence: Synthetic oligonucleotide
  Target: ATXN1; (-) strand; PAM type: YTN; PAM sequence: CTT
tacctttctcttgacagcaa

SEQ ID NO: 179023 - DNA, 20 bp, Artificial Sequence
  Description of Artificial Sequence: Synthetic oligonucleotide
  Target: ATXN1; (-) strand; PAM type: YTN; PAM sequence: TTG
aacatcacctttacctttct

SEQ ID NO: 179024 - DNA, 20 bp, Artificial Sequence
  Description of Artificial Sequence: Synthetic oligonucleotide
  Target: ATXN1; (-) strand; PAM type: YTN; PAM sequence: CTA
caagggagatggattgaaca

SEQ ID NO: 179025 - DNA, 20 bp, Artificial Sequence
  Description of Artificial Sequence: Synthetic oligonucleotide
  Target: ATXN1; (-) strand; PAM type: YTN; PAM sequence: CTG
tctacaagggagatggattg

SEQ ID NO: 179026 - DNA, 20 bp, Artificial Sequence
  Description of Artificial Sequence: Synthetic oligonucleotide
  Target: ATXN1; (-) strand; PAM type: YTN; PAM sequence: TTA
ctgtctacaagggagatgga

SEQ ID NO: 179027 - DNA, 20 bp, Artificial Sequence
  Description of Artificial Sequence: Synthetic oligonucleotide
  Target: ATXN1; (-) strand; PAM type: YTN; PAM sequence: TTT
actgtctacaagggagatgg

SEQ ID NO: 179028 - DNA, 20 bp, Artificial Sequence
  Description of Artificial Sequence: Synthetic oligonucleotide
  Target: ATXN1; (-) strand; PAM type: YTN; PAM sequence: TTA
aaatttactgtctacaaggg

SEQ ID NO: 179029 - DNA, 20 bp, Artificial Sequence
  Description of Artificial Sequence: Synthetic oligonucleotide
  Target: ATXN1; (-) strand; PAM type: YTN; PAM sequence: CTA
attaaaatttactgtctaca

SEQ ID NO: 179030 - DNA, 20 bp, Artificial Sequence
  Description of Artificial Sequence: Synthetic oligonucleotide
  Target: ATXN1; (-) strand; PAM type: YTN; PAM sequence: TTA
aaactaattaaaatttactg

SEQ ID NO: 179031 - DNA, 20 bp, Artificial Sequence
  Description of Artificial Sequence: Synthetic oligonucleotide
  Target: ATXN1; (-) strand; PAM type: YTN; PAM sequence: CTA
attaaaactaattaaaattt

SEQ ID NO: 179032 - DNA, 20 bp, Artificial Sequence
  Description of Artificial Sequence: Synthetic oligonucleotide
  Target: ATXN1; (-) strand; PAM type: YTN; PAM sequence: TTC
taattaaaactaattaaaat

SEQ ID NO: 179033 - DNA, 20 bp, Artificial Sequence
  Description of Artificial Sequence: Synthetic oligonucleotide
  Target: ATXN1; (-) strand; PAM type: YTN; PAM sequence: TTT
ctaattaaaactaattaaaa

SEQ ID NO: 179034 - DNA, 20 bp, Artificial Sequence
  Description of Artificial Sequence: Synthetic oligonucleotide
  Target: ATXN1; (-) strand; PAM type: YTN; PAM sequence: CTC
atttctaattaaaactaatt

SEQ ID NO: 179035 - DNA, 20 bp, Artificial Sequence
  Description of Artificial Sequence: Synthetic oligonucleotide
  Target: ATXN1; (-) strand; PAM type: YTN; PAM sequence: TTC
tcatttctaattaaaactaa

SEQ ID NO: 179036 - DNA, 20 bp, Artificial Sequence
  Description of Artificial Sequence: Synthetic oligonucleotide
  Target: ATXN1; (-) strand; PAM type: YTN; PAM sequence: CTT
ctcatttctaattaaaacta

SEQ ID NO: 179037 - DNA, 20 bp, Artificial Sequence
  Description of Artificial Sequence: Synthetic oligonucleotide
  Target: ATXN1; (-) strand; PAM type: YTN; PAM sequence: TTG
tagagatgaggtgtaggact

SEQ ID NO: 179038 - DNA, 20 bp, Artificial Sequence
  Description of Artificial Sequence: Synthetic oligonucleotide
  Target: ATXN1; (-) strand; PAM type: YTN; PAM sequence: CTT
gtagagatgaggtgtaggac

SEQ ID NO: 179039 - DNA, 20 bp, Artificial Sequence
  Description of Artificial Sequence: Synthetic oligonucleotide
  Target: ATXN1; (-) strand; PAM type: YTN; PAM sequence: TTC
aggagacttgtagagatgag

SEQ ID NO: 179040 - DNA, 20 bp, Artificial Sequence
  Description of Artificial Sequence: Synthetic oligonucleotide
  Target: ATXN1; (-) strand; PAM type: YTN; PAM sequence: TTT
caggagacttgtagagatga

SEQ ID NO: 179041 - DNA, 20 bp, Artificial Sequence
  Description of Artificial Sequence: Synthetic oligonucleotide
  Target: ATXN1; (-) strand; PAM type: YTN; PAM sequence: TTG
gtatgtttcaggagacttgt

SEQ ID NO: 179042 - DNA, 20 bp, Artificial Sequence
  Description of Artificial Sequence: Synthetic oligonucleotide
  Target: ATXN1; (-) strand; PAM type: YTN; PAM sequence: CTT
ggtatgtttcaggagacttg

SEQ ID NO: 179043 - DNA, 20 bp, Artificial Sequence
  Description of Artificial Sequence: Synthetic oligonucleotide
  Target: ATXN1; (-) strand; PAM type: YTN; PAM sequence: CTA
cagaaagacaatatcttggt

SEQ ID NO: 179044 - DNA, 20 bp, Artificial Sequence
  Description of Artificial Sequence: Synthetic oligonucleotide
  Target: ATXN1; (-) strand; PAM type: YTN; PAM sequence: CTG
agtctacagaaagacaatat

SEQ ID NO: 179045 - DNA, 20 bp, Artificial Sequence
  Description of Artificial Sequence: Synthetic oligonucleotide
  Target: ATXN1; (-) strand; PAM type: YTN; PAM sequence: CTC
tgagtctacagaaagacaat

SEQ ID NO: 179046 - DNA, 20 bp, Artificial Sequence
  Description of Artificial Sequence: Synthetic oligonucleotide
  Target: ATXN1; (-) strand; PAM type: YTN; PAM sequence: TTA
tacgtgctctgagtctacag

SEQ ID NO: 179047 - DNA, 20 bp, Artificial Sequence
  Description of Artificial Sequence: Synthetic oligonucleotide
  Target: ATXN1; (-) strand; PAM type: YTN; PAM sequence: CTG
attatacgtgctctgagtct

SEQ ID NO: 179048 - DNA, 20 bp, Artificial Sequence
  Description of Artificial Sequence: Synthetic oligonucleotide
  Target: ATXN1; (-) strand; PAM type: YTN; PAM sequence: TTA
tctgattatacgtgctctga

SEQ ID NO: 179049 - DNA, 20 bp, Artificial Sequence
  Description of Artificial Sequence: Synthetic oligonucleotide
  Target: ATXN1; (-) strand; PAM type: YTN; PAM sequence: TTG
gataaaatatacaatataaa

SEQ ID NO: 179050 - DNA, 20 bp, Artificial Sequence
  Description of Artificial Sequence: Synthetic oligonucleotide
  Target: ATXN1; (-) strand; PAM type: YTN; PAM sequence: CTT
ggataaaatatacaatataa

SEQ ID NO: 179051 - DNA, 20 bp, Artificial Sequence
  Description of Artificial Sequence: Synthetic oligonucleotide
  Target: ATXN1; (-) strand; PAM type: YTN; PAM sequence: TTC
ttggataaaatatacaatat

SEQ ID NO: 179052 - DNA, 20 bp, Artificial Sequence
  Description of Artificial Sequence: Synthetic oligonucleotide
  Target: ATXN1; (-) strand; PAM type: YTN; PAM sequence: TTA
taggtataaatcattcttgg

SEQ ID NO: 179053 - DNA, 20 bp, Artificial Sequence
  Description of Artificial Sequence: Synthetic oligonucleotide
  Target: ATXN1; (-) strand; PAM type: YTN; PAM sequence: TTT
ataggtataaatcattcttg

SEQ ID NO: 179054 - DNA, 20 bp, Artificial Sequence
  Description of Artificial Sequence: Synthetic oligonucleotide
  Target: ATXN1; (-) strand; PAM type: YTN; PAM sequence: CTG
gatttataggtataaatcat

SEQ ID NO: 179055 - DNA, 20 bp, Artificial Sequence
  Description of Artificial Sequence: Synthetic oligonucleotide
  Target: ATXN1; (-) strand; PAM type: YTN; PAM sequence: CTG
gctggatttataggtataaa

SEQ ID NO: 179056 - DNA, 20 bp, Artificial Sequence
  Description of Artificial Sequence: Synthetic oligonucleotide
  Target: ATXN1; (-) strand; PAM type: YTN; PAM sequence: CTC
ctggctggatttataggtat

SEQ ID NO: 179057 - DNA, 20 bp, Artificial Sequence
  Description of Artificial Sequence: Synthetic oligonucleotide
  Target: ATXN1; (-) strand; PAM type: YTN; PAM sequence: CTG
agatcctcctggctggattt

SEQ ID NO: 179058 - DNA, 20 bp, Artificial Sequence
  Description of Artificial Sequence: Synthetic oligonucleotide
  Target: ATXN1; (-) strand; PAM type: YTN; PAM sequence: TTC
tgagatcctcctggctggat

SEQ ID NO: 179059 - DNA, 20 bp, Artificial Sequence
  Description of Artificial Sequence: Synthetic oligonucleotide
  Target: ATXN1; (-) strand; PAM type: YTN; PAM sequence: TTA
ttctgagatcctcctggctg

SEQ ID NO: 179060 - DNA, 20 bp, Artificial Sequence
  Description of Artificial Sequence: Synthetic oligonucleotide
  Target: ATXN1; (-) strand; PAM type: YTN; PAM sequence: CTC
ataaatattattctgagatc

SEQ ID NO: 179061 - DNA, 20 bp, Artificial Sequence
  Description of Artificial Sequence: Synthetic oligonucleotide
  Target: ATXN1; (-) strand; PAM type: YTN; PAM sequence: CTA
tctcataaatattattctga

SEQ ID NO: 179062 - DNA, 20 bp, Artificial Sequence
  Description of Artificial Sequence: Synthetic oligonucleotide
  Target: ATXN1; (-) strand; PAM type: YTN; PAM sequence: TTC
agtctatctcataaatatta

SEQ ID NO: 179063 - DNA, 20 bp, Artificial Sequence
  Description of Artificial Sequence: Synthetic oligonucleotide
  Target: ATXN1; (-) strand; PAM type: YTN; PAM sequence: TTT
cagtctatctcataaatatt

SEQ ID NO: 179064 - DNA, 20 bp, Artificial Sequence
  Description of Artificial Sequence: Synthetic oligonucleotide
  Target: ATXN1; (-) strand; PAM type: YTN; PAM sequence: TTA
aatttcagtctatctcataa

SEQ ID NO: 179065 - DNA, 20 bp, Artificial Sequence
  Description of Artificial Sequence: Synthetic oligonucleotide
  Target: ATXN1; (-) strand; PAM type: YTN; PAM sequence: CTA
ttaaatttcagtctatctca

SEQ ID NO: 179066 - DNA, 20 bp, Artificial Sequence
  Description of Artificial Sequence: Synthetic oligonucleotide
  Target: ATXN1; (-) strand; PAM type: YTN; PAM sequence: TTG
ctattaaatttcagtctatc

SEQ ID NO: 179067 - DNA, 20 bp, Artificial Sequence
  Description of Artificial Sequence: Synthetic oligonucleotide
  Target: ATXN1; (-) strand; PAM type: YTN; PAM sequence: TTA
agaagtgttgctattaaatt

SEQ ID NO: 179068 - DNA, 20 bp, Artificial Sequence
  Description of Artificial Sequence: Synthetic oligonucleotide
  Target: ATXN1; (-) strand; PAM type: YTN; PAM sequence: CTT
aagaagtgttgctattaaat

SEQ ID NO: 179069 - DNA, 20 bp, Artificial Sequence
  Description of Artificial Sequence: Synthetic oligonucleotide
  Target: ATXN1; (-) strand; PAM type: YTN; PAM sequence: CTA
cttaagaagtgttgctatta

SEQ ID NO: 179070 - DNA, 20 bp, Artificial Sequence
  Description of Artificial Sequence: Synthetic oligonucleotide
  Target: ATXN1; (-) strand; PAM type: YTN; PAM sequence: TTG
atagtccatctacttaagaa

SEQ ID NO: 179071 - DNA, 20 bp, Artificial Sequence
  Description of Artificial Sequence: Synthetic oligonucleotide
  Target: ATXN1; (-) strand; PAM type: YTN; PAM sequence: CTT
gatagtccatctacttaaga

SEQ ID NO: 179072 - DNA, 20 bp, Artificial Sequence
  Description of Artificial Sequence: Synthetic oligonucleotide
  Target: ATXN1; (-) strand; PAM type: YTN; PAM sequence: TTC
ttgatagtccatctacttaa

SEQ ID NO: 179073 - DNA, 20 bp, Artificial Sequence
  Description of Artificial Sequence: Synthetic oligonucleotide
  Target: ATXN1; (-) strand; PAM type: YTN; PAM sequence: TTT
cttgatagtccatctactta

SEQ ID NO: 179074 - DNA, 20 bp, Artificial Sequence
  Description of Artificial Sequence: Synthetic oligonucleotide
  Target: ATXN1; (-) strand; PAM type: YTN; PAM sequence: TTA
agagtttcttgatagtccat

SEQ ID NO: 179075 - DNA, 20 bp, Artificial Sequence
  Description of Artificial Sequence: Synthetic oligonucleotide
  Target: ATXN1; (-) strand; PAM type: YTN; PAM sequence: TTT
aagagtttcttgatagtcca

SEQ ID NO: 179076 - DNA, 20 bp, Artificial Sequence
  Description of Artificial Sequence: Synthetic oligonucleotide
  Target: ATXN1; (-) strand; PAM type: YTN; PAM sequence: TTT
taagagtttcttgatagtcc

SEQ ID NO: 179077 - DNA, 20 bp, Artificial Sequence
  Description of Artificial Sequence: Synthetic oligonucleotide
  Target: ATXN1; (-) strand; PAM type: YTN; PAM sequence: TTA
ttttaagagtttcttgatag

SEQ ID NO: 179078 - DNA, 20 bp, Artificial Sequence
  Description of Artificial Sequence: Synthetic oligonucleotide
  Target: ATXN1; (-) strand; PAM type: YTN; PAM sequence: CTG
ttattttaagagtttcttga

SEQ ID NO: 179079 - DNA, 20 bp, Artificial Sequence
  Description of Artificial Sequence: Synthetic oligonucleotide
  Target: ATXN1; (-) strand; PAM type: YTN; PAM sequence: TTC
tgttattttaagagtttctt

SEQ ID NO: 179080 - DNA, 20 bp, Artificial Sequence
  Description of Artificial Sequence: Synthetic oligonucleotide
  Target: ATXN1; (-) strand; PAM type: YTN; PAM sequence: TTC
attctgttattttaagagtt

SEQ ID NO: 179081 - DNA, 20 bp, Artificial Sequence
  Description of Artificial Sequence: Synthetic oligonucleotide
  Target: ATXN1; (-) strand; PAM type: YTN; PAM sequence: TTT
cattctgttattttaagagt

SEQ ID NO: 179082 - DNA, 20 bp, Artificial Sequence
  Description of Artificial Sequence: Synthetic oligonucleotide
  Target: ATXN1; (-) strand; PAM type: YTN; PAM sequence: TTT
tcattctgttattttaagag

SEQ ID NO: 179083 - DNA, 20 bp, Artificial Sequence
  Description of Artificial Sequence: Synthetic oligonucleotide
  Target: ATXN1; (-) strand; PAM type: YTN; PAM sequence: TTT
ttcattctgttattttaaga

SEQ ID NO: 179084 - DNA, 20 bp, Artificial Sequence
  Description of Artificial Sequence: Synthetic oligonucleotide
  Target: ATXN1; (-) strand; PAM type: YTN; PAM sequence: TTA
tttttcattctgttatttta

SEQ ID NO: 179085 - DNA, 20 bp, Artificial Sequence
  Description of Artificial Sequence: Synthetic oligonucleotide
  Target: ATXN1; (-) strand; PAM type: YTN; PAM sequence: CTT
atttttcattctgttatttt

SEQ ID NO: 179086 - DNA, 20 bp, Artificial Sequence
  Description of Artificial Sequence: Synthetic oligonucleotide
  Target: ATXN1; (-) strand; PAM type: YTN; PAM sequence: CTA
ccttatttttcattctgtta

SEQ ID NO: 179087 - DNA, 20 bp, Artificial Sequence
  Description of Artificial Sequence: Synthetic oligonucleotide
  Target: ATXN1; (-) strand; PAM type: YTN; PAM sequence: TTA
tatacagagccactacctta

SEQ ID NO: 179088 - DNA, 20 bp, Artificial Sequence
  Description of Artificial Sequence: Synthetic oligonucleotide
  Target: ATXN1; (-) strand; PAM type: YTN; PAM sequence: CTT
atatacagagccactacctt

SEQ ID NO: 179089 - DNA, 20 bp, Artificial Sequence
  Description of Artificial Sequence: Synthetic oligonucleotide
  Target: ATXN1; (-) strand; PAM type: YTN; PAM sequence: CTG
acggggcttatatacagagc

SEQ ID NO: 179090 - DNA, 20 bp, Artificial Sequence
  Description of Artificial Sequence: Synthetic oligonucleotide
  Target: ATXN1; (-) strand; PAM type: YTN; PAM sequence: CTG
gctgacggggcttatataca

SEQ ID NO: 179091 - DNA, 20 bp, Artificial Sequence
  Description of Artificial Sequence: Synthetic oligonucleotide
  Target: ATXN1; (-) strand; PAM type: YTN; PAM sequence: CTC
ccgtgtactggctgacgggg

SEQ ID NO: 179092 - DNA, 20 bp, Artificial Sequence
  Description of Artificial Sequence: Synthetic oligonucleotide
  Target: ATXN1; (-) strand; PAM type: YTN; PAM sequence: TTG
atcgagtacctcccgtgtac

SEQ ID NO: 179093 - DNA, 20 bp, Artificial Sequence
  Description of Artificial Sequence: Synthetic oligonucleotide
  Target: ATXN1; (-) strand; PAM type: YTN; PAM sequence: TTG
gcattgatcgagtacctccc

SEQ ID NO: 179094 - DNA, 20 bp, Artificial Sequence
  Description of Artificial Sequence: Synthetic oligonucleotide
  Target: ATXN1; (-) strand; PAM type: YTN; PAM sequence: TTT
ggcattgatcgagtacctcc

SEQ ID NO: 179095 - DNA, 20 bp, Artificial Sequence
  Description of Artificial Sequence: Synthetic oligonucleotide
  Target: ATXN1; (-) strand; PAM type: YTN; PAM sequence: TTC
atttggcattgatcgagtac

SEQ ID NO: 179096 - DNA, 20 bp, Artificial Sequence
  Description of Artificial Sequence: Synthetic oligonucleotide
  Target: ATXN1; (-) strand; PAM type: YTN; PAM sequence: CTT
catttggcattgatcgagta

SEQ ID NO: 179097 - DNA, 20 bp, Artificial Sequence
  Description of Artificial Sequence: Synthetic oligonucleotide
  Target: ATXN1; (-) strand; PAM type: YTN; PAM sequence: CTC
cttcatttggcattgatcga

SEQ ID NO: 179098 - DNA, 20 bp, Artificial Sequence
  Description of Artificial Sequence: Synthetic oligonucleotide
  Target: ATXN1; (-) strand; PAM type: YTN; PAM sequence: TTA
cgaagtcactccttcatttg

SEQ ID NO: 179099 - DNA, 20 bp, Artificial Sequence
  Description of Artificial Sequence: Synthetic oligonucleotide
  Target: ATXN1; (-) strand; PAM type: YTN; PAM sequence: CTT
acgaagtcactccttcattt

SEQ ID NO: 179100 - DNA, 20 bp, Artificial Sequence
  Description of Artificial Sequence: Synthetic oligonucleotide
  Target: ATXN1; (-) strand; PAM type: YTN; PAM sequence: CTC
ttacgaagtcactccttcat

SEQ ID NO: 179101 - DNA, 20 bp, Artificial Sequence
  Description of Artificial Sequence: Synthetic oligonucleotide
  Target: ATXN1; (-) strand; PAM type: YTN; PAM sequence: TTA
gtccctcttacgaagtcact

SEQ ID NO: 179102 - DNA, 20 bp, Artificial Sequence
  Description of Artificial Sequence: Synthetic oligonucleotide
  Target: ATXN1; (-) strand; PAM type: YTN; PAM sequence: CTT
agtccctcttacgaagtcac

SEQ ID NO: 179103 - DNA, 20 bp, Artificial Sequence
  Description of Artificial Sequence: Synthetic oligonucleotide
  Target: ATXN1; (-) strand; PAM type: YTN; PAM sequence: TTC
ttagtccctcttacgaagtc

SEQ ID NO: 179104 - DNA, 20 bp, Artificial Sequence
  Description of Artificial Sequence: Synthetic oligonucleotide
  Target: ATXN1; (-) strand; PAM type: YTN; PAM sequence: CTT
cttagtccctcttacgaagt

SEQ ID NO: 179105 - DNA, 20 bp, Artificial Sequence
  Description of Artificial Sequence: Synthetic oligonucleotide
  Target: ATXN1; (-) strand; PAM type: YTN; PAM sequence: TTG
cttcttagtccctcttacga

SEQ ID NO: 179106 - DNA, 20 bp, Artificial Sequence
  Description of Artificial Sequence: Synthetic oligonucleotide
  Target: ATXN1; (-) strand; PAM type: YTN; PAM sequence: TTG
aattgcttcttagtccctct

SEQ ID NO: 179107 - DNA, 20 bp, Artificial Sequence
  Description of Artificial Sequence: Synthetic oligonucleotide
  Target: ATXN1; (-) strand; PAM type: YTN; PAM sequence: CTT
gaattgcttcttagtccctc

SEQ ID NO: 179108 - DNA, 20 bp, Artificial Sequence
  Description of Artificial Sequence: Synthetic oligonucleotide
  Target: ATXN1; (-) strand; PAM type: YTN; PAM sequence: TTC
cagaatagcaacttgaattg

SEQ ID NO: 179109 - DNA, 20 bp, Artificial Sequence
  Description of Artificial Sequence: Synthetic oligonucleotide
  Target: ATXN1; (-) strand; PAM type: YTN; PAM sequence: TTA
cacaagagattccagaatag

SEQ ID NO: 179110 - DNA, 20 bp, Artificial Sequence
  Description of Artificial Sequence: Synthetic oligonucleotide
  Target: ATXN1; (-) strand; PAM type: YTN; PAM sequence: CTT
acacaagagattccagaata

SEQ ID NO: 179111 - DNA, 20 bp, Artificial Sequence
  Description of Artificial Sequence: Synthetic oligonucleotide
  Target: ATXN1; (-) strand; PAM type: YTN; PAM sequence: TTC
ccatcttacacaagagattc

SEQ ID NO: 179112 - DNA, 20 bp, Artificial Sequence
  Description of Artificial Sequence: Synthetic oligonucleotide
  Target: ATXN1; (-) strand; PAM type: YTN; PAM sequence: TTG
attcccatcttacacaagag

SEQ ID NO: 179113 - DNA, 20 bp, Artificial Sequence
  Description of Artificial Sequence: Synthetic oligonucleotide
  Target: ATXN1; (-) strand; PAM type: YTN; PAM sequence: CTT
gattcccatcttacacaaga

SEQ ID NO: 179114 - DNA, 20 bp, Artificial Sequence
  Description of Artificial Sequence: Synthetic oligonucleotide
  Target: ATXN1; (-) strand; PAM type: YTN; PAM sequence: TTA
gacttgattcccatcttaca

SEQ ID NO: 179115 - DNA, 20 bp, Artificial Sequence
  Description of Artificial Sequence: Synthetic oligonucleotide
  Target: ATXN1; (-) strand; PAM type: YTN; PAM sequence: CTG
ttagacttgattcccatctt

SEQ ID NO: 179116 - DNA, 20 bp, Artificial Sequence
  Description of Artificial Sequence: Synthetic oligonucleotide
  Target: ATXN1; (-) strand; PAM type: YTN; PAM sequence: CTC
tgttagacttgattcccatc

SEQ ID NO: 179117 - DNA, 20 bp, Artificial Sequence
  Description of Artificial Sequence: Synthetic oligonucleotide
  Target: ATXN1; (-) strand; PAM type: YTN; PAM sequence: TTA
atgactctgttagacttgat

SEQ ID NO: 179118 - DNA, 20 bp, Artificial Sequence
  Description of Artificial Sequence: Synthetic oligonucleotide
  Target: ATXN1; (-) strand; PAM type: YTN; PAM sequence: CTA
ttaatgactctgttagactt

SEQ ID NO: 179119 - DNA, 20 bp, Artificial Sequence
  Description of Artificial Sequence: Synthetic oligonucleotide
  Target: ATXN1; (-) strand; PAM type: YTN; PAM sequence: TTC
tattaatgactctgttagac

SEQ ID NO: 179120 - DNA, 20 bp, Artificial Sequence
  Description of Artificial Sequence: Synthetic oligonucleotide
  Target: ATXN1; (-) strand; PAM type: YTN; PAM sequence: TTA
aattctattaatgactctgt

SEQ ID NO: 179121 - DNA, 20 bp, Artificial Sequence
  Description of Artificial Sequence: Synthetic oligonucleotide
  Target: ATXN1; (-) strand; PAM type: YTN; PAM sequence: TTA
ttaaattctattaatgactc

SEQ ID NO: 179122 - DNA, 20 bp, Artificial Sequence
  Description of Artificial Sequence: Synthetic oligonucleotide
  Target: ATXN1; (-) strand; PAM type: YTN; PAM sequence: CTT
attaaattctattaatgact

SEQ ID NO: 179123 - DNA, 20 bp, Artificial Sequence
  Description of Artificial Sequence: Synthetic oligonucleotide
  Target: ATXN1; (-) strand; PAM type: YTN; PAM sequence: TTC
cttattaaattctattaatg

SEQ ID NO: 179124 - DNA, 20 bp, Artificial Sequence
  Description of Artificial Sequence: Synthetic oligonucleotide
  Target: ATXN1; (-) strand; PAM type: YTN; PAM sequence: TTT
ccttattaaattctattaat

SEQ ID NO: 179125 - DNA, 20 bp, Artificial Sequence
  Description of Artificial Sequence: Synthetic oligonucleotide
  Target: ATXN1; (-) strand; PAM type: YTN; PAM sequence: CTT
tccttattaaattctattaa

SEQ ID NO: 179126 - DNA, 20 bp, Artificial Sequence
  Description of Artificial Sequence: Synthetic oligonucleotide
  Target: ATXN1; (-) strand; PAM type: YTN; PAM sequence: TTG
gaagctttccttattaaatt

SEQ ID NO: 179127 - DNA, 20 bp, Artificial Sequence
  Description of Artificial Sequence: Synthetic oligonucleotide
  Target: ATXN1; (-) strand; PAM type: YTN; PAM sequence: TTT
ggaagctttccttattaaat

SEQ ID NO: 179128 - DNA, 20 bp, Artificial Sequence
  Description of Artificial Sequence: Synthetic oligonucleotide
  Target: ATXN1; (-) strand; PAM type: YTN; PAM sequence: TTT
tggaagctttccttattaaa

SEQ ID NO: 179129 - DNA, 20 bp, Artificial Sequence
  Description of Artificial Sequence: Synthetic oligonucleotide
  Target: ATXN1; (-) strand; PAM type: YTN; PAM sequence: CTT
ttggaagctttccttattaa

SEQ ID NO: 179130 - DNA, 20 bp, Artificial Sequence
  Description of Artificial Sequence: Synthetic oligonucleotide
  Target: ATXN1; (-) strand; PAM type: YTN; PAM sequence: CTC
ttttggaagctttccttatt

SEQ ID NO: 179131 - DNA, 20 bp, Artificial Sequence
  Description of Artificial Sequence: Synthetic oligonucleotide
  Target: ATXN1; (-) strand; PAM type: YTN; PAM sequence: TTC
ctcttttggaagctttcctt

SEQ ID NO: 179132 - DNA, 20 bp, Artificial Sequence
  Description of Artificial Sequence: Synthetic oligonucleotide
  Target: ATXN1; (-) strand; PAM type: YTN; PAM sequence: TTT
cctcttttggaagctttcct

SEQ ID NO: 179133 - DNA, 20 bp, Artificial Sequence
  Description of Artificial Sequence: Synthetic oligonucleotide
  Target: ATXN1; (-) strand; PAM type: YTN; PAM sequence: TTG
gagtttcctcttttggaagc

SEQ ID NO: 179134 - DNA, 20 bp, Artificial Sequence
  Description of Artificial Sequence: Synthetic oligonucleotide
  Target: ATXN1; (-) strand; PAM type: YTN; PAM sequence: TTT
ggagtttcctcttttggaag

SEQ ID NO: 179135 - DNA, 20 bp, Artificial Sequence
  Description of Artificial Sequence: Synthetic oligonucleotide
  Target: ATXN1; (-) strand; PAM type: YTN; PAM sequence: CTT
tggagtttcctcttttggaa

SEQ ID NO: 179136 - DNA, 20 bp, Artificial Sequence
  Description of Artificial Sequence: Synthetic oligonucleotide
  Target: ATXN1; (-) strand; PAM type: YTN; PAM sequence: TTC
agtaatgaaagggtaacttt

SEQ ID NO: 179137 - DNA, 20 bp, Artificial Sequence
  Description of Artificial Sequence: Synthetic oligonucleotide
  Target: ATXN1; (-) strand; PAM type: YTN; PAM sequence: CTG
agaaattcagtaatgaaagg

SEQ ID NO: 179138 - DNA, 20 bp, Artificial Sequence
  Description of Artificial Sequence: Synthetic oligonucleotide
  Target: ATXN1; (-) strand; PAM type: YTN; PAM sequence: CTG
agaatctgagaaattcagta

SEQ ID NO: 179139 - DNA, 20 bp, Artificial Sequence
  Description of Artificial Sequence: Synthetic oligonucleotide
  Target: ATXN1; (-) strand; PAM type: YTN; PAM sequence: TTA
gatccactgagaatctgaga

SEQ ID NO: 179140 - DNA, 20 bp, Artificial Sequence
  Description of Artificial Sequence: Synthetic oligonucleotide
  Target: ATXN1; (-) strand; PAM type: YTN; PAM sequence: TTT
agatccactgagaatctgag

SEQ ID NO: 179141 - DNA, 20 bp, Artificial Sequence
  Description of Artificial Sequence: Synthetic oligonucleotide
  Target: ATXN1; (-) strand; PAM type: YTN; PAM sequence: TTA
aatttagatccactgagaat

SEQ ID NO: 179142 - DNA, 20 bp, Artificial Sequence
  Description of Artificial Sequence: Synthetic oligonucleotide
  Target: ATXN1; (-) strand; PAM type: YTN; PAM sequence: TTT
aaatttagatccactgagaa

SEQ ID NO: 179143 - DNA, 20 bp, Artificial Sequence
  Description of Artificial Sequence: Synthetic oligonucleotide
  Target: ATXN1; (-) strand; PAM type: YTN; PAM sequence: CTG
tgcagtttaaatttagatcc

SEQ ID NO: 179144 - DNA, 20 bp, Artificial Sequence
  Description of Artificial Sequence: Synthetic oligonucleotide
  Target: ATXN1; (-) strand; PAM type: YTN; PAM sequence: TTC
ctgtgcagtttaaatttaga

SEQ ID NO: 179145 - DNA, 20 bp, Artificial Sequence
  Description of Artificial Sequence: Synthetic oligonucleotide
  Target: ATXN1; (-) strand; PAM type: YTN; PAM sequence: TTT
cctgtgcagtttaaatttag

SEQ ID NO: 179146 - DNA, 20 bp, Artificial Sequence
  Description of Artificial Sequence: Synthetic oligonucleotide
  Target: ATXN1; (-) strand; PAM type: YTN; PAM sequence: TTG
tttcctgtgcagtttaaatt

SEQ ID NO: 179147 - DNA, 20 bp, Artificial Sequence
  Description of Artificial Sequence: Synthetic oligonucleotide
  Target: ATXN1; (-) strand; PAM type: YTN; PAM sequence: CTT
gtttcctgtgcagtttaaat

SEQ ID NO: 179148 - DNA, 20 bp, Artificial Sequence
  Description of Artificial Sequence: Synthetic oligonucleotide
  Target: ATXN1; (-) strand; PAM type: YTN; PAM sequence: TTG
acaaagggccttgtttcctg

SEQ ID NO: 179149 - DNA, 20 bp, Artificial Sequence
  Description of Artificial Sequence: Synthetic oligonucleotide
  Target: ATXN1; (-) strand; PAM type: YTN; PAM sequence: TTT
gacaaagggccttgtttcct

SEQ ID NO: 179150 - DNA, 20 bp, Artificial Sequence
  Description of Artificial Sequence: Synthetic oligonucleotide
  Target: ATXN1; (-) strand; PAM type: YTN; PAM sequence: TTT
tgacaaagggccttgtttcc

SEQ ID NO: 179151 - DNA, 20 bp, Artificial Sequence
  Description of Artificial Sequence: Synthetic oligonucleotide
  Target: ATXN1; (-) strand; PAM type: YTN; PAM sequence: CTT
ttgacaaagggccttgtttc

SEQ ID NO: 179152 - DNA, 20 bp, Artificial Sequence
  Description of Artificial Sequence: Synthetic oligonucleotide
  Target: ATXN1; (-) strand; PAM type: YTN; PAM sequence: TTA
gcaccttttgacaaagggcc

SEQ ID NO: 179153 - DNA, 20 bp, Artificial Sequence
  Description of Artificial Sequence: Synthetic oligonucleotide
  Target: ATXN1; (-) strand; PAM type: YTN; PAM sequence: TTT
agcaccttttgacaaagggc

SEQ ID NO: 179154 - DNA, 20 bp, Artificial Sequence
  Description of Artificial Sequence: Synthetic oligonucleotide
  Target: ATXN1; (-) strand; PAM type: YTN; PAM sequence: TTA
gatttagcaccttttgacaa

SEQ ID NO: 179155 - DNA, 20 bp, Artificial Sequence
  Description of Artificial Sequence: Synthetic oligonucleotide
  Target: ATXN1; (-) strand; PAM type: YTN; PAM sequence: TTA
tagtgtaggttagatttagc

SEQ ID NO: 179156 - DNA, 20 bp, Artificial Sequence
  Description of Artificial Sequence: Synthetic oligonucleotide
  Target: ATXN1; (-) strand; PAM type: YTN; PAM sequence: CTT
atagtgtaggttagatttag

SEQ ID NO: 179157 - DNA, 20 bp, Artificial Sequence
  Description of Artificial Sequence: Synthetic oligonucleotide
  Target: ATXN1; (-) strand; PAM type: YTN; PAM sequence: TTC
ttatagtgtaggttagattt

SEQ ID NO: 179158 - DNA, 20 bp, Artificial Sequence
  Description of Artificial Sequence: Synthetic oligonucleotide
  Target: ATXN1; (-) strand; PAM type: YTN; PAM sequence: CTT
cttatagtgtaggttagatt

SEQ ID NO: 179159 - DNA, 20 bp, Artificial Sequence
  Description of Artificial Sequence: Synthetic oligonucleotide
  Target: ATXN1; (-) strand; PAM type: YTN; PAM sequence: TTC
ataacatggaacacaggatg

SEQ ID NO: 179160 - DNA, 20 bp, Artificial Sequence
  Description of Artificial Sequence: Synthetic oligonucleotide
  Target: ATXN1; (-) strand; PAM type: YTN; PAM sequence: CTT
cataacatggaacacaggat

SEQ ID NO: 179161 - DNA, 20 bp, Artificial Sequence
  Description of Artificial Sequence: Synthetic oligonucleotide
  Target: ATXN1; (-) strand; PAM type: YTN; PAM sequence: TTG
gaggcccttcataacatgga

SEQ ID NO: 179162 - DNA, 20 bp, Artificial Sequence
  Description of Artificial Sequence: Synthetic oligonucleotide
  Target: ATXN1; (-) strand; PAM type: YTN; PAM sequence: CTT
ggaggcccttcataacatgg

SEQ ID NO: 179163 - DNA, 20 bp, Artificial Sequence
  Description of Artificial Sequence: Synthetic oligonucleotide
  Target: ATXN1; (-) strand; PAM type: YTN; PAM sequence: TTC
ttggaggcccttcataacat

SEQ ID NO: 179164 - DNA, 20 bp, Artificial Sequence
  Description of Artificial Sequence: Synthetic oligonucleotide
  Target: ATXN1; (-) strand; PAM type: YTN; PAM sequence: TTA
aattcttggaggcccttcat

SEQ ID NO: 179165 - DNA, 20 bp, Artificial Sequence
  Description of Artificial Sequence: Synthetic oligonucleotide
  Target: ATXN1; (-) strand; PAM type: YTN; PAM sequence: TTT
aaattcttggaggcccttca

SEQ ID NO: 179166 - DNA, 20 bp, Artificial Sequence
  Description of Artificial Sequence: Synthetic oligonucleotide
  Target: ATXN1; (-) strand; PAM type: YTN; PAM sequence: TTT
taaattcttggaggcccttc

SEQ ID NO: 179167 - DNA, 20 bp, Artificial Sequence
  Description of Artificial Sequence: Synthetic oligonucleotide
  Target: ATXN1; (-) strand; PAM type: YTN; PAM sequence: TTT
ttaaattcttggaggccctt

SEQ ID NO: 179168 - DNA, 20 bp, Artificial Sequence
  Description of Artificial Sequence: Synthetic oligonucleotide
  Target: ATXN1; (-) strand; PAM type: YTN; PAM sequence: CTT
tttaaattcttggaggccct

SEQ ID NO: 179169 - DNA, 20 bp, Artificial Sequence
  Description of Artificial Sequence: Synthetic oligonucleotide
  Target: ATXN1; (-) strand; PAM type: YTN; PAM sequence: TTG
tcctttttaaattcttggag

SEQ ID NO: 179170 - DNA, 20 bp, Artificial Sequence
  Description of Artificial Sequence: Synthetic oligonucleotide
  Target: ATXN1; (-) strand; PAM type: YTN; PAM sequence: TTT
gtcctttttaaattcttgga

SEQ ID NO: 179171 - DNA, 20 bp, Artificial Sequence
  Description of Artificial Sequence: Synthetic oligonucleotide
  Target: ATXN1; (-) strand; PAM type: YTN; PAM sequence: TTT
tgtcctttttaaattcttgg

SEQ ID NO: 179172 - DNA, 20 bp, Artificial Sequence
  Description of Artificial Sequence: Synthetic oligonucleotide
  Target: ATXN1; (-) strand; PAM type: YTN; PAM sequence: CTA
ttttgtcctttttaaattct

SEQ ID NO: 179173 - DNA, 20 bp, Artificial Sequence
  Description of Artificial Sequence: Synthetic oligonucleotide
  Target: ATXN1; (-) strand; PAM type: YTN; PAM sequence: TTC
tattttgtcctttttaaatt

SEQ ID NO: 179174 - DNA, 20 bp, Artificial Sequence
  Description of Artificial Sequence: Synthetic oligonucleotide
  Target: ATXN1; (-) strand; PAM type: YTN; PAM sequence: TTT
ctattttgtcctttttaaat

SEQ ID NO: 179175 - DNA, 20 bp, Artificial Sequence
  Description of Artificial Sequence: Synthetic oligonucleotide
  Target: ATXN1; (-) strand; PAM type: YTN; PAM sequence: TTT
tctattttgtcctttttaaa

SEQ ID NO: 179176 - DNA, 20 bp, Artificial Sequence
  Description of Artificial Sequence: Synthetic oligonucleotide
  Target: ATXN1; (-) strand; PAM type: YTN; PAM sequence: TTT
ttctattttgtcctttttaa

SEQ ID NO: 179177 - DNA, 20 bp, Artificial Sequence
  Description of Artificial Sequence: Synthetic oligonucleotide
  Target: ATXN1; (-) strand; PAM type: YTN; PAM sequence: CTT
tttctattttgtccttttta

SEQ ID NO: 179178 - DNA, 20 bp, Artificial Sequence
  Description of Artificial Sequence: Synthetic oligonucleotide
  Target: ATXN1; (-) strand; PAM type: YTN; PAM sequence: CTG
ctttttctattttgtccttt

SEQ ID NO: 179179 - DNA, 20 bp, Artificial Sequence
  Description of Artificial Sequence: Synthetic oligonucleotide
  Target: ATXN1; (-) strand; PAM type: YTN; PAM sequence: CTC
tgctttttctattttgtcct

SEQ ID NO: 179180 - DNA, 20 bp, Artificial Sequence
  Description of Artificial Sequence: Synthetic oligonucleotide
  Target: ATXN1; (-) strand; PAM type: YTN; PAM sequence: CTC
tctgctttttctattttgtc

SEQ ID NO: 179181 - DNA, 20 bp, Artificial Sequence
  Description of Artificial Sequence: Synthetic oligonucleotide
  Target: ATXN1; (-) strand; PAM type: YTN; PAM sequence: CTA
taaaggaactctctgctttt

SEQ ID NO: 179182 - DNA, 20 bp, Artificial Sequence
  Description of Artificial Sequence: Synthetic oligonucleotide
  Target: ATXN1; (-) strand; PAM type: YTN; PAM sequence: CTA
gatagtaatactataaagga

SEQ ID NO: 179183 - DNA, 20 bp, Artificial Sequence
  Description of Artificial Sequence: Synthetic oligonucleotide
  Target: ATXN1; (-) strand; PAM type: YTN; PAM sequence: TTA
gtagctagatagtaatacta

SEQ ID NO: 179184 - DNA, 20 bp, Artificial Sequence
  Description of Artificial Sequence: Synthetic oligonucleotide
  Target: ATXN1; (-) strand; PAM type: YTN; PAM sequence: TTT
agtagctagatagtaatact

SEQ ID NO: 179185 - DNA, 20 bp, Artificial Sequence
  Description of Artificial Sequence: Synthetic oligonucleotide
  Target: ATXN1; (-) strand; PAM type: YTN; PAM sequence: TTT
tagtagctagatagtaatac

SEQ ID NO: 179186 - DNA, 20 bp, Artificial Sequence
  Description of Artificial Sequence: Synthetic oligonucleotide
  Target: ATXN1; (-) strand; PAM type: YTN; PAM sequence: CTT
ttagtagctagatagtaata

SEQ ID NO: 179187 - DNA, 20 bp, Artificial Sequence
  Description of Artificial Sequence: Synthetic oligonucleotide
  Target: ATXN1; (-) strand; PAM type: YTN; PAM sequence: TTG
gcttttagtagctagatagt

SEQ ID NO: 179188 - DNA, 20 bp, Artificial Sequence
  Description of Artificial Sequence: Synthetic oligonucleotide
  Target: ATXN1; (-) strand; PAM type: YTN; PAM sequence: TTT
ggcttttagtagctagatag

SEQ ID NO: 179189 - DNA, 20 bp, Artificial Sequence
  Description of Artificial Sequence: Synthetic oligonucleotide
  Target: ATXN1; (-) strand; PAM type: YTN; PAM sequence: TTT
tggcttttagtagctagata

SEQ ID NO: 179190 - DNA, 20 bp, Artificial Sequence
  Description of Artificial Sequence: Synthetic oligonucleotide
  Target: ATXN1; (-) strand; PAM type: YTN; PAM sequence: TTT
ttggcttttagtagctagat

SEQ ID NO: 179191 - DNA, 20 bp, Artificial Sequence
  Description of Artificial Sequence: Synthetic oligonucleotide
  Target: ATXN1; (-) strand; PAM type: YTN; PAM sequence: CTT
tttggcttttagtagctaga

SEQ ID NO: 179192 - DNA, 20 bp, Artificial Sequence
  Description of Artificial Sequence: Synthetic oligonucleotide
  Target: ATXN1; (-) strand; PAM type: YTN; PAM sequence: TTC
tttttggcttttagtagcta

SEQ ID NO: 179193 - DNA, 20 bp, Artificial Sequence
  Description of Artificial Sequence: Synthetic oligonucleotide
  Target: ATXN1; (-) strand; PAM type: YTN; PAM sequence: TTT
ctttttggcttttagtagct

SEQ ID NO: 179194 - DNA, 20 bp, Artificial Sequence
  Description of Artificial Sequence: Synthetic oligonucleotide
  Target: ATXN1; (-) strand; PAM type: YTN; PAM sequence: TTT
tctttttggcttttagtagc

SEQ ID NO: 179195 - DNA, 20 bp, Artificial Sequence
  Description of Artificial Sequence: Synthetic oligonucleotide
  Target: ATXN1; (-) strand; PAM type: YTN; PAM sequence: TTT
ttctttttggcttttagtag

SEQ ID NO: 179196 - DNA, 20 bp, Artificial Sequence
  Description of Artificial Sequence: Synthetic oligonucleotide
  Target: ATXN1; (-) strand; PAM type: YTN; PAM sequence: TTG
acatcacatttttctttttg

SEQ ID NO: 179197 - DNA, 20 bp, Artificial Sequence
  Description of Artificial Sequence: Synthetic oligonucleotide
  Target: ATXN1; (-) strand; PAM type: YTN; PAM sequence: TTG
ccattgacatcacatttttc

SEQ ID NO: 179198 - DNA, 20 bp, Artificial Sequence
  Description of Artificial Sequence: Synthetic oligonucleotide
  Target: ATXN1; (-) strand; PAM type: YTN; PAM sequence: TTG
ccaaattgccattgacatca

SEQ ID NO: 179199 - DNA, 20 bp, Artificial Sequence
  Description of Artificial Sequence: Synthetic oligonucleotide
  Target: ATXN1; (-) strand; PAM type: YTN; PAM sequence: TTA
caaatgtagttgccaaattg

SEQ ID NO: 179200 - DNA, 20 bp, Artificial Sequence
  Description of Artificial Sequence: Synthetic oligonucleotide
  Target: ATXN1; (-) strand; PAM type: YTN; PAM sequence: TTT
acaaatgtagttgccaaatt

SEQ ID NO: 179201 - DNA, 20 bp, Artificial Sequence
  Description of Artificial Sequence: Synthetic oligonucleotide
  Target: ATXN1; (-) strand; PAM type: YTN; PAM sequence: CTT
tacaaatgtagttgccaaat

SEQ ID NO: 179202 - DNA, 20 bp, Artificial Sequence
  Description of Artificial Sequence: Synthetic oligonucleotide
  Target: ATXN1; (-) strand; PAM type: YTN; PAM sequence: TTA
taactttacaaatgtagttg

SEQ ID NO: 179203 - DNA, 20 bp, Artificial Sequence
  Description of Artificial Sequence: Synthetic oligonucleotide
  Target: ATXN1; (-) strand; PAM type: YTN; PAM sequence: TTG
ttataactttacaaatgtag

SEQ ID NO: 179204 - DNA, 20 bp, Artificial Sequence
  Description of Artificial Sequence: Synthetic oligonucleotide
  Target: ATXN1; (-) strand; PAM type: YTN; PAM sequence: CTT
gttataactttacaaatgta

SEQ ID NO: 179205 - DNA, 20 bp, Artificial Sequence
  Description of Artificial Sequence: Synthetic oligonucleotide
  Target: ATXN1; (-) strand; PAM type: YTN; PAM sequence: TTG
gcttgttataactttacaaa

SEQ ID NO: 179206 - DNA, 20 bp, Artificial Sequence
  Description of Artificial Sequence: Synthetic oligonucleotide
  Target: ATXN1; (-) strand; PAM type: YTN; PAM sequence: CTG
aaaattggcttgttataact

SEQ ID NO: 179207 - DNA, 20 bp, Artificial Sequence
  Description of Artificial Sequence: Synthetic oligonucleotide
  Target: ATXN1; (-) strand; PAM type: YTN; PAM sequence: CTC
tgaaaattggcttgttataa

SEQ ID NO: 179208 - DNA, 20 bp, Artificial Sequence
  Description of Artificial Sequence: Synthetic oligonucleotide
  Target: ATXN1; (-) strand; PAM type: YTN; PAM sequence: CTA
gctctgaaaattggcttgtt

SEQ ID NO: 179209 - DNA, 20 bp, Artificial Sequence
  Description of Artificial Sequence: Synthetic oligonucleotide
  Target: ATXN1; (-) strand; PAM type: YTN; PAM sequence: CTC
tagctctgaaaattggcttg

SEQ ID NO: 179210 - DNA, 20 bp, Artificial Sequence
  Description of Artificial Sequence: Synthetic oligonucleotide
  Target: ATXN1; (-) strand; PAM type: YTN; PAM sequence: TTC
ccgccccgcccccggccccg

SEQ ID NO: 179211 - DNA, 20 bp, Artificial Sequence
  Description of Artificial Sequence: Synthetic oligonucleotide
  Target: ATXN1; (-) strand; PAM type: YTN; PAM sequence: TTA
ttcccgccccgcccccggcc

SEQ ID NO: 179212 - DNA, 20 bp, Artificial Sequence
  Description of Artificial Sequence: Synthetic oligonucleotide
  Target: ATXN1; (-) strand; PAM type: YTN; PAM sequence: CTT
attcccgccccgcccccggc

SEQ ID NO: 179213 - DNA, 20 bp, Artificial Sequence
  Description of Artificial Sequence: Synthetic oligonucleotide
  Target: ATXN1; (-) strand; PAM type: YTN; PAM sequence: CTG
atgtcagcatccccacccca

SEQ ID NO: 179214 - DNA, 20 bp, Artificial Sequence
  Description of Artificial Sequence: Synthetic oligonucleotide
  Target: ATXN1; (-) strand; PAM type: YTN; PAM sequence: TTC
tgatgtcagcatccccaccc

SEQ ID NO: 179215 - DNA, 20 bp, Artificial Sequence
  Description of Artificial Sequence: Synthetic oligonucleotide
  Target: ATXN1; (-) strand; PAM type: YTN; PAM sequence: CTG
gtacacattctgatgtcagc

SEQ ID NO: 179216 - DNA, 20 bp, Artificial Sequence
  Description of Artificial Sequence: Synthetic oligonucleotide
  Target: ATXN1; (-) strand; PAM type: YTN; PAM sequence: CTC
tggtacacattctgatgtca

SEQ ID NO: 179217 - DNA, 20 bp, Artificial Sequence
  Description of Artificial Sequence: Synthetic oligonucleotide
  Target: ATXN1; (-) strand; PAM type: YTN; PAM sequence: CTG
agtcactctggtacacattc

SEQ ID NO: 179218 - DNA, 20 bp, Artificial Sequence
  Description of Artificial Sequence: Synthetic oligonucleotide
  Target: ATXN1; (-) strand; PAM type: YTN; PAM sequence: CTG
aaaaaaaacccctgagtcac

SEQ ID NO: 179219 - DNA, 20 bp, Artificial Sequence
  Description of Artificial Sequence: Synthetic oligonucleotide
  Target: ATXN1; (-) strand; PAM type: YTN; PAM sequence: CTG
aggctgaaaaaaaacccctg

SEQ ID NO: 179220 - DNA, 20 bp, Artificial Sequence
  Description of Artificial Sequence: Synthetic oligonucleotide
  Target: ATXN1; (-) strand; PAM type: YTN; PAM sequence: CTC
tgaggctgaaaaaaaacccc

SEQ ID NO: 179221 - DNA, 20 bp, Artificial Sequence
  Description of Artificial Sequence: Synthetic oligonucleotide
  Target: ATXN1; (-) strand; PAM type: YTN; PAM sequence: CTG
agtaaatggtagctctgagg

SEQ ID NO: 179222 - DNA, 20 bp, Artificial Sequence
  Description of Artificial Sequence: Synthetic oligonucleotide
  Target: ATXN1; (-) strand; PAM type: YTN; PAM sequence: CTG
gacgctgagtaaatggtagc

SEQ ID NO: 179223 - DNA, 20 bp, Artificial Sequence
  Description of Artificial Sequence: Synthetic oligonucleotide
  Target: ATXN1; (-) strand; PAM type: YTN; PAM sequence: TTA
ggacgctggacgctgagtaa

SEQ ID NO: 179224 - DNA, 20 bp, Artificial Sequence
  Description of Artificial Sequence: Synthetic oligonucleotide
  Target: ATXN1; (-) strand; PAM type: YTN; PAM sequence: TTG
gttaggacgctggacgctga

SEQ ID NO: 179225 - DNA, 20 bp, Artificial Sequence
  Description of Artificial Sequence: Synthetic oligonucleotide
  Target: ATXN1; (-) strand; PAM type: YTN; PAM sequence: CTT
ggttaggacgctggacgctg

SEQ ID NO: 179226 - DNA, 20 bp, Artificial Sequence
  Description of Artificial Sequence: Synthetic oligonucleotide
  Target: ATXN1; (-) strand; PAM type: YTN; PAM sequence: TTA
ggcttggttaggacgctgga

SEQ ID NO: 179227 - DNA, 20 bp, Artificial Sequence
  Description of Artificial Sequence: Synthetic oligonucleotide
  Target: ATXN1; (-) strand; PAM type: YTN; PAM sequence: TTT
aggcttggttaggacgctgg

SEQ ID NO: 179228 - DNA, 20 bp, Artificial Sequence
  Description of Artificial Sequence: Synthetic oligonucleotide
  Target: ATXN1; (-) strand; PAM type: YTN; PAM sequence: TTA
gatcaagtttaggcttggtt

SEQ ID NO: 179229 - DNA, 20 bp, Artificial Sequence
  Description of Artificial Sequence: Synthetic oligonucleotide
  Target: ATXN1; (-) strand; PAM type: YTN; PAM sequence: TTT
agatcaagtttaggcttggt

SEQ ID NO: 179230 - DNA, 20 bp, Artificial Sequence
  Description of Artificial Sequence: Synthetic oligonucleotide
  Target: ATXN1; (-) strand; PAM type: YTN; PAM sequence: TTC
atcaaaagacacaatttaga

SEQ ID NO: 179231 - DNA, 20 bp, Artificial Sequence
  Description of Artificial Sequence: Synthetic oligonucleotide
  Target: ATXN1; (-) strand; PAM type: YTN; PAM sequence: CTA
attcatcaaaagacacaatt

SEQ ID NO: 179232 - DNA, 20 bp, Artificial Sequence
  Description of Artificial Sequence: Synthetic oligonucleotide
  Target: ATXN1; (-) strand; PAM type: YTN; PAM sequence: CTA
ctaattcatcaaaagacaca

SEQ ID NO: 179233 - DNA, 20 bp, Artificial Sequence
  Description of Artificial Sequence: Synthetic oligonucleotide
  Target: ATXN1; (-) strand; PAM type: YTN; PAM sequence: TTA
acacagtatgaaaccaacca

SEQ ID NO: 179234 - DNA, 20 bp, Artificial Sequence
  Description of Artificial Sequence: Synthetic oligonucleotide
  Target: ATXN1; (-) strand; PAM type: YTN; PAM sequence: TTC
caaattaacacagtatgaaa

SEQ ID NO: 179235 - DNA, 20 bp, Artificial Sequence
  Description of Artificial Sequence: Synthetic oligonucleotide
  Target: ATXN1; (-) strand; PAM type: YTN; PAM sequence: TTT
ccaaattaacacagtatgaa

SEQ ID NO: 179236 - DNA, 20 bp, Artificial Sequence
  Description of Artificial Sequence: Synthetic oligonucleotide
  Target: ATXN1; (-) strand; PAM type: YTN; PAM sequence: TTT
tccaaattaacacagtatga

SEQ ID NO: 179237 - DNA, 20 bp, Artificial Sequence
  Description of Artificial Sequence: Synthetic oligonucleotide
  Target: ATXN1; (-) strand; PAM type: YTN; PAM sequence: CTT
ttccaaattaacacagtatg

SEQ ID NO: 179238 - DNA, 20 bp, Artificial Sequence
  Description of Artificial Sequence: Synthetic oligonucleotide
  Target: ATXN1; (-) strand; PAM type: YTN; PAM sequence: TTA
atacacgtatcttttccaaa

SEQ ID NO: 179239 - DNA, 20 bp, Artificial Sequence
  Description of Artificial Sequence: Synthetic oligonucleotide
  Target: ATXN1; (-) strand; PAM type: YTN; PAM sequence: TTA
acatatgtagaaaataaaat

SEQ ID NO: 179240 - DNA, 20 bp, Artificial Sequence
  Description of Artificial Sequence: Synthetic oligonucleotide
  Target: ATXN1; (-) strand; PAM type: YTN; PAM sequence: TTT
aacatatgtagaaaataaaa

SEQ ID NO: 179241 - DNA, 20 bp, Artificial Sequence
  Description of Artificial Sequence: Synthetic oligonucleotide
  Target: ATXN1; (-) strand; PAM type: YTN; PAM sequence: TTG
tttaacatatgtagaaaata

SEQ ID NO: 179242 - DNA, 20 bp, Artificial Sequence
  Description of Artificial Sequence: Synthetic oligonucleotide
  Target: ATXN1; (-) strand; PAM type: YTN; PAM sequence: TTT
gtttaacatatgtagaaaat

SEQ ID NO: 179243 - DNA, 20 bp, Artificial Sequence
  Description of Artificial Sequence: Synthetic oligonucleotide
  Target: ATXN1; (-) strand; PAM type: YTN; PAM sequence: TTA
tttgtttaacatatgtagaa

SEQ ID NO: 179244 - DNA, 20 bp, Artificial Sequence
  Description of Artificial Sequence: Synthetic oligonucleotide
  Target: ATXN1; (-) strand; PAM type: YTN; PAM sequence: TTT
atttgtttaacatatgtaga

SEQ ID NO: 179245 - DNA, 20 bp, Artificial Sequence
  Description of Artificial Sequence: Synthetic oligonucleotide
  Target: ATXN1; (-) strand; PAM type: YTN; PAM sequence: TTT
tatttgtttaacatatgtag

SEQ ID NO: 179246 - DNA, 20 bp, Artificial Sequence
  Description of Artificial Sequence: Synthetic oligonucleotide
  Target: ATXN1; (-) strand; PAM type: YTN; PAM sequence: TTT
ttatttgtttaacatatgta

SEQ ID NO: 179247 - DNA, 20 bp, Artificial Sequence
  Description of Artificial Sequence: Synthetic oligonucleotide
  Target: ATXN1; (-) strand; PAM type: YTN; PAM sequence: TTT
tttatttgtttaacatatgt

SEQ ID NO: 179248 - DNA, 20 bp, Artificial Sequence
  Description of Artificial Sequence: Synthetic oligonucleotide
  Target: ATXN1; (-) strand; PAM type: YTN; PAM sequence: CTC
aattttttatttgtttaaca

SEQ ID NO: 179249 - DNA, 20 bp, Artificial Sequence
  Description of Artificial Sequence: Synthetic oligonucleotide
  Target: ATXN1; (-) strand; PAM type: YTN; PAM sequence: TTG
aaaaacaaaacaagctcaat

SEQ ID NO: 179250 - DNA, 20 bp, Artificial Sequence
  Description of Artificial Sequence: Synthetic oligonucleotide
  Target: ATXN1; (-) strand; PAM type: YTN; PAM sequence: TTT
gaaaaacaaaacaagctcaa

SEQ ID NO: 179251 - DNA, 20 bp, Artificial Sequence
  Description of Artificial Sequence: Synthetic oligonucleotide
  Target: ATXN1; (-) strand; PAM type: YTN; PAM sequence: CTT
tgaaaaacaaaacaagctca

SEQ ID NO: 179252 - DNA, 20 bp, Artificial Sequence
  Description of Artificial Sequence: Synthetic oligonucleotide
  Target: ATXN1; (-) strand; PAM type: YTN; PAM sequence: CTA
caaagtgctttgaaaaacaa

SEQ ID NO: 179253 - DNA, 20 bp, Artificial Sequence
  Description of Artificial Sequence: Synthetic oligonucleotide
  Target: ATXN1; (-) strand; PAM type: YTN; PAM sequence: TTA
gggacaagaaaactacaaag

SEQ ID NO: 179254 - DNA, 20 bp, Artificial Sequence
  Description of Artificial Sequence: Synthetic oligonucleotide
  Target: ATXN1; (-) strand; PAM type: YTN; PAM sequence: TTT
agggacaagaaaactacaaa

SEQ ID NO: 179255 - DNA, 20 bp, Artificial Sequence
  Description of Artificial Sequence: Synthetic oligonucleotide
  Target: ATXN1; (-) strand; PAM type: YTN; PAM sequence: TTT
tagggacaagaaaactacaa

SEQ ID NO: 179256 - DNA, 20 bp, Artificial Sequence
  Description of Artificial Sequence: Synthetic oligonucleotide
  Target: ATXN1; (-) strand; PAM type: YTN; PAM sequence: TTT
ttagggacaagaaaactaca

SEQ ID NO: 179257 - DNA, 20 bp, Artificial Sequence
  Description of Artificial Sequence: Synthetic oligonucleotide
  Target: ATXN1; (-) strand; PAM type: YTN; PAM sequence: CTT
tttagggacaagaaaactac

SEQ ID NO: 179258 - DNA, 20 bp, Artificial Sequence
  Description of Artificial Sequence: Synthetic oligonucleotide
  Target: ATXN1; (-) strand; PAM type: YTN; PAM sequence: TTA
gtaaatactttttagggaca

SEQ ID NO: 179259 - DNA, 20 bp, Artificial Sequence
  Description of Artificial Sequence: Synthetic oligonucleotide
  Target: ATXN1; (-) strand; PAM type: YTN; PAM sequence: TTT
agtaaatactttttagggac

SEQ ID NO: 179260 - DNA, 20 bp, Artificial Sequence
  Description of Artificial Sequence: Synthetic oligonucleotide
  Target: ATXN1; (-) strand; PAM type: YTN; PAM sequence: TTT
tagtaaatactttttaggga

SEQ ID NO: 179261 - DNA, 20 bp, Artificial Sequence
  Description of Artificial Sequence: Synthetic oligonucleotide
  Target: ATXN1; (-) strand; PAM type: YTN; PAM sequence: TTT
ttagtaaatactttttaggg

SEQ ID NO: 179262 - DNA, 20 bp, Artificial Sequence
  Description of Artificial Sequence: Synthetic oligonucleotide
  Target: ATXN1; (-) strand; PAM type: YTN; PAM sequence: TTC
ggtcacagatttttagtaaa

SEQ ID NO: 179263 - DNA, 20 bp, Artificial Sequence
  Description of Artificial Sequence: Synthetic oligonucleotide
  Target: ATXN1; (-) strand; PAM type: YTN; PAM sequence: TTT
cggtcacagatttttagtaa

SEQ ID NO: 179264 - DNA, 20 bp, Artificial Sequence
  Description of Artificial Sequence: Synthetic oligonucleotide
  Target: ATXN1; (-) strand; PAM type: YTN; PAM sequence: TTG
atttcggtcacagattttta

SEQ ID NO: 179265 - DNA, 20 bp, Artificial Sequence
  Description of Artificial Sequence: Synthetic oligonucleotide
  Target: ATXN1; (-) strand; PAM type: YTN; PAM sequence: TTT
gatttcggtcacagattttt

SEQ ID NO: 179266 - DNA, 20 bp, Artificial Sequence
  Description of Artificial Sequence: Synthetic oligonucleotide
  Target: ATXN1; (-) strand; PAM type: YTN; PAM sequence: TTC
aaaatgaaaagtttgatttc

SEQ ID NO: 179267 - DNA, 20 bp, Artificial Sequence
  Description of Artificial Sequence: Synthetic oligonucleotide
  Target: ATXN1; (-) strand; PAM type: YTN; PAM sequence: CTT
caaaatgaaaagtttgattt

SEQ ID NO: 179268 - DNA, 20 bp, Artificial Sequence
  Description of Artificial Sequence: Synthetic oligonucleotide
  Target: ATXN1; (-) strand; PAM type: YTN; PAM sequence: CTC
aaatacttcaaaatgaaaag

SEQ ID NO: 179269 - DNA, 20 bp, Artificial Sequence
  Description of Artificial Sequence: Synthetic oligonucleotide
  Target: ATXN1; (-) strand; PAM type: YTN; PAM sequence: TTA
aacctcaaatacttcaaaat

SEQ ID NO: 179270 - DNA, 20 bp, Artificial Sequence
  Description of Artificial Sequence: Synthetic oligonucleotide
  Target: ATXN1; (-) strand; PAM type: YTN; PAM sequence: CTG
gattaaacctcaaatacttc

SEQ ID NO: 179271 - DNA, 20 bp, Artificial Sequence
  Description of Artificial Sequence: Synthetic oligonucleotide
  Target: ATXN1; (-) strand; PAM type: YTN; PAM sequence: CTC
tggattaaacctcaaatact

SEQ ID NO: 179272 - DNA, 20 bp, Artificial Sequence
  Description of Artificial Sequence: Synthetic oligonucleotide
  Target: ATXN1; (-) strand; PAM type: YTN; PAM sequence: CTA
tgcctctggattaaacctca

SEQ ID NO: 179273 - DNA, 20 bp, Artificial Sequence
  Description of Artificial Sequence: Synthetic oligonucleotide
  Target: ATXN1; (-) strand; PAM type: YTN; PAM sequence: CTA
aatactatgcctctggatta

SEQ ID NO: 179274 - DNA, 20 bp, Artificial Sequence
  Description of Artificial Sequence: Synthetic oligonucleotide
  Target: ATXN1; (-) strand; PAM type: YTN; PAM sequence: CTG
ctaaatactatgcctctgga

SEQ ID NO: 179275 - DNA, 20 bp, Artificial Sequence
  Description of Artificial Sequence: Synthetic oligonucleotide
  Target: ATXN1; (-) strand; PAM type: YTN; PAM sequence: TTC
tgctaaatactatgcctctg

SEQ ID NO: 179276 - DNA, 20 bp, Artificial Sequence
  Description of Artificial Sequence: Synthetic oligonucleotide
  Target: ATXN1; (-) strand; PAM type: YTN; PAM sequence: TTT
ctgctaaatactatgcctct

SEQ ID NO: 179277 - DNA, 20 bp, Artificial Sequence
  Description of Artificial Sequence: Synthetic oligonucleotide
  Target: ATXN1; (-) strand; PAM type: YTN; PAM sequence: TTG
agaagatgtttctgctaaat

SEQ ID NO: 179278 - DNA, 20 bp, Artificial Sequence
  Description of Artificial Sequence: Synthetic oligonucleotide
  Target: ATXN1; (-) strand; PAM type: YTN; PAM sequence: CTT
gagaagatgtttctgctaaa

SEQ ID NO: 179279 - DNA, 20 bp, Artificial Sequence
  Description of Artificial Sequence: Synthetic oligonucleotide
  Target: ATXN1; (-) strand; PAM type: YTN; PAM sequence: TTA
atagtgcttgagaagatgtt

SEQ ID NO: 179280 - DNA, 20 bp, Artificial Sequence
  Description of Artificial Sequence: Synthetic oligonucleotide
  Target: ATXN1; (-) strand; PAM type: YTN; PAM sequence: TTT
aatagtgcttgagaagatgt

SEQ ID NO: 179281 - DNA, 20 bp, Artificial Sequence
  Description of Artificial Sequence: Synthetic oligonucleotide
  Target: ATXN1; (-) strand; PAM type: YTN; PAM sequence: TTT
taatagtgcttgagaagatg

SEQ ID NO: 179282 - DNA, 20 bp, Artificial Sequence
  Description of Artificial Sequence: Synthetic oligonucleotide
  Target: ATXN1; (-) strand; PAM type: YTN; PAM sequence: TTT
ttaatagtgcttgagaagat

SEQ ID NO: 179283 - DNA, 20 bp, Artificial Sequence
  Description of Artificial Sequence: Synthetic oligonucleotide
  Target: ATXN1; (-) strand; PAM type: YTN; PAM sequence: TTT
tttaatagtgcttgagaaga

SEQ ID NO: 179284 - DNA, 20 bp, Artificial Sequence
  Description of Artificial Sequence: Synthetic oligonucleotide
  Target: ATXN1; (-) strand; PAM type: YTN; PAM sequence: TTA
attttttaatagtgcttgag

SEQ ID NO: 179285 - DNA, 20 bp, Artificial Sequence
  Description of Artificial Sequence: Synthetic oligonucleotide
  Target: ATXN1; (-) strand; PAM type: YTN; PAM sequence: TTT
aattttttaatagtgcttga

SEQ ID NO: 179286 - DNA, 20 bp, Artificial Sequence
  Description of Artificial Sequence: Synthetic oligonucleotide
  Target: ATXN1; (-) strand; PAM type: YTN; PAM sequence: CTT
taattttttaatagtgcttg

SEQ ID NO: 179287 - DNA, 20 bp, Artificial Sequence
  Description of Artificial Sequence: Synthetic oligonucleotide
  Target: ATXN1; (-) strand; PAM type: YTN; PAM sequence: CTG
gccccactttaattttttaa

SEQ ID NO: 179288 - DNA, 20 bp, Artificial Sequence
  Description of Artificial Sequence: Synthetic oligonucleotide
  Target: ATXN1; (-) strand; PAM type: YTN; PAM sequence: CTG
tgcctggccccactttaatt

SEQ ID NO: 179289 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccactgtgcc

SEQ ID NO: 179290 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 179291 - DNA, 20 bp, Artificial Sequence
  Description of Artificial Sequence: Synthetic oligonucleotide
  Target: ATXN1; (-) strand; PAM type: YTN; PAM sequence: CTC
ccaaaagtgctgggattaca

SEQ ID NO: 179292 - DNA, 20 bp, Artificial Sequence
  Description of Artificial Sequence: Synthetic oligonucleotide
  Target: ATXN1; (-) strand; PAM type: YTN; PAM sequence: TTC
agcctcccaaaagtgctggg

SEQ ID NO: 179293 - DNA, 20 bp, Artificial Sequence
  Description of Artificial Sequence: Synthetic oligonucleotide
  Target: ATXN1; (-) strand; PAM type: YTN; PAM sequence: CTT
cagcctcccaaaagtgctgg

SEQ ID NO: 179294 - DNA, 20 bp, Artificial Sequence
  Description of Artificial Sequence: Synthetic oligonucleotide
  Target: ATXN1; (-) strand; PAM type: YTN; PAM sequence: CTG
cccacttcagcctcccaaaa

SEQ ID NO: 179295 - DNA, 20 bp, Artificial Sequence
  Description of Artificial Sequence: Synthetic oligonucleotide
  Target: ATXN1; (-) strand; PAM type: YTN; PAM sequence: CTC
agatgatctgcccacttcag

SEQ ID NO: 179296 - DNA, 20 bp, Artificial Sequence
  Description of Artificial Sequence: Synthetic oligonucleotide
  Target: ATXN1; (-) strand; PAM type: YTN; PAM sequence: TTC
cgacctcagatgatctgccc

SEQ ID NO: 179297 - DNA, 20 bp, Artificial Sequence
  Description of Artificial Sequence: Synthetic oligonucleotide
  Target: ATXN1; (-) strand; PAM type: YTN; PAM sequence: CTT
ccgacctcagatgatctgcc

SEQ ID NO: 179298 - DNA, 20 bp, Artificial Sequence
  Description of Artificial Sequence: Synthetic oligonucleotide
  Target: ATXN1; (-) strand; PAM type: YTN; PAM sequence: CTC
gaacttccgacctcagatga

SEQ ID NO: 179299 - DNA, 20 bp, Artificial Sequence
  Description of Artificial Sequence: Synthetic oligonucleotide
  Target: ATXN1; (-) strand; PAM type: YTN; PAM sequence: CTG
gtctcgaacttccgacctca

SEQ ID NO: 179300 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtctcgaactt

SEQ ID NO: 179301 - DNA, 20 bp, Artificial Sequence
  Description of Artificial Sequence: Synthetic oligonucleotide
  Target: ATXN1; (-) strand; PAM type: YTN; PAM sequence: TTC
accatgttgcccaggctggt

SEQ ID NO: 179302 - DNA, 20 bp, Artificial Sequence
  Description of Artificial Sequence: Synthetic oligonucleotide
  Target: ATXN1; (-) strand; PAM type: YTN; PAM sequence: TTT
caccatgttgcccaggctgg

SEQ ID NO: 179303 - DNA, 20 bp, Artificial Sequence
  Description of Artificial Sequence: Synthetic oligonucleotide
  Target: ATXN1; (-) strand; PAM type: YTN; PAM sequence: TTG
gtaaagatggggtttcacca

SEQ ID NO: 179304 - DNA, 20 bp, Artificial Sequence
  Description of Artificial Sequence: Synthetic oligonucleotide
  Target: ATXN1; (-) strand; PAM type: YTN; PAM sequence: TTT
ggtaaagatggggtttcacc

SEQ ID NO: 179305 - DNA, 20 bp, Artificial Sequence
  Description of Artificial Sequence: Synthetic oligonucleotide
  Target: ATXN1; (-) strand; PAM type: YTN; PAM sequence: TTT
tggtaaagatggggtttcac

SEQ ID NO: 179306 - DNA, 20 bp, Artificial Sequence
  Description of Artificial Sequence: Synthetic oligonucleotide
  Target: ATXN1; (-) strand; PAM type: YTN; PAM sequence: TTT
ttggtaaagatggggtttca

SEQ ID NO: 179307 - DNA, 20 bp, Artificial Sequence
  Description of Artificial Sequence: Synthetic oligonucleotide
  Target: ATXN1; (-) strand; PAM type: YTN; PAM sequence: TTG
tatttttggtaaagatgggg

SEQ ID NO: 179308 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtaaagatggg

SEQ ID NO: 179309 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtaaagatgg

SEQ ID NO: 179310 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtaaagatg

SEQ ID NO: 179311 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttggtaaa

SEQ ID NO: 179312 - DNA, 20 bp, Artificial Sequence
  Description of Artificial Sequence: Synthetic oligonucleotide
  Target: ATXN1; (-) strand; PAM type: YTN; PAM sequence: CTA
ccatcacacccacctaattt

SEQ ID NO: 179313 - DNA, 20 bp, Artificial Sequence
  Description of Artificial Sequence: Synthetic oligonucleotide
  Target: ATXN1; (-) strand; PAM type: YTN; PAM sequence: TTA
caggtgcctaccatcacacc

SEQ ID NO: 179314 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcctaccat

SEQ ID NO: 179315 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggattacag

SEQ ID NO: 179316 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 179317 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 179318 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 179319 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 179320 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 179321 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattctcc

SEQ ID NO: 179322 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcaagtga

SEQ ID NO: 179323 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccgggtt

SEQ ID NO: 179324 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctcccg

SEQ ID NO: 179325 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctccgcc

SEQ ID NO: 179326 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggcaccgtctc

SEQ ID NO: 179327 - DNA, 20 bp, Artificial Sequence
  Description of Artificial Sequence: Synthetic oligonucleotide
  Target: ATXN1; (-) strand; PAM type: YTN; PAM sequence: TTG
tcccccaggctggagtgcaa

SEQ ID NO: 179328 - DNA, 20 bp, Artificial Sequence
  Description of Artificial Sequence: Synthetic oligonucleotide
  Target: ATXN1; (-) strand; PAM type: YTN; PAM sequence: CTT
gtcccccaggctggagtgca

SEQ ID NO: 179329 - DNA, 20 bp, Artificial Sequence
  Description of Artificial Sequence: Synthetic oligonucleotide
  Target: ATXN1; (-) strand; PAM type: YTN; PAM sequence: CTC
ttgtcccccaggctggagtg

SEQ ID NO: 179330 - DNA, 20 bp, Artificial Sequence
  Description of Artificial Sequence: Synthetic oligonucleotide
  Target: ATXN1; (-) strand; PAM type: YTN; PAM sequence: TTG
ctcttgtcccccaggctgga

SEQ ID NO: 179331 - DNA, 20 bp, Artificial Sequence
  Description of Artificial Sequence: Synthetic oligonucleotide
  Target: ATXN1; (-) strand; PAM type: YTN; PAM sequence: CTT
gctcttgtcccccaggctgg

SEQ ID NO: 179332 - DNA, 20 bp, Artificial Sequence
  Description of Artificial Sequence: Synthetic oligonucleotide
  Target: ATXN1; (-) strand; PAM type: YTN; PAM sequence: TTG
agacgaagtcttgctcttgt

SEQ ID NO: 179333 - DNA, 20 bp, Artificial Sequence
  Description of Artificial Sequence: Synthetic oligonucleotide
  Target: ATXN1; (-) strand; PAM type: YTN; PAM sequence: TTT
gagacgaagtcttgctcttg

SEQ ID NO: 179334 - DNA, 20 bp, Artificial Sequence
  Description of Artificial Sequence: Synthetic oligonucleotide
  Target: ATXN1; (-) strand; PAM type: YTN; PAM sequence: TTT
tgagacgaagtcttgctctt

SEQ ID NO: 179335 - DNA, 20 bp, Artificial Sequence
  Description of Artificial Sequence: Synthetic oligonucleotide
  Target: ATXN1; (-) strand; PAM type: YTN; PAM sequence: TTT
ttgagacgaagtcttgctct

SEQ ID NO: 179336 - DNA, 20 bp, Artificial Sequence
  Description of Artificial Sequence: Synthetic oligonucleotide
  Target: ATXN1; (-) strand; PAM type: YTN; PAM sequence: TTT
tttgagacgaagtcttgctc

SEQ ID NO: 179337 - DNA, 20 bp, Artificial Sequence
  Description of Artificial Sequence: Synthetic oligonucleotide
  Target: ATXN1; (-) strand; PAM type: YTN; PAM sequence: TTT
ttttgagacgaagtcttgct

SEQ ID NO: 179338 - DNA, 20 bp, Artificial Sequence
  Description of Artificial Sequence: Synthetic oligonucleotide
  Target: ATXN1; (-) strand; PAM type: YTN; PAM sequence: TTT
tttttgagacgaagtcttgc

SEQ ID NO: 179339 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacgaagtcttg

SEQ ID NO: 179340 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacgaagtctt

SEQ ID NO: 179341 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacgaagtct

SEQ ID NO: 179342 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacgaagtc

SEQ ID NO: 179343 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacgaagt

SEQ ID NO: 179344 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacgaag

SEQ ID NO: 179345 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgaa

SEQ ID NO: 179346 - DNA, 20 bp, Artificial Sequence
  Description of Artificial Sequence: Synthetic oligonucleotide
  Target: ATXN1; (-) strand; PAM type: YTN; PAM sequence: TTC
aatttttttttttttttgag

SEQ ID NO: 179347 - DNA, 20 bp, Artificial Sequence
  Description of Artificial Sequence: Synthetic oligonucleotide
  Target: ATXN1; (-) strand; PAM type: YTN; PAM sequence: CTT
caatttttttttttttttga

SEQ ID NO: 179348 - DNA, 20 bp, Artificial Sequence
  Description of Artificial Sequence: Synthetic oligonucleotide
  Target: ATXN1; (-) strand; PAM type: YTN; PAM sequence: CTG
gccccacttcaatttttttt

SEQ ID NO: 179349 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcacc

SEQ ID NO: 179350 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 179351 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 179352 - DNA, 20 bp, Artificial Sequence
  Description of Artificial Sequence: Synthetic oligonucleotide
  Target: ATXN1; (-) strand; PAM type: YTN; PAM sequence: TTA
gacctcccaaagtgctggga

SEQ ID NO: 179353 - DNA, 20 bp, Artificial Sequence
  Description of Artificial Sequence: Synthetic oligonucleotide
  Target: ATXN1; (-) strand; PAM type: YTN; PAM sequence: TTT
agacctcccaaagtgctggg

SEQ ID NO: 179354 - DNA, 20 bp, Artificial Sequence
  Description of Artificial Sequence: Synthetic oligonucleotide
  Target: ATXN1; (-) strand; PAM type: YTN; PAM sequence: TTC
aagcgatccacccatttaga

SEQ ID NO: 179355 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgatccacccat

SEQ ID NO: 179356 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgatccacc

SEQ ID NO: 179357 - DNA, 20 bp, Artificial Sequence
  Description of Artificial Sequence: Synthetic oligonucleotide
  Target: ATXN1; (-) strand; PAM type: YTN; PAM sequence: CTG
gagactcctgggttcaagcg

SEQ ID NO: 179358 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagactcctgg

SEQ ID NO: 179359 - DNA, 20 bp, Artificial Sequence
  Description of Artificial Sequence: Synthetic oligonucleotide
  Target: ATXN1; (-) strand; PAM type: YTN; PAM sequence: TTG
ccatgttgcccaggctggag

SEQ ID NO: 179360 - DNA, 20 bp, Artificial Sequence
  Description of Artificial Sequence: Synthetic oligonucleotide
  Target: ATXN1; (-) strand; PAM type: YTN; PAM sequence: TTT
gccatgttgcccaggctgga

SEQ ID NO: 179361 - DNA, 20 bp, Artificial Sequence
  Description of Artificial Sequence: Synthetic oligonucleotide
  Target: ATXN1; (-) strand; PAM type: YTN; PAM sequence: TTT
tgccatgttgcccaggctgg

SEQ ID NO: 179362 - DNA, 20 bp, Artificial Sequence
  Description of Artificial Sequence: Synthetic oligonucleotide
  Target: ATXN1; (-) strand; PAM type: YTN; PAM sequence: TTG
gtagagatggggttttgcca

SEQ ID NO: 179363 - DNA, 20 bp, Artificial Sequence
  Description of Artificial Sequence: Synthetic oligonucleotide
  Target: ATXN1; (-) strand; PAM type: YTN; PAM sequence: TTT
ggtagagatggggttttgcc

SEQ ID NO: 179364 - DNA, 20 bp, Artificial Sequence
  Description of Artificial Sequence: Synthetic oligonucleotide
  Target: ATXN1; (-) strand; PAM type: YTN; PAM sequence: TTT
tggtagagatggggttttgc

SEQ ID NO: 179365 - DNA, 20 bp, Artificial Sequence
  Description of Artificial Sequence: Synthetic oligonucleotide
  Target: ATXN1; (-) strand; PAM type: YTN; PAM sequence: TTT
ttggtagagatggggttttg

SEQ ID NO: 179366 - DNA, 20 bp, Artificial Sequence
  Description of Artificial Sequence: Synthetic oligonucleotide
  Target: ATXN1; (-) strand; PAM type: YTN; PAM sequence: TTG
tatttttggtagagatgggg

SEQ ID NO: 179367 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtagagatggg

SEQ ID NO: 179368 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtagagatgg

SEQ ID NO: 179369 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtagagatg

SEQ ID NO: 179370 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttggtagagat

SEQ ID NO: 179371 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttggtag

SEQ ID NO: 179372 - DNA, 20 bp, Artificial Sequence
  Description of Artificial Sequence: Synthetic oligonucleotide
  Target: ATXN1; (-) strand; PAM type: YTN; PAM sequence: CTG
gctaattttttgtatttttg

SEQ ID NO: 179373 - DNA, 20 bp, Artificial Sequence
  Description of Artificial Sequence: Synthetic oligonucleotide
  Target: ATXN1; (-) strand; PAM type: YTN; PAM sequence: CTG
tggtaagaatgtgccaccac

SEQ ID NO: 179374 - DNA, 20 bp, Artificial Sequence
  Description of Artificial Sequence: Synthetic oligonucleotide
  Target: ATXN1; (-) strand; PAM type: YTN; PAM sequence: CTC
tgtggtaagaatgtgccacc

SEQ ID NO: 179375 - DNA, 20 bp, Artificial Sequence
  Description of Artificial Sequence: Synthetic oligonucleotide
  Target: ATXN1; (-) strand; PAM type: YTN; PAM sequence: TTG
ggggcatgtctctgtggtaa

SEQ ID NO: 179376 - DNA, 20 bp, Artificial Sequence
  Description of Artificial Sequence: Synthetic oligonucleotide
  Target: ATXN1; (-) strand; PAM type: YTN; PAM sequence: TTT
gggggcatgtctctgtggta

SEQ ID NO: 179377 - DNA, 20 bp, Artificial Sequence
  Description of Artificial Sequence: Synthetic oligonucleotide
  Target: ATXN1; (-) strand; PAM type: YTN; PAM sequence: TTT
tgggggcatgtctctgtggt

SEQ ID NO: 179378 - DNA, 20 bp, Artificial Sequence
  Description of Artificial Sequence: Synthetic oligonucleotide
  Target: ATXN1; (-) strand; PAM type: YTN; PAM sequence: CTG
ttttgggggcatgtctctgt

SEQ ID NO: 179379 - DNA, 20 bp, Artificial Sequence
  Description of Artificial Sequence: Synthetic oligonucleotide
  Target: ATXN1; (-) strand; PAM type: YTN; PAM sequence: TTC
atctgttttgggggcatgtc

SEQ ID NO: 179380 - DNA, 20 bp, Artificial Sequence
  Description of Artificial Sequence: Synthetic oligonucleotide
  Target: ATXN1; (-) strand; PAM type: YTN; PAM sequence: TTT
catctgttttgggggcatgt

SEQ ID NO: 179381 - DNA, 20 bp, Artificial Sequence
  Description of Artificial Sequence: Synthetic oligonucleotide
  Target: ATXN1; (-) strand; PAM type: YTN; PAM sequence: TTT
tcatctgttttgggggcatg

SEQ ID NO: 179382 - DNA, 20 bp, Artificial Sequence
  Description of Artificial Sequence: Synthetic oligonucleotide
  Target: ATXN1; (-) strand; PAM type: YTN; PAM sequence: TTG
aaatatcaaagttttcatct

SEQ ID NO: 179383 - DNA, 20 bp, Artificial Sequence
  Description of Artificial Sequence: Synthetic oligonucleotide
  Target: ATXN1; (-) strand; PAM type: YTN; PAM sequence: TTT
gaaatatcaaagttttcatc

SEQ ID NO: 179384 - DNA, 20 bp, Artificial Sequence
  Description of Artificial Sequence: Synthetic oligonucleotide
  Target: ATXN1; (-) strand; PAM type: YTN; PAM sequence: TTT
tgaaatatcaaagttttcat

SEQ ID NO: 179385 - DNA, 20 bp, Artificial Sequence
  Description of Artificial Sequence: Synthetic oligonucleotide
  Target: ATXN1; (-) strand; PAM type: YTN; PAM sequence: CTT
ttgaaatatcaaagttttca

SEQ ID NO: 179386 - DNA, 20 bp, Artificial Sequence
  Description of Artificial Sequence: Synthetic oligonucleotide
  Target: ATXN1; (-) strand; PAM type: YTN; PAM sequence: CTC
ttttgaaatatcaaagtttt

SEQ ID NO: 179387 - DNA, 20 bp, Artificial Sequence
  Description of Artificial Sequence: Synthetic oligonucleotide
  Target: ATXN1; (-) strand; PAM type: YTN; PAM sequence: TTA
gctcttttgaaatatcaaag

SEQ ID NO: 179388 - DNA, 20 bp, Artificial Sequence
  Description of Artificial Sequence: Synthetic oligonucleotide
  Target: ATXN1; (-) strand; PAM type: YTN; PAM sequence: TTT
agctcttttgaaatatcaaa

SEQ ID NO: 179389 - DNA, 20 bp, Artificial Sequence
  Description of Artificial Sequence: Synthetic oligonucleotide
  Target: ATXN1; (-) strand; PAM type: YTN; PAM sequence: TTT
tagctcttttgaaatatcaa

SEQ ID NO: 179390 - DNA, 20 bp, Artificial Sequence
  Description of Artificial Sequence: Synthetic oligonucleotide
  Target: ATXN1; (-) strand; PAM type: YTN; PAM sequence: CTT
ttagctcttttgaaatatca

SEQ ID NO: 179391 - DNA, 20 bp, Artificial Sequence
  Description of Artificial Sequence: Synthetic oligonucleotide
  Target: ATXN1; (-) strand; PAM type: YTN; PAM sequence: TTC
ttttagctcttttgaaatat

SEQ ID NO: 179392 - DNA, 20 bp, Artificial Sequence
  Description of Artificial Sequence: Synthetic oligonucleotide
  Target: ATXN1; (-) strand; PAM type: YTN; PAM sequence: TTT
cttttagctcttttgaaata

SEQ ID NO: 179393 - DNA, 20 bp, Artificial Sequence
  Description of Artificial Sequence: Synthetic oligonucleotide
  Target: ATXN1; (-) strand; PAM type: YTN; PAM sequence: TTT
tcttttagctcttttgaaat

SEQ ID NO: 179394 - DNA, 20 bp, Artificial Sequence
  Description of Artificial Sequence: Synthetic oligonucleotide
  Target: ATXN1; (-) strand; PAM type: YTN; PAM sequence: CTC
attttcttttagctcttttg

SEQ ID NO: 179395 - DNA, 20 bp, Artificial Sequence
  Description of Artificial Sequence: Synthetic oligonucleotide
  Target: ATXN1; (-) strand; PAM type: YTN; PAM sequence: TTC
ctcattttcttttagctctt

SEQ ID NO: 179396 - DNA, 20 bp, Artificial Sequence
  Description of Artificial Sequence: Synthetic oligonucleotide
  Target: ATXN1; (-) strand; PAM type: YTN; PAM sequence: CTT
cctcattttcttttagctct

SEQ ID NO: 179397 - DNA, 20 bp, Artificial Sequence
  Description of Artificial Sequence: Synthetic oligonucleotide
  Target: ATXN1; (-) strand; PAM type: YTN; PAM sequence: TTA
cttcctcattttcttttagc

SEQ ID NO: 179398 - DNA, 20 bp, Artificial Sequence
  Description of Artificial Sequence: Synthetic oligonucleotide
  Target: ATXN1; (-) strand; PAM type: YTN; PAM sequence: CTT
acttcctcattttcttttag

SEQ ID NO: 179399 - DNA, 20 bp, Artificial Sequence
  Description of Artificial Sequence: Synthetic oligonucleotide
  Target: ATXN1; (-) strand; PAM type: YTN; PAM sequence: TTC
ttacttcctcattttctttt

SEQ ID NO: 179400 - DNA, 20 bp, Artificial Sequence
  Description of Artificial Sequence: Synthetic oligonucleotide
  Target: ATXN1; (-) strand; PAM type: YTN; PAM sequence: CTT
cttacttcctcattttcttt

SEQ ID NO: 179401 - DNA, 20 bp, Artificial Sequence
  Description of Artificial Sequence: Synthetic oligonucleotide
  Target: ATXN1; (-) strand; PAM type: YTN; PAM sequence: CTC
ttcttacttcctcattttct

SEQ ID NO: 179402 - DNA, 20 bp, Artificial Sequence
  Description of Artificial Sequence: Synthetic oligonucleotide
  Target: ATXN1; (-) strand; PAM type: YTN; PAM sequence: TTA
tctcttcttacttcctcatt

SEQ ID NO: 179403 - DNA, 20 bp, Artificial Sequence
  Description of Artificial Sequence: Synthetic oligonucleotide
  Target: ATXN1; (-) strand; PAM type: YTN; PAM sequence: TTT
atctcttcttacttcctcat

SEQ ID NO: 179404 - DNA, 20 bp, Artificial Sequence
  Description of Artificial Sequence: Synthetic oligonucleotide
  Target: ATXN1; (-) strand; PAM type: YTN; PAM sequence: CTT
tatctcttcttacttcctca

SEQ ID NO: 179405 - DNA, 20 bp, Artificial Sequence
  Description of Artificial Sequence: Synthetic oligonucleotide
  Target: ATXN1; (-) strand; PAM type: YTN; PAM sequence: TTC
ctttatctcttcttacttcc

SEQ ID NO: 179406 - DNA, 20 bp, Artificial Sequence
  Description of Artificial Sequence: Synthetic oligonucleotide
  Target: ATXN1; (-) strand; PAM type: YTN; PAM sequence: TTA
gtgttcctttatctcttctt

SEQ ID NO: 179407 - DNA, 20 bp, Artificial Sequence
  Description of Artificial Sequence: Synthetic oligonucleotide
  Target: ATXN1; (-) strand; PAM type: YTN; PAM sequence: TTG
ggattagtgttcctttatct

SEQ ID NO: 179408 - DNA, 20 bp, Artificial Sequence
  Description of Artificial Sequence: Synthetic oligonucleotide
  Target: ATXN1; (-) strand; PAM type: YTN; PAM sequence: TTA
ttgggattagtgttccttta

SEQ ID NO: 179409 - DNA, 20 bp, Artificial Sequence
  Description of Artificial Sequence: Synthetic oligonucleotide
  Target: ATXN1; (-) strand; PAM type: YTN; PAM sequence: TTT
attgggattagtgttccttt

SEQ ID NO: 179410 - DNA, 20 bp, Artificial Sequence
  Description of Artificial Sequence: Synthetic oligonucleotide
  Target: ATXN1; (-) strand; PAM type: YTN; PAM sequence: TTT
tattgggattagtgttcctt

SEQ ID NO: 179411 - DNA, 20 bp, Artificial Sequence
  Description of Artificial Sequence: Synthetic oligonucleotide
  Target: ATXN1; (-) strand; PAM type: YTN; PAM sequence: TTT
ttattgggattagtgttcct

SEQ ID NO: 179412 - DNA, 20 bp, Artificial Sequence
  Description of Artificial Sequence: Synthetic oligonucleotide
  Target: ATXN1; (-) strand; PAM type: YTN; PAM sequence: CTG
aatgtttttattgggattag

SEQ ID NO: 179413 - DNA, 20 bp, Artificial Sequence
  Description of Artificial Sequence: Synthetic oligonucleotide
  Target: ATXN1; (-) strand; PAM type: YTN; PAM sequence: TTC
tgaatgtttttattgggatt

SEQ ID NO: 179414 - DNA, 20 bp, Artificial Sequence
  Description of Artificial Sequence: Synthetic oligonucleotide
  Target: ATXN1; (-) strand; PAM type: YTN; PAM sequence: TTT
ctgaatgtttttattgggat

SEQ ID NO: 179415 - DNA, 20 bp, Artificial Sequence
  Description of Artificial Sequence: Synthetic oligonucleotide
  Target: ATXN1; (-) strand; PAM type: YTN; PAM sequence: TTC
atttctgaatgtttttattg

SEQ ID NO: 179416 - DNA, 20 bp, Artificial Sequence
  Description of Artificial Sequence: Synthetic oligonucleotide
  Target: ATXN1; (-) strand; PAM type: YTN; PAM sequence: CTT
catttctgaatgtttttatt

SEQ ID NO: 179417 - DNA, 20 bp, Artificial Sequence
  Description of Artificial Sequence: Synthetic oligonucleotide
  Target: ATXN1; (-) strand; PAM type: YTN; PAM sequence: CTC
caatcacttcatttctgaat

SEQ ID NO: 179418 - DNA, 20 bp, Artificial Sequence
  Description of Artificial Sequence: Synthetic oligonucleotide
  Target: ATXN1; (-) strand; PAM type: YTN; PAM sequence: TTC
tccaatcacttcatttctga

SEQ ID NO: 179419 - DNA, 20 bp, Artificial Sequence
  Description of Artificial Sequence: Synthetic oligonucleotide
  Target: ATXN1; (-) strand; PAM type: YTN; PAM sequence: TTT
ctccaatcacttcatttctg

SEQ ID NO: 179420 - DNA, 20 bp, Artificial Sequence
  Description of Artificial Sequence: Synthetic oligonucleotide
  Target: ATXN1; (-) strand; PAM type: YTN; PAM sequence: TTT
tctccaatcacttcatttct

SEQ ID NO: 179421 - DNA, 20 bp, Artificial Sequence
  Description of Artificial Sequence: Synthetic oligonucleotide
  Target: ATXN1; (-) strand; PAM type: YTN; PAM sequence: TTG
ttttctccaatcacttcatt

SEQ ID NO: 179422 - DNA, 20 bp, Artificial Sequence
  Description of Artificial Sequence: Synthetic oligonucleotide
  Target: ATXN1; (-) strand; PAM type: YTN; PAM sequence: TTT
gttttctccaatcacttcat

SEQ ID NO: 179423 - DNA, 20 bp, Artificial Sequence
  Description of Artificial Sequence: Synthetic oligonucleotide
  Target: ATXN1; (-) strand; PAM type: YTN; PAM sequence: CTA
tttgttttctccaatcactt

SEQ ID NO: 179424 - DNA, 20 bp, Artificial Sequence
  Description of Artificial Sequence: Synthetic oligonucleotide
  Target: ATXN1; (-) strand; PAM type: YTN; PAM sequence: CTA
tccaactatttgttttctcc

SEQ ID NO: 179425 - DNA, 20 bp, Artificial Sequence
  Description of Artificial Sequence: Synthetic oligonucleotide
  Target: ATXN1; (-) strand; PAM type: YTN; PAM sequence: CTC
tatccaactatttgttttct

SEQ ID NO: 179426 - DNA, 20 bp, Artificial Sequence
  Description of Artificial Sequence: Synthetic oligonucleotide
  Target: ATXN1; (-) strand; PAM type: YTN; PAM sequence: CTC
tctatccaactatttgtttt

SEQ ID NO: 179427 - DNA, 20 bp, Artificial Sequence
  Description of Artificial Sequence: Synthetic oligonucleotide
  Target: ATXN1; (-) strand; PAM type: YTN; PAM sequence: CTC
tctctatccaactatttgtt

SEQ ID NO: 179428 - DNA, 20 bp, Artificial Sequence
  Description of Artificial Sequence: Synthetic oligonucleotide
  Target: ATXN1; (-) strand; PAM type: YTN; PAM sequence: TTG
cctctctctatccaactatt

SEQ ID NO: 179429 - DNA, 20 bp, Artificial Sequence
  Description of Artificial Sequence: Synthetic oligonucleotide
  Target: ATXN1; (-) strand; PAM type: YTN; PAM sequence: TTT
gcctctctctatccaactat

SEQ ID NO: 179430 - DNA, 20 bp, Artificial Sequence
  Description of Artificial Sequence: Synthetic oligonucleotide
  Target: ATXN1; (-) strand; PAM type: YTN; PAM sequence: TTT
tgcctctctctatccaacta

SEQ ID NO: 179431 - DNA, 20 bp, Artificial Sequence
  Description of Artificial Sequence: Synthetic oligonucleotide
  Target: ATXN1; (-) strand; PAM type: YTN; PAM sequence: CTT
ttgcctctctctatccaact

SEQ ID NO: 179432 - DNA, 20 bp, Artificial Sequence
  Description of Artificial Sequence: Synthetic oligonucleotide
  Target: ATXN1; (-) strand; PAM type: YTN; PAM sequence: TTC
ttttgcctctctctatccaa

SEQ ID NO: 179433 - DNA, 20 bp, Artificial Sequence
  Description of Artificial Sequence: Synthetic oligonucleotide
  Target: ATXN1; (-) strand; PAM type: YTN; PAM sequence: TTC
ccacgttcttttgcctctct

SEQ ID NO: 179434 - DNA, 20 bp, Artificial Sequence
  Description of Artificial Sequence: Synthetic oligonucleotide
  Target: ATXN1; (-) strand; PAM type: YTN; PAM sequence: TTT
cccacgttcttttgcctctc

SEQ ID NO: 179435 - DNA, 20 bp, Artificial Sequence
  Description of Artificial Sequence: Synthetic oligonucleotide
  Target: ATXN1; (-) strand; PAM type: YTN; PAM sequence: CTT
tcccacgttcttttgcctct

SEQ ID NO: 179436 - DNA, 20 bp, Artificial Sequence
  Description of Artificial Sequence: Synthetic oligonucleotide
  Target: ATXN1; (-) strand; PAM type: YTN; PAM sequence: TTC
tttcccacgttcttttgcct

SEQ ID NO: 179437 - DNA, 20 bp, Artificial Sequence
  Description of Artificial Sequence: Synthetic oligonucleotide
  Target: ATXN1; (-) strand; PAM type: YTN; PAM sequence: TTC
aaattctttcccacgttctt

SEQ ID NO: 179438 - DNA, 20 bp, Artificial Sequence
  Description of Artificial Sequence: Synthetic oligonucleotide
  Target: ATXN1; (-) strand; PAM type: YTN; PAM sequence: CTT
caaattctttcccacgttct

SEQ ID NO: 179439 - DNA, 20 bp, Artificial Sequence
  Description of Artificial Sequence: Synthetic oligonucleotide
  Target: ATXN1; (-) strand; PAM type: YTN; PAM sequence: TTA
cttcaaattctttcccacgt

SEQ ID NO: 179440 - DNA, 20 bp, Artificial Sequence
  Description of Artificial Sequence: Synthetic oligonucleotide
  Target: ATXN1; (-) strand; PAM type: YTN; PAM sequence: TTT
acttcaaattctttcccacg

SEQ ID NO: 179441 - DNA, 20 bp, Artificial Sequence
  Description of Artificial Sequence: Synthetic oligonucleotide
  Target: ATXN1; (-) strand; PAM type: YTN; PAM sequence: TTT
tacttcaaattctttcccac

SEQ ID NO: 179442 - DNA, 20 bp, Artificial Sequence
  Description of Artificial Sequence: Synthetic oligonucleotide
  Target: ATXN1; (-) strand; PAM type: YTN; PAM sequence: CTT
ttacttcaaattctttccca

SEQ ID NO: 179443 - DNA, 20 bp, Artificial Sequence
  Description of Artificial Sequence: Synthetic oligonucleotide
  Target: ATXN1; (-) strand; PAM type: YTN; PAM sequence: TTC
ttttacttcaaattctttcc

SEQ ID NO: 179444 - DNA, 20 bp, Artificial Sequence
  Description of Artificial Sequence: Synthetic oligonucleotide
  Target: ATXN1; (-) strand; PAM type: YTN; PAM sequence: TTT
cttttacttcaaattctttc

SEQ ID NO: 179445 - DNA, 20 bp, Artificial Sequence
  Description of Artificial Sequence: Synthetic oligonucleotide
  Target: ATXN1; (-) strand; PAM type: YTN; PAM sequence: TTT
tcttttacttcaaattcttt

SEQ ID NO: 179446 - DNA, 20 bp, Artificial Sequence
  Description of Artificial Sequence: Synthetic oligonucleotide
  Target: ATXN1; (-) strand; PAM type: YTN; PAM sequence: TTT
ttcttttacttcaaattctt

SEQ ID NO: 179447 - DNA, 20 bp, Artificial Sequence
  Description of Artificial Sequence: Synthetic oligonucleotide
  Target: ATXN1; (-) strand; PAM type: YTN; PAM sequence: TTT
tttcttttacttcaaattct

SEQ ID NO: 179448 - DNA, 20 bp, Artificial Sequence
  Description of Artificial Sequence: Synthetic oligonucleotide
  Target: ATXN1; (-) strand; PAM type: YTN; PAM sequence: TTT
ttttcttttacttcaaattc

SEQ ID NO: 179449 - DNA, 20 bp, Artificial Sequence
  Description of Artificial Sequence: Synthetic oligonucleotide
  Target: ATXN1; (-) strand; PAM type: YTN; PAM sequence: TTT
tttttcttttacttcaaatt

SEQ ID NO: 179450 - DNA, 20 bp, Artificial Sequence
  Description of Artificial Sequence: Synthetic oligonucleotide
  Target: ATXN1; (-) strand; PAM type: YTN; PAM sequence: TTT
ttttttcttttacttcaaat

SEQ ID NO: 179451 - DNA, 20 bp, Artificial Sequence
  Description of Artificial Sequence: Synthetic oligonucleotide
  Target: ATXN1; (-) strand; PAM type: YTN; PAM sequence: TTT
tttttttcttttacttcaaa

SEQ ID NO: 179452 - DNA, 20 bp, Artificial Sequence
  Description of Artificial Sequence: Synthetic oligonucleotide
  Target: ATXN1; (-) strand; PAM type: YTN; PAM sequence: TTT
ttttttttcttttacttcaa

SEQ ID NO: 179453 - DNA, 20 bp, Artificial Sequence
  Description of Artificial Sequence: Synthetic oligonucleotide
  Target: ATXN1; (-) strand; PAM type: YTN; PAM sequence: TTT
tttttttttcttttacttca

SEQ ID NO: 179454 - DNA, 20 bp, Artificial Sequence
  Description of Artificial Sequence: Synthetic oligonucleotide
  Target: ATXN1; (-) strand; PAM type: YTN; PAM sequence: CTA
gaaaatggtttttttttttt

SEQ ID NO: 179455 - DNA, 20 bp, Artificial Sequence
  Description of Artificial Sequence: Synthetic oligonucleotide
  Target: ATXN1; (-) strand; PAM type: YTN; PAM sequence: TTC
atctagaaaatggttttttt

SEQ ID NO: 179456 - DNA, 20 bp, Artificial Sequence
  Description of Artificial Sequence: Synthetic oligonucleotide
  Target: ATXN1; (-) strand; PAM type: YTN; PAM sequence: CTT
catctagaaaatggtttttt

SEQ ID NO: 179457 - DNA, 20 bp, Artificial Sequence
  Description of Artificial Sequence: Synthetic oligonucleotide
  Target: ATXN1; (-) strand; PAM type: YTN; PAM sequence: TTG
gtcttcatctagaaaatggt

SEQ ID NO: 179458 - DNA, 20 bp, Artificial Sequence
  Description of Artificial Sequence: Synthetic oligonucleotide
  Target: ATXN1; (-) strand; PAM type: YTN; PAM sequence: TTT
ggtcttcatctagaaaatgg

SEQ ID NO: 179459 - DNA, 20 bp, Artificial Sequence
  Description of Artificial Sequence: Synthetic oligonucleotide
  Target: ATXN1; (-) strand; PAM type: YTN; PAM sequence: TTA
tttggtcttcatctagaaaa

SEQ ID NO: 179460 - DNA, 20 bp, Artificial Sequence
  Description of Artificial Sequence: Synthetic oligonucleotide
  Target: ATXN1; (-) strand; PAM type: YTN; PAM sequence: CTT
atttggtcttcatctagaaa

SEQ ID NO: 179461 - DNA, 20 bp, Artificial Sequence
  Description of Artificial Sequence: Synthetic oligonucleotide
  Target: ATXN1; (-) strand; PAM type: YTN; PAM sequence: TTC
ttatttggtcttcatctaga

SEQ ID NO: 179462 - DNA, 20 bp, Artificial Sequence
  Description of Artificial Sequence: Synthetic oligonucleotide
  Target: ATXN1; (-) strand; PAM type: YTN; PAM sequence: CTT
cttatttggtcttcatctag

SEQ ID NO: 179463 - DNA, 20 bp, Artificial Sequence
  Description of Artificial Sequence: Synthetic oligonucleotide
  Target: ATXN1; (-) strand; PAM type: YTN; PAM sequence: TTC
cttcttatttggtcttcatc

SEQ ID NO: 179464 - DNA, 20 bp, Artificial Sequence
  Description of Artificial Sequence: Synthetic oligonucleotide
  Target: ATXN1; (-) strand; PAM type: YTN; PAM sequence: TTG
tgttccttcttatttggtct

SEQ ID NO: 179465 - DNA, 20 bp, Artificial Sequence
  Description of Artificial Sequence: Synthetic oligonucleotide
  Target: ATXN1; (-) strand; PAM type: YTN; PAM sequence: CTT
gtgttccttcttatttggtc

SEQ ID NO: 179466 - DNA, 20 bp, Artificial Sequence
  Description of Artificial Sequence: Synthetic oligonucleotide
  Target: ATXN1; (-) strand; PAM type: YTN; PAM sequence: CTC
ttgtgttccttcttatttgg

SEQ ID NO: 179467 - DNA, 20 bp, Artificial Sequence
  Description of Artificial Sequence: Synthetic oligonucleotide
  Target: ATXN1; (-) strand; PAM type: YTN; PAM sequence: TTC
cctcttgtgttccttcttat

SEQ ID NO: 179468 - DNA, 20 bp, Artificial Sequence
  Description of Artificial Sequence: Synthetic oligonucleotide
  Target: ATXN1; (-) strand; PAM type: YTN; PAM sequence: CTA
aaggtgtatgtatgtattcc

SEQ ID NO: 179469 - DNA, 20 bp, Artificial Sequence
  Description of Artificial Sequence: Synthetic oligonucleotide
  Target: ATXN1; (-) strand; PAM type: YTN; PAM sequence: CTG
ggactaaaggtgtatgtatg

SEQ ID NO: 179470 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggactaaag

SEQ ID NO: 179471 - DNA, 20 bp, Artificial Sequence
  Description of Artificial Sequence: Synthetic oligonucleotide
  Target: ATXN1; (-) strand; PAM type: YTN; PAM sequence: TTA
gcctcccaagtagctgggac

SEQ ID NO: 179472 - DNA, 20 bp, Artificial Sequence
  Description of Artificial Sequence: Synthetic oligonucleotide
  Target: ATXN1; (-) strand; PAM type: YTN; PAM sequence: CTT
agcctcccaagtagctggga

SEQ ID NO: 179473 - DNA, 20 bp, Artificial Sequence
  Description of Artificial Sequence: Synthetic oligonucleotide
  Target: ATXN1; (-) strand; PAM type: YTN; PAM sequence: TTC
aagcaatcatcccaccttag

SEQ ID NO: 179474 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcaatcatcccac

SEQ ID NO: 179475 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcaatcatcc

SEQ ID NO: 179476 - DNA, 20 bp, Artificial Sequence
  Description of Artificial Sequence: Synthetic oligonucleotide
  Target: ATXN1; (-) strand; PAM type: YTN; PAM sequence: CTG
gctcctgggttcaagcaatc

SEQ ID NO: 179477 - DNA, 20 bp, Artificial Sequence
  Description of Artificial Sequence: Synthetic oligonucleotide
  Target: ATXN1; (-) strand; PAM type: YTN; PAM sequence: CTC
tggctcctgggttcaagcaa

SEQ ID NO: 179478 - DNA, 20 bp, Artificial Sequence
  Description of Artificial Sequence: Synthetic oligonucleotide
  Target: ATXN1; (-) strand; PAM type: YTN; PAM sequence: CTG
caacctctggctcctgggtt

SEQ ID NO: 179479 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctggctcctg

SEQ ID NO: 179480 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctctggct

SEQ ID NO: 179481 - DNA, 20 bp, Artificial Sequence
  Description of Artificial Sequence: Synthetic oligonucleotide
  Target: ATXN1; (-) strand; PAM type: YTN; PAM sequence: TTT
ggctcactgcaacctctggc

SEQ ID NO: 179482 - DNA, 20 bp, Artificial Sequence
  Description of Artificial Sequence: Synthetic oligonucleotide
  Target: ATXN1; (-) strand; PAM type: YTN; PAM sequence: TTT
tggctcactgcaacctctgg

SEQ ID NO: 179483 - DNA, 20 bp, Artificial Sequence
  Description of Artificial Sequence: Synthetic oligonucleotide
  Target: ATXN1; (-) strand; PAM type: YTN; PAM sequence: CTA
ttttggctcactgcaacctc

SEQ ID NO: 179484 - DNA, 20 bp, Artificial Sequence
  Description of Artificial Sequence: Synthetic oligonucleotide
  Target: ATXN1; (-) strand; PAM type: YTN; PAM sequence: TTG
gagtgcagtggtgctatttt

SEQ ID NO: 179485 - DNA, 20 bp, Artificial Sequence
  Description of Artificial Sequence: Synthetic oligonucleotide
  Target: ATXN1; (-) strand; PAM type: YTN; PAM sequence: TTC
ccaggttggagtgcagtggt

SEQ ID NO: 179486 - DNA, 20 bp, Artificial Sequence
  Description of Artificial Sequence: Synthetic oligonucleotide
  Target: ATXN1; (-) strand; PAM type: YTN; PAM sequence: TTT
cccaggttggagtgcagtgg

SEQ ID NO: 179487 - DNA, 20 bp, Artificial Sequence
  Description of Artificial Sequence: Synthetic oligonucleotide
  Target: ATXN1; (-) strand; PAM type: YTN; PAM sequence: CTG
tttcccaggttggagtgcag

SEQ ID NO: 179488 - DNA, 20 bp, Artificial Sequence
  Description of Artificial Sequence: Synthetic oligonucleotide
  Target: ATXN1; (-) strand; PAM type: YTN; PAM sequence: CTC
tgtttcccaggttggagtgc

SEQ ID NO: 179489 - DNA, 20 bp, Artificial Sequence
  Description of Artificial Sequence: Synthetic oligonucleotide
  Target: ATXN1; (-) strand; PAM type: YTN; PAM sequence: CTC
actctgtttcccaggttgga

SEQ ID NO: 179490 - DNA, 20 bp, Artificial Sequence
  Description of Artificial Sequence: Synthetic oligonucleotide
  Target: ATXN1; (-) strand; PAM type: YTN; PAM sequence: TTA
agacagggtctcactctgtt

SEQ ID NO: 179491 - DNA, 20 bp, Artificial Sequence
  Description of Artificial Sequence: Synthetic oligonucleotide
  Target: ATXN1; (-) strand; PAM type: YTN; PAM sequence: TTT
aagacagggtctcactctgt

SEQ ID NO: 179492 - DNA, 20 bp, Artificial Sequence
  Description of Artificial Sequence: Synthetic oligonucleotide
  Target: ATXN1; (-) strand; PAM type: YTN; PAM sequence: TTT
taagacagggtctcactctg

SEQ ID NO: 179493 - DNA, 20 bp, Artificial Sequence
  Description of Artificial Sequence: Synthetic oligonucleotide
  Target: ATXN1; (-) strand; PAM type: YTN; PAM sequence: TTT
ttaagacagggtctcactct

SEQ ID NO: 179494 - DNA, 20 bp, Artificial Sequence
  Description of Artificial Sequence: Synthetic oligonucleotide
  Target: ATXN1; (-) strand; PAM type: YTN; PAM sequence: TTT
tttaagacagggtctcactc

SEQ ID NO: 179495 - DNA, 20 bp, Artificial Sequence
  Description of Artificial Sequence: Synthetic oligonucleotide
  Target: ATXN1; (-) strand; PAM type: YTN; PAM sequence: TTT
ttttaagacagggtctcact

SEQ ID NO: 179496 - DNA, 20 bp, Artificial Sequence
  Description of Artificial Sequence: Synthetic oligonucleotide
  Target: ATXN1; (-) strand; PAM type: YTN; PAM sequence: TTT
tttttaagacagggtctcac

SEQ ID NO: 179497 - DNA, 20 bp, Artificial Sequence
  Description of Artificial Sequence: Synthetic oligonucleotide
  Target: ATXN1; (-) strand; PAM type: YTN; PAM sequence: TTT
ttttttaagacagggtctca

SEQ ID NO: 179498 - DNA, 20 bp, Artificial Sequence
  Description of Artificial Sequence: Synthetic oligonucleotide
  Target: ATXN1; (-) strand; PAM type: YTN; PAM sequence: TTT
tttttttaagacagggtctc

SEQ ID NO: 179499 - DNA, 20 bp, Artificial Sequence
  Description of Artificial Sequence: Synthetic oligonucleotide
  Target: ATXN1; (-) strand; PAM type: YTN; PAM sequence: TTT
ttttttttaagacagggtct

SEQ ID NO: 179500 - DNA, 20 bp, Artificial Sequence
  Description of Artificial Sequence: Synthetic oligonucleotide
  Target: ATXN1; (-) strand; PAM type: YTN; PAM sequence: TTT
tttttttttaagacagggtc

SEQ ID NO: 179501 - DNA, 20 bp, Artificial Sequence
  Description of Artificial Sequence: Synthetic oligonucleotide
  Target: ATXN1; (-) strand; PAM type: YTN; PAM sequence: CTT
ttttttttttaagacagggt

SEQ ID NO: 179502 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttaagacagg

SEQ ID NO: 179503 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttaagacag

SEQ ID NO: 179504 - DNA, 20 bp, Artificial Sequence
  Description of Artificial Sequence: Synthetic oligonucleotide
  Target: ATXN1; (-) strand; PAM type: YTN; PAM sequence: TTT
tcttttttttttttaagaca

SEQ ID NO: 179505 - DNA, 20 bp, Artificial Sequence
  Description of Artificial Sequence: Synthetic oligonucleotide
  Target: ATXN1; (-) strand; PAM type: YTN; PAM sequence: CTT
ttcttttttttttttaagac

SEQ ID NO: 179506 - DNA, 20 bp, Artificial Sequence
  Description of Artificial Sequence: Synthetic oligonucleotide
  Target: ATXN1; (-) strand; PAM type: YTN; PAM sequence: TTC
ttttcttttttttttttaag

SEQ ID NO: 179507 - DNA, 20 bp, Artificial Sequence
  Description of Artificial Sequence: Synthetic oligonucleotide
  Target: ATXN1; (-) strand; PAM type: YTN; PAM sequence: TTT
cttttcttttttttttttaa

SEQ ID NO: 179508 - DNA, 20 bp, Artificial Sequence
  Description of Artificial Sequence: Synthetic oligonucleotide
  Target: ATXN1; (-) strand; PAM type: YTN; PAM sequence: TTT
tcttttctttttttttttta

SEQ ID NO: 179509 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttttttttt

SEQ ID NO: 179510 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttttttt

SEQ ID NO: 179511 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttttttttt

SEQ ID NO: 179512 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttctttttttt

SEQ ID NO: 179513 - DNA, 20 bp, Artificial Sequence
  Description of Artificial Sequence: Synthetic oligonucleotide
  Target: ATXN1; (-) strand; PAM type: YTN; PAM sequence: TTT
ttcttttcttttcttttttt

SEQ ID NO: 179514 - DNA, 20 bp, Artificial Sequence
  Description of Artificial Sequence: Synthetic oligonucleotide
  Target: ATXN1; (-) strand; PAM type: YTN; PAM sequence: TTT
tttcttttcttttctttttt

SEQ ID NO: 179515 - DNA, 20 bp, Artificial Sequence
  Description of Artificial Sequence: Synthetic oligonucleotide
  Target: ATXN1; (-) strand; PAM type: YTN; PAM sequence: TTA
attttttcttttcttttctt

SEQ ID NO: 179516 - DNA, 20 bp, Artificial Sequence
  Description of Artificial Sequence: Synthetic oligonucleotide
  Target: ATXN1; (-) strand; PAM type: YTN; PAM sequence: TTT
aattttttcttttcttttct

SEQ ID NO: 179517 - DNA, 20 bp, Artificial Sequence
  Description of Artificial Sequence: Synthetic oligonucleotide
  Target: ATXN1; (-) strand; PAM type: YTN; PAM sequence: CTT
taattttttcttttcttttc

SEQ ID NO: 179518 - DNA, 20 bp, Artificial Sequence
  Description of Artificial Sequence: Synthetic oligonucleotide
  Target: ATXN1; (-) strand; PAM type: YTN; PAM sequence: TTC
ccgctttaattttttctttt

SEQ ID NO: 179519 - DNA, 20 bp, Artificial Sequence
  Description of Artificial Sequence: Synthetic oligonucleotide
  Target: ATXN1; (-) strand; PAM type: YTN; PAM sequence: CTG
aattcccgctttaatttttt

SEQ ID NO: 179520 - DNA, 20 bp, Artificial Sequence
  Description of Artificial Sequence: Synthetic oligonucleotide
  Target: ATXN1; (-) strand; PAM type: YTN; PAM sequence: TTC
cctgaattcccgctttaatt

SEQ ID NO: 179521 - DNA, 20 bp, Artificial Sequence
  Description of Artificial Sequence: Synthetic oligonucleotide
  Target: ATXN1; (-) strand; PAM type: YTN; PAM sequence: CTT
ccctgaattcccgctttaat

SEQ ID NO: 179522 - DNA, 20 bp, Artificial Sequence
  Description of Artificial Sequence: Synthetic oligonucleotide
  Target: ATXN1; (-) strand; PAM type: YTN; PAM sequence: CTG
gtgccatcatcttccctgaa

SEQ ID NO: 179523 - DNA, 20 bp, Artificial Sequence
  Description of Artificial Sequence: Synthetic oligonucleotide
  Target: ATXN1; (-) strand; PAM type: YTN; PAM sequence: TTG
acactggtgccatcatcttc

SEQ ID NO: 179524 - DNA, 20 bp, Artificial Sequence
  Description of Artificial Sequence: Synthetic oligonucleotide
  Target: ATXN1; (-) strand; PAM type: YTN; PAM sequence: TTT
gacactggtgccatcatctt

SEQ ID NO: 179525 - DNA, 20 bp, Artificial Sequence
  Description of Artificial Sequence: Synthetic oligonucleotide
  Target: ATXN1; (-) strand; PAM type: YTN; PAM sequence: CTT
tgacactggtgccatcatct

SEQ ID NO: 179526 - DNA, 20 bp, Artificial Sequence
  Description of Artificial Sequence: Synthetic oligonucleotide
  Target: ATXN1; (-) strand; PAM type: YTN; PAM sequence: CTA
cctttgacactggtgccatc

SEQ ID NO: 179527 - DNA, 20 bp, Artificial Sequence
  Description of Artificial Sequence: Synthetic oligonucleotide
  Target: ATXN1; (-) strand; PAM type: YTN; PAM sequence: CTG
tgctacctttgacactggtg

SEQ ID NO: 179528 - DNA, 20 bp, Artificial Sequence
  Description of Artificial Sequence: Synthetic oligonucleotide
  Target: ATXN1; (-) strand; PAM type: YTN; PAM sequence: TTA
aactgtgctacctttgacac

SEQ ID NO: 179529 - DNA, 20 bp, Artificial Sequence
  Description of Artificial Sequence: Synthetic oligonucleotide
  Target: ATXN1; (-) strand; PAM type: YTN; PAM sequence: TTT
aaactgtgctacctttgaca

SEQ ID NO: 179530 - DNA, 20 bp, Artificial Sequence
  Description of Artificial Sequence: Synthetic oligonucleotide
  Target: ATXN1; (-) strand; PAM type: YTN; PAM sequence: TTT
taaactgtgctacctttgac

SEQ ID NO: 179531 - DNA, 20 bp, Artificial Sequence
  Description of Artificial Sequence: Synthetic oligonucleotide
  Target: ATXN1; (-) strand; PAM type: YTN; PAM sequence: TTT
ttaaactgtgctacctttga

SEQ ID NO: 179532 - DNA, 20 bp, Artificial Sequence
  Description of Artificial Sequence: Synthetic oligonucleotide
  Target: ATXN1; (-) strand; PAM type: YTN; PAM sequence: TTT
tttaaactgtgctacctttg

SEQ ID NO: 179533 - DNA, 20 bp, Artificial Sequence
  Description of Artificial Sequence: Synthetic oligonucleotide
  Target: ATXN1; (-) strand; PAM type: YTN; PAM sequence: TTT
ttttaaactgtgctaccttt

SEQ ID NO: 179534 - DNA, 20 bp, Artificial Sequence
  Description of Artificial Sequence: Synthetic oligonucleotide
  Target: ATXN1; (-) strand; PAM type: YTN; PAM sequence: CTG
aaaaatttttttaaactgtg

SEQ ID NO: 179535 - DNA, 20 bp, Artificial Sequence
  Description of Artificial Sequence: Synthetic oligonucleotide
  Target: ATXN1; (-) strand; PAM type: YTN; PAM sequence: TTC
tgaaaaatttttttaaactg

SEQ ID NO: 179536 - DNA, 20 bp, Artificial Sequence
  Description of Artificial Sequence: Synthetic oligonucleotide
  Target: ATXN1; (-) strand; PAM type: YTN; PAM sequence: CTG
gcagggaggaggagggcagg

SEQ ID NO: 179537 - DNA, 20 bp, Artificial Sequence
  Description of Artificial Sequence: Synthetic oligonucleotide
  Target: ATXN1; (-) strand; PAM type: YTN; PAM sequence: TTA
ctggcagggaggaggagggc

SEQ ID NO: 179538 - DNA, 20 bp, Artificial Sequence
  Description of Artificial Sequence: Synthetic oligonucleotide
  Target: ATXN1; (-) strand; PAM type: YTN; PAM sequence: TTG
ttactggcagggaggaggag

SEQ ID NO: 179539 - DNA, 20 bp, Artificial Sequence
  Description of Artificial Sequence: Synthetic oligonucleotide
  Target: ATXN1; (-) strand; PAM type: YTN; PAM sequence: CTA
ttgttactggcagggaggag

SEQ ID NO: 179540 - DNA, 20 bp, Artificial Sequence
  Description of Artificial Sequence: Synthetic oligonucleotide
  Target: ATXN1; (-) strand; PAM type: YTN; PAM sequence: TTG
ctattgttactggcagggag

SEQ ID NO: 179541 - DNA, 20 bp, Artificial Sequence
  Description of Artificial Sequence: Synthetic oligonucleotide
  Target: ATXN1; (-) strand; PAM type: YTN; PAM sequence: TTA
tcattgctattgttactggc

SEQ ID NO: 179542 - DNA, 20 bp, Artificial Sequence
  Description of Artificial Sequence: Synthetic oligonucleotide
  Target: ATXN1; (-) strand; PAM type: YTN; PAM sequence: TTG
ttatcattgctattgttact

SEQ ID NO: 179543 - DNA, 20 bp, Artificial Sequence
  Description of Artificial Sequence: Synthetic oligonucleotide
  Target: ATXN1; (-) strand; PAM type: YTN; PAM sequence: TTG
ttgttatcattgctattgtt

SEQ ID NO: 179544 - DNA, 20 bp, Artificial Sequence
  Description of Artificial Sequence: Synthetic oligonucleotide
  Target: ATXN1; (-) strand; PAM type: YTN; PAM sequence: TTT
gttgttatcattgctattgt

SEQ ID NO: 179545 - DNA, 20 bp, Artificial Sequence
  Description of Artificial Sequence: Synthetic oligonucleotide
  Target: ATXN1; (-) strand; PAM type: YTN; PAM sequence: TTT
tgttgttatcattgctattg

SEQ ID NO: 179546 - DNA, 20 bp, Artificial Sequence
  Description of Artificial Sequence: Synthetic oligonucleotide
  Target: ATXN1; (-) strand; PAM type: YTN; PAM sequence: TTT
ttgttgttatcattgctatt

SEQ ID NO: 179547 - DNA, 20 bp, Artificial Sequence
  Description of Artificial Sequence: Synthetic oligonucleotide
  Target: ATXN1; (-) strand; PAM type: YTN; PAM sequence: CTG
tttttgttgttatcattgct

SEQ ID NO: 179548 - DNA, 20 bp, Artificial Sequence
  Description of Artificial Sequence: Synthetic oligonucleotide
  Target: ATXN1; (-) strand; PAM type: YTN; PAM sequence: CTC
tgtttttgttgttatcattg

SEQ ID NO: 179549 - DNA, 20 bp, Artificial Sequence
  Description of Artificial Sequence: Synthetic oligonucleotide
  Target: ATXN1; (-) strand; PAM type: YTN; PAM sequence: TTC
tctgtttttgttgttatcat

SEQ ID NO: 179550 - DNA, 20 bp, Artificial Sequence
  Description of Artificial Sequence: Synthetic oligonucleotide
  Target: ATXN1; (-) strand; PAM type: YTN; PAM sequence: TTT
ctctgtttttgttgttatca

SEQ ID NO: 179551 - DNA, 20 bp, Artificial Sequence
  Description of Artificial Sequence: Synthetic oligonucleotide
  Target: ATXN1; (-) strand; PAM type: YTN; PAM sequence: TTC
caatttctctgtttttgttg

SEQ ID NO: 179552 - DNA, 20 bp, Artificial Sequence
  Description of Artificial Sequence: Synthetic oligonucleotide
  Target: ATXN1; (-) strand; PAM type: YTN; PAM sequence: CTG
tgtaattccaatttctctgt

SEQ ID NO: 179553 - DNA, 20 bp, Artificial Sequence
  Description of Artificial Sequence: Synthetic oligonucleotide
  Target: ATXN1; (-) strand; PAM type: YTN; PAM sequence: TTG
gctgtgtaattccaatttct

SEQ ID NO: 179554 - DNA, 20 bp, Artificial Sequence
  Description of Artificial Sequence: Synthetic oligonucleotide
  Target: ATXN1; (-) strand; PAM type: YTN; PAM sequence: TTT
ggctgtgtaattccaatttc

SEQ ID NO: 179555 - DNA, 20 bp, Artificial Sequence
  Description of Artificial Sequence: Synthetic oligonucleotide
  Target: ATXN1; (-) strand; PAM type: YTN; PAM sequence: TTT
tggctgtgtaattccaattt

SEQ ID NO: 179556 - DNA, 20 bp, Artificial Sequence
  Description of Artificial Sequence: Synthetic oligonucleotide
  Target: ATXN1; (-) strand; PAM type: YTN; PAM sequence: TTT
ttggctgtgtaattccaatt

SEQ ID NO: 179557 - DNA, 20 bp, Artificial Sequence
  Description of Artificial Sequence: Synthetic oligonucleotide
  Target: ATXN1; (-) strand; PAM type: YTN; PAM sequence: TTG
atgtggtccatgggtttttg

SEQ ID NO: 179558 - DNA, 20 bp, Artificial Sequence
  Description of Artificial Sequence: Synthetic oligonucleotide
  Target: ATXN1; (-) strand; PAM type: YTN; PAM sequence: CTT
gatgtggtccatgggttttt

SEQ ID NO: 179559 - DNA, 20 bp, Artificial Sequence
  Description of Artificial Sequence: Synthetic oligonucleotide
  Target: ATXN1; (-) strand; PAM type: YTN; PAM sequence: TTG
tcttgatgtggtccatgggt

SEQ ID NO: 179560 - DNA, 20 bp, Artificial Sequence
  Description of Artificial Sequence: Synthetic oligonucleotide
  Target: ATXN1; (-) strand; PAM type: YTN; PAM sequence: TTT
gtcttgatgtggtccatggg

SEQ ID NO: 179561 - DNA, 20 bp, Artificial Sequence
  Description of Artificial Sequence: Synthetic oligonucleotide
  Target: ATXN1; (-) strand; PAM type: YTN; PAM sequence: TTT
tgtcttgatgtggtccatgg

SEQ ID NO: 179562 - DNA, 20 bp, Artificial Sequence
  Description of Artificial Sequence: Synthetic oligonucleotide
  Target: ATXN1; (-) strand; PAM type: YTN; PAM sequence: CTC
attttgtcttgatgtggtcc

SEQ ID NO: 179563 - DNA, 20 bp, Artificial Sequence
  Description of Artificial Sequence: Synthetic oligonucleotide
  Target: ATXN1; (-) strand; PAM type: YTN; PAM sequence: CTA
cacagtaacctcattttgtc

SEQ ID NO: 179564 - DNA, 20 bp, Artificial Sequence
  Description of Artificial Sequence: Synthetic oligonucleotide
  Target: ATXN1; (-) strand; PAM type: YTN; PAM sequence: TTA
tggactacacagtaacctca

SEQ ID NO: 179565 - DNA, 20 bp, Artificial Sequence
  Description of Artificial Sequence: Synthetic oligonucleotide
  Target: ATXN1; (-) strand; PAM type: YTN; PAM sequence: TTT
atggactacacagtaacctc

SEQ ID NO: 179566 - DNA, 20 bp, Artificial Sequence
  Description of Artificial Sequence: Synthetic oligonucleotide
  Target: ATXN1; (-) strand; PAM type: YTN; PAM sequence: TTC
aggtttatggactacacagt

SEQ ID NO: 179567 - DNA, 20 bp, Artificial Sequence
  Description of Artificial Sequence: Synthetic oligonucleotide
  Target: ATXN1; (-) strand; PAM type: YTN; PAM sequence: CTT
caggtttatggactacacag

SEQ ID NO: 179568 - DNA, 20 bp, Artificial Sequence
  Description of Artificial Sequence: Synthetic oligonucleotide
  Target: ATXN1; (-) strand; PAM type: YTN; PAM sequence: CTG
tcttcaggtttatggactac

SEQ ID NO: 179569 - DNA, 20 bp, Artificial Sequence
  Description of Artificial Sequence: Synthetic oligonucleotide
  Target: ATXN1; (-) strand; PAM type: YTN; PAM sequence: TTC
ctgtcttcaggtttatggac

SEQ ID NO: 179570 - DNA, 20 bp, Artificial Sequence
  Description of Artificial Sequence: Synthetic oligonucleotide
  Target: ATXN1; (-) strand; PAM type: YTN; PAM sequence: TTC
ggccacacccattcctgtct

SEQ ID NO: 179571 - DNA, 20 bp, Artificial Sequence
  Description of Artificial Sequence: Synthetic oligonucleotide
  Target: ATXN1; (-) strand; PAM type: YTN; PAM sequence: CTA
taaatggttcggccacaccc

SEQ ID NO: 179572 - DNA, 20 bp, Artificial Sequence
  Description of Artificial Sequence: Synthetic oligonucleotide
  Target: ATXN1; (-) strand; PAM type: YTN; PAM sequence: CTG
tcactataaatggttcggcc

SEQ ID NO: 179573 - DNA, 20 bp, Artificial Sequence
  Description of Artificial Sequence: Synthetic oligonucleotide
  Target: ATXN1; (-) strand; PAM type: YTN; PAM sequence: CTC
tgtcactataaatggttcgg

SEQ ID NO: 179574 - DNA, 20 bp, Artificial Sequence
  Description of Artificial Sequence: Synthetic oligonucleotide
  Target: ATXN1; (-) strand; PAM type: YTN; PAM sequence: CTG
gctctgtcactataaatggt

SEQ ID NO: 179575 - DNA, 20 bp, Artificial Sequence
  Description of Artificial Sequence: Synthetic oligonucleotide
  Target: ATXN1; (-) strand; PAM type: YTN; PAM sequence: CTG
cctggctctgtcactataaa

SEQ ID NO: 179576 - DNA, 20 bp, Artificial Sequence
  Description of Artificial Sequence: Synthetic oligonucleotide
  Target: ATXN1; (-) strand; PAM type: YTN; PAM sequence: TTC
tgcctggctctgtcactata

SEQ ID NO: 179577 - DNA, 20 bp, Artificial Sequence
  Description of Artificial Sequence: Synthetic oligonucleotide
  Target: ATXN1; (-) strand; PAM type: YTN; PAM sequence: CTT
ctgcctggctctgtcactat

SEQ ID NO: 179578 - DNA, 20 bp, Artificial Sequence
  Description of Artificial Sequence: Synthetic oligonucleotide
  Target: ATXN1; (-) strand; PAM type: YTN; PAM sequence: TTG
cttctgcctggctctgtcac

SEQ ID NO: 179579 - DNA, 20 bp, Artificial Sequence
  Description of Artificial Sequence: Synthetic oligonucleotide
  Target: ATXN1; (-) strand; PAM type: YTN; PAM sequence: TTG
cacagatattgcttctgcct

SEQ ID NO: 179580 - DNA, 20 bp, Artificial Sequence
  Description of Artificial Sequence: Synthetic oligonucleotide
  Target: ATXN1; (-) strand; PAM type: YTN; PAM sequence: CTT
gcacagatattgcttctgcc

SEQ ID NO: 179581 - DNA, 20 bp, Artificial Sequence
  Description of Artificial Sequence: Synthetic oligonucleotide
  Target: ATXN1; (-) strand; PAM type: YTN; PAM sequence: CTC
ttgcacagatattgcttctg

SEQ ID NO: 179582 - DNA, 20 bp, Artificial Sequence
  Description of Artificial Sequence: Synthetic oligonucleotide
  Target: ATXN1; (-) strand; PAM type: YTN; PAM sequence: TTC
tcttgcacagatattgcttc

SEQ ID NO: 179583 - DNA, 20 bp, Artificial Sequence
  Description of Artificial Sequence: Synthetic oligonucleotide
  Target: ATXN1; (-) strand; PAM type: YTN; PAM sequence: TTT
ctcttgcacagatattgctt

SEQ ID NO: 179584 - DNA, 20 bp, Artificial Sequence
  Description of Artificial Sequence: Synthetic oligonucleotide
  Target: ATXN1; (-) strand; PAM type: YTN; PAM sequence: CTT
tctcttgcacagatattgct

SEQ ID NO: 179585 - DNA, 20 bp, Artificial Sequence
  Description of Artificial Sequence: Synthetic oligonucleotide
  Target: ATXN1; (-) strand; PAM type: YTN; PAM sequence: CTC
caactttctcttgcacagat

SEQ ID NO: 179586 - DNA, 20 bp, Artificial Sequence
  Description of Artificial Sequence: Synthetic oligonucleotide
  Target: ATXN1; (-) strand; PAM type: YTN; PAM sequence: CTC
ctccaactttctcttgcaca

SEQ ID NO: 179587 - DNA, 20 bp, Artificial Sequence
  Description of Artificial Sequence: Synthetic oligonucleotide
  Target: ATXN1; (-) strand; PAM type: YTN; PAM sequence: CTC
tcctccaactttctcttgca

SEQ ID NO: 179588 - DNA, 20 bp, Artificial Sequence
  Description of Artificial Sequence: Synthetic oligonucleotide
  Target: ATXN1; (-) strand; PAM type: YTN; PAM sequence: CTG
cctctcctccaactttctct

SEQ ID NO: 179589 - DNA, 20 bp, Artificial Sequence
  Description of Artificial Sequence: Synthetic oligonucleotide
  Target: ATXN1; (-) strand; PAM type: YTN; PAM sequence: TTC
agatgcccactgcctctcct

SEQ ID NO: 179590 - DNA, 20 bp, Artificial Sequence
  Description of Artificial Sequence: Synthetic oligonucleotide
  Target: ATXN1; (-) strand; PAM type: YTN; PAM sequence: CTT
cagatgcccactgcctctcc

SEQ ID NO: 179591 - DNA, 20 bp, Artificial Sequence
  Description of Artificial Sequence: Synthetic oligonucleotide
  Target: ATXN1; (-) strand; PAM type: YTN; PAM sequence: TTG
tgccaaaaccttcagatgcc

SEQ ID NO: 179592 - DNA, 20 bp, Artificial Sequence
  Description of Artificial Sequence: Synthetic oligonucleotide
  Target: ATXN1; (-) strand; PAM type: YTN; PAM sequence: TTG
ggagcccgttgtgccaaaac

SEQ ID NO: 179593 - DNA, 20 bp, Artificial Sequence
  Description of Artificial Sequence: Synthetic oligonucleotide
  Target: ATXN1; (-) strand; PAM type: YTN; PAM sequence: CTT
gggagcccgttgtgccaaaa

SEQ ID NO: 179594 - DNA, 20 bp, Artificial Sequence
  Description of Artificial Sequence: Synthetic oligonucleotide
  Target: ATXN1; (-) strand; PAM type: YTN; PAM sequence: TTG
gaagcttgggagcccgttgt

SEQ ID NO: 179595 - DNA, 20 bp, Artificial Sequence
  Description of Artificial Sequence: Synthetic oligonucleotide
  Target: ATXN1; (-) strand; PAM type: YTN; PAM sequence: TTT
ggaagcttgggagcccgttg

SEQ ID NO: 179596 - DNA, 20 bp, Artificial Sequence
  Description of Artificial Sequence: Synthetic oligonucleotide
  Target: ATXN1; (-) strand; PAM type: YTN; PAM sequence: CTT
tggaagcttgggagcccgtt

SEQ ID NO: 179597 - DNA, 20 bp, Artificial Sequence
  Description of Artificial Sequence: Synthetic oligonucleotide
  Target: ATXN1; (-) strand; PAM type: YTN; PAM sequence: CTG
accgtgccgtaaggaccttt

SEQ ID NO: 179598 - DNA, 20 bp, Artificial Sequence
  Description of Artificial Sequence: Synthetic oligonucleotide
  Target: ATXN1; (-) strand; PAM type: YTN; PAM sequence: CTG
ctgaccgtgccgtaaggacc

SEQ ID NO: 179599 - DNA, 20 bp, Artificial Sequence
  Description of Artificial Sequence: Synthetic oligonucleotide
  Target: ATXN1; (-) strand; PAM type: YTN; PAM sequence: CTC
accaccctgctgaccgtgcc

SEQ ID NO: 179600 - DNA, 20 bp, Artificial Sequence
  Description of Artificial Sequence: Synthetic oligonucleotide
  Target: ATXN1; (-) strand; PAM type: YTN; PAM sequence: CTC
aaaatagctcaccaccctgc

SEQ ID NO: 179601 - DNA, 20 bp, Artificial Sequence
  Description of Artificial Sequence: Synthetic oligonucleotide
  Target: ATXN1; (-) strand; PAM type: YTN; PAM sequence: CTG
tgctcaaaatagctcaccac

SEQ ID NO: 179602 - DNA, 20 bp, Artificial Sequence
  Description of Artificial Sequence: Synthetic oligonucleotide
  Target: ATXN1; (-) strand; PAM type: YTN; PAM sequence: CTG
ctgtgctcaaaatagctcac

SEQ ID NO: 179603 - DNA, 20 bp, Artificial Sequence
  Description of Artificial Sequence: Synthetic oligonucleotide
  Target: ATXN1; (-) strand; PAM type: YTN; PAM sequence: TTG
ccaatgatgctgctgtgctc

SEQ ID NO: 179604 - DNA, 20 bp, Artificial Sequence
  Description of Artificial Sequence: Synthetic oligonucleotide
  Target: ATXN1; (-) strand; PAM type: YTN; PAM sequence: CTT
gccaatgatgctgctgtgct

SEQ ID NO: 179605 - DNA, 20 bp, Artificial Sequence
  Description of Artificial Sequence: Synthetic oligonucleotide
  Target: ATXN1; (-) strand; PAM type: YTN; PAM sequence: CTG
caggaccccttgccaatgat

SEQ ID NO: 179606 - DNA, 20 bp, Artificial Sequence
  Description of Artificial Sequence: Synthetic oligonucleotide
  Target: ATXN1; (-) strand; PAM type: YTN; PAM sequence: TTC
tgcaggaccccttgccaatg

SEQ ID NO: 179607 - DNA, 20 bp, Artificial Sequence
  Description of Artificial Sequence: Synthetic oligonucleotide
  Target: ATXN1; (-) strand; PAM type: YTN; PAM sequence: TTG
gattctgcaggaccccttgc

SEQ ID NO: 179608 - DNA, 20 bp, Artificial Sequence
  Description of Artificial Sequence: Synthetic oligonucleotide
  Target: ATXN1; (-) strand; PAM type: YTN; PAM sequence: CTC
accccatgaattggattctg

SEQ ID NO: 179609 - DNA, 20 bp, Artificial Sequence
  Description of Artificial Sequence: Synthetic oligonucleotide
  Target: ATXN1; (-) strand; PAM type: YTN; PAM sequence: TTG
ccctcaccccatgaattgga

SEQ ID NO: 179610 - DNA, 20 bp, Artificial Sequence
  Description of Artificial Sequence: Synthetic oligonucleotide
  Target: ATXN1; (-) strand; PAM type: YTN; PAM sequence: CTT
gccctcaccccatgaattgg

SEQ ID NO: 179611 - DNA, 20 bp, Artificial Sequence
  Description of Artificial Sequence: Synthetic oligonucleotide
  Target: ATXN1; (-) strand; PAM type: YTN; PAM sequence: TTC
cttgccctcaccccatgaat

SEQ ID NO: 179612 - DNA, 20 bp, Artificial Sequence
  Description of Artificial Sequence: Synthetic oligonucleotide
  Target: ATXN1; (-) strand; PAM type: YTN; PAM sequence: TTC
ccagggttccttgccctcac

SEQ ID NO: 179613 - DNA, 20 bp, Artificial Sequence
  Description of Artificial Sequence: Synthetic oligonucleotide
  Target: ATXN1; (-) strand; PAM type: YTN; PAM sequence: CTT
cccagggttccttgccctca

SEQ ID NO: 179614 - DNA, 20 bp, Artificial Sequence
  Description of Artificial Sequence: Synthetic oligonucleotide
  Target: ATXN1; (-) strand; PAM type: YTN; PAM sequence: CTC
agaccttcccagggttcctt

SEQ ID NO: 179615 - DNA, 20 bp, Artificial Sequence
  Description of Artificial Sequence: Synthetic oligonucleotide
  Target: ATXN1; (-) strand; PAM type: YTN; PAM sequence: CTA
agcacctcagaccttcccag

SEQ ID NO: 179616 - DNA, 20 bp, Artificial Sequence
  Description of Artificial Sequence: Synthetic oligonucleotide
  Target: ATXN1; (-) strand; PAM type: YTN; PAM sequence: CTC
cgtaacacctaagcacctca

SEQ ID NO: 179617 - DNA, 20 bp, Artificial Sequence
  Description of Artificial Sequence: Synthetic oligonucleotide
  Target: ATXN1; (-) strand; PAM type: YTN; PAM sequence: CTG
gctccgtaacacctaagcac

SEQ ID NO: 179618 - DNA, 20 bp, Artificial Sequence
  Description of Artificial Sequence: Synthetic oligonucleotide
  Target: ATXN1; (-) strand; PAM type: YTN; PAM sequence: CTC
aagagtgccctggctccgta

SEQ ID NO: 179619 - DNA, 20 bp, Artificial Sequence
  Description of Artificial Sequence: Synthetic oligonucleotide
  Target: ATXN1; (-) strand; PAM type: YTN; PAM sequence: TTG
gtctcaagagtgccctggct

SEQ ID NO: 179620 - DNA, 20 bp, Artificial Sequence
  Description of Artificial Sequence: Synthetic oligonucleotide
  Target: ATXN1; (-) strand; PAM type: YTN; PAM sequence: TTG
ttggtctcaagagtgccctg

SEQ ID NO: 179621 - DNA, 20 bp, Artificial Sequence
  Description of Artificial Sequence: Synthetic oligonucleotide
  Target: ATXN1; (-) strand; PAM type: YTN; PAM sequence: TTT
gttggtctcaagagtgccct

SEQ ID NO: 179622 - DNA, 20 bp, Artificial Sequence
  Description of Artificial Sequence: Synthetic oligonucleotide
  Target: ATXN1; (-) strand; PAM type: YTN; PAM sequence: TTA
gatttgttggtctcaagagt

SEQ ID NO: 179623 - DNA, 20 bp, Artificial Sequence
  Description of Artificial Sequence: Synthetic oligonucleotide
  Target: ATXN1; (-) strand; PAM type: YTN; PAM sequence: CTT
agatttgttggtctcaagag

SEQ ID NO: 179624 - DNA, 20 bp, Artificial Sequence
  Description of Artificial Sequence: Synthetic oligonucleotide
  Target: ATXN1; (-) strand; PAM type: YTN; PAM sequence: TTG
gtcgtggaaggaagcttaga

SEQ ID NO: 179625 - DNA, 20 bp, Artificial Sequence
  Description of Artificial Sequence: Synthetic oligonucleotide
  Target: ATXN1; (-) strand; PAM type: YTN; PAM sequence: TTT
ggtcgtggaaggaagcttag

SEQ ID NO: 179626 - DNA, 20 bp, Artificial Sequence
  Description of Artificial Sequence: Synthetic oligonucleotide
  Target: ATXN1; (-) strand; PAM type: YTN; PAM sequence: CTC
aaggtgatttggtcgtggaa

SEQ ID NO: 179627 - DNA, 20 bp, Artificial Sequence
  Description of Artificial Sequence: Synthetic oligonucleotide
  Target: ATXN1; (-) strand; PAM type: YTN; PAM sequence: TTC
tcaaggtgatttggtcgtgg

SEQ ID NO: 179628 - DNA, 20 bp, Artificial Sequence
  Description of Artificial Sequence: Synthetic oligonucleotide
  Target: ATXN1; (-) strand; PAM type: YTN; PAM sequence: CTT
ctcaaggtgatttggtcgtg

SEQ ID NO: 179629 - DNA, 20 bp, Artificial Sequence
  Description of Artificial Sequence: Synthetic oligonucleotide
  Target: ATXN1; (-) strand; PAM type: YTN; PAM sequence: TTC
ttctcaaggtgatttggtcg

SEQ ID NO: 179630 - DNA, 20 bp, Artificial Sequence
  Description of Artificial Sequence: Synthetic oligonucleotide
  Target: ATXN1; (-) strand; PAM type: YTN; PAM sequence: TTT
cttctcaaggtgatttggtc

SEQ ID NO: 179631 - DNA, 20 bp, Artificial Sequence
  Description of Artificial Sequence: Synthetic oligonucleotide
  Target: ATXN1; (-) strand; PAM type: YTN; PAM sequence: CTC
aaaagtttcttctcaaggtg

SEQ ID NO: 179632 - DNA, 20 bp, Artificial Sequence
  Description of Artificial Sequence: Synthetic oligonucleotide
  Target: ATXN1; (-) strand; PAM type: YTN; PAM sequence: CTC
tcaaaagtttcttctcaagg

SEQ ID NO: 179633 - DNA, 20 bp, Artificial Sequence
  Description of Artificial Sequence: Synthetic oligonucleotide
  Target: ATXN1; (-) strand; PAM type: YTN; PAM sequence: CTG
ctctcaaaagtttcttctca

SEQ ID NO: 179634 - DNA, 20 bp, Artificial Sequence
  Description of Artificial Sequence: Synthetic oligonucleotide
  Target: ATXN1; (-) strand; PAM type: YTN; PAM sequence: TTC
tgctctcaaaagtttcttct

SEQ ID NO: 179635 - DNA, 20 bp, Artificial Sequence
  Description of Artificial Sequence: Synthetic oligonucleotide
  Target: ATXN1; (-) strand; PAM type: YTN; PAM sequence: TTA
gattctgctctcaaaagttt

SEQ ID NO: 179636 - DNA, 20 bp, Artificial Sequence
  Description of Artificial Sequence: Synthetic oligonucleotide
  Target: ATXN1; (-) strand; PAM type: YTN; PAM sequence: TTT
agattctgctctcaaaagtt

SEQ ID NO: 179637 - DNA, 20 bp, Artificial Sequence
  Description of Artificial Sequence: Synthetic oligonucleotide
  Target: ATXN1; (-) strand; PAM type: YTN; PAM sequence: TTC
gatttagattctgctctcaa

SEQ ID NO: 179638 - DNA, 20 bp, Artificial Sequence
  Description of Artificial Sequence: Synthetic oligonucleotide
  Target: ATXN1; (-) strand; PAM type: YTN; PAM sequence: CTG
ccatgttcgatttagattct

SEQ ID NO: 179639 - DNA, 20 bp, Artificial Sequence
  Description of Artificial Sequence: Synthetic oligonucleotide
  Target: ATXN1; (-) strand; PAM type: YTN; PAM sequence: TTA
ctgccatgttcgatttagat

SEQ ID NO: 179640 - DNA, 20 bp, Artificial Sequence
  Description of Artificial Sequence: Synthetic oligonucleotide
  Target: ATXN1; (-) strand; PAM type: YTN; PAM sequence: TTA
ttactgccatgttcgattta

SEQ ID NO: 179641 - DNA, 20 bp, Artificial Sequence
  Description of Artificial Sequence: Synthetic oligonucleotide
  Target: ATXN1; (-) strand; PAM type: YTN; PAM sequence: CTA
aattattactgccatgttcg

SEQ ID NO: 179642 - DNA, 20 bp, Artificial Sequence
  Description of Artificial Sequence: Synthetic oligonucleotide
  Target: ATXN1; (-) strand; PAM type: YTN; PAM sequence: TTG
gctaaattattactgccatg

SEQ ID NO: 179643 - DNA, 20 bp, Artificial Sequence
  Description of Artificial Sequence: Synthetic oligonucleotide
  Target: ATXN1; (-) strand; PAM type: YTN; PAM sequence: TTT
ggctaaattattactgccat

SEQ ID NO: 179644 - DNA, 20 bp, Artificial Sequence
  Description of Artificial Sequence: Synthetic oligonucleotide
  Target: ATXN1; (-) strand; PAM type: YTN; PAM sequence: CTT
tggctaaattattactgcca

SEQ ID NO: 179645 - DNA, 20 bp, Artificial Sequence
  Description of Artificial Sequence: Synthetic oligonucleotide
  Target: ATXN1; (-) strand; PAM type: YTN; PAM sequence: TTC
actttggctaaattattact

SEQ ID NO: 179646 - DNA, 20 bp, Artificial Sequence
  Description of Artificial Sequence: Synthetic oligonucleotide
  Target: ATXN1; (-) strand; PAM type: YTN; PAM sequence: CTT
cactttggctaaattattac

SEQ ID NO: 179647 - DNA, 20 bp, Artificial Sequence
  Description of Artificial Sequence: Synthetic oligonucleotide
  Target: ATXN1; (-) strand; PAM type: YTN; PAM sequence: CTC
ccttcactttggctaaatta

SEQ ID NO: 179648 - DNA, 20 bp, Artificial Sequence
  Description of Artificial Sequence: Synthetic oligonucleotide
  Target: ATXN1; (-) strand; PAM type: YTN; PAM sequence: CTG
ccccctcccttcactttggc

SEQ ID NO: 179649 - DNA, 20 bp, Artificial Sequence
  Description of Artificial Sequence: Synthetic oligonucleotide
  Target: ATXN1; (-) strand; PAM type: YTN; PAM sequence: TTG
gatctgccccctcccttcac

SEQ ID NO: 179650 - DNA, 20 bp, Artificial Sequence
  Description of Artificial Sequence: Synthetic oligonucleotide
  Target: ATXN1; (-) strand; PAM type: YTN; PAM sequence: CTT
ggatctgccccctcccttca

SEQ ID NO: 179651 - DNA, 20 bp, Artificial Sequence
  Description of Artificial Sequence: Synthetic oligonucleotide
  Target: ATXN1; (-) strand; PAM type: YTN; PAM sequence: TTC
acttggatctgccccctccc

SEQ ID NO: 179652 - DNA, 20 bp, Artificial Sequence
  Description of Artificial Sequence: Synthetic oligonucleotide
  Target: ATXN1; (-) strand; PAM type: YTN; PAM sequence: CTT
cacttggatctgccccctcc

SEQ ID NO: 179653 - DNA, 20 bp, Artificial Sequence
  Description of Artificial Sequence: Synthetic oligonucleotide
  Target: ATXN1; (-) strand; PAM type: YTN; PAM sequence: CTC
ccttcacttggatctgcccc

SEQ ID NO: 179654 - DNA, 20 bp, Artificial Sequence
  Description of Artificial Sequence: Synthetic oligonucleotide
  Target: ATXN1; (-) strand; PAM type: YTN; PAM sequence: CTG
cctcccttcacttggatctg

SEQ ID NO: 179655 - DNA, 20 bp, Artificial Sequence
  Description of Artificial Sequence: Synthetic oligonucleotide
  Target: ATXN1; (-) strand; PAM type: YTN; PAM sequence: CTC
tgcctcccttcacttggatc

SEQ ID NO: 179656 - DNA, 20 bp, Artificial Sequence
  Description of Artificial Sequence: Synthetic oligonucleotide
  Target: ATXN1; (-) strand; PAM type: YTN; PAM sequence: TTC
tctgcctcccttcacttgga

SEQ ID NO: 179657 - DNA, 20 bp, Artificial Sequence
  Description of Artificial Sequence: Synthetic oligonucleotide
  Target: ATXN1; (-) strand; PAM type: YTN; PAM sequence: CTT
ctctgcctcccttcacttgg

SEQ ID NO: 179658 - DNA, 20 bp, Artificial Sequence
  Description of Artificial Sequence: Synthetic oligonucleotide
  Target: ATXN1; (-) strand; PAM type: YTN; PAM sequence: TTC
gtcttctctgcctcccttca

SEQ ID NO: 179659 - DNA, 20 bp, Artificial Sequence
  Description of Artificial Sequence: Synthetic oligonucleotide
  Target: ATXN1; (-) strand; PAM type: YTN; PAM sequence: CTT
cgtcttctctgcctcccttc

SEQ ID NO: 179660 - DNA, 20 bp, Artificial Sequence
  Description of Artificial Sequence: Synthetic oligonucleotide
  Target: ATXN1; (-) strand; PAM type: YTN; PAM sequence: TTA
gcttcgtcttctctgcctcc

SEQ ID NO: 179661 - DNA, 20 bp, Artificial Sequence
  Description of Artificial Sequence: Synthetic oligonucleotide
  Target: ATXN1; (-) strand; PAM type: YTN; PAM sequence: CTT
agcttcgtcttctctgcctc

SEQ ID NO: 179662 - DNA, 20 bp, Artificial Sequence
  Description of Artificial Sequence: Synthetic oligonucleotide
  Target: ATXN1; (-) strand; PAM type: YTN; PAM sequence: TTC
ttagcttcgtcttctctgcc

SEQ ID NO: 179663 - DNA, 20 bp, Artificial Sequence
  Description of Artificial Sequence: Synthetic oligonucleotide
  Target: ATXN1; (-) strand; PAM type: YTN; PAM sequence: TTT
cttagcttcgtcttctctgc

SEQ ID NO: 179664 - DNA, 20 bp, Artificial Sequence
  Description of Artificial Sequence: Synthetic oligonucleotide
  Target: ATXN1; (-) strand; PAM type: YTN; PAM sequence: TTT
tcttagcttcgtcttctctg

SEQ ID NO: 179665 - DNA, 20 bp, Artificial Sequence
  Description of Artificial Sequence: Synthetic oligonucleotide
  Target: ATXN1; (-) strand; PAM type: YTN; PAM sequence: CTA
tattttcttagcttcgtctt

SEQ ID NO: 179666 - DNA, 20 bp, Artificial Sequence
  Description of Artificial Sequence: Synthetic oligonucleotide
  Target: ATXN1; (-) strand; PAM type: YTN; PAM sequence: TTC
catggaataaaataaggcct

SEQ ID NO: 179667 - DNA, 20 bp, Artificial Sequence
  Description of Artificial Sequence: Synthetic oligonucleotide
  Target: ATXN1; (-) strand; PAM type: YTN; PAM sequence: TTT
ccatggaataaaataaggcc

SEQ ID NO: 179668 - DNA, 20 bp, Artificial Sequence
  Description of Artificial Sequence: Synthetic oligonucleotide
  Target: ATXN1; (-) strand; PAM type: YTN; PAM sequence: TTG
tttccatggaataaaataag

SEQ ID NO: 179669 - DNA, 20 bp, Artificial Sequence
  Description of Artificial Sequence: Synthetic oligonucleotide
  Target: ATXN1; (-) strand; PAM type: YTN; PAM sequence: CTG
ttgtttccatggaataaaat

SEQ ID NO: 179670 - DNA, 20 bp, Artificial Sequence
  Description of Artificial Sequence: Synthetic oligonucleotide
  Target: ATXN1; (-) strand; PAM type: YTN; PAM sequence: TTC
tgttgtttccatggaataaa

SEQ ID NO: 179671 - DNA, 20 bp, Artificial Sequence
  Description of Artificial Sequence: Synthetic oligonucleotide
  Target: ATXN1; (-) strand; PAM type: YTN; PAM sequence: CTT
ctgttgtttccatggaataa

SEQ ID NO: 179672 - DNA, 20 bp, Artificial Sequence
  Description of Artificial Sequence: Synthetic oligonucleotide
  Target: ATXN1; (-) strand; PAM type: YTN; PAM sequence: CTC
cgtcttctgttgtttccatg

SEQ ID NO: 179673 - DNA, 20 bp, Artificial Sequence
  Description of Artificial Sequence: Synthetic oligonucleotide
  Target: ATXN1; (-) strand; PAM type: YTN; PAM sequence: CTA
ggccatagaactccgtcttc

SEQ ID NO: 179674 - DNA, 20 bp, Artificial Sequence
  Description of Artificial Sequence: Synthetic oligonucleotide
  Target: ATXN1; (-) strand; PAM type: YTN; PAM sequence: CTA
gtgtctaggccatagaactc

SEQ ID NO: 179675 - DNA, 20 bp, Artificial Sequence
  Description of Artificial Sequence: Synthetic oligonucleotide
  Target: ATXN1; (-) strand; PAM type: YTN; PAM sequence: TTC
tagtgtctaggccatagaac

SEQ ID NO: 179676 - DNA, 20 bp, Artificial Sequence
  Description of Artificial Sequence: Synthetic oligonucleotide
  Target: ATXN1; (-) strand; PAM type: YTN; PAM sequence: TTT
ctagtgtctaggccatagaa

SEQ ID NO: 179677 - DNA, 20 bp, Artificial Sequence
  Description of Artificial Sequence: Synthetic oligonucleotide
  Target: ATXN1; (-) strand; PAM type: YTN; PAM sequence: TTT
tctagtgtctaggccataga

SEQ ID NO: 179678 - DNA, 20 bp, Artificial Sequence
  Description of Artificial Sequence: Synthetic oligonucleotide
  Target: ATXN1; (-) strand; PAM type: YTN; PAM sequence: TTA
gggataagggatgggccaga

SEQ ID NO: 179679 - DNA, 20 bp, Artificial Sequence
  Description of Artificial Sequence: Synthetic oligonucleotide
  Target: ATXN1; (-) strand; PAM type: YTN; PAM sequence: TTT
agggataagggatgggccag

SEQ ID NO: 179680 - DNA, 20 bp, Artificial Sequence
  Description of Artificial Sequence: Synthetic oligonucleotide
  Target: ATXN1; (-) strand; PAM type: YTN; PAM sequence: TTT
tagggataagggatgggcca

SEQ ID NO: 179681 - DNA, 20 bp, Artificial Sequence
  Description of Artificial Sequence: Synthetic oligonucleotide
  Target: ATXN1; (-) strand; PAM type: YTN; PAM sequence: TTT
ttagggataagggatgggcc

SEQ ID NO: 179682 - DNA, 20 bp, Artificial Sequence
  Description of Artificial Sequence: Synthetic oligonucleotide
  Target: ATXN1; (-) strand; PAM type: YTN; PAM sequence: TTG
tatttttagggataagggat

SEQ ID NO: 179683 - DNA, 20 bp, Artificial Sequence
  Description of Artificial Sequence: Synthetic oligonucleotide
  Target: ATXN1; (-) strand; PAM type: YTN; PAM sequence: CTT
gtatttttagggataaggga

SEQ ID NO: 179684 - DNA, 20 bp, Artificial Sequence
  Description of Artificial Sequence: Synthetic oligonucleotide
  Target: ATXN1; (-) strand; PAM type: YTN; PAM sequence: TTC
ttgtatttttagggataagg

SEQ ID NO: 179685 - DNA, 20 bp, Artificial Sequence
  Description of Artificial Sequence: Synthetic oligonucleotide
  Target: ATXN1; (-) strand; PAM type: YTN; PAM sequence: TTT
cttgtatttttagggataag

SEQ ID NO: 179686 - DNA, 20 bp, Artificial Sequence
  Description of Artificial Sequence: Synthetic oligonucleotide
  Target: ATXN1; (-) strand; PAM type: YTN; PAM sequence: TTT
tcttgtatttttagggataa

SEQ ID NO: 179687 - DNA, 20 bp, Artificial Sequence
  Description of Artificial Sequence: Synthetic oligonucleotide
  Target: ATXN1; (-) strand; PAM type: YTN; PAM sequence: TTA
agtggaatgagttttcttgt

SEQ ID NO: 179688 - DNA, 20 bp, Artificial Sequence
  Description of Artificial Sequence: Synthetic oligonucleotide
  Target: ATXN1; (-) strand; PAM type: YTN; PAM sequence: TTT
aagtggaatgagttttcttg

SEQ ID NO: 179689 - DNA, 20 bp, Artificial Sequence
  Description of Artificial Sequence: Synthetic oligonucleotide
  Target: ATXN1; (-) strand; PAM type: YTN; PAM sequence: TTT
taagtggaatgagttttctt

SEQ ID NO: 179690 - DNA, 20 bp, Artificial Sequence
  Description of Artificial Sequence: Synthetic oligonucleotide
  Target: ATXN1; (-) strand; PAM type: YTN; PAM sequence: TTT
ttaagtggaatgagttttct

SEQ ID NO: 179691 - DNA, 20 bp, Artificial Sequence
  Description of Artificial Sequence: Synthetic oligonucleotide
  Target: ATXN1; (-) strand; PAM type: YTN; PAM sequence: CTC
atttttaagtggaatgagtt

SEQ ID NO: 179692 - DNA, 20 bp, Artificial Sequence
  Description of Artificial Sequence: Synthetic oligonucleotide
  Target: ATXN1; (-) strand; PAM type: YTN; PAM sequence: TTA
ctcatttttaagtggaatga

SEQ ID NO: 179693 - DNA, 20 bp, Artificial Sequence
  Description of Artificial Sequence: Synthetic oligonucleotide
  Target: ATXN1; (-) strand; PAM type: YTN; PAM sequence: TTG
ttactcatttttaagtggaa

SEQ ID NO: 179694 - DNA, 20 bp, Artificial Sequence
  Description of Artificial Sequence: Synthetic oligonucleotide
  Target: ATXN1; (-) strand; PAM type: YTN; PAM sequence: TTT
gttactcatttttaagtgga

SEQ ID NO: 179695 - DNA, 20 bp, Artificial Sequence
  Description of Artificial Sequence: Synthetic oligonucleotide
  Target: ATXN1; (-) strand; PAM type: YTN; PAM sequence: TTT
tgttactcatttttaagtgg

SEQ ID NO: 179696 - DNA, 20 bp, Artificial Sequence
  Description of Artificial Sequence: Synthetic oligonucleotide
  Target: ATXN1; (-) strand; PAM type: YTN; PAM sequence: CTA
ttttgttactcatttttaag

SEQ ID NO: 179697 - DNA, 20 bp, Artificial Sequence
  Description of Artificial Sequence: Synthetic oligonucleotide
  Target: ATXN1; (-) strand; PAM type: YTN; PAM sequence: TTG
accacaatcctattttgtta

SEQ ID NO: 179698 - DNA, 20 bp, Artificial Sequence
  Description of Artificial Sequence: Synthetic oligonucleotide
  Target: ATXN1; (-) strand; PAM type: YTN; PAM sequence: TTT
gaccacaatcctattttgtt

SEQ ID NO: 179699 - DNA, 20 bp, Artificial Sequence
  Description of Artificial Sequence: Synthetic oligonucleotide
  Target: ATXN1; (-) strand; PAM type: YTN; PAM sequence: CTG
tatttgaccacaatcctatt

SEQ ID NO: 179700 - DNA, 20 bp, Artificial Sequence
  Description of Artificial Sequence: Synthetic oligonucleotide
  Target: ATXN1; (-) strand; PAM type: YTN; PAM sequence: CTG
tgcactgtatttgaccacaa

SEQ ID NO: 179701 - DNA, 20 bp, Artificial Sequence
  Description of Artificial Sequence: Synthetic oligonucleotide
  Target: ATXN1; (-) strand; PAM type: YTN; PAM sequence: TTA
taataactgtgcactgtatt

SEQ ID NO: 179702 - DNA, 20 bp, Artificial Sequence
  Description of Artificial Sequence: Synthetic oligonucleotide
  Target: ATXN1; (-) strand; PAM type: YTN; PAM sequence: CTT
ataataactgtgcactgtat

SEQ ID NO: 179703 - DNA, 20 bp, Artificial Sequence
  Description of Artificial Sequence: Synthetic oligonucleotide
  Target: ATXN1; (-) strand; PAM type: YTN; PAM sequence: TTC
ttataataactgtgcactgt

SEQ ID NO: 179704 - DNA, 20 bp, Artificial Sequence
  Description of Artificial Sequence: Synthetic oligonucleotide
  Target: ATXN1; (-) strand; PAM type: YTN; PAM sequence: CTT
cttataataactgtgcactg

SEQ ID NO: 179705 - DNA, 20 bp, Artificial Sequence
  Description of Artificial Sequence: Synthetic oligonucleotide
  Target: ATXN1; (-) strand; PAM type: YTN; PAM sequence: TTC
ttcttataataactgtgcac

SEQ ID NO: 179706 - DNA, 20 bp, Artificial Sequence
  Description of Artificial Sequence: Synthetic oligonucleotide
  Target: ATXN1; (-) strand; PAM type: YTN; PAM sequence: TTT
cttcttataataactgtgca

SEQ ID NO: 179707 - DNA, 20 bp, Artificial Sequence
  Description of Artificial Sequence: Synthetic oligonucleotide
  Target: ATXN1; (-) strand; PAM type: YTN; PAM sequence: TTT
tcttcttataataactgtgc

SEQ ID NO: 179708 - DNA, 20 bp, Artificial Sequence
  Description of Artificial Sequence: Synthetic oligonucleotide
  Target: ATXN1; (-) strand; PAM type: YTN; PAM sequence: TTT
ttcttcttataataactgtg

SEQ ID NO: 179709 - DNA, 20 bp, Artificial Sequence
  Description of Artificial Sequence: Synthetic oligonucleotide
  Target: ATXN1; (-) strand; PAM type: YTN; PAM sequence: CTG
atttttcttcttataataac

SEQ ID NO: 179710 - DNA, 20 bp, Artificial Sequence
  Description of Artificial Sequence: Synthetic oligonucleotide
  Target: ATXN1; (-) strand; PAM type: YTN; PAM sequence: CTC
tgatttttcttcttataata

SEQ ID NO: 179711 - DNA, 20 bp, Artificial Sequence
  Description of Artificial Sequence: Synthetic oligonucleotide
  Target: ATXN1; (-) strand; PAM type: YTN; PAM sequence: CTA
ctctgatttttcttcttata

SEQ ID NO: 179712 - DNA, 20 bp, Artificial Sequence
  Description of Artificial Sequence: Synthetic oligonucleotide
  Target: ATXN1; (-) strand; PAM type: YTN; PAM sequence: CTG
tggtaagaatgctactctga

SEQ ID NO: 179713 - DNA, 20 bp, Artificial Sequence
  Description of Artificial Sequence: Synthetic oligonucleotide
  Target: ATXN1; (-) strand; PAM type: YTN; PAM sequence: CTC
tgtggtaagaatgctactct

SEQ ID NO: 179714 - DNA, 20 bp, Artificial Sequence
  Description of Artificial Sequence: Synthetic oligonucleotide
  Target: ATXN1; (-) strand; PAM type: YTN; PAM sequence: TTG
ggggcatgtctctgtggtaa

SEQ ID NO: 179715 - DNA, 20 bp, Artificial Sequence
  Description of Artificial Sequence: Synthetic oligonucleotide
  Target: ATXN1; (-) strand; PAM type: YTN; PAM sequence: TTT
gggggcatgtctctgtggta

SEQ ID NO: 179716 - DNA, 20 bp, Artificial Sequence
  Description of Artificial Sequence: Synthetic oligonucleotide
  Target: ATXN1; (-) strand; PAM type: YTN; PAM sequence: TTT
tgggggcatgtctctgtggt

SEQ ID NO: 179717 - DNA, 20 bp, Artificial Sequence
  Description of Artificial Sequence: Synthetic oligonucleotide
  Target: ATXN1; (-) strand; PAM type: YTN; PAM sequence: CTG
ttttgggggcatgtctctgt

SEQ ID NO: 179718 - DNA, 20 bp, Artificial Sequence
  Description of Artificial Sequence: Synthetic oligonucleotide
  Target: ATXN1; (-) strand; PAM type: YTN; PAM sequence: TTC
atctgttttgggggcatgtc

SEQ ID NO: 179719 - DNA, 20 bp, Artificial Sequence
  Description of Artificial Sequence: Synthetic oligonucleotide
  Target: ATXN1; (-) strand; PAM type: YTN; PAM sequence: TTT
catctgttttgggggcatgt

SEQ ID NO: 179720 - DNA, 20 bp, Artificial Sequence
  Description of Artificial Sequence: Synthetic oligonucleotide
  Target: ATXN1; (-) strand; PAM type: YTN; PAM sequence: TTT
tcatctgttttgggggcatg

SEQ ID NO: 179721 - DNA, 20 bp, Artificial Sequence
  Description of Artificial Sequence: Synthetic oligonucleotide
  Target: ATXN1; (-) strand; PAM type: YTN; PAM sequence: TTA
aagttttcatctgttttggg

SEQ ID NO: 179722 - DNA, 20 bp, Artificial Sequence
  Description of Artificial Sequence: Synthetic oligonucleotide
  Target: ATXN1; (-) strand; PAM type: YTN; PAM sequence: TTG
aaatattaaagttttcatct

SEQ ID NO: 179723 - DNA, 20 bp, Artificial Sequence
  Description of Artificial Sequence: Synthetic oligonucleotide
  Target: ATXN1; (-) strand; PAM type: YTN; PAM sequence: TTT
gaaatattaaagttttcatc

SEQ ID NO: 179724 - DNA, 20 bp, Artificial Sequence
  Description of Artificial Sequence: Synthetic oligonucleotide
  Target: ATXN1; (-) strand; PAM type: YTN; PAM sequence: TTT
tgaaatattaaagttttcat

SEQ ID NO: 179725 - DNA, 20 bp, Artificial Sequence
  Description of Artificial Sequence: Synthetic oligonucleotide
  Target: ATXN1; (-) strand; PAM type: YTN; PAM sequence: CTT
ttgaaatattaaagttttca

SEQ ID NO: 179726 - DNA, 20 bp, Artificial Sequence
  Description of Artificial Sequence: Synthetic oligonucleotide
  Target: ATXN1; (-) strand; PAM type: YTN; PAM sequence: CTC
ttttgaaatattaaagtttt

SEQ ID NO: 179727 - DNA, 20 bp, Artificial Sequence
  Description of Artificial Sequence: Synthetic oligonucleotide
  Target: ATXN1; (-) strand; PAM type: YTN; PAM sequence: TTA
gctcttttgaaatattaaag

SEQ ID NO: 179728 - DNA, 20 bp, Artificial Sequence
  Description of Artificial Sequence: Synthetic oligonucleotide
  Target: ATXN1; (-) strand; PAM type: YTN; PAM sequence: TTT
agctcttttgaaatattaaa

SEQ ID NO: 179729 - DNA, 20 bp, Artificial Sequence
  Description of Artificial Sequence: Synthetic oligonucleotide
  Target: ATXN1; (-) strand; PAM type: YTN; PAM sequence: TTT
tagctcttttgaaatattaa

SEQ ID NO: 179730 - DNA, 20 bp, Artificial Sequence
  Description of Artificial Sequence: Synthetic oligonucleotide
  Target: ATXN1; (-) strand; PAM type: YTN; PAM sequence: CTT
ttagctcttttgaaatatta

SEQ ID NO: 179731 - DNA, 20 bp, Artificial Sequence
  Description of Artificial Sequence: Synthetic oligonucleotide
  Target: ATXN1; (-) strand; PAM type: YTN; PAM sequence: TTC
ttttagctcttttgaaatat

SEQ ID NO: 179732 - DNA, 20 bp, Artificial Sequence
  Description of Artificial Sequence: Synthetic oligonucleotide
  Target: ATXN1; (-) strand; PAM type: YTN; PAM sequence: TTT
cttttagctcttttgaaata

SEQ ID NO: 179733 - DNA, 20 bp, Artificial Sequence
  Description of Artificial Sequence: Synthetic oligonucleotide
  Target: ATXN1; (-) strand; PAM type: YTN; PAM sequence: TTT
tcttttagctcttttgaaat

SEQ ID NO: 179734 - DNA, 20 bp, Artificial Sequence
  Description of Artificial Sequence: Synthetic oligonucleotide
  Target: ATXN1; (-) strand; PAM type: YTN; PAM sequence: CTC
attttcttttagctcttttg

SEQ ID NO: 179735 - DNA, 20 bp, Artificial Sequence
  Description of Artificial Sequence: Synthetic oligonucleotide
  Target: ATXN1; (-) strand; PAM type: YTN; PAM sequence: CTG
cctcattttcttttagctct

SEQ ID NO: 179736 - DNA, 20 bp, Artificial Sequence
  Description of Artificial Sequence: Synthetic oligonucleotide
  Target: ATXN1; (-) strand; PAM type: YTN; PAM sequence: TTA
ctgcctcattttcttttagc

SEQ ID NO: 179737 - DNA, 20 bp, Artificial Sequence
  Description of Artificial Sequence: Synthetic oligonucleotide
  Target: ATXN1; (-) strand; PAM type: YTN; PAM sequence: CTT
actgcctcattttcttttag

SEQ ID NO: 179738 - DNA, 20 bp, Artificial Sequence
  Description of Artificial Sequence: Synthetic oligonucleotide
  Target: ATXN1; (-) strand; PAM type: YTN; PAM sequence: TTC
ttactgcctcattttctttt

SEQ ID NO: 179739 - DNA, 20 bp, Artificial Sequence
  Description of Artificial Sequence: Synthetic oligonucleotide
  Target: ATXN1; (-) strand; PAM type: YTN; PAM sequence: CTT
cttactgcctcattttcttt

SEQ ID NO: 179740 - DNA, 20 bp, Artificial Sequence
  Description of Artificial Sequence: Synthetic oligonucleotide
  Target: ATXN1; (-) strand; PAM type: YTN; PAM sequence: CTC
ttcttactgcctcattttct

SEQ ID NO: 179741 - DNA, 20 bp, Artificial Sequence
  Description of Artificial Sequence: Synthetic oligonucleotide
  Target: ATXN1; (-) strand; PAM type: YTN; PAM sequence: TTA
tctcttcttactgcctcatt

SEQ ID NO: 179742 - DNA, 20 bp, Artificial Sequence
  Description of Artificial Sequence: Synthetic oligonucleotide
  Target: ATXN1; (-) strand; PAM type: YTN; PAM sequence: TTT
atctcttcttactgcctcat

SEQ ID NO: 179743 - DNA, 20 bp, Artificial Sequence
  Description of Artificial Sequence: Synthetic oligonucleotide
  Target: ATXN1; (-) strand; PAM type: YTN; PAM sequence: CTT
tatctcttcttactgcctca

SEQ ID NO: 179744 - DNA, 20 bp, Artificial Sequence
  Description of Artificial Sequence: Synthetic oligonucleotide
  Target: ATXN1; (-) strand; PAM type: YTN; PAM sequence: TTC
ctttatctcttcttactgcc

SEQ ID NO: 179745 - DNA, 20 bp, Artificial Sequence
  Description of Artificial Sequence: Synthetic oligonucleotide
  Target: ATXN1; (-) strand; PAM type: YTN; PAM sequence: TTA
gtgttcctttatctcttctt

SEQ ID NO: 179746 - DNA, 20 bp, Artificial Sequence
  Description of Artificial Sequence: Synthetic oligonucleotide
  Target: ATXN1; (-) strand; PAM type: YTN; PAM sequence: TTG
ggattagtgttcctttatct

SEQ ID NO: 179747 - DNA, 20 bp, Artificial Sequence
  Description of Artificial Sequence: Synthetic oligonucleotide
  Target: ATXN1; (-) strand; PAM type: YTN; PAM sequence: TTA
ttgggattagtgttccttta

SEQ ID NO: 179748 - DNA, 20 bp, Artificial Sequence
  Description of Artificial Sequence: Synthetic oligonucleotide
  Target: ATXN1; (-) strand; PAM type: YTN; PAM sequence: TTT
attgggattagtgttccttt

SEQ ID NO: 179749 - DNA, 20 bp, Artificial Sequence
  Description of Artificial Sequence: Synthetic oligonucleotide
  Target: ATXN1; (-) strand; PAM type: YTN; PAM sequence: TTT
tattgggattagtgttcctt

SEQ ID NO: 179750 - DNA, 20 bp, Artificial Sequence
  Description of Artificial Sequence: Synthetic oligonucleotide
  Target: ATXN1; (-) strand; PAM type: YTN; PAM sequence: TTT
ttattgggattagtgttcct

SEQ ID NO: 179751 - DNA, 20 bp, Artificial Sequence
  Description of Artificial Sequence: Synthetic oligonucleotide
  Target: ATXN1; (-) strand; PAM type: YTN; PAM sequence: CTG
aatgtttttattgggattag

SEQ ID NO: 179752 - DNA, 20 bp, Artificial Sequence
  Description of Artificial Sequence: Synthetic oligonucleotide
  Target: ATXN1; (-) strand; PAM type: YTN; PAM sequence: TTC
tgaatgtttttattgggatt

SEQ ID NO: 179753 - DNA, 20 bp, Artificial Sequence
  Description of Artificial Sequence: Synthetic oligonucleotide
  Target: ATXN1; (-) strand; PAM type: YTN; PAM sequence: TTT
ctgaatgtttttattgggat

SEQ ID NO: 179754 - DNA, 20 bp, Artificial Sequence
  Description of Artificial Sequence: Synthetic oligonucleotide
  Target: ATXN1; (-) strand; PAM type: YTN; PAM sequence: TTC
atttctgaatgtttttattg

SEQ ID NO: 179755 - DNA, 20 bp, Artificial Sequence
  Description of Artificial Sequence: Synthetic oligonucleotide
  Target: ATXN1; (-) strand; PAM type: YTN; PAM sequence: CTT
catttctgaatgtttttatt

SEQ ID NO: 179756 - DNA, 20 bp, Artificial Sequence
  Description of Artificial Sequence: Synthetic oligonucleotide
  Target: ATXN1; (-) strand; PAM type: YTN; PAM sequence: CTC
caatcacttcatttctgaat

SEQ ID NO: 179757 - DNA, 20 bp, Artificial Sequence
  Description of Artificial Sequence: Synthetic oligonucleotide
  Target: ATXN1; (-) strand; PAM type: YTN; PAM sequence: TTC
tccaatcacttcatttctga

SEQ ID NO: 179758 - DNA, 20 bp, Artificial Sequence
  Description of Artificial Sequence: Synthetic oligonucleotide
  Target: ATXN1; (-) strand; PAM type: YTN; PAM sequence: TTT
ctccaatcacttcatttctg

SEQ ID NO: 179759 - DNA, 20 bp, Artificial Sequence
  Description of Artificial Sequence: Synthetic oligonucleotide
  Target: ATXN1; (-) strand; PAM type: YTN; PAM sequence: TTT
tctccaatcacttcatttct

SEQ ID NO: 179760 - DNA, 20 bp, Artificial Sequence
  Description of Artificial Sequence: Synthetic oligonucleotide
  Target: ATXN1; (-) strand; PAM type: YTN; PAM sequence: CTT
ttctccaatcacttcatttc

SEQ ID NO: 179761 - DNA, 20 bp, Artificial Sequence
  Description of Artificial Sequence: Synthetic oligonucleotide
  Target: ATXN1; (-) strand; PAM type: YTN; PAM sequence: TTC
ttttctccaatcacttcatt

SEQ ID NO: 179762 - DNA, 20 bp, Artificial Sequence
  Description of Artificial Sequence: Synthetic oligonucleotide
  Target: ATXN1; (-) strand; PAM type: YTN; PAM sequence: TTT
cttttctccaatcacttcat

SEQ ID NO: 179763 - DNA, 20 bp, Artificial Sequence
  Description of Artificial Sequence: Synthetic oligonucleotide
  Target: ATXN1; (-) strand; PAM type: YTN; PAM sequence: CTA
tttcttttctccaatcactt

SEQ ID NO: 179764 - DNA, 20 bp, Artificial Sequence
  Description of Artificial Sequence: Synthetic oligonucleotide
  Target: ATXN1; (-) strand; PAM type: YTN; PAM sequence: CTA
tccaactatttcttttctcc

SEQ ID NO: 179765 - DNA, 20 bp, Artificial Sequence
  Description of Artificial Sequence: Synthetic oligonucleotide
  Target: ATXN1; (-) strand; PAM type: YTN; PAM sequence: CTC
tatccaactatttcttttct

SEQ ID NO: 179766 - DNA, 20 bp, Artificial Sequence
  Description of Artificial Sequence: Synthetic oligonucleotide
  Target: ATXN1; (-) strand; PAM type: YTN; PAM sequence: CTC
tctatccaactatttctttt

SEQ ID NO: 179767 - DNA, 20 bp, Artificial Sequence
  Description of Artificial Sequence: Synthetic oligonucleotide
  Target: ATXN1; (-) strand; PAM type: YTN; PAM sequence: CTC
tctctatccaactatttctt

SEQ ID NO: 179768 - DNA, 20 bp, Artificial Sequence
  Description of Artificial Sequence: Synthetic oligonucleotide
  Target: ATXN1; (-) strand; PAM type: YTN; PAM sequence: TTG
cctctctctatccaactatt

SEQ ID NO: 179769 - DNA, 20 bp, Artificial Sequence
  Description of Artificial Sequence: Synthetic oligonucleotide
  Target: ATXN1; (-) strand; PAM type: YTN; PAM sequence: TTT
gcctctctctatccaactat

SEQ ID NO: 179770 - DNA, 20 bp, Artificial Sequence
  Description of Artificial Sequence: Synthetic oligonucleotide
  Target: ATXN1; (-) strand; PAM type: YTN; PAM sequence: TTT
tgcctctctctatccaacta

SEQ ID NO: 179771 - DNA, 20 bp, Artificial Sequence
  Description of Artificial Sequence: Synthetic oligonucleotide
  Target: ATXN1; (-) strand; PAM type: YTN; PAM sequence: CTT
ttgcctctctctatccaact

SEQ ID NO: 179772 - DNA, 20 bp, Artificial Sequence
  Description of Artificial Sequence: Synthetic oligonucleotide
  Target: ATXN1; (-) strand; PAM type: YTN; PAM sequence: TTC
ttttgcctctctctatccaa

SEQ ID NO: 179773 - DNA, 20 bp, Artificial Sequence
  Description of Artificial Sequence: Synthetic oligonucleotide
  Target: ATXN1; (-) strand; PAM type: YTN; PAM sequence: TTC
ccacgttcttttgcctctct

SEQ ID NO: 179774 - DNA, 20 bp, Artificial Sequence
  Description of Artificial Sequence: Synthetic oligonucleotide
  Target: ATXN1; (-) strand; PAM type: YTN; PAM sequence: TTT
cccacgttcttttgcctctc

SEQ ID NO: 179775 - DNA, 20 bp, Artificial Sequence
  Description of Artificial Sequence: Synthetic oligonucleotide
  Target: ATXN1; (-) strand; PAM type: YTN; PAM sequence: CTT
tcccacgttcttttgcctct

SEQ ID NO: 179776 - DNA, 20 bp, Artificial Sequence
  Description of Artificial Sequence: Synthetic oligonucleotide
  Target: ATXN1; (-) strand; PAM type: YTN; PAM sequence: TTC
tttcccacgttcttttgcct

SEQ ID NO: 179777 - DNA, 20 bp, Artificial Sequence
  Description of Artificial Sequence: Synthetic oligonucleotide
  Target: ATXN1; (-) strand; PAM type: YTN; PAM sequence: TTC
aaattctttcccacgttctt

SEQ ID NO: 179778 - DNA, 20 bp, Artificial Sequence
  Description of Artificial Sequence: Synthetic oligonucleotide
  Target: ATXN1; (-) strand; PAM type: YTN; PAM sequence: CTT
caaattctttcccacgttct

SEQ ID NO: 179779 - DNA, 20 bp, Artificial Sequence
  Description of Artificial Sequence: Synthetic oligonucleotide
  Target: ATXN1; (-) strand; PAM type: YTN; PAM sequence: TTC
ttcaaattctttcccacgtt

SEQ ID NO: 179780 - DNA, 20 bp, Artificial Sequence
  Description of Artificial Sequence: Synthetic oligonucleotide
  Target: ATXN1; (-) strand; PAM type: YTN; PAM sequence: TTT
cttcaaattctttcccacgt

SEQ ID NO: 179781 - DNA, 20 bp, Artificial Sequence
  Description of Artificial Sequence: Synthetic oligonucleotide
  Target: ATXN1; (-) strand; PAM type: YTN; PAM sequence: TTT
tcttcaaattctttcccacg

SEQ ID NO: 179782 - DNA, 20 bp, Artificial Sequence
  Description of Artificial Sequence: Synthetic oligonucleotide
  Target: ATXN1; (-) strand; PAM type: YTN; PAM sequence: TTC
gttttcttcaaattctttcc

SEQ ID NO: 179783 - DNA, 20 bp, Artificial Sequence
  Description of Artificial Sequence: Synthetic oligonucleotide
  Target: ATXN1; (-) strand; PAM type: YTN; PAM sequence: TTT
cgttttcttcaaattctttc

SEQ ID NO: 179784 - DNA, 20 bp, Artificial Sequence
  Description of Artificial Sequence: Synthetic oligonucleotide
  Target: ATXN1; (-) strand; PAM type: YTN; PAM sequence: TTT
tcgttttcttcaaattcttt

SEQ ID NO: 179785 - DNA, 20 bp, Artificial Sequence
  Description of Artificial Sequence: Synthetic oligonucleotide
  Target: ATXN1; (-) strand; PAM type: YTN; PAM sequence: TTT
ttcgttttcttcaaattctt

SEQ ID NO: 179786 - DNA, 20 bp, Artificial Sequence
  Description of Artificial Sequence: Synthetic oligonucleotide
  Target: ATXN1; (-) strand; PAM type: YTN; PAM sequence: TTT
tttcgttttcttcaaattct

SEQ ID NO: 179787 - DNA, 20 bp, Artificial Sequence
  Description of Artificial Sequence: Synthetic oligonucleotide
  Target: ATXN1; (-) strand; PAM type: YTN; PAM sequence: CTT
ttttcgttttcttcaaattc

SEQ ID NO: 179788 - DNA, 20 bp, Artificial Sequence
  Description of Artificial Sequence: Synthetic oligonucleotide
  Target: ATXN1; (-) strand; PAM type: YTN; PAM sequence: TTC
ttttttcgttttcttcaaat

SEQ ID NO: 179789 - DNA, 20 bp, Artificial Sequence
  Description of Artificial Sequence: Synthetic oligonucleotide
  Target: ATXN1; (-) strand; PAM type: YTN; PAM sequence: TTT
cttttttcgttttcttcaaa

SEQ ID NO: 179790 - DNA, 20 bp, Artificial Sequence
  Description of Artificial Sequence: Synthetic oligonucleotide
  Target: ATXN1; (-) strand; PAM type: YTN; PAM sequence: TTT
tcttttttcgttttcttcaa

SEQ ID NO: 179791 - DNA, 20 bp, Artificial Sequence
  Description of Artificial Sequence: Synthetic oligonucleotide
  Target: ATXN1; (-) strand; PAM type: YTN; PAM sequence: CTA
gaaaatggattttctttttt

SEQ ID NO: 179792 - DNA, 20 bp, Artificial Sequence
  Description of Artificial Sequence: Synthetic oligonucleotide
  Target: ATXN1; (-) strand; PAM type: YTN; PAM sequence: TTC
atctagaaaatggattttct

SEQ ID NO: 179793 - DNA, 20 bp, Artificial Sequence
  Description of Artificial Sequence: Synthetic oligonucleotide
  Target: ATXN1; (-) strand; PAM type: YTN; PAM sequence: CTT
catctagaaaatggattttc

SEQ ID NO: 179794 - DNA, 20 bp, Artificial Sequence
  Description of Artificial Sequence: Synthetic oligonucleotide
  Target: ATXN1; (-) strand; PAM type: YTN; PAM sequence: TTG
gtcttcatctagaaaatgga

SEQ ID NO: 179795 - DNA, 20 bp, Artificial Sequence
  Description of Artificial Sequence: Synthetic oligonucleotide
  Target: ATXN1; (-) strand; PAM type: YTN; PAM sequence: TTT
ggtcttcatctagaaaatgg

SEQ ID NO: 179796 - DNA, 20 bp, Artificial Sequence
  Description of Artificial Sequence: Synthetic oligonucleotide
  Target: ATXN1; (-) strand; PAM type: YTN; PAM sequence: TTA
tttggtcttcatctagaaaa

SEQ ID NO: 179797 - DNA, 20 bp, Artificial Sequence
  Description of Artificial Sequence: Synthetic oligonucleotide
  Target: ATXN1; (-) strand; PAM type: YTN; PAM sequence: CTT
atttggtcttcatctagaaa

SEQ ID NO: 179798 - DNA, 20 bp, Artificial Sequence
  Description of Artificial Sequence: Synthetic oligonucleotide
  Target: ATXN1; (-) strand; PAM type: YTN; PAM sequence: TTC
ttatttggtcttcatctaga

SEQ ID NO: 179799 - DNA, 20 bp, Artificial Sequence
  Description of Artificial Sequence: Synthetic oligonucleotide
  Target: ATXN1; (-) strand; PAM type: YTN; PAM sequence: CTT
cttatttggtcttcatctag

SEQ ID NO: 179800 - DNA, 20 bp, Artificial Sequence
  Description of Artificial Sequence: Synthetic oligonucleotide
  Target: ATXN1; (-) strand; PAM type: YTN; PAM sequence: TTC
cttcttatttggtcttcatc

SEQ ID NO: 179801 - DNA, 20 bp, Artificial Sequence
  Description of Artificial Sequence: Synthetic oligonucleotide
  Target: ATXN1; (-) strand; PAM type: YTN; PAM sequence: TTG
tgttccttcttatttggtct

SEQ ID NO: 179802 - DNA, 20 bp, Artificial Sequence
  Description of Artificial Sequence: Synthetic oligonucleotide
  Target: ATXN1; (-) strand; PAM type: YTN; PAM sequence: CTT
gtgttccttcttatttggtc

SEQ ID NO: 179803 - DNA, 20 bp, Artificial Sequence
  Description of Artificial Sequence: Synthetic oligonucleotide
  Target: ATXN1; (-) strand; PAM type: YTN; PAM sequence: CTC
ttgtgttccttcttatttgg

SEQ ID NO: 179804 - DNA, 20 bp, Artificial Sequence
  Description of Artificial Sequence: Synthetic oligonucleotide
  Target: ATXN1; (-) strand; PAM type: YTN; PAM sequence: TTC
cctcttgtgttccttcttat

SEQ ID NO: 179805 - DNA, 20 bp, Artificial Sequence
  Description of Artificial Sequence: Synthetic oligonucleotide
  Target: ATXN1; (-) strand; PAM type: YTN; PAM sequence: TTG
tatgtattccctcttgtgtt

SEQ ID NO: 179806 - DNA, 20 bp, Artificial Sequence
  Description of Artificial Sequence: Synthetic oligonucleotide
  Target: ATXN1; (-) strand; PAM type: YTN; PAM sequence: CTG
ttgtatgtattccctcttgt

SEQ ID NO: 179807 - DNA, 20 bp, Artificial Sequence
  Description of Artificial Sequence: Synthetic oligonucleotide
  Target: ATXN1; (-) strand; PAM type: YTN; PAM sequence: TTA
tctgttgtatgtattccctc

SEQ ID NO: 179808 - DNA, 20 bp, Artificial Sequence
  Description of Artificial Sequence: Synthetic oligonucleotide
  Target: ATXN1; (-) strand; PAM type: YTN; PAM sequence: CTC
aaagattatctgttgtatgt

SEQ ID NO: 179809 - DNA, 20 bp, Artificial Sequence
  Description of Artificial Sequence: Synthetic oligonucleotide
  Target: ATXN1; (-) strand; PAM type: YTN; PAM sequence: CTC
ctcaaagattatctgttgta

SEQ ID NO: 179810 - DNA, 20 bp, Artificial Sequence
  Description of Artificial Sequence: Synthetic oligonucleotide
  Target: ATXN1; (-) strand; PAM type: YTN; PAM sequence: TTA
gcactcctcaaagattatct

SEQ ID NO: 179811 - DNA, 20 bp, Artificial Sequence
  Description of Artificial Sequence: Synthetic oligonucleotide
  Target: ATXN1; (-) strand; PAM type: YTN; PAM sequence: TTT
agcactcctcaaagattatc

SEQ ID NO: 179812 - DNA, 20 bp, Artificial Sequence
  Description of Artificial Sequence: Synthetic oligonucleotide
  Target: ATXN1; (-) strand; PAM type: YTN; PAM sequence: TTT
tagcactcctcaaagattat

SEQ ID NO: 179813 - DNA, 20 bp, Artificial Sequence
  Description of Artificial Sequence: Synthetic oligonucleotide
  Target: ATXN1; (-) strand; PAM type: YTN; PAM sequence: TTT
ttagcactcctcaaagatta

SEQ ID NO: 179814 - DNA, 20 bp, Artificial Sequence
  Description of Artificial Sequence: Synthetic oligonucleotide
  Target: ATXN1; (-) strand; PAM type: YTN; PAM sequence: TTT
tttagcactcctcaaagatt

SEQ ID NO: 179815 - DNA, 20 bp, Artificial Sequence
  Description of Artificial Sequence: Synthetic oligonucleotide
  Target: ATXN1; (-) strand; PAM type: YTN; PAM sequence: CTA
ttttttagcactcctcaaag

SEQ ID NO: 179816 - DNA, 20 bp, Artificial Sequence
  Description of Artificial Sequence: Synthetic oligonucleotide
  Target: ATXN1; (-) strand; PAM type: YTN; PAM sequence: TTC
tattttttagcactcctcaa

SEQ ID NO: 179817 - DNA, 20 bp, Artificial Sequence
  Description of Artificial Sequence: Synthetic oligonucleotide
  Target: ATXN1; (-) strand; PAM type: YTN; PAM sequence: TTT
ctattttttagcactcctca

SEQ ID NO: 179818 - DNA, 20 bp, Artificial Sequence
  Description of Artificial Sequence: Synthetic oligonucleotide
  Target: ATXN1; (-) strand; PAM type: YTN; PAM sequence: CTT
tctattttttagcactcctc

SEQ ID NO: 179819 - DNA, 20 bp, Artificial Sequence
  Description of Artificial Sequence: Synthetic oligonucleotide
  Target: ATXN1; (-) strand; PAM type: YTN; PAM sequence: CTC
ctttctattttttagcactc

SEQ ID NO: 179820 - DNA, 20 bp, Artificial Sequence
  Description of Artificial Sequence: Synthetic oligonucleotide
  Target: ATXN1; (-) strand; PAM type: YTN; PAM sequence: TTC
tcctttctattttttagcac

SEQ ID NO: 179821 - DNA, 20 bp, Artificial Sequence
  Description of Artificial Sequence: Synthetic oligonucleotide
  Target: ATXN1; (-) strand; PAM type: YTN; PAM sequence: TTT
ctcctttctattttttagca

SEQ ID NO: 179822 - DNA, 20 bp, Artificial Sequence
  Description of Artificial Sequence: Synthetic oligonucleotide
  Target: ATXN1; (-) strand; PAM type: YTN; PAM sequence: CTT
tctcctttctattttttagc

SEQ ID NO: 179823 - DNA, 20 bp, Artificial Sequence
  Description of Artificial Sequence: Synthetic oligonucleotide
  Target: ATXN1; (-) strand; PAM type: YTN; PAM sequence: TTA
acactttctcctttctattt

SEQ ID NO: 179824 - DNA, 20 bp, Artificial Sequence
  Description of Artificial Sequence: Synthetic oligonucleotide
  Target: ATXN1; (-) strand; PAM type: YTN; PAM sequence: TTT
aacactttctcctttctatt

SEQ ID NO: 179825 - DNA, 20 bp, Artificial Sequence
  Description of Artificial Sequence: Synthetic oligonucleotide
  Target: ATXN1; (-) strand; PAM type: YTN; PAM sequence: TTG
atgtttaacactttctcctt

SEQ ID NO: 179826 - DNA, 20 bp, Artificial Sequence
  Description of Artificial Sequence: Synthetic oligonucleotide
  Target: ATXN1; (-) strand; PAM type: YTN; PAM sequence: TTT
gatgtttaacactttctcct

SEQ ID NO: 179827 - DNA, 20 bp, Artificial Sequence
  Description of Artificial Sequence: Synthetic oligonucleotide
  Target: ATXN1; (-) strand; PAM type: YTN; PAM sequence: TTT
tgatgtttaacactttctcc

SEQ ID NO: 179828 - DNA, 20 bp, Artificial Sequence
  Description of Artificial Sequence: Synthetic oligonucleotide
  Target: ATXN1; (-) strand; PAM type: YTN; PAM sequence: TTT
ttgatgtttaacactttctc

SEQ ID NO: 179829 - DNA, 20 bp, Artificial Sequence
  Description of Artificial Sequence: Synthetic oligonucleotide
  Target: ATXN1; (-) strand; PAM type: YTN; PAM sequence: CTT
tttgatgtttaacactttct

SEQ ID NO: 179830 - DNA, 20 bp, Artificial Sequence
  Description of Artificial Sequence: Synthetic oligonucleotide
  Target: ATXN1; (-) strand; PAM type: YTN; PAM sequence: TTC
tttttgatgtttaacacttt

SEQ ID NO: 179831 - DNA, 20 bp, Artificial Sequence
  Description of Artificial Sequence: Synthetic oligonucleotide
  Target: ATXN1; (-) strand; PAM type: YTN; PAM sequence: TTT
ctttttgatgtttaacactt

SEQ ID NO: 179832 - DNA, 20 bp, Artificial Sequence
  Description of Artificial Sequence: Synthetic oligonucleotide
  Target: ATXN1; (-) strand; PAM type: YTN; PAM sequence: CTC
atttctttttgatgtttaac

SEQ ID NO: 179833 - DNA, 20 bp, Artificial Sequence
  Description of Artificial Sequence: Synthetic oligonucleotide
  Target: ATXN1; (-) strand; PAM type: YTN; PAM sequence: TTC
ctcatttctttttgatgttt

SEQ ID NO: 179834 - DNA, 20 bp, Artificial Sequence
  Description of Artificial Sequence: Synthetic oligonucleotide
  Target: ATXN1; (-) strand; PAM type: YTN; PAM sequence: TTT
cctcatttctttttgatgtt

SEQ ID NO: 179835 - DNA, 20 bp, Artificial Sequence
  Description of Artificial Sequence: Synthetic oligonucleotide
  Target: ATXN1; (-) strand; PAM type: YTN; PAM sequence: CTT
tcctcatttctttttgatgt

SEQ ID NO: 179836 - DNA, 20 bp, Artificial Sequence
  Description of Artificial Sequence: Synthetic oligonucleotide
  Target: ATXN1; (-) strand; PAM type: YTN; PAM sequence: TTC
tttcctcatttctttttgat

SEQ ID NO: 179837 - DNA, 20 bp, Artificial Sequence
  Description of Artificial Sequence: Synthetic oligonucleotide
  Target: ATXN1; (-) strand; PAM type: YTN; PAM sequence: TTT
ctttcctcatttctttttga

SEQ ID NO: 179838 - DNA, 20 bp, Artificial Sequence
  Description of Artificial Sequence: Synthetic oligonucleotide
  Target: ATXN1; (-) strand; PAM type: YTN; PAM sequence: CTA
tttctttcctcatttctttt

SEQ ID NO: 179839 - DNA, 20 bp, Artificial Sequence
  Description of Artificial Sequence: Synthetic oligonucleotide
  Target: ATXN1; (-) strand; PAM type: YTN; PAM sequence: TTC
tatttctttcctcatttctt

SEQ ID NO: 179840 - DNA, 20 bp, Artificial Sequence
  Description of Artificial Sequence: Synthetic oligonucleotide
  Target: ATXN1; (-) strand; PAM type: YTN; PAM sequence: TTG
aattctatttctttcctcat

SEQ ID NO: 179841 - DNA, 20 bp, Artificial Sequence
  Description of Artificial Sequence: Synthetic oligonucleotide
  Target: ATXN1; (-) strand; PAM type: YTN; PAM sequence: CTT
gaattctatttctttcctca

SEQ ID NO: 179842 - DNA, 20 bp, Artificial Sequence
  Description of Artificial Sequence: Synthetic oligonucleotide
  Target: ATXN1; (-) strand; PAM type: YTN; PAM sequence: CTC
ttgaattctatttctttcct

SEQ ID NO: 179843 - DNA, 20 bp, Artificial Sequence
  Description of Artificial Sequence: Synthetic oligonucleotide
  Target: ATXN1; (-) strand; PAM type: YTN; PAM sequence: TTC
tcttgaattctatttctttc

SEQ ID NO: 179844 - DNA, 20 bp, Artificial Sequence
  Description of Artificial Sequence: Synthetic oligonucleotide
  Target: ATXN1; (-) strand; PAM type: YTN; PAM sequence: TTT
ctcttgaattctatttcttt

SEQ ID NO: 179845 - DNA, 20 bp, Artificial Sequence
  Description of Artificial Sequence: Synthetic oligonucleotide
  Target: ATXN1; (-) strand; PAM type: YTN; PAM sequence: CTT
tctcttgaattctatttctt

SEQ ID NO: 179846 - DNA, 20 bp, Artificial Sequence
  Description of Artificial Sequence: Synthetic oligonucleotide
  Target: ATXN1; (-) strand; PAM type: YTN; PAM sequence: CTG
agtctttctcttgaattcta

SEQ ID NO: 179847 - DNA, 20 bp, Artificial Sequence
  Description of Artificial Sequence: Synthetic oligonucleotide
  Target: ATXN1; (-) strand; PAM type: YTN; PAM sequence: TTC
tgagtctttctcttgaattc

SEQ ID NO: 179848 - DNA, 20 bp, Artificial Sequence
  Description of Artificial Sequence: Synthetic oligonucleotide
  Target: ATXN1; (-) strand; PAM type: YTN; PAM sequence: TTT
ctgagtctttctcttgaatt

SEQ ID NO: 179849 - DNA, 20 bp, Artificial Sequence
  Description of Artificial Sequence: Synthetic oligonucleotide
  Target: ATXN1; (-) strand; PAM type: YTN; PAM sequence: TTT
tctgagtctttctcttgaat

SEQ ID NO: 179850 - DNA, 20 bp, Artificial Sequence
  Description of Artificial Sequence: Synthetic oligonucleotide
  Target: ATXN1; (-) strand; PAM type: YTN; PAM sequence: CTT
ttctgagtctttctcttgaa

SEQ ID NO: 179851 - DNA, 20 bp, Artificial Sequence
  Description of Artificial Sequence: Synthetic oligonucleotide
  Target: ATXN1; (-) strand; PAM type: YTN; PAM sequence: TTC
cttttctgagtctttctctt

SEQ ID NO: 179852 - DNA, 20 bp, Artificial Sequence
  Description of Artificial Sequence: Synthetic oligonucleotide
  Target: ATXN1; (-) strand; PAM type: YTN; PAM sequence: CTC
atgttccttttctgagtctt

SEQ ID NO: 179853 - DNA, 20 bp, Artificial Sequence
  Description of Artificial Sequence: Synthetic oligonucleotide
  Target: ATXN1; (-) strand; PAM type: YTN; PAM sequence: TTG
ctcatgttccttttctgagt

SEQ ID NO: 179854 - DNA, 20 bp, Artificial Sequence
  Description of Artificial Sequence: Synthetic oligonucleotide
  Target: ATXN1; (-) strand; PAM type: YTN; PAM sequence: TTT
gctcatgttccttttctgag

SEQ ID NO: 179855 - DNA, 20 bp, Artificial Sequence
  Description of Artificial Sequence: Synthetic oligonucleotide
  Target: ATXN1; (-) strand; PAM type: YTN; PAM sequence: CTT
tgctcatgttccttttctga

SEQ ID NO: 179856 - DNA, 20 bp, Artificial Sequence
  Description of Artificial Sequence: Synthetic oligonucleotide
  Target: ATXN1; (-) strand; PAM type: YTN; PAM sequence: TTC
tttgctcatgttccttttct

SEQ ID NO: 179857 - DNA, 20 bp, Artificial Sequence
  Description of Artificial Sequence: Synthetic oligonucleotide
  Target: ATXN1; (-) strand; PAM type: YTN; PAM sequence: TTT
ctttgctcatgttccttttc

SEQ ID NO: 179858 - DNA, 20 bp, Artificial Sequence
  Description of Artificial Sequence: Synthetic oligonucleotide
  Target: ATXN1; (-) strand; PAM type: YTN; PAM sequence: TTT
tctttgctcatgttcctttt

SEQ ID NO: 179859 - DNA, 20 bp, Artificial Sequence
  Description of Artificial Sequence: Synthetic oligonucleotide
  Target: ATXN1; (-) strand; PAM type: YTN; PAM sequence: TTG
ggttttctttgctcatgttc

SEQ ID NO: 179860 - DNA, 20 bp, Artificial Sequence
  Description of Artificial Sequence: Synthetic oligonucleotide
  Target: ATXN1; (-) strand; PAM type: YTN; PAM sequence: TTA
tgttgggttttctttgctca

SEQ ID NO: 179861 - DNA, 20 bp, Artificial Sequence
  Description of Artificial Sequence: Synthetic oligonucleotide
  Target: ATXN1; (-) strand; PAM type: YTN; PAM sequence: TTA
cagtgttatgttgggttttc

SEQ ID NO: 179862 - DNA, 20 bp, Artificial Sequence
  Description of Artificial Sequence: Synthetic oligonucleotide
  Target: ATXN1; (-) strand; PAM type: YTN; PAM sequence: TTA
ttacagtgttatgttgggtt

SEQ ID NO: 179863 - DNA, 20 bp, Artificial Sequence
  Description of Artificial Sequence: Synthetic oligonucleotide
  Target: ATXN1; (-) strand; PAM type: YTN; PAM sequence: CTT
attacagtgttatgttgggt

SEQ ID NO: 179864 - DNA, 20 bp, Artificial Sequence
  Description of Artificial Sequence: Synthetic oligonucleotide
  Target: ATXN1; (-) strand; PAM type: YTN; PAM sequence: CTC
ttattacagtgttatgttgg

SEQ ID NO: 179865 - DNA, 20 bp, Artificial Sequence
  Description of Artificial Sequence: Synthetic oligonucleotide
  Target: ATXN1; (-) strand; PAM type: YTN; PAM sequence: TTC
aaaggctcttattacagtgt

SEQ ID NO: 179866 - DNA, 20 bp, Artificial Sequence
  Description of Artificial Sequence: Synthetic oligonucleotide
  Target: ATXN1; (-) strand; PAM type: YTN; PAM sequence: CTT
caaaggctcttattacagtg

SEQ ID NO: 179867 - DNA, 20 bp, Artificial Sequence
  Description of Artificial Sequence: Synthetic oligonucleotide
  Target: ATXN1; (-) strand; PAM type: YTN; PAM sequence: TTC
ttcaaaggctcttattacag

SEQ ID NO: 179868 - DNA, 20 bp, Artificial Sequence
  Description of Artificial Sequence: Synthetic oligonucleotide
  Target: ATXN1; (-) strand; PAM type: YTN; PAM sequence: CTT
cttcaaaggctcttattaca

SEQ ID NO: 179869 - DNA, 20 bp, Artificial Sequence
  Description of Artificial Sequence: Synthetic oligonucleotide
  Target: ATXN1; (-) strand; PAM type: YTN; PAM sequence: TTC
ttcttcaaaggctcttatta

SEQ ID NO: 179870 - DNA, 20 bp, Artificial Sequence
  Description of Artificial Sequence: Synthetic oligonucleotide
  Target: ATXN1; (-) strand; PAM type: YTN; PAM sequence: TTT
cttcttcaaaggctcttatt

SEQ ID NO: 179871 - DNA, 20 bp, Artificial Sequence
  Description of Artificial Sequence: Synthetic oligonucleotide
  Target: ATXN1; (-) strand; PAM type: YTN; PAM sequence: TTT
tcttcttcaaaggctcttat

SEQ ID NO: 179872 - DNA, 20 bp, Artificial Sequence
  Description of Artificial Sequence: Synthetic oligonucleotide
  Target: ATXN1; (-) strand; PAM type: YTN; PAM sequence: CTT
ttcttcttcaaaggctctta

SEQ ID NO: 179873 - DNA, 20 bp, Artificial Sequence
  Description of Artificial Sequence: Synthetic oligonucleotide
  Target: ATXN1; (-) strand; PAM type: YTN; PAM sequence: TTG
cttttcttcttcaaaggctc

SEQ ID NO: 179874 - DNA, 20 bp, Artificial Sequence
  Description of Artificial Sequence: Synthetic oligonucleotide
  Target: ATXN1; (-) strand; PAM type: YTN; PAM sequence: TTA
ttgcttttcttcttcaaagg

SEQ ID NO: 179875 - DNA, 20 bp, Artificial Sequence
  Description of Artificial Sequence: Synthetic oligonucleotide
  Target: ATXN1; (-) strand; PAM type: YTN; PAM sequence: TTT
attgcttttcttcttcaaag

SEQ ID NO: 179876 - DNA, 20 bp, Artificial Sequence
  Description of Artificial Sequence: Synthetic oligonucleotide
  Target: ATXN1; (-) strand; PAM type: YTN; PAM sequence: TTT
tattgcttttcttcttcaaa

SEQ ID NO: 179877 - DNA, 20 bp, Artificial Sequence
  Description of Artificial Sequence: Synthetic oligonucleotide
  Target: ATXN1; (-) strand; PAM type: YTN; PAM sequence: TTT
ttattgcttttcttcttcaa

SEQ ID NO: 179878 - DNA, 20 bp, Artificial Sequence
  Description of Artificial Sequence: Synthetic oligonucleotide
  Target: ATXN1; (-) strand; PAM type: YTN; PAM sequence: CTG
tttttattgcttttcttctt

SEQ ID NO: 179879 - DNA, 20 bp, Artificial Sequence
  Description of Artificial Sequence: Synthetic oligonucleotide
  Target: ATXN1; (-) strand; PAM type: YTN; PAM sequence: TTG
ctgtttttattgcttttctt

SEQ ID NO: 179880 - DNA, 20 bp, Artificial Sequence
  Description of Artificial Sequence: Synthetic oligonucleotide
  Target: ATXN1; (-) strand; PAM type: YTN; PAM sequence: TTT
gctgtttttattgcttttct

SEQ ID NO: 179881 - DNA, 20 bp, Artificial Sequence
  Description of Artificial Sequence: Synthetic oligonucleotide
  Target: ATXN1; (-) strand; PAM type: YTN; PAM sequence: TTA
agcatttgctgtttttattg

SEQ ID NO: 179882 - DNA, 20 bp, Artificial Sequence
  Description of Artificial Sequence: Synthetic oligonucleotide
  Target: ATXN1; (-) strand; PAM type: YTN; PAM sequence: TTT
aagcatttgctgtttttatt

SEQ ID NO: 179883 - DNA, 20 bp, Artificial Sequence
  Description of Artificial Sequence: Synthetic oligonucleotide
  Target: ATXN1; (-) strand; PAM type: YTN; PAM sequence: TTT
taagcatttgctgtttttat

SEQ ID NO: 179884 - DNA, 20 bp, Artificial Sequence
  Description of Artificial Sequence: Synthetic oligonucleotide
  Target: ATXN1; (-) strand; PAM type: YTN; PAM sequence: TTC
agtcacgattttaagcattt

SEQ ID NO: 179885 - DNA, 20 bp, Artificial Sequence
  Description of Artificial Sequence: Synthetic oligonucleotide
  Target: ATXN1; (-) strand; PAM type: YTN; PAM sequence: CTT
cagtcacgattttaagcatt

SEQ ID NO: 179886 - DNA, 20 bp, Artificial Sequence
  Description of Artificial Sequence: Synthetic oligonucleotide
  Target: ATXN1; (-) strand; PAM type: YTN; PAM sequence: TTG
tgcttcagtcacgattttaa

SEQ ID NO: 179887 - DNA, 20 bp, Artificial Sequence
  Description of Artificial Sequence: Synthetic oligonucleotide
  Target: ATXN1; (-) strand; PAM type: YTN; PAM sequence: TTT
gtgcttcagtcacgatttta

SEQ ID NO: 179888 - DNA, 20 bp, Artificial Sequence
  Description of Artificial Sequence: Synthetic oligonucleotide
  Target: ATXN1; (-) strand; PAM type: YTN; PAM sequence: CTA
gaatttgtgcttcagtcacg

SEQ ID NO: 179889 - DNA, 20 bp, Artificial Sequence
  Description of Artificial Sequence: Synthetic oligonucleotide
  Target: ATXN1; (-) strand; PAM type: YTN; PAM sequence: TTC
tagaatttgtgcttcagtca

SEQ ID NO: 179890 - DNA, 20 bp, Artificial Sequence
  Description of Artificial Sequence: Synthetic oligonucleotide
  Target: ATXN1; (-) strand; PAM type: YTN; PAM sequence: CTT
ctagaatttgtgcttcagtc

SEQ ID NO: 179891 - DNA, 20 bp, Artificial Sequence
  Description of Artificial Sequence: Synthetic oligonucleotide
  Target: ATXN1; (-) strand; PAM type: YTN; PAM sequence: CTA
cttctagaatttgtgcttca

SEQ ID NO: 179892 - DNA, 20 bp, Artificial Sequence
  Description of Artificial Sequence: Synthetic oligonucleotide
  Target: ATXN1; (-) strand; PAM type: YTN; PAM sequence: TTC
tacttctagaatttgtgctt

SEQ ID NO: 179893 - DNA, 20 bp, Artificial Sequence
  Description of Artificial Sequence: Synthetic oligonucleotide
  Target: ATXN1; (-) strand; PAM type: YTN; PAM sequence: TTT
ctacttctagaatttgtgct

SEQ ID NO: 179894 - DNA, 20 bp, Artificial Sequence
  Description of Artificial Sequence: Synthetic oligonucleotide
  Target: ATXN1; (-) strand; PAM type: YTN; PAM sequence: TTT
tctacttctagaatttgtgc

SEQ ID NO: 179895 - DNA, 20 bp, Artificial Sequence
  Description of Artificial Sequence: Synthetic oligonucleotide
  Target: ATXN1; (-) strand; PAM type: YTN; PAM sequence: TTT
ttctacttctagaatttgtg

SEQ ID NO: 179896 - DNA, 20 bp, Artificial Sequence
  Description of Artificial Sequence: Synthetic oligonucleotide
  Target: ATXN1; (-) strand; PAM type: YTN; PAM sequence: CTT
tttctacttctagaatttgt

SEQ ID NO: 179897 - DNA, 20 bp, Artificial Sequence
  Description of Artificial Sequence: Synthetic oligonucleotide
  Target: ATXN1; (-) strand; PAM type: YTN; PAM sequence: TTC
aaatctttttctacttctag

SEQ ID NO: 179898 - DNA, 20 bp, Artificial Sequence
  Description of Artificial Sequence: Synthetic oligonucleotide
  Target: ATXN1; (-) strand; PAM type: YTN; PAM sequence: TTT
caaatctttttctacttcta

SEQ ID NO: 179899 - DNA, 20 bp, Artificial Sequence
  Description of Artificial Sequence: Synthetic oligonucleotide
  Target: ATXN1; (-) strand; PAM type: YTN; PAM sequence: CTG
tcaatatatagtttcaaatc

SEQ ID NO: 179900 - DNA, 20 bp, Artificial Sequence
  Description of Artificial Sequence: Synthetic oligonucleotide
  Target: ATXN1; (-) strand; PAM type: YTN; PAM sequence: TTC
tgtcaatatatagtttcaaa

SEQ ID NO: 179901 - DNA, 20 bp, Artificial Sequence
  Description of Artificial Sequence: Synthetic oligonucleotide
  Target: ATXN1; (-) strand; PAM type: YTN; PAM sequence: TTC
caggtgcatggagtattctg

SEQ ID NO: 179902 - DNA, 20 bp, Artificial Sequence
  Description of Artificial Sequence: Synthetic oligonucleotide
  Target: ATXN1; (-) strand; PAM type: YTN; PAM sequence: TTT
ccaggtgcatggagtattct

SEQ ID NO: 179903 - DNA, 20 bp, Artificial Sequence
  Description of Artificial Sequence: Synthetic oligonucleotide
  Target: ATXN1; (-) strand; PAM type: YTN; PAM sequence: TTT
tccaggtgcatggagtattc

SEQ ID NO: 179904 - DNA, 20 bp, Artificial Sequence
  Description of Artificial Sequence: Synthetic oligonucleotide
  Target: ATXN1; (-) strand; PAM type: YTN; PAM sequence: TTT
ttccaggtgcatggagtatt

SEQ ID NO: 179905 - DNA, 20 bp, Artificial Sequence
  Description of Artificial Sequence: Synthetic oligonucleotide
  Target: ATXN1; (-) strand; PAM type: YTN; PAM sequence: CTA
ggtcagtttttccaggtgca

SEQ ID NO: 179906 - DNA, 20 bp, Artificial Sequence
  Description of Artificial Sequence: Synthetic oligonucleotide
  Target: ATXN1; (-) strand; PAM type: YTN; PAM sequence: TTC
ctaggtcagtttttccaggt

SEQ ID NO: 179907 - DNA, 20 bp, Artificial Sequence
  Description of Artificial Sequence: Synthetic oligonucleotide
  Target: ATXN1; (-) strand; PAM type: YTN; PAM sequence: TTT
cctaggtcagtttttccagg

SEQ ID NO: 179908 - DNA, 20 bp, Artificial Sequence
  Description of Artificial Sequence: Synthetic oligonucleotide
  Target: ATXN1; (-) strand; PAM type: YTN; PAM sequence: CTT
tcctaggtcagtttttccag

SEQ ID NO: 179909 - DNA, 20 bp, Artificial Sequence
  Description of Artificial Sequence: Synthetic oligonucleotide
  Target: ATXN1; (-) strand; PAM type: YTN; PAM sequence: TTC
tttcctaggtcagtttttcc

SEQ ID NO: 179910 - DNA, 20 bp, Artificial Sequence
  Description of Artificial Sequence: Synthetic oligonucleotide
  Target: ATXN1; (-) strand; PAM type: YTN; PAM sequence: TTT
ctttcctaggtcagtttttc

SEQ ID NO: 179911 - DNA, 20 bp, Artificial Sequence
  Description of Artificial Sequence: Synthetic oligonucleotide
  Target: ATXN1; (-) strand; PAM type: YTN; PAM sequence: TTT
tctttcctaggtcagttttt

SEQ ID NO: 179912 - DNA, 20 bp, Artificial Sequence
  Description of Artificial Sequence: Synthetic oligonucleotide
  Target: ATXN1; (-) strand; PAM type: YTN; PAM sequence: TTG
ttttctttcctaggtcagtt

SEQ ID NO: 179913 - DNA, 20 bp, Artificial Sequence
  Description of Artificial Sequence: Synthetic oligonucleotide
  Target: ATXN1; (-) strand; PAM type: YTN; PAM sequence: TTT
gttttctttcctaggtcagt

SEQ ID NO: 179914 - DNA, 20 bp, Artificial Sequence
  Description of Artificial Sequence: Synthetic oligonucleotide
  Target: ATXN1; (-) strand; PAM type: YTN; PAM sequence: TTT
tgttttctttcctaggtcag

SEQ ID NO: 179915 - DNA, 20 bp, Artificial Sequence
  Description of Artificial Sequence: Synthetic oligonucleotide
  Target: ATXN1; (-) strand; PAM type: YTN; PAM sequence: TTT
ttgttttctttcctaggtca

SEQ ID NO: 179916 - DNA, 20 bp, Artificial Sequence
  Description of Artificial Sequence: Synthetic oligonucleotide
  Target: ATXN1; (-) strand; PAM type: YTN; PAM sequence: TTT
tttgttttctttcctaggtc

SEQ ID NO: 179917 - DNA, 20 bp, Artificial Sequence
  Description of Artificial Sequence: Synthetic oligonucleotide
  Target: ATXN1; (-) strand; PAM type: YTN; PAM sequence: TTT
ttttgttttctttcctaggt

SEQ ID NO: 179918 - DNA, 20 bp, Artificial Sequence
  Description of Artificial Sequence: Synthetic oligonucleotide
  Target: ATXN1; (-) strand; PAM type: YTN; PAM sequence: TTT
tttttgttttctttcctagg

SEQ ID NO: 179919 - DNA, 20 bp, Artificial Sequence
  Description of Artificial Sequence: Synthetic oligonucleotide
  Target: ATXN1; (-) strand; PAM type: YTN; PAM sequence: TTT
ttttttgttttctttcctag

SEQ ID NO: 179920 - DNA, 20 bp, Artificial Sequence
  Description of Artificial Sequence: Synthetic oligonucleotide
  Target: ATXN1; (-) strand; PAM type: YTN; PAM sequence: CTG
agtgtccaaagaattttttt

SEQ ID NO: 179921 - DNA, 20 bp, Artificial Sequence
  Description of Artificial Sequence: Synthetic oligonucleotide
  Target: ATXN1; (-) strand; PAM type: YTN; PAM sequence: TTA
cctgagtgtccaaagaattt

SEQ ID NO: 179922 - DNA, 20 bp, Artificial Sequence
  Description of Artificial Sequence: Synthetic oligonucleotide
  Target: ATXN1; (-) strand; PAM type: YTN; PAM sequence: TTT
acctgagtgtccaaagaatt

SEQ ID NO: 179923 - DNA, 20 bp, Artificial Sequence
  Description of Artificial Sequence: Synthetic oligonucleotide
  Target: ATXN1; (-) strand; PAM type: YTN; PAM sequence: TTT
tacctgagtgtccaaagaat

SEQ ID NO: 179924 - DNA, 20 bp, Artificial Sequence
  Description of Artificial Sequence: Synthetic oligonucleotide
  Target: ATXN1; (-) strand; PAM type: YTN; PAM sequence: CTC
agtcattttacctgagtgtc

SEQ ID NO: 179925 - DNA, 20 bp, Artificial Sequence
  Description of Artificial Sequence: Synthetic oligonucleotide
  Target: ATXN1; (-) strand; PAM type: YTN; PAM sequence: TTA
taggtaactcagtcatttta

SEQ ID NO: 179926 - DNA, 20 bp, Artificial Sequence
  Description of Artificial Sequence: Synthetic oligonucleotide
  Target: ATXN1; (-) strand; PAM type: YTN; PAM sequence: CTT
ataggtaactcagtcatttt

SEQ ID NO: 179927 - DNA, 20 bp, Artificial Sequence
  Description of Artificial Sequence: Synthetic oligonucleotide
  Target: ATXN1; (-) strand; PAM type: YTN; PAM sequence: CTG
tcccttataggtaactcagt

SEQ ID NO: 179928 - DNA, 20 bp, Artificial Sequence
  Description of Artificial Sequence: Synthetic oligonucleotide
  Target: ATXN1; (-) strand; PAM type: YTN; PAM sequence: TTC
tgtcccttataggtaactca

SEQ ID NO: 179929 - DNA, 20 bp, Artificial Sequence
  Description of Artificial Sequence: Synthetic oligonucleotide
  Target: ATXN1; (-) strand; PAM type: YTN; PAM sequence: TTT
ctgtcccttataggtaactc

SEQ ID NO: 179930 - DNA, 20 bp, Artificial Sequence
  Description of Artificial Sequence: Synthetic oligonucleotide
  Target: ATXN1; (-) strand; PAM type: YTN; PAM sequence: TTT
tctgtcccttataggtaact

SEQ ID NO: 179931 - DNA, 20 bp, Artificial Sequence
  Description of Artificial Sequence: Synthetic oligonucleotide
  Target: ATXN1; (-) strand; PAM type: YTN; PAM sequence: CTA
attttctgtcccttataggt

SEQ ID NO: 179932 - DNA, 20 bp, Artificial Sequence
  Description of Artificial Sequence: Synthetic oligonucleotide
  Target: ATXN1; (-) strand; PAM type: YTN; PAM sequence: CTC
taattttctgtcccttatag

SEQ ID NO: 179933 - DNA, 20 bp, Artificial Sequence
  Description of Artificial Sequence: Synthetic oligonucleotide
  Target: ATXN1; (-) strand; PAM type: YTN; PAM sequence: TTG
aaaaatcgggtgacactcta

SEQ ID NO: 179934 - DNA, 20 bp, Artificial Sequence
  Description of Artificial Sequence: Synthetic oligonucleotide
  Target: ATXN1; (-) strand; PAM type: YTN; PAM sequence: CTT
gaaaaatcgggtgacactct

SEQ ID NO: 179935 - DNA, 20 bp, Artificial Sequence
  Description of Artificial Sequence: Synthetic oligonucleotide
  Target: ATXN1; (-) strand; PAM type: YTN; PAM sequence: CTC
ttgaaaaatcgggtgacact

SEQ ID NO: 179936 - DNA, 20 bp, Artificial Sequence
  Description of Artificial Sequence: Synthetic oligonucleotide
  Target: ATXN1; (-) strand; PAM type: YTN; PAM sequence: CTG
gctcttgaaaaatcgggtga

SEQ ID NO: 179937 - DNA, 20 bp, Artificial Sequence
  Description of Artificial Sequence: Synthetic oligonucleotide
  Target: ATXN1; (-) strand; PAM type: YTN; PAM sequence: TTA
gcatgaagcctggctcttga

SEQ ID NO: 179938 - DNA, 20 bp, Artificial Sequence
  Description of Artificial Sequence: Synthetic oligonucleotide
  Target: ATXN1; (-) strand; PAM type: YTN; PAM sequence: TTT
agcatgaagcctggctcttg

SEQ ID NO: 179939 - DNA, 20 bp, Artificial Sequence
  Description of Artificial Sequence: Synthetic oligonucleotide
  Target: ATXN1; (-) strand; PAM type: YTN; PAM sequence: TTT
tagcatgaagcctggctctt

SEQ ID NO: 179940 - DNA, 20 bp, Artificial Sequence
  Description of Artificial Sequence: Synthetic oligonucleotide
  Target: ATXN1; (-) strand; PAM type: YTN; PAM sequence: CTT
ttagcatgaagcctggctct

SEQ ID NO: 179941 - DNA, 20 bp, Artificial Sequence
  Description of Artificial Sequence: Synthetic oligonucleotide
  Target: ATXN1; (-) strand; PAM type: YTN; PAM sequence: CTG
acttttagcatgaagcctgg

SEQ ID NO: 179942 - DNA, 20 bp, Artificial Sequence
  Description of Artificial Sequence: Synthetic oligonucleotide
  Target: ATXN1; (-) strand; PAM type: YTN; PAM sequence: CTA
ctgacttttagcatgaagcc

SEQ ID NO: 179943 - DNA, 20 bp, Artificial Sequence
  Description of Artificial Sequence: Synthetic oligonucleotide
  Target: ATXN1; (-) strand; PAM type: YTN; PAM sequence: CTG
agtgtcacgctactgacttt

SEQ ID NO: 179944 - DNA, 20 bp, Artificial Sequence
  Description of Artificial Sequence: Synthetic oligonucleotide
  Target: ATXN1; (-) strand; PAM type: YTN; PAM sequence: TTC
ctgagtgtcacgctactgac

SEQ ID NO: 179945 - DNA, 20 bp, Artificial Sequence
  Description of Artificial Sequence: Synthetic oligonucleotide
  Target: ATXN1; (-) strand; PAM type: YTN; PAM sequence: TTT
cctgagtgtcacgctactga

SEQ ID NO: 179946 - DNA, 20 bp, Artificial Sequence
  Description of Artificial Sequence: Synthetic oligonucleotide
  Target: ATXN1; (-) strand; PAM type: YTN; PAM sequence: CTT
tcctgagtgtcacgctactg

SEQ ID NO: 179947 - DNA, 20 bp, Artificial Sequence
  Description of Artificial Sequence: Synthetic oligonucleotide
  Target: ATXN1; (-) strand; PAM type: YTN; PAM sequence: TTG
tctttcctgagtgtcacgct

SEQ ID NO: 179948 - DNA, 20 bp, Artificial Sequence
  Description of Artificial Sequence: Synthetic oligonucleotide
  Target: ATXN1; (-) strand; PAM type: YTN; PAM sequence: TTA
gttgtctttcctgagtgtca

SEQ ID NO: 179949 - DNA, 20 bp, Artificial Sequence
  Description of Artificial Sequence: Synthetic oligonucleotide
  Target: ATXN1; (-) strand; PAM type: YTN; PAM sequence: CTT
agttgtctttcctgagtgtc

SEQ ID NO: 179950 - DNA, 20 bp, Artificial Sequence
  Description of Artificial Sequence: Synthetic oligonucleotide
  Target: ATXN1; (-) strand; PAM type: YTN; PAM sequence: TTG
gcttagttgtctttcctgag

SEQ ID NO: 179951 - DNA, 20 bp, Artificial Sequence
  Description of Artificial Sequence: Synthetic oligonucleotide
  Target: ATXN1; (-) strand; PAM type: YTN; PAM sequence: CTT
ggcttagttgtctttcctga

SEQ ID NO: 179952 - DNA, 20 bp, Artificial Sequence
  Description of Artificial Sequence: Synthetic oligonucleotide
  Target: ATXN1; (-) strand; PAM type: YTN; PAM sequence: CTG
ggtataagatccttggctta

SEQ ID NO: 179953 - DNA, 20 bp, Artificial Sequence
  Description of Artificial Sequence: Synthetic oligonucleotide
  Target: ATXN1; (-) strand; PAM type: YTN; PAM sequence: TTG
gctgggtataagatccttgg

SEQ ID NO: 179954 - DNA, 20 bp, Artificial Sequence
  Description of Artificial Sequence: Synthetic oligonucleotide
  Target: ATXN1; (-) strand; PAM type: YTN; PAM sequence: TTT
ggctgggtataagatccttg

SEQ ID NO: 179955 - DNA, 20 bp, Artificial Sequence
  Description of Artificial Sequence: Synthetic oligonucleotide
  Target: ATXN1; (-) strand; PAM type: YTN; PAM sequence: TTT
tggctgggtataagatcctt

SEQ ID NO: 179956 - DNA, 20 bp, Artificial Sequence
  Description of Artificial Sequence: Synthetic oligonucleotide
  Target: ATXN1; (-) strand; PAM type: YTN; PAM sequence: CTG
gaagatcattttggctgggt

SEQ ID NO: 179957 - DNA, 20 bp, Artificial Sequence
  Description of Artificial Sequence: Synthetic oligonucleotide
  Target: ATXN1; (-) strand; PAM type: YTN; PAM sequence: TTG
gctggaagatcattttggct

SEQ ID NO: 179958 - DNA, 20 bp, Artificial Sequence
  Description of Artificial Sequence: Synthetic oligonucleotide
  Target: ATXN1; (-) strand; PAM type: YTN; PAM sequence: TTG
ttggctggaagatcattttg

SEQ ID NO: 179959 - DNA, 20 bp, Artificial Sequence
  Description of Artificial Sequence: Synthetic oligonucleotide
  Target: ATXN1; (-) strand; PAM type: YTN; PAM sequence: TTG
ttgttggctggaagatcatt

SEQ ID NO: 179960 - DNA, 20 bp, Artificial Sequence
  Description of Artificial Sequence: Synthetic oligonucleotide
  Target: ATXN1; (-) strand; PAM type: YTN; PAM sequence: TTC
ataacagattgttgttggct

SEQ ID NO: 179961 - DNA, 20 bp, Artificial Sequence
  Description of Artificial Sequence: Synthetic oligonucleotide
  Target: ATXN1; (-) strand; PAM type: YTN; PAM sequence: TTG
catattcataacagattgtt

SEQ ID NO: 179962 - DNA, 20 bp, Artificial Sequence
  Description of Artificial Sequence: Synthetic oligonucleotide
  Target: ATXN1; (-) strand; PAM type: YTN; PAM sequence: CTT
gcatattcataacagattgt

SEQ ID NO: 179963 - DNA, 20 bp, Artificial Sequence
  Description of Artificial Sequence: Synthetic oligonucleotide
  Target: ATXN1; (-) strand; PAM type: YTN; PAM sequence: TTG
ggtccttgcatattcataac

SEQ ID NO: 179964 - DNA, 20 bp, Artificial Sequence
  Description of Artificial Sequence: Synthetic oligonucleotide
  Target: ATXN1; (-) strand; PAM type: YTN; PAM sequence: CTT
gggtccttgcatattcataa

SEQ ID NO: 179965 - DNA, 20 bp, Artificial Sequence
  Description of Artificial Sequence: Synthetic oligonucleotide
  Target: ATXN1; (-) strand; PAM type: YTN; PAM sequence: TTC
cttgggtccttgcatattca

SEQ ID NO: 179966 - DNA, 20 bp, Artificial Sequence
  Description of Artificial Sequence: Synthetic oligonucleotide
  Target: ATXN1; (-) strand; PAM type: YTN; PAM sequence: CTG
cgaacaatattccttgggtc

SEQ ID NO: 179967 - DNA, 20 bp, Artificial Sequence
  Description of Artificial Sequence: Synthetic oligonucleotide
  Target: ATXN1; (-) strand; PAM type: YTN; PAM sequence: TTC
tgcgaacaatattccttggg

SEQ ID NO: 179968 - DNA, 20 bp, Artificial Sequence
  Description of Artificial Sequence: Synthetic oligonucleotide
  Target: ATXN1; (-) strand; PAM type: YTN; PAM sequence: TTT
ctgcgaacaatattccttgg

SEQ ID NO: 179969 - DNA, 20 bp, Artificial Sequence
  Description of Artificial Sequence: Synthetic oligonucleotide
  Target: ATXN1; (-) strand; PAM type: YTN; PAM sequence: CTA
agggtttctgcgaacaatat

SEQ ID NO: 179970 - DNA, 20 bp, Artificial Sequence
  Description of Artificial Sequence: Synthetic oligonucleotide
  Target: ATXN1; (-) strand; PAM type: YTN; PAM sequence: TTA
ctaagggtttctgcgaacaa

SEQ ID NO: 179971 - DNA, 20 bp, Artificial Sequence
  Description of Artificial Sequence: Synthetic oligonucleotide
  Target: ATXN1; (-) strand; PAM type: YTN; PAM sequence: TTG
cagattactaagggtttctg

SEQ ID NO: 179972 - DNA, 20 bp, Artificial Sequence
  Description of Artificial Sequence: Synthetic oligonucleotide
  Target: ATXN1; (-) strand; PAM type: YTN; PAM sequence: CTT
gcagattactaagggtttct

SEQ ID NO: 179973 - DNA, 20 bp, Artificial Sequence
  Description of Artificial Sequence: Synthetic oligonucleotide
  Target: ATXN1; (-) strand; PAM type: YTN; PAM sequence: CTC
ccttgcagattactaagggt

SEQ ID NO: 179974 - DNA, 20 bp, Artificial Sequence
  Description of Artificial Sequence: Synthetic oligonucleotide
  Target: ATXN1; (-) strand; PAM type: YTN; PAM sequence: TTC
tcccttgcagattactaagg

SEQ ID NO: 179975 - DNA, 20 bp, Artificial Sequence
  Description of Artificial Sequence: Synthetic oligonucleotide
  Target: ATXN1; (-) strand; PAM type: YTN; PAM sequence: CTT
ctcccttgcagattactaag

SEQ ID NO: 179976 - DNA, 20 bp, Artificial Sequence
  Description of Artificial Sequence: Synthetic oligonucleotide
  Target: ATXN1; (-) strand; PAM type: YTN; PAM sequence: CTC
ttctcccttgcagattacta

SEQ ID NO: 179977 - DNA, 20 bp, Artificial Sequence
  Description of Artificial Sequence: Synthetic oligonucleotide
  Target: ATXN1; (-) strand; PAM type: YTN; PAM sequence: CTG
actcttctcccttgcagatt

SEQ ID NO: 179978 - DNA, 20 bp, Artificial Sequence
  Description of Artificial Sequence: Synthetic oligonucleotide
  Target: ATXN1; (-) strand; PAM type: YTN; PAM sequence: TTG
cctgactcttctcccttgca

SEQ ID NO: 179979 - DNA, 20 bp, Artificial Sequence
  Description of Artificial Sequence: Synthetic oligonucleotide
  Target: ATXN1; (-) strand; PAM type: YTN; PAM sequence: CTG
gttgcctgactcttctccct

SEQ ID NO: 179980 - DNA, 20 bp, Artificial Sequence
  Description of Artificial Sequence: Synthetic oligonucleotide
  Target: ATXN1; (-) strand; PAM type: YTN; PAM sequence: TTC
cagccagactggttgcctga

SEQ ID NO: 179981 - DNA, 20 bp, Artificial Sequence
  Description of Artificial Sequence: Synthetic oligonucleotide
  Target: ATXN1; (-) strand; PAM type: YTN; PAM sequence: TTT
ccagccagactggttgcctg

SEQ ID NO: 179982 - DNA, 20 bp, Artificial Sequence
  Description of Artificial Sequence: Synthetic oligonucleotide
  Target: ATXN1; (-) strand; PAM type: YTN; PAM sequence: CTT
tccagccagactggttgcct

SEQ ID NO: 179983 - DNA, 20 bp, Artificial Sequence
  Description of Artificial Sequence: Synthetic oligonucleotide
  Target: ATXN1; (-) strand; PAM type: YTN; PAM sequence: TTG
tatcagtgcctttccagcca

SEQ ID NO: 179984 - DNA, 20 bp, Artificial Sequence
  Description of Artificial Sequence: Synthetic oligonucleotide
  Target: ATXN1; (-) strand; PAM type: YTN; PAM sequence: TTT
gtatcagtgcctttccagcc

SEQ ID NO: 179985 - DNA, 20 bp, Artificial Sequence
  Description of Artificial Sequence: Synthetic oligonucleotide
  Target: ATXN1; (-) strand; PAM type: YTN; PAM sequence: CTT
tgtatcagtgcctttccagc

SEQ ID NO: 179986 - DNA, 20 bp, Artificial Sequence
  Description of Artificial Sequence: Synthetic oligonucleotide
  Target: ATXN1; (-) strand; PAM type: YTN; PAM sequence: CTC
acccagtctttgtatcagtg

SEQ ID NO: 179987 - DNA, 20 bp, Artificial Sequence
  Description of Artificial Sequence: Synthetic oligonucleotide
  Target: ATXN1; (-) strand; PAM type: YTN; PAM sequence: TTA
aatgctcacccagtctttgt

SEQ ID NO: 179988 - DNA, 20 bp, Artificial Sequence
  Description of Artificial Sequence: Synthetic oligonucleotide
  Target: ATXN1; (-) strand; PAM type: YTN; PAM sequence: TTA
tgtgttaaatgctcacccag

SEQ ID NO: 179989 - DNA, 20 bp, Artificial Sequence
  Description of Artificial Sequence: Synthetic oligonucleotide
  Target: ATXN1; (-) strand; PAM type: YTN; PAM sequence: CTG
attatgtgttaaatgctcac

SEQ ID NO: 179990 - DNA, 20 bp, Artificial Sequence
  Description of Artificial Sequence: Synthetic oligonucleotide
  Target: ATXN1; (-) strand; PAM type: YTN; PAM sequence: CTA
cagctgattatgtgttaaat

SEQ ID NO: 179991 - DNA, 20 bp, Artificial Sequence
  Description of Artificial Sequence: Synthetic oligonucleotide
  Target: ATXN1; (-) strand; PAM type: YTN; PAM sequence: TTC
agtaacagacctacagctga

SEQ ID NO: 179992 - DNA, 20 bp, Artificial Sequence
  Description of Artificial Sequence: Synthetic oligonucleotide
  Target: ATXN1; (-) strand; PAM type: YTN; PAM sequence: TTT
cagtaacagacctacagctg

SEQ ID NO: 179993 - DNA, 20 bp, Artificial Sequence
  Description of Artificial Sequence: Synthetic oligonucleotide
  Target: ATXN1; (-) strand; PAM type: YTN; PAM sequence: CTT
tcagtaacagacctacagct

SEQ ID NO: 179994 - DNA, 20 bp, Artificial Sequence
  Description of Artificial Sequence: Synthetic oligonucleotide
  Target: ATXN1; (-) strand; PAM type: YTN; PAM sequence: TTG
taatcatctttcagtaacag

SEQ ID NO: 179995 - DNA, 20 bp, Artificial Sequence
  Description of Artificial Sequence: Synthetic oligonucleotide
  Target: ATXN1; (-) strand; PAM type: YTN; PAM sequence: CTT
gtaatcatctttcagtaaca

SEQ ID NO: 179996 - DNA, 20 bp, Artificial Sequence
  Description of Artificial Sequence: Synthetic oligonucleotide
  Target: ATXN1; (-) strand; PAM type: YTN; PAM sequence: TTC
cttgtaatcatctttcagta

SEQ ID NO: 179997 - DNA, 20 bp, Artificial Sequence
  Description of Artificial Sequence: Synthetic oligonucleotide
  Target: ATXN1; (-) strand; PAM type: YTN; PAM sequence: TTT
ccttgtaatcatctttcagt

SEQ ID NO: 179998 - DNA, 20 bp, Artificial Sequence
  Description of Artificial Sequence: Synthetic oligonucleotide
  Target: ATXN1; (-) strand; PAM type: YTN; PAM sequence: TTG
tttccttgtaatcatctttc

SEQ ID NO: 179999 - DNA, 20 bp, Artificial Sequence
  Description of Artificial Sequence: Synthetic oligonucleotide
  Target: ATXN1; (-) strand; PAM type: YTN; PAM sequence: CTA
tatgtaatattgtttccttg

SEQ ID NO: 180000 - DNA, 20 bp, Artificial Sequence
  Description of Artificial Sequence: Synthetic oligonucleotide
  Target: ATXN1; (-) strand; PAM type: YTN; PAM sequence: CTG
gctatatgtaatattgtttc

SEQ ID NO: 180001 - DNA, 20 bp, Artificial Sequence
  Description of Artificial Sequence: Synthetic oligonucleotide
  Target: ATXN1; (-) strand; PAM type: YTN; PAM sequence: TTC
tggctatatgtaatattgtt

SEQ ID NO: 180002 - DNA, 20 bp, Artificial Sequence
  Description of Artificial Sequence: Synthetic oligonucleotide
  Target: ATXN1; (-) strand; PAM type: YTN; PAM sequence: TTA
tatcgttctggctatatgta

SEQ ID NO: 180003 - DNA, 20 bp, Artificial Sequence
  Description of Artificial Sequence: Synthetic oligonucleotide
  Target: ATXN1; (-) strand; PAM type: YTN; PAM sequence: TTG
tcagggcacatagtcattat

SEQ ID NO: 180004 - DNA, 20 bp, Artificial Sequence
  Description of Artificial Sequence: Synthetic oligonucleotide
  Target: ATXN1; (-) strand; PAM type: YTN; PAM sequence: CTA
tattgtcagggcacatagtc

SEQ ID NO: 180005 - DNA, 20 bp, Artificial Sequence
  Description of Artificial Sequence: Synthetic oligonucleotide
  Target: ATXN1; (-) strand; PAM type: YTN; PAM sequence: CTA
tctatattgtcagggcacat

SEQ ID NO: 180006 - DNA, 20 bp, Artificial Sequence
  Description of Artificial Sequence: Synthetic oligonucleotide
  Target: ATXN1; (-) strand; PAM type: YTN; PAM sequence: TTA
tactatctatattgtcaggg

SEQ ID NO: 180007 - DNA, 20 bp, Artificial Sequence
  Description of Artificial Sequence: Synthetic oligonucleotide
  Target: ATXN1; (-) strand; PAM type: YTN; PAM sequence: TTA
atcattatactatctatatt

SEQ ID NO: 180008 - DNA, 20 bp, Artificial Sequence
  Description of Artificial Sequence: Synthetic oligonucleotide
  Target: ATXN1; (-) strand; PAM type: YTN; PAM sequence: TTT
aatcattatactatctatat

SEQ ID NO: 180009 - DNA, 20 bp, Artificial Sequence
  Description of Artificial Sequence: Synthetic oligonucleotide
  Target: ATXN1; (-) strand; PAM type: YTN; PAM sequence: TTT
taatcattatactatctata

SEQ ID NO: 180010 - DNA, 20 bp, Artificial Sequence
  Description of Artificial Sequence: Synthetic oligonucleotide
  Target: ATXN1; (-) strand; PAM type: YTN; PAM sequence: TTT
ttaatcattatactatctat

SEQ ID NO: 180011 - DNA, 20 bp, Artificial Sequence
  Description of Artificial Sequence: Synthetic oligonucleotide
  Target: ATXN1; (-) strand; PAM type: YTN; PAM sequence: TTT
tttaatcattatactatcta

SEQ ID NO: 180012 - DNA, 20 bp, Artificial Sequence
  Description of Artificial Sequence: Synthetic oligonucleotide
  Target: ATXN1; (-) strand; PAM type: YTN; PAM sequence: TTT
ttttaatcattatactatct

SEQ ID NO: 180013 - DNA, 20 bp, Artificial Sequence
  Description of Artificial Sequence: Synthetic oligonucleotide
  Target: ATXN1; (-) strand; PAM type: YTN; PAM sequence: TTT
tttttaatcattatactatc

SEQ ID NO: 180014 - DNA, 20 bp, Artificial Sequence
  Description of Artificial Sequence: Synthetic oligonucleotide
  Target: ATXN1; (-) strand; PAM type: YTN; PAM sequence: TTT
ttttttaatcattatactat

SEQ ID NO: 180015 - DNA, 20 bp, Artificial Sequence
  Description of Artificial Sequence: Synthetic oligonucleotide
  Target: ATXN1; (-) strand; PAM type: YTN; PAM sequence: TTC
ccgcgtgtttttttttaatc

SEQ ID NO: 180016 - DNA, 20 bp, Artificial Sequence
  Description of Artificial Sequence: Synthetic oligonucleotide
  Target: ATXN1; (-) strand; PAM type: YTN; PAM sequence: CTT
cccgcgtgtttttttttaat

SEQ ID NO: 180017 - DNA, 20 bp, Artificial Sequence
  Description of Artificial Sequence: Synthetic oligonucleotide
  Target: ATXN1; (-) strand; PAM type: YTN; PAM sequence: TTC
ttcccgcgtgttttttttta

SEQ ID NO: 180018 - DNA, 20 bp, Artificial Sequence
  Description of Artificial Sequence: Synthetic oligonucleotide
  Target: ATXN1; (-) strand; PAM type: YTN; PAM sequence: TTC
atattcttcccgcgtgtttt

SEQ ID NO: 180019 - DNA, 20 bp, Artificial Sequence
  Description of Artificial Sequence: Synthetic oligonucleotide
  Target: ATXN1; (-) strand; PAM type: YTN; PAM sequence: TTT
catattcttcccgcgtgttt

SEQ ID NO: 180020 - DNA, 20 bp, Artificial Sequence
  Description of Artificial Sequence: Synthetic oligonucleotide
  Target: ATXN1; (-) strand; PAM type: YTN; PAM sequence: CTT
tcatattcttcccgcgtgtt

SEQ ID NO: 180021 - DNA, 20 bp, Artificial Sequence
  Description of Artificial Sequence: Synthetic oligonucleotide
  Target: ATXN1; (-) strand; PAM type: YTN; PAM sequence: TTC
ctttcatattcttcccgcgt

SEQ ID NO: 180022 - DNA, 20 bp, Artificial Sequence
  Description of Artificial Sequence: Synthetic oligonucleotide
  Target: ATXN1; (-) strand; PAM type: YTN; PAM sequence: TTC
gttcctttcatattcttccc

SEQ ID NO: 180023 - DNA, 20 bp, Artificial Sequence
  Description of Artificial Sequence: Synthetic oligonucleotide
  Target: ATXN1; (-) strand; PAM type: YTN; PAM sequence: TTT
cgttcctttcatattcttcc

SEQ ID NO: 180024 - DNA, 20 bp, Artificial Sequence
  Description of Artificial Sequence: Synthetic oligonucleotide
  Target: ATXN1; (-) strand; PAM type: YTN; PAM sequence: TTT
tcgttcctttcatattcttc

SEQ ID NO: 180025 - DNA, 20 bp, Artificial Sequence
  Description of Artificial Sequence: Synthetic oligonucleotide
  Target: ATXN1; (-) strand; PAM type: YTN; PAM sequence: TTA
ttttcgttcctttcatattc

SEQ ID NO: 180026 - DNA, 20 bp, Artificial Sequence
  Description of Artificial Sequence: Synthetic oligonucleotide
  Target: ATXN1; (-) strand; PAM type: YTN; PAM sequence: TTA
gtgagattattttcgttcct

SEQ ID NO: 180027 - DNA, 20 bp, Artificial Sequence
  Description of Artificial Sequence: Synthetic oligonucleotide
  Target: ATXN1; (-) strand; PAM type: YTN; PAM sequence: CTA
tgttagtgagattattttcg

SEQ ID NO: 180028 - DNA, 20 bp, Artificial Sequence
  Description of Artificial Sequence: Synthetic oligonucleotide
  Target: ATXN1; (-) strand; PAM type: YTN; PAM sequence: TTA
acatctatgttagtgagatt

SEQ ID NO: 180029 - DNA, 20 bp, Artificial Sequence
  Description of Artificial Sequence: Synthetic oligonucleotide
  Target: ATXN1; (-) strand; PAM type: YTN; PAM sequence: CTT
aacatctatgttagtgagat

SEQ ID NO: 180030 - DNA, 20 bp, Artificial Sequence
  Description of Artificial Sequence: Synthetic oligonucleotide
  Target: ATXN1; (-) strand; PAM type: YTN; PAM sequence: CTC
ccacttaacatctatgttag

SEQ ID NO: 180031 - DNA, 20 bp, Artificial Sequence
  Description of Artificial Sequence: Synthetic oligonucleotide
  Target: ATXN1; (-) strand; PAM type: YTN; PAM sequence: TTA
ctcccacttaacatctatgt

SEQ ID NO: 180032 - DNA, 20 bp, Artificial Sequence
  Description of Artificial Sequence: Synthetic oligonucleotide
  Target: ATXN1; (-) strand; PAM type: YTN; PAM sequence: TTT
actcccacttaacatctatg

SEQ ID NO: 180033 - DNA, 20 bp, Artificial Sequence
  Description of Artificial Sequence: Synthetic oligonucleotide
  Target: ATXN1; (-) strand; PAM type: YTN; PAM sequence: TTT
tactcccacttaacatctat

SEQ ID NO: 180034 - DNA, 20 bp, Artificial Sequence
  Description of Artificial Sequence: Synthetic oligonucleotide
  Target: ATXN1; (-) strand; PAM type: YTN; PAM sequence: CTT
ttactcccacttaacatcta

SEQ ID NO: 180035 - DNA, 20 bp, Artificial Sequence
  Description of Artificial Sequence: Synthetic oligonucleotide
  Target: ATXN1; (-) strand; PAM type: YTN; PAM sequence: TTA
aggtaatatccttttactcc

SEQ ID NO: 180036 - DNA, 20 bp, Artificial Sequence
  Description of Artificial Sequence: Synthetic oligonucleotide
  Target: ATXN1; (-) strand; PAM type: YTN; PAM sequence: TTT
aaggtaatatccttttactc

SEQ ID NO: 180037 - DNA, 20 bp, Artificial Sequence
  Description of Artificial Sequence: Synthetic oligonucleotide
  Target: ATXN1; (-) strand; PAM type: YTN; PAM sequence: TTG
atttaaggtaatatcctttt

SEQ ID NO: 180038 - DNA, 20 bp, Artificial Sequence
  Description of Artificial Sequence: Synthetic oligonucleotide
  Target: ATXN1; (-) strand; PAM type: YTN; PAM sequence: TTT
gatttaaggtaatatccttt

SEQ ID NO: 180039 - DNA, 20 bp, Artificial Sequence
  Description of Artificial Sequence: Synthetic oligonucleotide
  Target: ATXN1; (-) strand; PAM type: YTN; PAM sequence: CTA
taatttgatttaaggtaata

SEQ ID NO: 180040 - DNA, 20 bp, Artificial Sequence
  Description of Artificial Sequence: Synthetic oligonucleotide
  Target: ATXN1; (-) strand; PAM type: YTN; PAM sequence: CTG
gctataatttgatttaaggt

SEQ ID NO: 180041 - DNA, 20 bp, Artificial Sequence
  Description of Artificial Sequence: Synthetic oligonucleotide
  Target: ATXN1; (-) strand; PAM type: YTN; PAM sequence: CTC
tggctataatttgatttaag

SEQ ID NO: 180042 - DNA, 20 bp, Artificial Sequence
  Description of Artificial Sequence: Synthetic oligonucleotide
  Target: ATXN1; (-) strand; PAM type: YTN; PAM sequence: TTC
tctggctataatttgattta

SEQ ID NO: 180043 - DNA, 20 bp, Artificial Sequence
  Description of Artificial Sequence: Synthetic oligonucleotide
  Target: ATXN1; (-) strand; PAM type: YTN; PAM sequence: CTT
ctctggctataatttgattt

SEQ ID NO: 180044 - DNA, 20 bp, Artificial Sequence
  Description of Artificial Sequence: Synthetic oligonucleotide
  Target: ATXN1; (-) strand; PAM type: YTN; PAM sequence: TTC
ttctctggctataatttgat

SEQ ID NO: 180045 - DNA, 20 bp, Artificial Sequence
  Description of Artificial Sequence: Synthetic oligonucleotide
  Target: ATXN1; (-) strand; PAM type: YTN; PAM sequence: TTT
cttctctggctataatttga

SEQ ID NO: 180046 - DNA, 20 bp, Artificial Sequence
  Description of Artificial Sequence: Synthetic oligonucleotide
  Target: ATXN1; (-) strand; PAM type: YTN; PAM sequence: TTT
tcttctctggctataatttg

SEQ ID NO: 180047 - DNA, 20 bp, Artificial Sequence
  Description of Artificial Sequence: Synthetic oligonucleotide
  Target: ATXN1; (-) strand; PAM type: YTN; PAM sequence: TTA
ttttcttctctggctataat

SEQ ID NO: 180048 - DNA, 20 bp, Artificial Sequence
  Description of Artificial Sequence: Synthetic oligonucleotide
  Target: ATXN1; (-) strand; PAM type: YTN; PAM sequence: CTT
attttcttctctggctataa

SEQ ID NO: 180049 - DNA, 20 bp, Artificial Sequence
  Description of Artificial Sequence: Synthetic oligonucleotide
  Target: ATXN1; (-) strand; PAM type: YTN; PAM sequence: TTC
ttattttcttctctggctat

SEQ ID NO: 180050 - DNA, 20 bp, Artificial Sequence
  Description of Artificial Sequence: Synthetic oligonucleotide
  Target: ATXN1; (-) strand; PAM type: YTN; PAM sequence: TTT
cttattttcttctctggcta

SEQ ID NO: 180051 - DNA, 20 bp, Artificial Sequence
  Description of Artificial Sequence: Synthetic oligonucleotide
  Target: ATXN1; (-) strand; PAM type: YTN; PAM sequence: CTT
tcttattttcttctctggct

SEQ ID NO: 180052 - DNA, 20 bp, Artificial Sequence
  Description of Artificial Sequence: Synthetic oligonucleotide
  Target: ATXN1; (-) strand; PAM type: YTN; PAM sequence: TTC
tttcttattttcttctctgg

SEQ ID NO: 180053 - DNA, 20 bp, Artificial Sequence
  Description of Artificial Sequence: Synthetic oligonucleotide
  Target: ATXN1; (-) strand; PAM type: YTN; PAM sequence: TTT
ctttcttattttcttctctg

SEQ ID NO: 180054 - DNA, 20 bp, Artificial Sequence
  Description of Artificial Sequence: Synthetic oligonucleotide
  Target: ATXN1; (-) strand; PAM type: YTN; PAM sequence: CTT
tctttcttattttcttctct

SEQ ID NO: 180055 - DNA, 20 bp, Artificial Sequence
  Description of Artificial Sequence: Synthetic oligonucleotide
  Target: ATXN1; (-) strand; PAM type: YTN; PAM sequence: TTA
gtaccctttctttcttattt

SEQ ID NO: 180056 - DNA, 20 bp, Artificial Sequence
  Description of Artificial Sequence: Synthetic oligonucleotide
  Target: ATXN1; (-) strand; PAM type: YTN; PAM sequence: CTT
agtaccctttctttcttatt

SEQ ID NO: 180057 - DNA, 20 bp, Artificial Sequence
  Description of Artificial Sequence: Synthetic oligonucleotide
  Target: ATXN1; (-) strand; PAM type: YTN; PAM sequence: TTC
ttagtaccctttctttctta

SEQ ID NO: 180058 - DNA, 20 bp, Artificial Sequence
  Description of Artificial Sequence: Synthetic oligonucleotide
  Target: ATXN1; (-) strand; PAM type: YTN; PAM sequence: TTG
aaattcttagtaccctttct

SEQ ID NO: 180059 - DNA, 20 bp, Artificial Sequence
  Description of Artificial Sequence: Synthetic oligonucleotide
  Target: ATXN1; (-) strand; PAM type: YTN; PAM sequence: TTT
gaaattcttagtaccctttc

SEQ ID NO: 180060 - DNA, 20 bp, Artificial Sequence
  Description of Artificial Sequence: Synthetic oligonucleotide
  Target: ATXN1; (-) strand; PAM type: YTN; PAM sequence: TTT
tgaaattcttagtacccttt

SEQ ID NO: 180061 - DNA, 20 bp, Artificial Sequence
  Description of Artificial Sequence: Synthetic oligonucleotide
  Target: ATXN1; (-) strand; PAM type: YTN; PAM sequence: CTG
agtgattttgaaattcttag

SEQ ID NO: 180062 - DNA, 20 bp, Artificial Sequence
  Description of Artificial Sequence: Synthetic oligonucleotide
  Target: ATXN1; (-) strand; PAM type: YTN; PAM sequence: CTC
tgagtgattttgaaattctt

SEQ ID NO: 180063 - DNA, 20 bp, Artificial Sequence
  Description of Artificial Sequence: Synthetic oligonucleotide
  Target: ATXN1; (-) strand; PAM type: YTN; PAM sequence: TTC
caactctgagtgattttgaa

SEQ ID NO: 180064 - DNA, 20 bp, Artificial Sequence
  Description of Artificial Sequence: Synthetic oligonucleotide
  Target: ATXN1; (-) strand; PAM type: YTN; PAM sequence: TTT
ccaactctgagtgattttga

SEQ ID NO: 180065 - DNA, 20 bp, Artificial Sequence
  Description of Artificial Sequence: Synthetic oligonucleotide
  Target: ATXN1; (-) strand; PAM type: YTN; PAM sequence: TTG
gtttccaactctgagtgatt

SEQ ID NO: 180066 - DNA, 20 bp, Artificial Sequence
  Description of Artificial Sequence: Synthetic oligonucleotide
  Target: ATXN1; (-) strand; PAM type: YTN; PAM sequence: TTA
ttggtttccaactctgagtg

SEQ ID NO: 180067 - DNA, 20 bp, Artificial Sequence
  Description of Artificial Sequence: Synthetic oligonucleotide
  Target: ATXN1; (-) strand; PAM type: YTN; PAM sequence: TTT
attggtttccaactctgagt

SEQ ID NO: 180068 - DNA, 20 bp, Artificial Sequence
  Description of Artificial Sequence: Synthetic oligonucleotide
  Target: ATXN1; (-) strand; PAM type: YTN; PAM sequence: TTG
tttattggtttccaactctg

SEQ ID NO: 180069 - DNA, 20 bp, Artificial Sequence
  Description of Artificial Sequence: Synthetic oligonucleotide
  Target: ATXN1; (-) strand; PAM type: YTN; PAM sequence: CTG
ttgtttattggtttccaact

SEQ ID NO: 180070 - DNA, 20 bp, Artificial Sequence
  Description of Artificial Sequence: Synthetic oligonucleotide
  Target: ATXN1; (-) strand; PAM type: YTN; PAM sequence: TTA
gctgttgtttattggtttcc

SEQ ID NO: 180071 - DNA, 20 bp, Artificial Sequence
  Description of Artificial Sequence: Synthetic oligonucleotide
  Target: ATXN1; (-) strand; PAM type: YTN; PAM sequence: CTT
agctgttgtttattggtttc

SEQ ID NO: 180072 - DNA, 20 bp, Artificial Sequence
  Description of Artificial Sequence: Synthetic oligonucleotide
  Target: ATXN1; (-) strand; PAM type: YTN; PAM sequence: TTC
ttagctgttgtttattggtt

SEQ ID NO: 180073 - DNA, 20 bp, Artificial Sequence
  Description of Artificial Sequence: Synthetic oligonucleotide
  Target: ATXN1; (-) strand; PAM type: YTN; PAM sequence: TTT
cttagctgttgtttattggt

SEQ ID NO: 180074 - DNA, 20 bp, Artificial Sequence
  Description of Artificial Sequence: Synthetic oligonucleotide
  Target: ATXN1; (-) strand; PAM type: YTN; PAM sequence: TTT
tcttagctgttgtttattgg

SEQ ID NO: 180075 - DNA, 20 bp, Artificial Sequence
  Description of Artificial Sequence: Synthetic oligonucleotide
  Target: ATXN1; (-) strand; PAM type: YTN; PAM sequence: CTT
ttcttagctgttgtttattg

SEQ ID NO: 180076 - DNA, 20 bp, Artificial Sequence
  Description of Artificial Sequence: Synthetic oligonucleotide
  Target: ATXN1; (-) strand; PAM type: YTN; PAM sequence: TTA
tcccccaaacttttcttagc

SEQ ID NO: 180077 - DNA, 20 bp, Artificial Sequence
  Description of Artificial Sequence: Synthetic oligonucleotide
  Target: ATXN1; (-) strand; PAM type: YTN; PAM sequence: CTT
atcccccaaacttttcttag

SEQ ID NO: 180078 - DNA, 20 bp, Artificial Sequence
  Description of Artificial Sequence: Synthetic oligonucleotide
  Target: ATXN1; (-) strand; PAM type: YTN; PAM sequence: TTC
ttatcccccaaacttttctt

SEQ ID NO: 180079 - DNA, 20 bp, Artificial Sequence
  Description of Artificial Sequence: Synthetic oligonucleotide
  Target: ATXN1; (-) strand; PAM type: YTN; PAM sequence: CTT
cttatcccccaaacttttct

SEQ ID NO: 180080 - DNA, 20 bp, Artificial Sequence
  Description of Artificial Sequence: Synthetic oligonucleotide
  Target: ATXN1; (-) strand; PAM type: YTN; PAM sequence: TTA
atatggtacccttcttatcc

SEQ ID NO: 180081 - DNA, 20 bp, Artificial Sequence
  Description of Artificial Sequence: Synthetic oligonucleotide
  Target: ATXN1; (-) strand; PAM type: YTN; PAM sequence: CTT
aatatggtacccttcttatc

SEQ ID NO: 180082 - DNA, 20 bp, Artificial Sequence
  Description of Artificial Sequence: Synthetic oligonucleotide
  Target: ATXN1; (-) strand; PAM type: YTN; PAM sequence: TTC
cttaatatggtacccttctt

SEQ ID NO: 180083 - DNA, 20 bp, Artificial Sequence
  Description of Artificial Sequence: Synthetic oligonucleotide
  Target: ATXN1; (-) strand; PAM type: YTN; PAM sequence: TTA
gaataattccttaatatggt

SEQ ID NO: 180084 - DNA, 20 bp, Artificial Sequence
  Description of Artificial Sequence: Synthetic oligonucleotide
  Target: ATXN1; (-) strand; PAM type: YTN; PAM sequence: TTT
agaataattccttaatatgg

SEQ ID NO: 180085 - DNA, 20 bp, Artificial Sequence
  Description of Artificial Sequence: Synthetic oligonucleotide
  Target: ATXN1; (-) strand; PAM type: YTN; PAM sequence: TTC
cagtaaaaatgtttagaata

SEQ ID NO: 180086 - DNA, 20 bp, Artificial Sequence
  Description of Artificial Sequence: Synthetic oligonucleotide
  Target: ATXN1; (-) strand; PAM type: YTN; PAM sequence: CTT
ccagtaaaaatgtttagaat

SEQ ID NO: 180087 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccatgcc

SEQ ID NO: 180088 - DNA, 20 bp, Artificial Sequence
  Description of Artificial Sequence: Synthetic oligonucleotide
  Target: ATXN1; (-) strand; PAM type: YTN; PAM sequence: TTG
ggattacaggtgtgagccac

SEQ ID NO: 180089 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttgggattacag

SEQ ID NO: 180090 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgttgggat

SEQ ID NO: 180091 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgttggga

SEQ ID NO: 180092 - DNA, 20 bp, Artificial Sequence
  Description of Artificial Sequence: Synthetic oligonucleotide
  Target: ATXN1; (-) strand; PAM type: YTN; PAM sequence: CTC
aagtgatccacccgccttgg

SEQ ID NO: 180093 - DNA, 20 bp, Artificial Sequence
  Description of Artificial Sequence: Synthetic oligonucleotide
  Target: ATXN1; (-) strand; PAM type: YTN; PAM sequence: CTG
gcctcaagtgatccacccgc

SEQ ID NO: 180094 - DNA, 20 bp, Artificial Sequence
  Description of Artificial Sequence: Synthetic oligonucleotide
  Target: ATXN1; (-) strand; PAM type: YTN; PAM sequence: TTC
ctggcctcaagtgatccacc

SEQ ID NO: 180095 - DNA, 20 bp, Artificial Sequence
  Description of Artificial Sequence: Synthetic oligonucleotide
  Target: ATXN1; (-) strand; PAM type: YTN; PAM sequence: CTC
aagttcctggcctcaagtga

SEQ ID NO: 180096 - DNA, 20 bp, Artificial Sequence
  Description of Artificial Sequence: Synthetic oligonucleotide
  Target: ATXN1; (-) strand; PAM type: YTN; PAM sequence: CTA
gtctcaagttcctggcctca

SEQ ID NO: 180097 - DNA, 20 bp, Artificial Sequence
  Description of Artificial Sequence: Synthetic oligonucleotide
  Target: ATXN1; (-) strand; PAM type: YTN; PAM sequence: TTG
gccaggctagtctcaagttc

SEQ ID NO: 180098 - DNA, 20 bp, Artificial Sequence
  Description of Artificial Sequence: Synthetic oligonucleotide
  Target: ATXN1; (-) strand; PAM type: YTN; PAM sequence: TTG
ccatgttggccaggctagtc

SEQ ID NO: 180099 - DNA, 20 bp, Artificial Sequence
  Description of Artificial Sequence: Synthetic oligonucleotide
  Target: ATXN1; (-) strand; PAM type: YTN; PAM sequence: TTT
gccatgttggccaggctagt

SEQ ID NO: 180100 - DNA, 20 bp, Artificial Sequence
  Description of Artificial Sequence: Synthetic oligonucleotide
  Target: ATXN1; (-) strand; PAM type: YTN; PAM sequence: TTT
tgccatgttggccaggctag

SEQ ID NO: 180101 - DNA, 20 bp, Artificial Sequence
  Description of Artificial Sequence: Synthetic oligonucleotide
  Target: ATXN1; (-) strand; PAM type: YTN; PAM sequence: TTG
gtagagacggggttttgcca

SEQ ID NO: 180102 - DNA, 20 bp, Artificial Sequence
  Description of Artificial Sequence: Synthetic oligonucleotide
  Target: ATXN1; (-) strand; PAM type: YTN; PAM sequence: TTT
ggtagagacggggttttgcc

SEQ ID NO: 180103 - DNA, 20 bp, Artificial Sequence
  Description of Artificial Sequence: Synthetic oligonucleotide
  Target: ATXN1; (-) strand; PAM type: YTN; PAM sequence: TTT
tggtagagacggggttttgc

SEQ ID NO: 180104 - DNA, 20 bp, Artificial Sequence
  Description of Artificial Sequence: Synthetic oligonucleotide
  Target: ATXN1; (-) strand; PAM type: YTN; PAM sequence: TTT
ttggtagagacggggttttg

SEQ ID NO: 180105 - DNA, 20 bp, Artificial Sequence
  Description of Artificial Sequence: Synthetic oligonucleotide
  Target: ATXN1; (-) strand; PAM type: YTN; PAM sequence: TTG
gatttttggtagagacgggg

SEQ ID NO: 180106 - DNA, 20 bp, Artificial Sequence
  Description of Artificial Sequence: Synthetic oligonucleotide
  Target: ATXN1; (-) strand; PAM type: YTN; PAM sequence: TTT
ggatttttggtagagacggg

SEQ ID NO: 180107 - DNA, 20 bp, Artificial Sequence
  Description of Artificial Sequence: Synthetic oligonucleotide
  Target: ATXN1; (-) strand; PAM type: YTN; PAM sequence: TTT
tggatttttggtagagacgg

SEQ ID NO: 180108 - DNA, 20 bp, Artificial Sequence
  Description of Artificial Sequence: Synthetic oligonucleotide
  Target: ATXN1; (-) strand; PAM type: YTN; PAM sequence: TTT
ttggatttttggtagagacg

SEQ ID NO: 180109 - DNA, 20 bp, Artificial Sequence
  Description of Artificial Sequence: Synthetic oligonucleotide
  Target: ATXN1; (-) strand; PAM type: YTN; PAM sequence: TTA
caggtgtgcgccaccacgac

SEQ ID NO: 180110 - DNA, 20 bp, Artificial Sequence
  Description of Artificial Sequence: Synthetic oligonucleotide
  Target: ATXN1; (-) strand; PAM type: YTN; PAM sequence: CTG
agtagatgggattacaggtg

SEQ ID NO: 180111 - DNA, 20 bp, Artificial Sequence
  Description of Artificial Sequence: Synthetic oligonucleotide
  Target: ATXN1; (-) strand; PAM type: YTN; PAM sequence: CTC
ctgagtagatgggattacag

SEQ ID NO: 180112 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagatggga

SEQ ID NO: 180113 - DNA, 20 bp, Artificial Sequence
  Description of Artificial Sequence: Synthetic oligonucleotide
  Target: ATXN1; (-) strand; PAM type: YTN; PAM sequence: CTC
gtgcctcagcctcctgagta

SEQ ID NO: 180114 - DNA, 20 bp, Artificial Sequence
  Description of Artificial Sequence: Synthetic oligonucleotide
  Target: ATXN1; (-) strand; PAM type: YTN; PAM sequence: TTC
tcgtgcctcagcctcctgag

SEQ ID NO: 180115 - DNA, 20 bp, Artificial Sequence
  Description of Artificial Sequence: Synthetic oligonucleotide
  Target: ATXN1; (-) strand; PAM type: YTN; PAM sequence: TTA
agcaattctcgtgcctcagc

SEQ ID NO: 180116 - DNA, 20 bp, Artificial Sequence
  Description of Artificial Sequence: Synthetic oligonucleotide
  Target: ATXN1; (-) strand; PAM type: YTN; PAM sequence: TTT
aagcaattctcgtgcctcag

SEQ ID NO: 180117 - DNA, 20 bp, Artificial Sequence
  Description of Artificial Sequence: Synthetic oligonucleotide
  Target: ATXN1; (-) strand; PAM type: YTN; PAM sequence: CTG
ggtttaagcaattctcgtgc

SEQ ID NO: 180118 - DNA, 20 bp, Artificial Sequence
  Description of Artificial Sequence: Synthetic oligonucleotide
  Target: ATXN1; (-) strand; PAM type: YTN; PAM sequence: CTC
ctgggtttaagcaattctcg

SEQ ID NO: 180119 - DNA, 20 bp, Artificial Sequence
  Description of Artificial Sequence: Synthetic oligonucleotide
  Target: ATXN1; (-) strand; PAM type: YTN; PAM sequence: CTC
accctcctgggtttaagcaa

SEQ ID NO: 180120 - DNA, 20 bp, Artificial Sequence
  Description of Artificial Sequence: Synthetic oligonucleotide
  Target: ATXN1; (-) strand; PAM type: YTN; PAM sequence: CTG
cagcctcaccctcctgggtt

SEQ ID NO: 180121 - DNA, 20 bp, Artificial Sequence
  Description of Artificial Sequence: Synthetic oligonucleotide
  Target: ATXN1; (-) strand; PAM type: YTN; PAM sequence: CTC
actgcagcctcaccctcctg

SEQ ID NO: 180122 - DNA, 20 bp, Artificial Sequence
  Description of Artificial Sequence: Synthetic oligonucleotide
  Target: ATXN1; (-) strand; PAM type: YTN; PAM sequence: TTG
gctcactgcagcctcaccct

SEQ ID NO: 180123 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcagcctcaccc

SEQ ID NO: 180124 - DNA, 20 bp, Artificial Sequence
  Description of Artificial Sequence: Synthetic oligonucleotide
  Target: ATXN1; (-) strand; PAM type: YTN; PAM sequence: CTG
gagagcagtggcaccatctt

SEQ ID NO: 180125 - DNA, 20 bp, Artificial Sequence
  Description of Artificial Sequence: Synthetic oligonucleotide
  Target: ATXN1; (-) strand; PAM type: YTN; PAM sequence: CTG
tcacccgggctggagagcag

SEQ ID NO: 180126 - DNA, 20 bp, Artificial Sequence
  Description of Artificial Sequence: Synthetic oligonucleotide
  Target: ATXN1; (-) strand; PAM type: YTN; PAM sequence: CTC
tgtcacccgggctggagagc

SEQ ID NO: 180127 - DNA, 20 bp, Artificial Sequence
  Description of Artificial Sequence: Synthetic oligonucleotide
  Target: ATXN1; (-) strand; PAM type: YTN; PAM sequence: TTG
ctctgtcacccgggctggag

SEQ ID NO: 180128 - DNA, 20 bp, Artificial Sequence
  Description of Artificial Sequence: Synthetic oligonucleotide
  Target: ATXN1; (-) strand; PAM type: YTN; PAM sequence: CTT
gctctgtcacccgggctgga

SEQ ID NO: 180129 - DNA, 20 bp, Artificial Sequence
  Description of Artificial Sequence: Synthetic oligonucleotide
  Target: ATXN1; (-) strand; PAM type: YTN; PAM sequence: TTC
cagaccaagccttgctctgt

SEQ ID NO: 180130 - DNA, 20 bp, Artificial Sequence
  Description of Artificial Sequence: Synthetic oligonucleotide
  Target: ATXN1; (-) strand; PAM type: YTN; PAM sequence: TTT
ccagaccaagccttgctctg

SEQ ID NO: 180131 - DNA, 20 bp, Artificial Sequence
  Description of Artificial Sequence: Synthetic oligonucleotide
  Target: ATXN1; (-) strand; PAM type: YTN; PAM sequence: TTT
tccagaccaagccttgctct

SEQ ID NO: 180132 - DNA, 20 bp, Artificial Sequence
  Description of Artificial Sequence: Synthetic oligonucleotide
  Target: ATXN1; (-) strand; PAM type: YTN; PAM sequence: TTT
ttccagaccaagccttgctc

SEQ ID NO: 180133 - DNA, 20 bp, Artificial Sequence
  Description of Artificial Sequence: Synthetic oligonucleotide
  Target: ATXN1; (-) strand; PAM type: YTN; PAM sequence: TTG
tttttccagaccaagccttg

SEQ ID NO: 180134 - DNA, 20 bp, Artificial Sequence
  Description of Artificial Sequence: Synthetic oligonucleotide
  Target: ATXN1; (-) strand; PAM type: YTN; PAM sequence: TTT
gtttttccagaccaagcctt

SEQ ID NO: 180135 - DNA, 20 bp, Artificial Sequence
  Description of Artificial Sequence: Synthetic oligonucleotide
  Target: ATXN1; (-) strand; PAM type: YTN; PAM sequence: TTG
tttgtttttccagaccaagc

SEQ ID NO: 180136 - DNA, 20 bp, Artificial Sequence
  Description of Artificial Sequence: Synthetic oligonucleotide
  Target: ATXN1; (-) strand; PAM type: YTN; PAM sequence: TTT
gtttgtttttccagaccaag

SEQ ID NO: 180137 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttttccagacc

SEQ ID NO: 180138 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttttccagac

SEQ ID NO: 180139 - DNA, 20 bp, Artificial Sequence
  Description of Artificial Sequence: Synthetic oligonucleotide
  Target: ATXN1; (-) strand; PAM type: YTN; PAM sequence: TTT
tgtttgtttgtttttccaga

SEQ ID NO: 180140 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtttgtttttccag

SEQ ID NO: 180141 - DNA, 20 bp, Artificial Sequence
  Description of Artificial Sequence: Synthetic oligonucleotide
  Target: ATXN1; (-) strand; PAM type: YTN; PAM sequence: TTT
tttgtttgtttgtttttcca

SEQ ID NO: 180142 - DNA, 20 bp, Artificial Sequence
  Description of Artificial Sequence: Synthetic oligonucleotide
  Target: ATXN1; (-) strand; PAM type: YTN; PAM sequence: TTT
ttttgtttgtttgtttttcc

SEQ ID NO: 180143 - DNA, 20 bp, Artificial Sequence
  Description of Artificial Sequence: Synthetic oligonucleotide
  Target: ATXN1; (-) strand; PAM type: YTN; PAM sequence: TTT
tttttgtttgtttgtttttc

SEQ ID NO: 180144 - DNA, 20 bp, Artificial Sequence
  Description of Artificial Sequence: Synthetic oligonucleotide
  Target: ATXN1; (-) strand; PAM type: YTN; PAM sequence: CTA
ttttttttgtttgtttgttt

SEQ ID NO: 180145 - DNA, 20 bp, Artificial Sequence
  Description of Artificial Sequence: Synthetic oligonucleotide
  Target: ATXN1; (-) strand; PAM type: YTN; PAM sequence: CTA
caggtgtgccccaccatgcc

SEQ ID NO: 180146 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgtgccccac

SEQ ID NO: 180147 - DNA, 20 bp, Artificial Sequence
  Description of Artificial Sequence: Synthetic oligonucleotide
  Target: ATXN1; (-) strand; PAM type: YTN; PAM sequence: CTC
agccccccaagtagctggga

SEQ ID NO: 180148 - DNA, 20 bp, Artificial Sequence
  Description of Artificial Sequence: Synthetic oligonucleotide
  Target: ATXN1; (-) strand; PAM type: YTN; PAM sequence: CTG
cctcagccccccaagtagct

SEQ ID NO: 180149 - DNA, 20 bp, Artificial Sequence
  Description of Artificial Sequence: Synthetic oligonucleotide
  Target: ATXN1; (-) strand; PAM type: YTN; PAM sequence: TTC
tgcctcagccccccaagtag

SEQ ID NO: 180150 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagccccccaagta

SEQ ID NO: 180151 - DNA, 20 bp, Artificial Sequence
  Description of Artificial Sequence: Synthetic oligonucleotide
  Target: ATXN1; (-) strand; PAM type: YTN; PAM sequence: TTA
agcaatccttctgcctcagc

SEQ ID NO: 180152 - DNA, 20 bp, Artificial Sequence
  Description of Artificial Sequence: Synthetic oligonucleotide
  Target: ATXN1; (-) strand; PAM type: YTN; PAM sequence: CTT
aagcaatccttctgcctcag

SEQ ID NO: 180153 - DNA, 20 bp, Artificial Sequence
  Description of Artificial Sequence: Synthetic oligonucleotide
  Target: ATXN1; (-) strand; PAM type: YTN; PAM sequence: TTA
ggcttaagcaatccttctgc

SEQ ID NO: 180154 - DNA, 20 bp, Artificial Sequence
  Description of Artificial Sequence: Synthetic oligonucleotide
  Target: ATXN1; (-) strand; PAM type: YTN; PAM sequence: CTT
aggcttaagcaatccttctg

SEQ ID NO: 180155 - DNA, 20 bp, Artificial Sequence
  Description of Artificial Sequence: Synthetic oligonucleotide
  Target: ATXN1; (-) strand; PAM type: YTN; PAM sequence: CTC
ttaggcttaagcaatccttc

SEQ ID NO: 180156 - DNA, 20 bp, Artificial Sequence
  Description of Artificial Sequence: Synthetic oligonucleotide
  Target: ATXN1; (-) strand; PAM type: YTN; PAM sequence: TTG
aactcttaggcttaagcaat

SEQ ID NO: 180157 - DNA, 20 bp, Artificial Sequence
  Description of Artificial Sequence: Synthetic oligonucleotide
  Target: ATXN1; (-) strand; PAM type: YTN; PAM sequence: CTT
gaactcttaggcttaagcaa

SEQ ID NO: 180158 - DNA, 20 bp, Artificial Sequence
  Description of Artificial Sequence: Synthetic oligonucleotide
  Target: ATXN1; (-) strand; PAM type: YTN; PAM sequence: CTG
cagccttgaactcttaggct

SEQ ID NO: 180159 - DNA, 20 bp, Artificial Sequence
  Description of Artificial Sequence: Synthetic oligonucleotide
  Target: ATXN1; (-) strand; PAM type: YTN; PAM sequence: CTC
actgcagccttgaactctta

SEQ ID NO: 180160 - DNA, 20 bp, Artificial Sequence
  Description of Artificial Sequence: Synthetic oligonucleotide
  Target: ATXN1; (-) strand; PAM type: YTN; PAM sequence: TTG
gctcactgcagccttgaact

SEQ ID NO: 180161 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcagccttgaac

SEQ ID NO: 180162 - DNA, 20 bp, Artificial Sequence
  Description of Artificial Sequence: Synthetic oligonucleotide
  Target: ATXN1; (-) strand; PAM type: YTN; PAM sequence: CTG
gagtacagtggtacagtctt

SEQ ID NO: 180163 - DNA, 20 bp, Artificial Sequence
  Description of Artificial Sequence: Synthetic oligonucleotide
  Target: ATXN1; (-) strand; PAM type: YTN; PAM sequence: TTG
tcacccaggctggagtacag

SEQ ID NO: 180164 - DNA, 20 bp, Artificial Sequence
  Description of Artificial Sequence: Synthetic oligonucleotide
  Target: ATXN1; (-) strand; PAM type: YTN; PAM sequence: TTT
gtcacccaggctggagtaca

SEQ ID NO: 180165 - DNA, 20 bp, Artificial Sequence
  Description of Artificial Sequence: Synthetic oligonucleotide
  Target: ATXN1; (-) strand; PAM type: YTN; PAM sequence: CTT
tgtcacccaggctggagtac

SEQ ID NO: 180166 - DNA, 20 bp, Artificial Sequence
  Description of Artificial Sequence: Synthetic oligonucleotide
  Target: ATXN1; (-) strand; PAM type: YTN; PAM sequence: CTC
actttgtcacccaggctgga

SEQ ID NO: 180167 - DNA, 20 bp, Artificial Sequence
  Description of Artificial Sequence: Synthetic oligonucleotide
  Target: ATXN1; (-) strand; PAM type: YTN; PAM sequence: TTA
gagacagggtctcactttgt

SEQ ID NO: 180168 - DNA, 20 bp, Artificial Sequence
  Description of Artificial Sequence: Synthetic oligonucleotide
  Target: ATXN1; (-) strand; PAM type: YTN; PAM sequence: TTT
agagacagggtctcactttg

SEQ ID NO: 180169 - DNA, 20 bp, Artificial Sequence
  Description of Artificial Sequence: Synthetic oligonucleotide
  Target: ATXN1; (-) strand; PAM type: YTN; PAM sequence: TTA
tttagagacagggtctcact

SEQ ID NO: 180170 - DNA, 20 bp, Artificial Sequence
  Description of Artificial Sequence: Synthetic oligonucleotide
  Target: ATXN1; (-) strand; PAM type: YTN; PAM sequence: TTT
atttagagacagggtctcac

SEQ ID NO: 180171 - DNA, 20 bp, Artificial Sequence
  Description of Artificial Sequence: Synthetic oligonucleotide
  Target: ATXN1; (-) strand; PAM type: YTN; PAM sequence: TTA
tttatttagagacagggtct

SEQ ID NO: 180172 - DNA, 20 bp, Artificial Sequence
  Description of Artificial Sequence: Synthetic oligonucleotide
  Target: ATXN1; (-) strand; PAM type: YTN; PAM sequence: TTT
atttatttagagacagggtc

SEQ ID NO: 180173 - DNA, 20 bp, Artificial Sequence
  Description of Artificial Sequence: Synthetic oligonucleotide
  Target: ATXN1; (-) strand; PAM type: YTN; PAM sequence: TTA
tttatttatttagagacagg

SEQ ID NO: 180174 - DNA, 20 bp, Artificial Sequence
  Description of Artificial Sequence: Synthetic oligonucleotide
  Target: ATXN1; (-) strand; PAM type: YTN; PAM sequence: TTT
atttatttatttagagacag

SEQ ID NO: 180175 - DNA, 20 bp, Artificial Sequence
  Description of Artificial Sequence: Synthetic oligonucleotide
  Target: ATXN1; (-) strand; PAM type: YTN; PAM sequence: CTC
caatagatttatttatttat

SEQ ID NO: 180176 - DNA, 20 bp, Artificial Sequence
  Description of Artificial Sequence: Synthetic oligonucleotide
  Target: ATXN1; (-) strand; PAM type: YTN; PAM sequence: TTG
ctccaatagatttatttatt

SEQ ID NO: 180177 - DNA, 20 bp, Artificial Sequence
  Description of Artificial Sequence: Synthetic oligonucleotide
  Target: ATXN1; (-) strand; PAM type: YTN; PAM sequence: TTT
gctccaatagatttatttat

SEQ ID NO: 180178 - DNA, 20 bp, Artificial Sequence
  Description of Artificial Sequence: Synthetic oligonucleotide
  Target: ATXN1; (-) strand; PAM type: YTN; PAM sequence: TTT
tgctccaatagatttattta

SEQ ID NO: 180179 - DNA, 20 bp, Artificial Sequence
  Description of Artificial Sequence: Synthetic oligonucleotide
  Target: ATXN1; (-) strand; PAM type: YTN; PAM sequence: TTT
ttgctccaatagatttattt

SEQ ID NO: 180180 - DNA, 20 bp, Artificial Sequence
  Description of Artificial Sequence: Synthetic oligonucleotide
  Target: ATXN1; (-) strand; PAM type: YTN; PAM sequence: TTT
tttgctccaatagatttatt

SEQ ID NO: 180181 - DNA, 20 bp, Artificial Sequence
  Description of Artificial Sequence: Synthetic oligonucleotide
  Target: ATXN1; (-) strand; PAM type: YTN; PAM sequence: TTT
ttttgctccaatagatttat

SEQ ID NO: 180182 - DNA, 20 bp, Artificial Sequence
  Description of Artificial Sequence: Synthetic oligonucleotide
  Target: ATXN1; (-) strand; PAM type: YTN; PAM sequence: TTT
tttttgctccaatagattta

SEQ ID NO: 180183 - DNA, 20 bp, Artificial Sequence
  Description of Artificial Sequence: Synthetic oligonucleotide
  Target: ATXN1; (-) strand; PAM type: YTN; PAM sequence: TTT
ttttttgctccaatagattt

SEQ ID NO: 180184 - DNA, 20 bp, Artificial Sequence
  Description of Artificial Sequence: Synthetic oligonucleotide
  Target: ATXN1; (-) strand; PAM type: YTN; PAM sequence: TTT
tttttttgctccaatagatt

SEQ ID NO: 180185 - DNA, 20 bp, Artificial Sequence
  Description of Artificial Sequence: Synthetic oligonucleotide
  Target: ATXN1; (-) strand; PAM type: YTN; PAM sequence: TTT
ttttttttgctccaatagat

SEQ ID NO: 180186 - DNA, 20 bp, Artificial Sequence
  Description of Artificial Sequence: Synthetic oligonucleotide
  Target: ATXN1; (-) strand; PAM type: YTN; PAM sequence: TTT
tttttttttgctccaataga

SEQ ID NO: 180187 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgctccaatag

SEQ ID NO: 180188 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgctccaata

SEQ ID NO: 180189 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgctccaat

SEQ ID NO: 180190 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgctccaa

SEQ ID NO: 180191 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgctcca

SEQ ID NO: 180192 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgctcc

SEQ ID NO: 180193 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgctc

SEQ ID NO: 180194 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgct

SEQ ID NO: 180195 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttgc

SEQ ID NO: 180196 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 180197 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 180198 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 180199 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 180200 - DNA, 20 bp, Artificial Sequence
  Description of Artificial Sequence: Synthetic oligonucleotide
  Target: ATXN1; (-) strand; PAM type: YTN; PAM sequence: TTA
ggtaggtttttttttttttt

SEQ ID NO: 180201 - DNA, 20 bp, Artificial Sequence
  Description of Artificial Sequence: Synthetic oligonucleotide
  Target: ATXN1; (-) strand; PAM type: YTN; PAM sequence: TTT
aggtaggttttttttttttt

SEQ ID NO: 180202 - DNA, 20 bp, Artificial Sequence
  Description of Artificial Sequence: Synthetic oligonucleotide
  Target: ATXN1; (-) strand; PAM type: YTN; PAM sequence: CTA
tttaggtaggtttttttttt

SEQ ID NO: 180203 - DNA, 20 bp, Artificial Sequence
  Description of Artificial Sequence: Synthetic oligonucleotide
  Target: ATXN1; (-) strand; PAM type: YTN; PAM sequence: TTA
taagcaatcatactatttag

SEQ ID NO: 180204 - DNA, 20 bp, Artificial Sequence
  Description of Artificial Sequence: Synthetic oligonucleotide
  Target: ATXN1; (-) strand; PAM type: YTN; PAM sequence: TTA
ttataagcaatcatactatt

SEQ ID NO: 180205 - DNA, 20 bp, Artificial Sequence
  Description of Artificial Sequence: Synthetic oligonucleotide
  Target: ATXN1; (-) strand; PAM type: YTN; PAM sequence: TTT
attataagcaatcatactat

SEQ ID NO: 180206 - DNA, 20 bp, Artificial Sequence
  Description of Artificial Sequence: Synthetic oligonucleotide
  Target: ATXN1; (-) strand; PAM type: YTN; PAM sequence: TTT
tattataagcaatcatacta

SEQ ID NO: 180207 - DNA, 20 bp, Artificial Sequence
  Description of Artificial Sequence: Synthetic oligonucleotide
  Target: ATXN1; (-) strand; PAM type: YTN; PAM sequence: TTT
ttattataagcaatcatact

SEQ ID NO: 180208 - DNA, 20 bp, Artificial Sequence
  Description of Artificial Sequence: Synthetic oligonucleotide
  Target: ATXN1; (-) strand; PAM type: YTN; PAM sequence: TTC
atttttattataagcaatca

SEQ ID NO: 180209 - DNA, 20 bp, Artificial Sequence
  Description of Artificial Sequence: Synthetic oligonucleotide
  Target: ATXN1; (-) strand; PAM type: YTN; PAM sequence: TTT
catttttattataagcaatc

SEQ ID NO: 180210 - DNA, 20 bp, Artificial Sequence
  Description of Artificial Sequence: Synthetic oligonucleotide
  Target: ATXN1; (-) strand; PAM type: YTN; PAM sequence: CTT
tcatttttattataagcaat

SEQ ID NO: 180211 - DNA, 20 bp, Artificial Sequence
  Description of Artificial Sequence: Synthetic oligonucleotide
  Target: ATXN1; (-) strand; PAM type: YTN; PAM sequence: TTA
ggcatatctttcatttttat

SEQ ID NO: 180212 - DNA, 20 bp, Artificial Sequence
  Description of Artificial Sequence: Synthetic oligonucleotide
  Target: ATXN1; (-) strand; PAM type: YTN; PAM sequence: TTT
aggcatatctttcattttta

SEQ ID NO: 180213 - DNA, 20 bp, Artificial Sequence
  Description of Artificial Sequence: Synthetic oligonucleotide
  Target: ATXN1; (-) strand; PAM type: YTN; PAM sequence: TTT
taggcatatctttcattttt

SEQ ID NO: 180214 - DNA, 20 bp, Artificial Sequence
  Description of Artificial Sequence: Synthetic oligonucleotide
  Target: ATXN1; (-) strand; PAM type: YTN; PAM sequence: TTT
ttaggcatatctttcatttt

SEQ ID NO: 180215 - DNA, 20 bp, Artificial Sequence
  Description of Artificial Sequence: Synthetic oligonucleotide
  Target: ATXN1; (-) strand; PAM type: YTN; PAM sequence: TTA
ccatttttaggcatatcttt

SEQ ID NO: 180216 - DNA, 20 bp, Artificial Sequence
  Description of Artificial Sequence: Synthetic oligonucleotide
  Target: ATXN1; (-) strand; PAM type: YTN; PAM sequence: TTT
accatttttaggcatatctt

SEQ ID NO: 180217 - DNA, 20 bp, Artificial Sequence
  Description of Artificial Sequence: Synthetic oligonucleotide
  Target: ATXN1; (-) strand; PAM type: YTN; PAM sequence: TTT
taccatttttaggcatatct

SEQ ID NO: 180218 - DNA, 20 bp, Artificial Sequence
  Description of Artificial Sequence: Synthetic oligonucleotide
  Target: ATXN1; (-) strand; PAM type: YTN; PAM sequence: TTT
ttaccatttttaggcatatc

SEQ ID NO: 180219 - DNA, 20 bp, Artificial Sequence
  Description of Artificial Sequence: Synthetic oligonucleotide
  Target: ATXN1; (-) strand; PAM type: YTN; PAM sequence: CTT
tttaccatttttaggcatat

SEQ ID NO: 180220 - DNA, 20 bp, Artificial Sequence
  Description of Artificial Sequence: Synthetic oligonucleotide
  Target: ATXN1; (-) strand; PAM type: YTN; PAM sequence: CTC
ctttttaccatttttaggca

SEQ ID NO: 180221 - DNA, 20 bp, Artificial Sequence
  Description of Artificial Sequence: Synthetic oligonucleotide
  Target: ATXN1; (-) strand; PAM type: YTN; PAM sequence: TTC
tcctttttaccatttttagg

SEQ ID NO: 180222 - DNA, 20 bp, Artificial Sequence
  Description of Artificial Sequence: Synthetic oligonucleotide
  Target: ATXN1; (-) strand; PAM type: YTN; PAM sequence: TTT
ctcctttttaccatttttag

SEQ ID NO: 180223 - DNA, 20 bp, Artificial Sequence
  Description of Artificial Sequence: Synthetic oligonucleotide
  Target: ATXN1; (-) strand; PAM type: YTN; PAM sequence: TTT
tctcctttttaccattttta

SEQ ID NO: 180224 - DNA, 20 bp, Artificial Sequence
  Description of Artificial Sequence: Synthetic oligonucleotide
  Target: ATXN1; (-) strand; PAM type: YTN; PAM sequence: TTA
ttttctcctttttaccattt

SEQ ID NO: 180225 - DNA, 20 bp, Artificial Sequence
  Description of Artificial Sequence: Synthetic oligonucleotide
  Target: ATXN1; (-) strand; PAM type: YTN; PAM sequence: TTT
attttctcctttttaccatt

SEQ ID NO: 180226 - DNA, 20 bp, Artificial Sequence
  Description of Artificial Sequence: Synthetic oligonucleotide
  Target: ATXN1; (-) strand; PAM type: YTN; PAM sequence: CTT
tattttctcctttttaccat

SEQ ID NO: 180227 - DNA, 20 bp, Artificial Sequence
  Description of Artificial Sequence: Synthetic oligonucleotide
  Target: ATXN1; (-) strand; PAM type: YTN; PAM sequence: CTG
ctttattttctcctttttac

SEQ ID NO: 180228 - DNA, 20 bp, Artificial Sequence
  Description of Artificial Sequence: Synthetic oligonucleotide
  Target: ATXN1; (-) strand; PAM type: YTN; PAM sequence: CTG
tctgctttattttctccttt

SEQ ID NO: 180229 - DNA, 20 bp, Artificial Sequence
  Description of Artificial Sequence: Synthetic oligonucleotide
  Target: ATXN1; (-) strand; PAM type: YTN; PAM sequence: TTC
atgcctgtctgctttatttt

SEQ ID NO: 180230 - DNA, 20 bp, Artificial Sequence
  Description of Artificial Sequence: Synthetic oligonucleotide
  Target: ATXN1; (-) strand; PAM type: YTN; PAM sequence: TTT
catgcctgtctgctttattt

SEQ ID NO: 180231 - DNA, 20 bp, Artificial Sequence
  Description of Artificial Sequence: Synthetic oligonucleotide
  Target: ATXN1; (-) strand; PAM type: YTN; PAM sequence: CTT
tcatgcctgtctgctttatt

SEQ ID NO: 180232 - DNA, 20 bp, Artificial Sequence
  Description of Artificial Sequence: Synthetic oligonucleotide
  Target: ATXN1; (-) strand; PAM type: YTN; PAM sequence: CTG
tctttcatgcctgtctgctt

SEQ ID NO: 180233 - DNA, 20 bp, Artificial Sequence
  Description of Artificial Sequence: Synthetic oligonucleotide
  Target: ATXN1; (-) strand; PAM type: YTN; PAM sequence: TTG
aagtctgtctttcatgcctg

SEQ ID NO: 180234 - DNA, 20 bp, Artificial Sequence
  Description of Artificial Sequence: Synthetic oligonucleotide
  Target: ATXN1; (-) strand; PAM type: YTN; PAM sequence: CTG
aaacaaaacccacaaaacaa

SEQ ID NO: 180235 - DNA, 20 bp, Artificial Sequence
  Description of Artificial Sequence: Synthetic oligonucleotide
  Target: ATXN1; (-) strand; PAM type: YTN; PAM sequence: TTC
ctgaaacaaaacccacaaaa

SEQ ID NO: 180236 - DNA, 20 bp, Artificial Sequence
  Description of Artificial Sequence: Synthetic oligonucleotide
  Target: ATXN1; (-) strand; PAM type: YTN; PAM sequence: TTT
cctgaaacaaaacccacaaa

SEQ ID NO: 180237 - DNA, 20 bp, Artificial Sequence
  Description of Artificial Sequence: Synthetic oligonucleotide
  Target: ATXN1; (-) strand; PAM type: YTN; PAM sequence: TTT
tcctgaaacaaaacccacaa

SEQ ID NO: 180238 - DNA, 20 bp, Artificial Sequence
  Description of Artificial Sequence: Synthetic oligonucleotide
  Target: ATXN1; (-) strand; PAM type: YTN; PAM sequence: TTA
aattttcctgaaacaaaacc

SEQ ID NO: 180239 - DNA, 20 bp, Artificial Sequence
  Description of Artificial Sequence: Synthetic oligonucleotide
  Target: ATXN1; (-) strand; PAM type: YTN; PAM sequence: TTT
aaattttcctgaaacaaaac

SEQ ID NO: 180240 - DNA, 20 bp, Artificial Sequence
  Description of Artificial Sequence: Synthetic oligonucleotide
  Target: ATXN1; (-) strand; PAM type: YTN; PAM sequence: TTA
tataaaaatatttaaatttt

SEQ ID NO: 180241 - DNA, 20 bp, Artificial Sequence
  Description of Artificial Sequence: Synthetic oligonucleotide
  Target: ATXN1; (-) strand; PAM type: YTN; PAM sequence: TTC
aataattatataaaaatatt

SEQ ID NO: 180242 - DNA, 20 bp, Artificial Sequence
  Description of Artificial Sequence: Synthetic oligonucleotide
  Target: ATXN1; (-) strand; PAM type: YTN; PAM sequence: TTG
ttcaataattatataaaaat

SEQ ID NO: 180243 - DNA, 20 bp, Artificial Sequence
  Description of Artificial Sequence: Synthetic oligonucleotide
  Target: ATXN1; (-) strand; PAM type: YTN; PAM sequence: CTT
gttcaataattatataaaaa

SEQ ID NO: 180244 - DNA, 20 bp, Artificial Sequence
  Description of Artificial Sequence: Synthetic oligonucleotide
  Target: ATXN1; (-) strand; PAM type: YTN; PAM sequence: TTC
ttgttcaataattatataaa

SEQ ID NO: 180245 - DNA, 20 bp, Artificial Sequence
  Description of Artificial Sequence: Synthetic oligonucleotide
  Target: ATXN1; (-) strand; PAM type: YTN; PAM sequence: TTG
aaaagtgattcttgttcaat

SEQ ID NO: 180246 - DNA, 20 bp, Artificial Sequence
  Description of Artificial Sequence: Synthetic oligonucleotide
  Target: ATXN1; (-) strand; PAM type: YTN; PAM sequence: TTT
gaaaagtgattcttgttcaa

SEQ ID NO: 180247 - DNA, 20 bp, Artificial Sequence
  Description of Artificial Sequence: Synthetic oligonucleotide
  Target: ATXN1; (-) strand; PAM type: YTN; PAM sequence: TTT
tgaaaagtgattcttgttca

SEQ ID NO: 180248 - DNA, 20 bp, Artificial Sequence
  Description of Artificial Sequence: Synthetic oligonucleotide
  Target: ATXN1; (-) strand; PAM type: YTN; PAM sequence: CTT
ttgaaaagtgattcttgttc

SEQ ID NO: 180249 - DNA, 20 bp, Artificial Sequence
  Description of Artificial Sequence: Synthetic oligonucleotide
  Target: ATXN1; (-) strand; PAM type: YTN; PAM sequence: CTA
agaggcttttgaaaagtgat

SEQ ID NO: 180250 - DNA, 20 bp, Artificial Sequence
  Description of Artificial Sequence: Synthetic oligonucleotide
  Target: ATXN1; (-) strand; PAM type: YTN; PAM sequence: TTC
ctaagaggcttttgaaaagt

SEQ ID NO: 180251 - DNA, 20 bp, Artificial Sequence
  Description of Artificial Sequence: Synthetic oligonucleotide
  Target: ATXN1; (-) strand; PAM type: YTN; PAM sequence: CTT
cctaagaggcttttgaaaag

SEQ ID NO: 180252 - DNA, 20 bp, Artificial Sequence
  Description of Artificial Sequence: Synthetic oligonucleotide
  Target: ATXN1; (-) strand; PAM type: YTN; PAM sequence: TTG
agacttcctaagaggctttt

SEQ ID NO: 180253 - DNA, 20 bp, Artificial Sequence
  Description of Artificial Sequence: Synthetic oligonucleotide
  Target: ATXN1; (-) strand; PAM type: YTN; PAM sequence: TTT
gagacttcctaagaggcttt

SEQ ID NO: 180254 - DNA, 20 bp, Artificial Sequence
  Description of Artificial Sequence: Synthetic oligonucleotide
  Target: ATXN1; (-) strand; PAM type: YTN; PAM sequence: TTA
atttgagacttcctaagagg

SEQ ID NO: 180255 - DNA, 20 bp, Artificial Sequence
  Description of Artificial Sequence: Synthetic oligonucleotide
  Target: ATXN1; (-) strand; PAM type: YTN; PAM sequence: TTT
aatttgagacttcctaagag

SEQ ID NO: 180256 - DNA, 20 bp, Artificial Sequence
  Description of Artificial Sequence: Synthetic oligonucleotide
  Target: ATXN1; (-) strand; PAM type: YTN; PAM sequence: CTT
taatttgagacttcctaaga

SEQ ID NO: 180257 - DNA, 20 bp, Artificial Sequence
  Description of Artificial Sequence: Synthetic oligonucleotide
  Target: ATXN1; (-) strand; PAM type: YTN; PAM sequence: TTA
ctttaatttgagacttccta

SEQ ID NO: 180258 - DNA, 20 bp, Artificial Sequence
  Description of Artificial Sequence: Synthetic oligonucleotide
  Target: ATXN1; (-) strand; PAM type: YTN; PAM sequence: CTT
actttaatttgagacttcct

SEQ ID NO: 180259 - DNA, 20 bp, Artificial Sequence
  Description of Artificial Sequence: Synthetic oligonucleotide
  Target: ATXN1; (-) strand; PAM type: YTN; PAM sequence: TTC
acttactttaatttgagact

SEQ ID NO: 180260 - DNA, 20 bp, Artificial Sequence
  Description of Artificial Sequence: Synthetic oligonucleotide
  Target: ATXN1; (-) strand; PAM type: YTN; PAM sequence: TTG
agttcacttactttaatttg

SEQ ID NO: 180261 - DNA, 20 bp, Artificial Sequence
  Description of Artificial Sequence: Synthetic oligonucleotide
  Target: ATXN1; (-) strand; PAM type: YTN; PAM sequence: TTT
gagttcacttactttaattt

SEQ ID NO: 180262 - DNA, 20 bp, Artificial Sequence
  Description of Artificial Sequence: Synthetic oligonucleotide
  Target: ATXN1; (-) strand; PAM type: YTN; PAM sequence: CTG
gatatacatttgagttcact

SEQ ID NO: 180263 - DNA, 20 bp, Artificial Sequence
  Description of Artificial Sequence: Synthetic oligonucleotide
  Target: ATXN1; (-) strand; PAM type: YTN; PAM sequence: TTA
tgccaataactggatataca

SEQ ID NO: 180264 - DNA, 20 bp, Artificial Sequence
  Description of Artificial Sequence: Synthetic oligonucleotide
  Target: ATXN1; (-) strand; PAM type: YTN; PAM sequence: TTT
atgccaataactggatatac

SEQ ID NO: 180265 - DNA, 20 bp, Artificial Sequence
  Description of Artificial Sequence: Synthetic oligonucleotide
  Target: ATXN1; (-) strand; PAM type: YTN; PAM sequence: CTG
tgtgtttatgccaataactg

SEQ ID NO: 180266 - DNA, 20 bp, Artificial Sequence
  Description of Artificial Sequence: Synthetic oligonucleotide
  Target: ATXN1; (-) strand; PAM type: YTN; PAM sequence: TTA
cagtctgtgtgtttatgcca

SEQ ID NO: 180267 - DNA, 20 bp, Artificial Sequence
  Description of Artificial Sequence: Synthetic oligonucleotide
  Target: ATXN1; (-) strand; PAM type: YTN; PAM sequence: TTG
gaatagttacagtctgtgtg

SEQ ID NO: 180268 - DNA, 20 bp, Artificial Sequence
  Description of Artificial Sequence: Synthetic oligonucleotide
  Target: ATXN1; (-) strand; PAM type: YTN; PAM sequence: TTT
ggaatagttacagtctgtgt

SEQ ID NO: 180269 - DNA, 20 bp, Artificial Sequence
  Description of Artificial Sequence: Synthetic oligonucleotide
  Target: ATXN1; (-) strand; PAM type: YTN; PAM sequence: TTA
gggtcatttggaatagttac

SEQ ID NO: 180270 - DNA, 20 bp, Artificial Sequence
  Description of Artificial Sequence: Synthetic oligonucleotide
  Target: ATXN1; (-) strand; PAM type: YTN; PAM sequence: TTA
caatatgttagggtcatttg

SEQ ID NO: 180271 - DNA, 20 bp, Artificial Sequence
  Description of Artificial Sequence: Synthetic oligonucleotide
  Target: ATXN1; (-) strand; PAM type: YTN; PAM sequence: TTA
cattacaatatgttagggtc

SEQ ID NO: 180272 - DNA, 20 bp, Artificial Sequence
  Description of Artificial Sequence: Synthetic oligonucleotide
  Target: ATXN1; (-) strand; PAM type: YTN; PAM sequence: CTA
gagatggacaattacattac

SEQ ID NO: 180273 - DNA, 20 bp, Artificial Sequence
  Description of Artificial Sequence: Synthetic oligonucleotide
  Target: ATXN1; (-) strand; PAM type: YTN; PAM sequence: CTG
ggctagagatggacaattac

SEQ ID NO: 180274 - DNA, 20 bp, Artificial Sequence
  Description of Artificial Sequence: Synthetic oligonucleotide
  Target: ATXN1; (-) strand; PAM type: YTN; PAM sequence: TTA
gtccactgggctagagatgg

SEQ ID NO: 180275 - DNA, 20 bp, Artificial Sequence
  Description of Artificial Sequence: Synthetic oligonucleotide
  Target: ATXN1; (-) strand; PAM type: YTN; PAM sequence: TTT
agtccactgggctagagatg

SEQ ID NO: 180276 - DNA, 20 bp, Artificial Sequence
  Description of Artificial Sequence: Synthetic oligonucleotide
  Target: ATXN1; (-) strand; PAM type: YTN; PAM sequence: TTT
tagtccactgggctagagat

SEQ ID NO: 180277 - DNA, 20 bp, Artificial Sequence
  Description of Artificial Sequence: Synthetic oligonucleotide
  Target: ATXN1; (-) strand; PAM type: YTN; PAM sequence: TTT
ttagtccactgggctagaga

SEQ ID NO: 180278 - DNA, 20 bp, Artificial Sequence
  Description of Artificial Sequence: Synthetic oligonucleotide
  Target: ATXN1; (-) strand; PAM type: YTN; PAM sequence: TTG
gtttttagtccactgggcta

SEQ ID NO: 180279 - DNA, 20 bp, Artificial Sequence
  Description of Artificial Sequence: Synthetic oligonucleotide
  Target: ATXN1; (-) strand; PAM type: YTN; PAM sequence: TTG
tattggtttttagtccactg

SEQ ID NO: 180280 - DNA, 20 bp, Artificial Sequence
  Description of Artificial Sequence: Synthetic oligonucleotide
  Target: ATXN1; (-) strand; PAM type: YTN; PAM sequence: TTT
gtattggtttttagtccact

SEQ ID NO: 180281 - DNA, 20 bp, Artificial Sequence
  Description of Artificial Sequence: Synthetic oligonucleotide
  Target: ATXN1; (-) strand; PAM type: YTN; PAM sequence: TTT
tgtattggtttttagtccac

SEQ ID NO: 180282 - DNA, 20 bp, Artificial Sequence
  Description of Artificial Sequence: Synthetic oligonucleotide
  Target: ATXN1; (-) strand; PAM type: YTN; PAM sequence: TTA
gttttgtattggtttttagt

SEQ ID NO: 180283 - DNA, 20 bp, Artificial Sequence
  Description of Artificial Sequence: Synthetic oligonucleotide
  Target: ATXN1; (-) strand; PAM type: YTN; PAM sequence: TTT
agttttgtattggtttttag

SEQ ID NO: 180284 - DNA, 20 bp, Artificial Sequence
  Description of Artificial Sequence: Synthetic oligonucleotide
  Target: ATXN1; (-) strand; PAM type: YTN; PAM sequence: TTG
tttagttttgtattggtttt

SEQ ID NO: 180285 - DNA, 20 bp, Artificial Sequence
  Description of Artificial Sequence: Synthetic oligonucleotide
  Target: ATXN1; (-) strand; PAM type: YTN; PAM sequence: TTG
attgtttagttttgtattgg

SEQ ID NO: 180286 - DNA, 20 bp, Artificial Sequence
  Description of Artificial Sequence: Synthetic oligonucleotide
  Target: ATXN1; (-) strand; PAM type: YTN; PAM sequence: TTT
gattgtttagttttgtattg

SEQ ID NO: 180287 - DNA, 20 bp, Artificial Sequence
  Description of Artificial Sequence: Synthetic oligonucleotide
  Target: ATXN1; (-) strand; PAM type: YTN; PAM sequence: TTT
tgattgtttagttttgtatt

SEQ ID NO: 180288 - DNA, 20 bp, Artificial Sequence
  Description of Artificial Sequence: Synthetic oligonucleotide
  Target: ATXN1; (-) strand; PAM type: YTN; PAM sequence: TTA
ttttgattgtttagttttgt

SEQ ID NO: 180289 - DNA, 20 bp, Artificial Sequence
  Description of Artificial Sequence: Synthetic oligonucleotide
  Target: ATXN1; (-) strand; PAM type: YTN; PAM sequence: TTT
attttgattgtttagttttg

SEQ ID NO: 180290 - DNA, 20 bp, Artificial Sequence
  Description of Artificial Sequence: Synthetic oligonucleotide
  Target: ATXN1; (-) strand; PAM type: YTN; PAM sequence: TTT
tattttgattgtttagtttt

SEQ ID NO: 180291 - DNA, 20 bp, Artificial Sequence
  Description of Artificial Sequence: Synthetic oligonucleotide
  Target: ATXN1; (-) strand; PAM type: YTN; PAM sequence: TTT
ttattttgattgtttagttt

SEQ ID NO: 180292 - DNA, 20 bp, Artificial Sequence
  Description of Artificial Sequence: Synthetic oligonucleotide
  Target: ATXN1; (-) strand; PAM type: YTN; PAM sequence: TTT
tttattttgattgtttagtt

SEQ ID NO: 180293 - DNA, 20 bp, Artificial Sequence
  Description of Artificial Sequence: Synthetic oligonucleotide
  Target: ATXN1; (-) strand; PAM type: YTN; PAM sequence: TTT
ttttattttgattgtttagt

SEQ ID NO: 180294 - DNA, 20 bp, Artificial Sequence
  Description of Artificial Sequence: Synthetic oligonucleotide
  Target: ATXN1; (-) strand; PAM type: YTN; PAM sequence: TTT
tttttattttgattgtttag

SEQ ID NO: 180295 - DNA, 20 bp, Artificial Sequence
  Description of Artificial Sequence: Synthetic oligonucleotide
  Target: ATXN1; (-) strand; PAM type: YTN; PAM sequence: TTA
aggttttttttattttgatt

SEQ ID NO: 180296 - DNA, 20 bp, Artificial Sequence
  Description of Artificial Sequence: Synthetic oligonucleotide
  Target: ATXN1; (-) strand; PAM type: YTN; PAM sequence: TTT
aaggttttttttattttgat

SEQ ID NO: 180297 - DNA, 20 bp, Artificial Sequence
  Description of Artificial Sequence: Synthetic oligonucleotide
  Target: ATXN1; (-) strand; PAM type: YTN; PAM sequence: CTG
aaaatgtttaaggttttttt

SEQ ID NO: 180298 - DNA, 20 bp, Artificial Sequence
  Description of Artificial Sequence: Synthetic oligonucleotide
  Target: ATXN1; (-) strand; PAM type: YTN; PAM sequence: TTA
ctgaaaatgtttaaggtttt

SEQ ID NO: 180299 - DNA, 20 bp, Artificial Sequence
  Description of Artificial Sequence: Synthetic oligonucleotide
  Target: ATXN1; (-) strand; PAM type: YTN; PAM sequence: CTT
actgaaaatgtttaaggttt

SEQ ID NO: 180300 - DNA, 20 bp, Artificial Sequence
  Description of Artificial Sequence: Synthetic oligonucleotide
  Target: ATXN1; (-) strand; PAM type: YTN; PAM sequence: TTG
caacaatatgcttactgaaa

SEQ ID NO: 180301 - DNA, 20 bp, Artificial Sequence
  Description of Artificial Sequence: Synthetic oligonucleotide
  Target: ATXN1; (-) strand; PAM type: YTN; PAM sequence: TTC
cgaacaaaaatgccagtgac

SEQ ID NO: 180302 - DNA, 20 bp, Artificial Sequence
  Description of Artificial Sequence: Synthetic oligonucleotide
  Target: ATXN1; (-) strand; PAM type: YTN; PAM sequence: TTT
ccgaacaaaaatgccagtga

SEQ ID NO: 180303 - DNA, 20 bp, Artificial Sequence
  Description of Artificial Sequence: Synthetic oligonucleotide
  Target: ATXN1; (-) strand; PAM type: YTN; PAM sequence: TTG
caataatttccgaacaaaaa

SEQ ID NO: 180304 - DNA, 20 bp, Artificial Sequence
  Description of Artificial Sequence: Synthetic oligonucleotide
  Target: ATXN1; (-) strand; PAM type: YTN; PAM sequence: CTT
gcaataatttccgaacaaaa

SEQ ID NO: 180305 - DNA, 20 bp, Artificial Sequence
  Description of Artificial Sequence: Synthetic oligonucleotide
  Target: ATXN1; (-) strand; PAM type: YTN; PAM sequence: CTA
cacttgcaataatttccgaa

SEQ ID NO: 180306 - DNA, 20 bp, Artificial Sequence
  Description of Artificial Sequence: Synthetic oligonucleotide
  Target: ATXN1; (-) strand; PAM type: YTN; PAM sequence: CTC
ccacactacacttgcaataa

SEQ ID NO: 180307 - DNA, 20 bp, Artificial Sequence
  Description of Artificial Sequence: Synthetic oligonucleotide
  Target: ATXN1; (-) strand; PAM type: YTN; PAM sequence: TTC
tcccacactacacttgcaat

SEQ ID NO: 180308 - DNA, 20 bp, Artificial Sequence
  Description of Artificial Sequence: Synthetic oligonucleotide
  Target: ATXN1; (-) strand; PAM type: YTN; PAM sequence: TTT
ctcccacactacacttgcaa

SEQ ID NO: 180309 - DNA, 20 bp, Artificial Sequence
  Description of Artificial Sequence: Synthetic oligonucleotide
  Target: ATXN1; (-) strand; PAM type: YTN; PAM sequence: CTT
tctcccacactacacttgca

SEQ ID NO: 180310 - DNA, 20 bp, Artificial Sequence
  Description of Artificial Sequence: Synthetic oligonucleotide
  Target: ATXN1; (-) strand; PAM type: YTN; PAM sequence: TTA
ctttctcccacactacactt

SEQ ID NO: 180311 - DNA, 20 bp, Artificial Sequence
  Description of Artificial Sequence: Synthetic oligonucleotide
  Target: ATXN1; (-) strand; PAM type: YTN; PAM sequence: TTT
actttctcccacactacact

SEQ ID NO: 180312 - DNA, 20 bp, Artificial Sequence
  Description of Artificial Sequence: Synthetic oligonucleotide
  Target: ATXN1; (-) strand; PAM type: YTN; PAM sequence: CTC
atttactttctcccacacta

SEQ ID NO: 180313 - DNA, 20 bp, Artificial Sequence
  Description of Artificial Sequence: Synthetic oligonucleotide
  Target: ATXN1; (-) strand; PAM type: YTN; PAM sequence: TTA
ctcatttactttctcccaca

SEQ ID NO: 180314 - DNA, 20 bp, Artificial Sequence
  Description of Artificial Sequence: Synthetic oligonucleotide
  Target: ATXN1; (-) strand; PAM type: YTN; PAM sequence: TTT
actcatttactttctcccac

SEQ ID NO: 180315 - DNA, 20 bp, Artificial Sequence
  Description of Artificial Sequence: Synthetic oligonucleotide
  Target: ATXN1; (-) strand; PAM type: YTN; PAM sequence: CTC
acaccaacacaatttactca

SEQ ID NO: 180316 - DNA, 20 bp, Artificial Sequence
  Description of Artificial Sequence: Synthetic oligonucleotide
  Target: ATXN1; (-) strand; PAM type: YTN; PAM sequence: CTC
actcacaccaacacaattta

SEQ ID NO: 180317 - DNA, 20 bp, Artificial Sequence
  Description of Artificial Sequence: Synthetic oligonucleotide
  Target: ATXN1; (-) strand; PAM type: YTN; PAM sequence: TTC
tcactcacaccaacacaatt

SEQ ID NO: 180318 - DNA, 20 bp, Artificial Sequence
  Description of Artificial Sequence: Synthetic oligonucleotide
  Target: ATXN1; (-) strand; PAM type: YTN; PAM sequence: CTG
aaaatagcagttctcactca

SEQ ID NO: 180319 - DNA, 20 bp, Artificial Sequence
  Description of Artificial Sequence: Synthetic oligonucleotide
  Target: ATXN1; (-) strand; PAM type: YTN; PAM sequence: CTC
aaactgaaaatagcagttct

SEQ ID NO: 180320 - DNA, 20 bp, Artificial Sequence
  Description of Artificial Sequence: Synthetic oligonucleotide
  Target: ATXN1; (-) strand; PAM type: YTN; PAM sequence: CTC
tcaaactgaaaatagcagtt

SEQ ID NO: 180321 - DNA, 20 bp, Artificial Sequence
  Description of Artificial Sequence: Synthetic oligonucleotide
  Target: ATXN1; (-) strand; PAM type: YTN; PAM sequence: TTC
tctcaaactgaaaatagcag

SEQ ID NO: 180322 - DNA, 20 bp, Artificial Sequence
  Description of Artificial Sequence: Synthetic oligonucleotide
  Target: ATXN1; (-) strand; PAM type: YTN; PAM sequence: TTT
ctctcaaactgaaaatagca

SEQ ID NO: 180323 - DNA, 20 bp, Artificial Sequence
  Description of Artificial Sequence: Synthetic oligonucleotide
  Target: ATXN1; (-) strand; PAM type: YTN; PAM sequence: CTT
tctctcaaactgaaaatagc

SEQ ID NO: 180324 - DNA, 20 bp, Artificial Sequence
  Description of Artificial Sequence: Synthetic oligonucleotide
  Target: ATXN1; (-) strand; PAM type: YTN; PAM sequence: TTC
tttctctcaaactgaaaata

SEQ ID NO: 180325 - DNA, 20 bp, Artificial Sequence
  Description of Artificial Sequence: Synthetic oligonucleotide
  Target: ATXN1; (-) strand; PAM type: YTN; PAM sequence: TTT
ctttctctcaaactgaaaat

SEQ ID NO: 180326 - DNA, 20 bp, Artificial Sequence
  Description of Artificial Sequence: Synthetic oligonucleotide
  Target: ATXN1; (-) strand; PAM type: YTN; PAM sequence: TTT
tctttctctcaaactgaaaa

SEQ ID NO: 180327 - DNA, 20 bp, Artificial Sequence
  Description of Artificial Sequence: Synthetic oligonucleotide
  Target: ATXN1; (-) strand; PAM type: YTN; PAM sequence: TTA
catcagtattttctttctct

SEQ ID NO: 180328 - DNA, 20 bp, Artificial Sequence
  Description of Artificial Sequence: Synthetic oligonucleotide
  Target: ATXN1; (-) strand; PAM type: YTN; PAM sequence: TTT
acatcagtattttctttctc

SEQ ID NO: 180329 - DNA, 20 bp, Artificial Sequence
  Description of Artificial Sequence: Synthetic oligonucleotide
  Target: ATXN1; (-) strand; PAM type: YTN; PAM sequence: TTT
tacatcagtattttctttct

SEQ ID NO: 180330 - DNA, 20 bp, Artificial Sequence
  Description of Artificial Sequence: Synthetic oligonucleotide
  Target: ATXN1; (-) strand; PAM type: YTN; PAM sequence: TTC
attttacatcagtattttct

SEQ ID NO: 180331 - DNA, 20 bp, Artificial Sequence
  Description of Artificial Sequence: Synthetic oligonucleotide
  Target: ATXN1; (-) strand; PAM type: YTN; PAM sequence: TTC
attcattttacatcagtatt

SEQ ID NO: 180332 - DNA, 20 bp, Artificial Sequence
  Description of Artificial Sequence: Synthetic oligonucleotide
  Target: ATXN1; (-) strand; PAM type: YTN; PAM sequence: CTT
cattcattttacatcagtat

SEQ ID NO: 180333 - DNA, 20 bp, Artificial Sequence
  Description of Artificial Sequence: Synthetic oligonucleotide
  Target: ATXN1; (-) strand; PAM type: YTN; PAM sequence: TTA
acttcattcattttacatca

SEQ ID NO: 180334 - DNA, 20 bp, Artificial Sequence
  Description of Artificial Sequence: Synthetic oligonucleotide
  Target: ATXN1; (-) strand; PAM type: YTN; PAM sequence: CTT
aacttcattcattttacatc

SEQ ID NO: 180335 - DNA, 20 bp, Artificial Sequence
  Description of Artificial Sequence: Synthetic oligonucleotide
  Target: ATXN1; (-) strand; PAM type: YTN; PAM sequence: TTA
cttaacttcattcattttac

SEQ ID NO: 180336 - DNA, 20 bp, Artificial Sequence
  Description of Artificial Sequence: Synthetic oligonucleotide
  Target: ATXN1; (-) strand; PAM type: YTN; PAM sequence: TTT
acttaacttcattcatttta

SEQ ID NO: 180337 - DNA, 20 bp, Artificial Sequence
  Description of Artificial Sequence: Synthetic oligonucleotide
  Target: ATXN1; (-) strand; PAM type: YTN; PAM sequence: TTT
tacttaacttcattcatttt

SEQ ID NO: 180338 - DNA, 20 bp, Artificial Sequence
  Description of Artificial Sequence: Synthetic oligonucleotide
  Target: ATXN1; (-) strand; PAM type: YTN; PAM sequence: CTT
ttacttaacttcattcattt

SEQ ID NO: 180339 - DNA, 20 bp, Artificial Sequence
  Description of Artificial Sequence: Synthetic oligonucleotide
  Target: ATXN1; (-) strand; PAM type: YTN; PAM sequence: CTG
atgtgccacaaggcttttac

SEQ ID NO: 180340 - DNA, 20 bp, Artificial Sequence
  Description of Artificial Sequence: Synthetic oligonucleotide
  Target: ATXN1; (-) strand; PAM type: YTN; PAM sequence: TTA
tactgatgtgccacaaggct

SEQ ID NO: 180341 - DNA, 20 bp, Artificial Sequence
  Description of Artificial Sequence: Synthetic oligonucleotide
  Target: ATXN1; (-) strand; PAM type: YTN; PAM sequence: TTT
atactgatgtgccacaaggc

SEQ ID NO: 180342 - DNA, 20 bp, Artificial Sequence
  Description of Artificial Sequence: Synthetic oligonucleotide
  Target: ATXN1; (-) strand; PAM type: YTN; PAM sequence: CTC
atgagtttatactgatgtgc

SEQ ID NO: 180343 - DNA, 20 bp, Artificial Sequence
  Description of Artificial Sequence: Synthetic oligonucleotide
  Target: ATXN1; (-) strand; PAM type: YTN; PAM sequence: TTA
aggtaaaatacctcatgagt

SEQ ID NO: 180344 - DNA, 20 bp, Artificial Sequence
  Description of Artificial Sequence: Synthetic oligonucleotide
  Target: ATXN1; (-) strand; PAM type: YTN; PAM sequence: TTT
aaggtaaaatacctcatgag

SEQ ID NO: 180345 - DNA, 20 bp, Artificial Sequence
  Description of Artificial Sequence: Synthetic oligonucleotide
  Target: ATXN1; (-) strand; PAM type: YTN; PAM sequence: TTT
taaggtaaaatacctcatga

SEQ ID NO: 180346 - DNA, 20 bp, Artificial Sequence
  Description of Artificial Sequence: Synthetic oligonucleotide
  Target: ATXN1; (-) strand; PAM type: YTN; PAM sequence: TTT
ttaaggtaaaatacctcatg

SEQ ID NO: 180347 - DNA, 20 bp, Artificial Sequence
  Description of Artificial Sequence: Synthetic oligonucleotide
  Target: ATXN1; (-) strand; PAM type: YTN; PAM sequence: TTT
tttaaggtaaaatacctcat

SEQ ID NO: 180348 - DNA, 20 bp, Artificial Sequence
  Description of Artificial Sequence: Synthetic oligonucleotide
  Target: ATXN1; (-) strand; PAM type: YTN; PAM sequence: CTG
gccgtgtgtacgtatttttt

SEQ ID NO: 180349 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccatcgtgcc

SEQ ID NO: 180350 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccat

SEQ ID NO: 180351 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 180352 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 180353 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 180354 - DNA, 20 bp, Artificial Sequence
  Description of Artificial Sequence: Synthetic oligonucleotide
  Target: ATXN1; (-) strand; PAM type: YTN; PAM sequence: CTC
cttggcctcccaaagtgctg

SEQ ID NO: 180355 - DNA, 20 bp, Artificial Sequence
  Description of Artificial Sequence: Synthetic oligonucleotide
  Target: ATXN1; (-) strand; PAM type: YTN; PAM sequence: TTG
tgatcggccctccttggcct

SEQ ID NO: 180356 - DNA, 20 bp, Artificial Sequence
  Description of Artificial Sequence: Synthetic oligonucleotide
  Target: ATXN1; (-) strand; PAM type: YTN; PAM sequence: CTT
gtgatcggccctccttggcc

SEQ ID NO: 180357 - DNA, 20 bp, Artificial Sequence
  Description of Artificial Sequence: Synthetic oligonucleotide
  Target: ATXN1; (-) strand; PAM type: YTN; PAM sequence: CTG
accttgtgatcggccctcct

SEQ ID NO: 180358 - DNA, 20 bp, Artificial Sequence
  Description of Artificial Sequence: Synthetic oligonucleotide
  Target: ATXN1; (-) strand; PAM type: YTN; PAM sequence: CTC
ctgaccttgtgatcggccct

SEQ ID NO: 180359 - DNA, 20 bp, Artificial Sequence
  Description of Artificial Sequence: Synthetic oligonucleotide
  Target: ATXN1; (-) strand; PAM type: YTN; PAM sequence: CTC
gatctcctgaccttgtgatc

SEQ ID NO: 180360 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 180361 - DNA, 20 bp, Artificial Sequence
  Description of Artificial Sequence: Synthetic oligonucleotide
  Target: ATXN1; (-) strand; PAM type: YTN; PAM sequence: CTG
tgttagccaggatggtctcg

SEQ ID NO: 180362 - DNA, 20 bp, Artificial Sequence
  Description of Artificial Sequence: Synthetic oligonucleotide
  Target: ATXN1; (-) strand; PAM type: YTN; PAM sequence: TTC
actgtgttagccaggatggt

SEQ ID NO: 180363 - DNA, 20 bp, Artificial Sequence
  Description of Artificial Sequence: Synthetic oligonucleotide
  Target: ATXN1; (-) strand; PAM type: YTN; PAM sequence: TTT
cactgtgttagccaggatgg

SEQ ID NO: 180364 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcactg

SEQ ID NO: 180365 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcact

SEQ ID NO: 180366 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 180367 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 180368 - DNA, 20 bp, Artificial Sequence
  Description of Artificial Sequence: Synthetic oligonucleotide
  Target: ATXN1; (-) strand; PAM type: YTN; PAM sequence: CTG
tttttagtagagacggggtt

SEQ ID NO: 180369 - DNA, 20 bp, Artificial Sequence
  Description of Artificial Sequence: Synthetic oligonucleotide
  Target: ATXN1; (-) strand; PAM type: YTN; PAM sequence: TTC
tgtttttagtagagacgggg

SEQ ID NO: 180370 - DNA, 20 bp, Artificial Sequence
  Description of Artificial Sequence: Synthetic oligonucleotide
  Target: ATXN1; (-) strand; PAM type: YTN; PAM sequence: TTT
ctgtttttagtagagacggg

SEQ ID NO: 180371 - DNA, 20 bp, Artificial Sequence
  Description of Artificial Sequence: Synthetic oligonucleotide
  Target: ATXN1; (-) strand; PAM type: YTN; PAM sequence: TTT
tctgtttttagtagagacgg

SEQ ID NO: 180372 - DNA, 20 bp, Artificial Sequence
  Description of Artificial Sequence: Synthetic oligonucleotide
  Target: ATXN1; (-) strand; PAM type: YTN; PAM sequence: CTT
ttctgtttttagtagagacg

SEQ ID NO: 180373 - DNA, 20 bp, Artificial Sequence
  Description of Artificial Sequence: Synthetic oligonucleotide
  Target: ATXN1; (-) strand; PAM type: YTN; PAM sequence: CTA
atcttttctgtttttagtag

SEQ ID NO: 180374 - DNA, 20 bp, Artificial Sequence
  Description of Artificial Sequence: Synthetic oligonucleotide
  Target: ATXN1; (-) strand; PAM type: YTN; PAM sequence: CTG
gctaatcttttctgttttta

SEQ ID NO: 180375 - DNA, 20 bp, Artificial Sequence
  Description of Artificial Sequence: Synthetic oligonucleotide
  Target: ATXN1; (-) strand; PAM type: YTN; PAM sequence: CTA
caggcgcccgccaccacgcc

SEQ ID NO: 180376 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcgcccgccac

SEQ ID NO: 180377 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggactacag

SEQ ID NO: 180378 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 180379 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 180380 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 180381 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 180382 - DNA, 20 bp, Artificial Sequence
  Description of Artificial Sequence: Synthetic oligonucleotide
  Target: ATXN1; (-) strand; PAM type: YTN; PAM sequence: TTC
acgccattctcctgcctcag

SEQ ID NO: 180383 - DNA, 20 bp, Artificial Sequence
  Description of Artificial Sequence: Synthetic oligonucleotide
  Target: ATXN1; (-) strand; PAM type: YTN; PAM sequence: CTC
ccaggttcacgccattctcc

SEQ ID NO: 180384 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcacgcca

SEQ ID NO: 180385 - DNA, 20 bp, Artificial Sequence
  Description of Artificial Sequence: Synthetic oligonucleotide
  Target: ATXN1; (-) strand; PAM type: YTN; PAM sequence: CTG
caagctccacctcccaggtt

SEQ ID NO: 180386 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccacctccca

SEQ ID NO: 180387 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaagctccacc

SEQ ID NO: 180388 - DNA, 20 bp, Artificial Sequence
  Description of Artificial Sequence: Synthetic oligonucleotide
  Target: ATXN1; (-) strand; PAM type: YTN; PAM sequence: CTG
gaatgcagtggcgcaatctc

SEQ ID NO: 180389 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggaatgcag

SEQ ID NO: 180390 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggaatgc

SEQ ID NO: 180391 - DNA, 20 bp, Artificial Sequence
  Description of Artificial Sequence: Synthetic oligonucleotide
  Target: ATXN1; (-) strand; PAM type: YTN; PAM sequence: CTC
gctctgtcgcccaggctgga

SEQ ID NO: 180392 - DNA, 20 bp, Artificial Sequence
  Description of Artificial Sequence: Synthetic oligonucleotide
  Target: ATXN1; (-) strand; PAM type: YTN; PAM sequence: TTG
agacggagcctcgctctgtc

SEQ ID NO: 180393 - DNA, 20 bp, Artificial Sequence
  Description of Artificial Sequence: Synthetic oligonucleotide
  Target: ATXN1; (-) strand; PAM type: YTN; PAM sequence: TTT
gagacggagcctcgctctgt

SEQ ID NO: 180394 - DNA, 20 bp, Artificial Sequence
  Description of Artificial Sequence: Synthetic oligonucleotide
  Target: ATXN1; (-) strand; PAM type: YTN; PAM sequence: TTT
tgagacggagcctcgctctg

SEQ ID NO: 180395 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagcctcgctct

SEQ ID NO: 180396 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagcctcgctc

SEQ ID NO: 180397 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagcctcgct

SEQ ID NO: 180398 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagcctcgc

SEQ ID NO: 180399 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagcctcg

SEQ ID NO: 180400 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagcctc

SEQ ID NO: 180401 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagcct

SEQ ID NO: 180402 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagcc

SEQ ID NO: 180403 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagc

SEQ ID NO: 180404 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 180405 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 180406 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 180407 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 180408 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgagac

SEQ ID NO: 180409 - DNA, 20 bp, Artificial Sequence
  Description of Artificial Sequence: Synthetic oligonucleotide
  Target: ATXN1; (-) strand; PAM type: YTN; PAM sequence: TTG
tgtgtacttttttttttttt

SEQ ID NO: 180410 - DNA, 20 bp, Artificial Sequence
  Description of Artificial Sequence: Synthetic oligonucleotide
  Target: ATXN1; (-) strand; PAM type: YTN; PAM sequence: CTA
gatatagatatagatcgatt

SEQ ID NO: 180411 - DNA, 20 bp, Artificial Sequence
  Description of Artificial Sequence: Synthetic oligonucleotide
  Target: ATXN1; (-) strand; PAM type: YTN; PAM sequence: CTC
tagatatagatatagatcga

SEQ ID NO: 180412 - DNA, 20 bp, Artificial Sequence
  Description of Artificial Sequence: Synthetic oligonucleotide
  Target: ATXN1; (-) strand; PAM type: YTN; PAM sequence: CTC
tctagatatagatatagatc

SEQ ID NO: 180413 - DNA, 20 bp, Artificial Sequence
  Description of Artificial Sequence: Synthetic oligonucleotide
  Target: ATXN1; (-) strand; PAM type: YTN; PAM sequence: CTG
tgtctctctagatatagata

SEQ ID NO: 180414 - DNA, 20 bp, Artificial Sequence
  Description of Artificial Sequence: Synthetic oligonucleotide
  Target: ATXN1; (-) strand; PAM type: YTN; PAM sequence: TTC
cagtggacacagccagtgat

SEQ ID NO: 180415 - DNA, 20 bp, Artificial Sequence
  Description of Artificial Sequence: Synthetic oligonucleotide
  Target: ATXN1; (-) strand; PAM type: YTN; PAM sequence: TTT
ccagtggacacagccagtga

SEQ ID NO: 180416 - DNA, 20 bp, Artificial Sequence
  Description of Artificial Sequence: Synthetic oligonucleotide
  Target: ATXN1; (-) strand; PAM type: YTN; PAM sequence: CTT
tccagtggacacagccagtg

SEQ ID NO: 180417 - DNA, 20 bp, Artificial Sequence
  Description of Artificial Sequence: Synthetic oligonucleotide
  Target: ATXN1; (-) strand; PAM type: YTN; PAM sequence: TTC
ctttccagtggacacagcca

SEQ ID NO: 180418 - DNA, 20 bp, Artificial Sequence
  Description of Artificial Sequence: Synthetic oligonucleotide
  Target: ATXN1; (-) strand; PAM type: YTN; PAM sequence: TTT
cctttccagtggacacagcc

SEQ ID NO: 180419 - DNA, 20 bp, Artificial Sequence
  Description of Artificial Sequence: Synthetic oligonucleotide
  Target: ATXN1; (-) strand; PAM type: YTN; PAM sequence: TTT
tcctttccagtggacacagc

SEQ ID NO: 180420 - DNA, 20 bp, Artificial Sequence
  Description of Artificial Sequence: Synthetic oligonucleotide
  Target: ATXN1; (-) strand; PAM type: YTN; PAM sequence: TTT
ttcctttccagtggacacag

SEQ ID NO: 180421 - DNA, 20 bp, Artificial Sequence
  Description of Artificial Sequence: Synthetic oligonucleotide
  Target: ATXN1; (-) strand; PAM type: YTN; PAM sequence: TTG
tttttcctttccagtggaca

SEQ ID NO: 180422 - DNA, 20 bp, Artificial Sequence
  Description of Artificial Sequence: Synthetic oligonucleotide
  Target: ATXN1; (-) strand; PAM type: YTN; PAM sequence: TTG
aatattgtttttcctttcca

SEQ ID NO: 180423 - DNA, 20 bp, Artificial Sequence
  Description of Artificial Sequence: Synthetic oligonucleotide
  Target: ATXN1; (-) strand; PAM type: YTN; PAM sequence: CTG
ggttgaatattgtttttcct

SEQ ID NO: 180424 - DNA, 20 bp, Artificial Sequence
  Description of Artificial Sequence: Synthetic oligonucleotide
  Target: ATXN1; (-) strand; PAM type: YTN; PAM sequence: CTC
actgggttgaatattgtttt

SEQ ID NO: 180425 - DNA, 20 bp, Artificial Sequence
  Description of Artificial Sequence: Synthetic oligonucleotide
  Target: ATXN1; (-) strand; PAM type: YTN; PAM sequence: TTC
tcactgggttgaatattgtt

SEQ ID NO: 180426 - DNA, 20 bp, Artificial Sequence
  Description of Artificial Sequence: Synthetic oligonucleotide
  Target: ATXN1; (-) strand; PAM type: YTN; PAM sequence: CTG
ttctcactgggttgaatatt

SEQ ID NO: 180427 - DNA, 20 bp, Artificial Sequence
  Description of Artificial Sequence: Synthetic oligonucleotide
  Target: ATXN1; (-) strand; PAM type: YTN; PAM sequence: CTG
ggccccaggggaactgttct

SEQ ID NO: 180428 - DNA, 20 bp, Artificial Sequence
  Description of Artificial Sequence: Synthetic oligonucleotide
  Target: ATXN1; (-) strand; PAM type: YTN; PAM sequence: TTG
gagaccaaagactgggcccc

SEQ ID NO: 180429 - DNA, 20 bp, Artificial Sequence
  Description of Artificial Sequence: Synthetic oligonucleotide
  Target: ATXN1; (-) strand; PAM type: YTN; PAM sequence: TTT
ggagaccaaagactgggccc

SEQ ID NO: 180430 - DNA, 20 bp, Artificial Sequence
  Description of Artificial Sequence: Synthetic oligonucleotide
  Target: ATXN1; (-) strand; PAM type: YTN; PAM sequence: TTC
agtgagaaatgatatttgga

SEQ ID NO: 180431 - DNA, 20 bp, Artificial Sequence
  Description of Artificial Sequence: Synthetic oligonucleotide
  Target: ATXN1; (-) strand; PAM type: YTN; PAM sequence: TTT
cagtgagaaatgatatttgg

SEQ ID NO: 180432 - DNA, 20 bp, Artificial Sequence
  Description of Artificial Sequence: Synthetic oligonucleotide
  Target: ATXN1; (-) strand; PAM type: YTN; PAM sequence: CTT
tcagtgagaaatgatatttg

SEQ ID NO: 180433 - DNA, 20 bp, Artificial Sequence
  Description of Artificial Sequence: Synthetic oligonucleotide
  Target: ATXN1; (-) strand; PAM type: YTN; PAM sequence: TTC
tttcagtgagaaatgatatt

SEQ ID NO: 180434 - DNA, 20 bp, Artificial Sequence
  Description of Artificial Sequence: Synthetic oligonucleotide
  Target: ATXN1; (-) strand; PAM type: YTN; PAM sequence: TTT
ctttcagtgagaaatgatat

SEQ ID NO: 180435 - DNA, 20 bp, Artificial Sequence
  Description of Artificial Sequence: Synthetic oligonucleotide
  Target: ATXN1; (-) strand; PAM type: YTN; PAM sequence: CTG
gtttctttcagtgagaaatg

SEQ ID NO: 180436 - DNA, 20 bp, Artificial Sequence
  Description of Artificial Sequence: Synthetic oligonucleotide
  Target: ATXN1; (-) strand; PAM type: YTN; PAM sequence: TTC
caaggagacctggtttcttt

SEQ ID NO: 180437 - DNA, 20 bp, Artificial Sequence
  Description of Artificial Sequence: Synthetic oligonucleotide
  Target: ATXN1; (-) strand; PAM type: YTN; PAM sequence: TTT
ccaaggagacctggtttctt

SEQ ID NO: 180438 - DNA, 20 bp, Artificial Sequence
  Description of Artificial Sequence: Synthetic oligonucleotide
  Target: ATXN1; (-) strand; PAM type: YTN; PAM sequence: TTT
tccaaggagacctggtttct

SEQ ID NO: 180439 - DNA, 20 bp, Artificial Sequence
  Description of Artificial Sequence: Synthetic oligonucleotide
  Target: ATXN1; (-) strand; PAM type: YTN; PAM sequence: TTT
ttccaaggagacctggtttc

SEQ ID NO: 180440 - DNA, 20 bp, Artificial Sequence
  Description of Artificial Sequence: Synthetic oligonucleotide
  Target: ATXN1; (-) strand; PAM type: YTN; PAM sequence: TTT
tttccaaggagacctggttt

SEQ ID NO: 180441 - DNA, 20 bp, Artificial Sequence
  Description of Artificial Sequence: Synthetic oligonucleotide
  Target: ATXN1; (-) strand; PAM type: YTN; PAM sequence: CTT
ttttccaaggagacctggtt

SEQ ID NO: 180442 - DNA, 20 bp, Artificial Sequence
  Description of Artificial Sequence: Synthetic oligonucleotide
  Target: ATXN1; (-) strand; PAM type: YTN; PAM sequence: CTG
ggatcagcttttttccaagg

SEQ ID NO: 180443 - DNA, 20 bp, Artificial Sequence
  Description of Artificial Sequence: Synthetic oligonucleotide
  Target: ATXN1; (-) strand; PAM type: YTN; PAM sequence: CTC
tgggatcagcttttttccaa

SEQ ID NO: 180444 - DNA, 20 bp, Artificial Sequence
  Description of Artificial Sequence: Synthetic oligonucleotide
  Target: ATXN1; (-) strand; PAM type: YTN; PAM sequence: TTA
gctctgggatcagctttttt

SEQ ID NO: 180445 - DNA, 20 bp, Artificial Sequence
  Description of Artificial Sequence: Synthetic oligonucleotide
  Target: ATXN1; (-) strand; PAM type: YTN; PAM sequence: CTT
agctctgggatcagcttttt

SEQ ID NO: 180446 - DNA, 20 bp, Artificial Sequence
  Description of Artificial Sequence: Synthetic oligonucleotide
  Target: ATXN1; (-) strand; PAM type: YTN; PAM sequence: TTG
ccttagctctgggatcagct

SEQ ID NO: 180447 - DNA, 20 bp, Artificial Sequence
  Description of Artificial Sequence: Synthetic oligonucleotide
  Target: ATXN1; (-) strand; PAM type: YTN; PAM sequence: CTT
gccttagctctgggatcagc

SEQ ID NO: 180448 - DNA, 20 bp, Artificial Sequence
  Description of Artificial Sequence: Synthetic oligonucleotide
  Target: ATXN1; (-) strand; PAM type: YTN; PAM sequence: TTC
ttgccttagctctgggatca

SEQ ID NO: 180449 - DNA, 20 bp, Artificial Sequence
  Description of Artificial Sequence: Synthetic oligonucleotide
  Target: ATXN1; (-) strand; PAM type: YTN; PAM sequence: TTT
cttgccttagctctgggatc

SEQ ID NO: 180450 - DNA, 20 bp, Artificial Sequence
  Description of Artificial Sequence: Synthetic oligonucleotide
  Target: ATXN1; (-) strand; PAM type: YTN; PAM sequence: TTG
tacatttcttgccttagctc

SEQ ID NO: 180451 - DNA, 20 bp, Artificial Sequence
  Description of Artificial Sequence: Synthetic oligonucleotide
  Target: ATXN1; (-) strand; PAM type: YTN; PAM sequence: CTT
gtacatttcttgccttagct

SEQ ID NO: 180452 - DNA, 20 bp, Artificial Sequence
  Description of Artificial Sequence: Synthetic oligonucleotide
  Target: ATXN1; (-) strand; PAM type: YTN; PAM sequence: CTC
atcttgtacatttcttgcct

SEQ ID NO: 180453 - DNA, 20 bp, Artificial Sequence
  Description of Artificial Sequence: Synthetic oligonucleotide
  Target: ATXN1; (-) strand; PAM type: YTN; PAM sequence: TTC
caggctcatcttgtacattt

SEQ ID NO: 180454 - DNA, 20 bp, Artificial Sequence
  Description of Artificial Sequence: Synthetic oligonucleotide
  Target: ATXN1; (-) strand; PAM type: YTN; PAM sequence: CTA
tgttccaggctcatcttgta

SEQ ID NO: 180455 - DNA, 20 bp, Artificial Sequence
  Description of Artificial Sequence: Synthetic oligonucleotide
  Target: ATXN1; (-) strand; PAM type: YTN; PAM sequence: CTA
gtataacactatgttccagg

SEQ ID NO: 180456 - DNA, 20 bp, Artificial Sequence
  Description of Artificial Sequence: Synthetic oligonucleotide
  Target: ATXN1; (-) strand; PAM type: YTN; PAM sequence: TTC
tagtataacactatgttcca

SEQ ID NO: 180457 - DNA, 20 bp, Artificial Sequence
  Description of Artificial Sequence: Synthetic oligonucleotide
  Target: ATXN1; (-) strand; PAM type: YTN; PAM sequence: TTT
ctagtataacactatgttcc

SEQ ID NO: 180458 - DNA, 20 bp, Artificial Sequence
  Description of Artificial Sequence: Synthetic oligonucleotide
  Target: ATXN1; (-) strand; PAM type: YTN; PAM sequence: CTT
tctagtataacactatgttc

SEQ ID NO: 180459 - DNA, 20 bp, Artificial Sequence
  Description of Artificial Sequence: Synthetic oligonucleotide
  Target: ATXN1; (-) strand; PAM type: YTN; PAM sequence: TTG
ctttctagtataacactatg

SEQ ID NO: 180460 - DNA, 20 bp, Artificial Sequence
  Description of Artificial Sequence: Synthetic oligonucleotide
  Target: ATXN1; (-) strand; PAM type: YTN; PAM sequence: CTT
gctttctagtataacactat

SEQ ID NO: 180461 - DNA, 20 bp, Artificial Sequence
  Description of Artificial Sequence: Synthetic oligonucleotide
  Target: ATXN1; (-) strand; PAM type: YTN; PAM sequence: TTC
ttgctttctagtataacact

SEQ ID NO: 180462 - DNA, 20 bp, Artificial Sequence
  Description of Artificial Sequence: Synthetic oligonucleotide
  Target: ATXN1; (-) strand; PAM type: YTN; PAM sequence: TTT
cttgctttctagtataacac

SEQ ID NO: 180463 - DNA, 20 bp, Artificial Sequence
  Description of Artificial Sequence: Synthetic oligonucleotide
  Target: ATXN1; (-) strand; PAM type: YTN; PAM sequence: TTT
tcttgctttctagtataaca

SEQ ID NO: 180464 - DNA, 20 bp, Artificial Sequence
  Description of Artificial Sequence: Synthetic oligonucleotide
  Target: ATXN1; (-) strand; PAM type: YTN; PAM sequence: TTG
atagttttcttgctttctag

SEQ ID NO: 180465 - DNA, 20 bp, Artificial Sequence
  Description of Artificial Sequence: Synthetic oligonucleotide
  Target: ATXN1; (-) strand; PAM type: YTN; PAM sequence: TTT
gatagttttcttgctttcta

SEQ ID NO: 180466 - DNA, 20 bp, Artificial Sequence
  Description of Artificial Sequence: Synthetic oligonucleotide
  Target: ATXN1; (-) strand; PAM type: YTN; PAM sequence: CTT
tgatagttttcttgctttct

SEQ ID NO: 180467 - DNA, 20 bp, Artificial Sequence
  Description of Artificial Sequence: Synthetic oligonucleotide
  Target: ATXN1; (-) strand; PAM type: YTN; PAM sequence: CTG
tctttgatagttttcttgct

SEQ ID NO: 180468 - DNA, 20 bp, Artificial Sequence
  Description of Artificial Sequence: Synthetic oligonucleotide
  Target: ATXN1; (-) strand; PAM type: YTN; PAM sequence: CTG
gctgtctttgatagttttct

SEQ ID NO: 180469 - DNA, 20 bp, Artificial Sequence
  Description of Artificial Sequence: Synthetic oligonucleotide
  Target: ATXN1; (-) strand; PAM type: YTN; PAM sequence: TTA
atccaatactggctgtcttt

SEQ ID NO: 180470 - DNA, 20 bp, Artificial Sequence
  Description of Artificial Sequence: Synthetic oligonucleotide
  Target: ATXN1; (-) strand; PAM type: YTN; PAM sequence: TTT
aatccaatactggctgtctt

SEQ ID NO: 180471 - DNA, 20 bp, Artificial Sequence
  Description of Artificial Sequence: Synthetic oligonucleotide
  Target: ATXN1; (-) strand; PAM type: YTN; PAM sequence: TTT
taatccaatactggctgtct

SEQ ID NO: 180472 - DNA, 20 bp, Artificial Sequence
  Description of Artificial Sequence: Synthetic oligonucleotide
  Target: ATXN1; (-) strand; PAM type: YTN; PAM sequence: CTT
ttaatccaatactggctgtc

SEQ ID NO: 180473 - DNA, 20 bp, Artificial Sequence
  Description of Artificial Sequence: Synthetic oligonucleotide
  Target: ATXN1; (-) strand; PAM type: YTN; PAM sequence: CTG
agtccttttaatccaatact

SEQ ID NO: 180474 - DNA, 20 bp, Artificial Sequence
  Description of Artificial Sequence: Synthetic oligonucleotide
  Target: ATXN1; (-) strand; PAM type: YTN; PAM sequence: CTA
ctgagtccttttaatccaat

SEQ ID NO: 180475 - DNA, 20 bp, Artificial Sequence
  Description of Artificial Sequence: Synthetic oligonucleotide
  Target: ATXN1; (-) strand; PAM type: YTN; PAM sequence: TTG
gctactgagtccttttaatc

SEQ ID NO: 180476 - DNA, 20 bp, Artificial Sequence
  Description of Artificial Sequence: Synthetic oligonucleotide
  Target: ATXN1; (-) strand; PAM type: YTN; PAM sequence: TTT
ggctactgagtccttttaat

SEQ ID NO: 180477 - DNA, 20 bp, Artificial Sequence
  Description of Artificial Sequence: Synthetic oligonucleotide
  Target: ATXN1; (-) strand; PAM type: YTN; PAM sequence: TTC
agtttggctactgagtcctt

SEQ ID NO: 180478 - DNA, 20 bp, Artificial Sequence
  Description of Artificial Sequence: Synthetic oligonucleotide
  Target: ATXN1; (-) strand; PAM type: YTN; PAM sequence: CTA
ttcagtttggctactgagtc

SEQ ID NO: 180479 - DNA, 20 bp, Artificial Sequence
  Description of Artificial Sequence: Synthetic oligonucleotide
  Target: ATXN1; (-) strand; PAM type: YTN; PAM sequence: TTG
ggatcctattcagtttggct

SEQ ID NO: 180480 - DNA, 20 bp, Artificial Sequence
  Description of Artificial Sequence: Synthetic oligonucleotide
  Target: ATXN1; (-) strand; PAM type: YTN; PAM sequence: CTG
agcattgggatcctattcag

SEQ ID NO: 180481 - DNA, 20 bp, Artificial Sequence
  Description of Artificial Sequence: Synthetic oligonucleotide
  Target: ATXN1; (-) strand; PAM type: YTN; PAM sequence: CTG
tctgagcattgggatcctat

SEQ ID NO: 180482 - DNA, 20 bp, Artificial Sequence
  Description of Artificial Sequence: Synthetic oligonucleotide
  Target: ATXN1; (-) strand; PAM type: YTN; PAM sequence: TTC
agatggtcccctgtctgagc

SEQ ID NO: 180483 - DNA, 20 bp, Artificial Sequence
  Description of Artificial Sequence: Synthetic oligonucleotide
  Target: ATXN1; (-) strand; PAM type: YTN; PAM sequence: TTC
atgttcagatggtcccctgt

SEQ ID NO: 180484 - DNA, 20 bp, Artificial Sequence
  Description of Artificial Sequence: Synthetic oligonucleotide
  Target: ATXN1; (-) strand; PAM type: YTN; PAM sequence: TTT
catgttcagatggtcccctg

SEQ ID NO: 180485 - DNA, 20 bp, Artificial Sequence
  Description of Artificial Sequence: Synthetic oligonucleotide
  Target: ATXN1; (-) strand; PAM type: YTN; PAM sequence: TTT
tcatgttcagatggtcccct

SEQ ID NO: 180486 - DNA, 20 bp, Artificial Sequence
  Description of Artificial Sequence: Synthetic oligonucleotide
  Target: ATXN1; (-) strand; PAM type: YTN; PAM sequence: TTT
ttcatgttcagatggtcccc

SEQ ID NO: 180487 - DNA, 20 bp, Artificial Sequence
  Description of Artificial Sequence: Synthetic oligonucleotide
  Target: ATXN1; (-) strand; PAM type: YTN; PAM sequence: CTT
tttcatgttcagatggtccc

SEQ ID NO: 180488 - DNA, 20 bp, Artificial Sequence
  Description of Artificial Sequence: Synthetic oligonucleotide
  Target: ATXN1; (-) strand; PAM type: YTN; PAM sequence: TTA
ccctttttcatgttcagatg

SEQ ID NO: 180489 - DNA, 20 bp, Artificial Sequence
  Description of Artificial Sequence: Synthetic oligonucleotide
  Target: ATXN1; (-) strand; PAM type: YTN; PAM sequence: TTC
agtccatgacagtgattacc

SEQ ID NO: 180490 - DNA, 20 bp, Artificial Sequence
  Description of Artificial Sequence: Synthetic oligonucleotide
  Target: ATXN1; (-) strand; PAM type: YTN; PAM sequence: TTT
cagtccatgacagtgattac

SEQ ID NO: 180491 - DNA, 20 bp, Artificial Sequence
  Description of Artificial Sequence: Synthetic oligonucleotide
  Target: ATXN1; (-) strand; PAM type: YTN; PAM sequence: TTG
tgtttcagtccatgacagtg

SEQ ID NO: 180492 - DNA, 20 bp, Artificial Sequence
  Description of Artificial Sequence: Synthetic oligonucleotide
  Target: ATXN1; (-) strand; PAM type: YTN; PAM sequence: CTG
ttgtgtttcagtccatgaca

SEQ ID NO: 180493 - DNA, 20 bp, Artificial Sequence
  Description of Artificial Sequence: Synthetic oligonucleotide
  Target: ATXN1; (-) strand; PAM type: YTN; PAM sequence: TTG
cagcatatctgttgtgtttc

SEQ ID NO: 180494 - DNA, 20 bp, Artificial Sequence
  Description of Artificial Sequence: Synthetic oligonucleotide
  Target: ATXN1; (-) strand; PAM type: YTN; PAM sequence: TTC
atagattgcagcatatctgt

SEQ ID NO: 180495 - DNA, 20 bp, Artificial Sequence
  Description of Artificial Sequence: Synthetic oligonucleotide
  Target: ATXN1; (-) strand; PAM type: YTN; PAM sequence: CTG
taaattcatagattgcagca

SEQ ID NO: 180496 - DNA, 20 bp, Artificial Sequence
  Description of Artificial Sequence: Synthetic oligonucleotide
  Target: ATXN1; (-) strand; PAM type: YTN; PAM sequence: TTG
aaagcatgactgtaaattca

SEQ ID NO: 180497 - DNA, 20 bp, Artificial Sequence
  Description of Artificial Sequence: Synthetic oligonucleotide
  Target: ATXN1; (-) strand; PAM type: YTN; PAM sequence: TTT
gaaagcatgactgtaaattc

SEQ ID NO: 180498 - DNA, 20 bp, Artificial Sequence
  Description of Artificial Sequence: Synthetic oligonucleotide
  Target: ATXN1; (-) strand; PAM type: YTN; PAM sequence: TTT
tgaaagcatgactgtaaatt

SEQ ID NO: 180499 - DNA, 20 bp, Artificial Sequence
  Description of Artificial Sequence: Synthetic oligonucleotide
  Target: ATXN1; (-) strand; PAM type: YTN; PAM sequence: CTG
tgttttgaaagcatgactgt

SEQ ID NO: 180500 - DNA, 20 bp, Artificial Sequence
  Description of Artificial Sequence: Synthetic oligonucleotide
  Target: ATXN1; (-) strand; PAM type: YTN; PAM sequence: TTC
acagtgtcaaaccaagtcac

SEQ ID NO: 180501 - DNA, 20 bp, Artificial Sequence
  Description of Artificial Sequence: Synthetic oligonucleotide
  Target: ATXN1; (-) strand; PAM type: YTN; PAM sequence: CTA
gttcacagtgtcaaaccaag

SEQ ID NO: 180502 - DNA, 20 bp, Artificial Sequence
  Description of Artificial Sequence: Synthetic oligonucleotide
  Target: ATXN1; (-) strand; PAM type: YTN; PAM sequence: TTG
cacgatacagctagttcaca

SEQ ID NO: 180503 - DNA, 20 bp, Artificial Sequence
  Description of Artificial Sequence: Synthetic oligonucleotide
  Target: ATXN1; (-) strand; PAM type: YTN; PAM sequence: TTT
gcacgatacagctagttcac

SEQ ID NO: 180504 - DNA, 20 bp, Artificial Sequence
  Description of Artificial Sequence: Synthetic oligonucleotide
  Target: ATXN1; (-) strand; PAM type: YTN; PAM sequence: TTA
ccaatttgcacgatacagct

SEQ ID NO: 180505 - DNA, 20 bp, Artificial Sequence
  Description of Artificial Sequence: Synthetic oligonucleotide
  Target: ATXN1; (-) strand; PAM type: YTN; PAM sequence: TTT
accaatttgcacgatacagc

SEQ ID NO: 180506 - DNA, 20 bp, Artificial Sequence
  Description of Artificial Sequence: Synthetic oligonucleotide
  Target: ATXN1; (-) strand; PAM type: YTN; PAM sequence: CTA
tttaccaatttgcacgatac

SEQ ID NO: 180507 - DNA, 20 bp, Artificial Sequence
  Description of Artificial Sequence: Synthetic oligonucleotide
  Target: ATXN1; (-) strand; PAM type: YTN; PAM sequence: CTG
tctatttaccaatttgcacg

SEQ ID NO: 180508 - DNA, 20 bp, Artificial Sequence
  Description of Artificial Sequence: Synthetic oligonucleotide
  Target: ATXN1; (-) strand; PAM type: YTN; PAM sequence: TTC
tgtctatttaccaatttgca

SEQ ID NO: 180509 - DNA, 20 bp, Artificial Sequence
  Description of Artificial Sequence: Synthetic oligonucleotide
  Target: ATXN1; (-) strand; PAM type: YTN; PAM sequence: CTA
gattctgtctatttaccaat

SEQ ID NO: 180510 - DNA, 20 bp, Artificial Sequence
  Description of Artificial Sequence: Synthetic oligonucleotide
  Target: ATXN1; (-) strand; PAM type: YTN; PAM sequence: TTG
taggaaaagcaggataatat

SEQ ID NO: 180511 - DNA, 20 bp, Artificial Sequence
  Description of Artificial Sequence: Synthetic oligonucleotide
  Target: ATXN1; (-) strand; PAM type: YTN; PAM sequence: TTT
gtaggaaaagcaggataata

SEQ ID NO: 180512 - DNA, 20 bp, Artificial Sequence
  Description of Artificial Sequence: Synthetic oligonucleotide
  Target: ATXN1; (-) strand; PAM type: YTN; PAM sequence: TTT
tgtaggaaaagcaggataat

SEQ ID NO: 180513 - DNA, 20 bp, Artificial Sequence
  Description of Artificial Sequence: Synthetic oligonucleotide
  Target: ATXN1; (-) strand; PAM type: YTN; PAM sequence: TTC
aggttttgtaggaaaagcag

SEQ ID NO: 180514 - DNA, 20 bp, Artificial Sequence
  Description of Artificial Sequence: Synthetic oligonucleotide
  Target: ATXN1; (-) strand; PAM type: YTN; PAM sequence: CTT
caggttttgtaggaaaagca

SEQ ID NO: 180515 - DNA, 20 bp, Artificial Sequence
  Description of Artificial Sequence: Synthetic oligonucleotide
  Target: ATXN1; (-) strand; PAM type: YTN; PAM sequence: CTA
cccggtgcttcaggttttgt

SEQ ID NO: 180516 - DNA, 20 bp, Artificial Sequence
  Description of Artificial Sequence: Synthetic oligonucleotide
  Target: ATXN1; (-) strand; PAM type: YTN; PAM sequence: TTA
tctacccggtgcttcaggtt

SEQ ID NO: 180517 - DNA, 20 bp, Artificial Sequence
  Description of Artificial Sequence: Synthetic oligonucleotide
  Target: ATXN1; (-) strand; PAM type: YTN; PAM sequence: TTT
atctacccggtgcttcaggt

SEQ ID NO: 180518 - DNA, 20 bp, Artificial Sequence
  Description of Artificial Sequence: Synthetic oligonucleotide
  Target: ATXN1; (-) strand; PAM type: YTN; PAM sequence: CTG
taatttatctacccggtgct

SEQ ID NO: 180519 - DNA, 20 bp, Artificial Sequence
  Description of Artificial Sequence: Synthetic oligonucleotide
  Target: ATXN1; (-) strand; PAM type: YTN; PAM sequence: TTG
catctgtaatttatctaccc

SEQ ID NO: 180520 - DNA, 20 bp, Artificial Sequence
  Description of Artificial Sequence: Synthetic oligonucleotide
  Target: ATXN1; (-) strand; PAM type: YTN; PAM sequence: CTT
gcatctgtaatttatctacc

SEQ ID NO: 180521 - DNA, 20 bp, Artificial Sequence
  Description of Artificial Sequence: Synthetic oligonucleotide
  Target: ATXN1; (-) strand; PAM type: YTN; PAM sequence: CTC
cttgcatctgtaatttatct

SEQ ID NO: 180522 - DNA, 20 bp, Artificial Sequence
  Description of Artificial Sequence: Synthetic oligonucleotide
  Target: ATXN1; (-) strand; PAM type: YTN; PAM sequence: TTC
atgaagagaaactccttgca

SEQ ID NO: 180523 - DNA, 20 bp, Artificial Sequence
  Description of Artificial Sequence: Synthetic oligonucleotide
  Target: ATXN1; (-) strand; PAM type: YTN; PAM sequence: TTG
ttcatgaagagaaactcctt

SEQ ID NO: 180524 - DNA, 20 bp, Artificial Sequence
  Description of Artificial Sequence: Synthetic oligonucleotide
  Target: ATXN1; (-) strand; PAM type: YTN; PAM sequence: TTA
ttgttcatgaagagaaactc

SEQ ID NO: 180525 - DNA, 20 bp, Artificial Sequence
  Description of Artificial Sequence: Synthetic oligonucleotide
  Target: ATXN1; (-) strand; PAM type: YTN; PAM sequence: TTA
gcaggaattattgttcatga

SEQ ID NO: 180526 - DNA, 20 bp, Artificial Sequence
  Description of Artificial Sequence: Synthetic oligonucleotide
  Target: ATXN1; (-) strand; PAM type: YTN; PAM sequence: TTG
ttagcaggaattattgttca

SEQ ID NO: 180527 - DNA, 20 bp, Artificial Sequence
  Description of Artificial Sequence: Synthetic oligonucleotide
  Target: ATXN1; (-) strand; PAM type: YTN; PAM sequence: TTT
gttagcaggaattattgttc

SEQ ID NO: 180528 - DNA, 20 bp, Artificial Sequence
  Description of Artificial Sequence: Synthetic oligonucleotide
  Target: ATXN1; (-) strand; PAM type: YTN; PAM sequence: TTC
atttgttagcaggaattatt

SEQ ID NO: 180529 - DNA, 20 bp, Artificial Sequence
  Description of Artificial Sequence: Synthetic oligonucleotide
  Target: ATXN1; (-) strand; PAM type: YTN; PAM sequence: TTG
ttcatttgttagcaggaatt

SEQ ID NO: 180530 - DNA, 20 bp, Artificial Sequence
  Description of Artificial Sequence: Synthetic oligonucleotide
  Target: ATXN1; (-) strand; PAM type: YTN; PAM sequence: TTT
gttcatttgttagcaggaat

SEQ ID NO: 180531 - DNA, 20 bp, Artificial Sequence
  Description of Artificial Sequence: Synthetic oligonucleotide
  Target: ATXN1; (-) strand; PAM type: YTN; PAM sequence: TTA
tttgttcatttgttagcagg

SEQ ID NO: 180532 - DNA, 20 bp, Artificial Sequence
  Description of Artificial Sequence: Synthetic oligonucleotide
  Target: ATXN1; (-) strand; PAM type: YTN; PAM sequence: TTA
ttatttgttcatttgttagc

SEQ ID NO: 180533 - DNA, 20 bp, Artificial Sequence
  Description of Artificial Sequence: Synthetic oligonucleotide
  Target: ATXN1; (-) strand; PAM type: YTN; PAM sequence: CTA
ttattatttgttcatttgtt

SEQ ID NO: 180534 - DNA, 20 bp, Artificial Sequence
  Description of Artificial Sequence: Synthetic oligonucleotide
  Target: ATXN1; (-) strand; PAM type: YTN; PAM sequence: TTC
tattattatttgttcatttg

SEQ ID NO: 180535 - DNA, 20 bp, Artificial Sequence
  Description of Artificial Sequence: Synthetic oligonucleotide
  Target: ATXN1; (-) strand; PAM type: YTN; PAM sequence: CTA
attctattattatttgttca

SEQ ID NO: 180536 - DNA, 20 bp, Artificial Sequence
  Description of Artificial Sequence: Synthetic oligonucleotide
  Target: ATXN1; (-) strand; PAM type: YTN; PAM sequence: TTG
caaatagtggtagtctaatt

SEQ ID NO: 180537 - DNA, 20 bp, Artificial Sequence
  Description of Artificial Sequence: Synthetic oligonucleotide
  Target: ATXN1; (-) strand; PAM type: YTN; PAM sequence: TTA
tcagggattgcaaatagtgg

SEQ ID NO: 180538 - DNA, 20 bp, Artificial Sequence
  Description of Artificial Sequence: Synthetic oligonucleotide
  Target: ATXN1; (-) strand; PAM type: YTN; PAM sequence: TTT
atcagggattgcaaatagtg

SEQ ID NO: 180539 - DNA, 20 bp, Artificial Sequence
  Description of Artificial Sequence: Synthetic oligonucleotide
  Target: ATXN1; (-) strand; PAM type: YTN; PAM sequence: TTC
ataaatttatcagggattgc

SEQ ID NO: 180540 - DNA, 20 bp, Artificial Sequence
  Description of Artificial Sequence: Synthetic oligonucleotide
  Target: ATXN1; (-) strand; PAM type: YTN; PAM sequence: CTG
aattcataaatttatcaggg

SEQ ID NO: 180541 - DNA, 20 bp, Artificial Sequence
  Description of Artificial Sequence: Synthetic oligonucleotide
  Target: ATXN1; (-) strand; PAM type: YTN; PAM sequence: CTG
tcatctgaattcataaattt

SEQ ID NO: 180542 - DNA, 20 bp, Artificial Sequence
  Description of Artificial Sequence: Synthetic oligonucleotide
  Target: ATXN1; (-) strand; PAM type: YTN; PAM sequence: TTG
cagtgagactgtcatctgaa

SEQ ID NO: 180543 - DNA, 20 bp, Artificial Sequence
  Description of Artificial Sequence: Synthetic oligonucleotide
  Target: ATXN1; (-) strand; PAM type: YTN; PAM sequence: TTT
gcagtgagactgtcatctga

SEQ ID NO: 180544 - DNA, 20 bp, Artificial Sequence
  Description of Artificial Sequence: Synthetic oligonucleotide
  Target: ATXN1; (-) strand; PAM type: YTN; PAM sequence: TTT
tgcagtgagactgtcatctg

SEQ ID NO: 180545 - DNA, 20 bp, Artificial Sequence
  Description of Artificial Sequence: Synthetic oligonucleotide
  Target: ATXN1; (-) strand; PAM type: YTN; PAM sequence: TTT
ttgcagtgagactgtcatct

SEQ ID NO: 180546 - DNA, 20 bp, Artificial Sequence
  Description of Artificial Sequence: Synthetic oligonucleotide
  Target: ATXN1; (-) strand; PAM type: YTN; PAM sequence: CTT
tttgcagtgagactgtcatc

SEQ ID NO: 180547 - DNA, 20 bp, Artificial Sequence
  Description of Artificial Sequence: Synthetic oligonucleotide
  Target: ATXN1; (-) strand; PAM type: YTN; PAM sequence: CTC
tttttgcagtgagactgtca

SEQ ID NO: 180548 - DNA, 20 bp, Artificial Sequence
  Description of Artificial Sequence: Synthetic oligonucleotide
  Target: ATXN1; (-) strand; PAM type: YTN; PAM sequence: TTG
gtggcatctctttttgcagt

SEQ ID NO: 180549 - DNA, 20 bp, Artificial Sequence
  Description of Artificial Sequence: Synthetic oligonucleotide
  Target: ATXN1; (-) strand; PAM type: YTN; PAM sequence: TTC
aggaggtaatggttggtggc

SEQ ID NO: 180550 - DNA, 20 bp, Artificial Sequence
  Description of Artificial Sequence: Synthetic oligonucleotide
  Target: ATXN1; (-) strand; PAM type: YTN; PAM sequence: CTT
caggaggtaatggttggtgg

SEQ ID NO: 180551 - DNA, 20 bp, Artificial Sequence
  Description of Artificial Sequence: Synthetic oligonucleotide
  Target: ATXN1; (-) strand; PAM type: YTN; PAM sequence: TTC
cttcaggaggtaatggttgg

SEQ ID NO: 180552 - DNA, 20 bp, Artificial Sequence
  Description of Artificial Sequence: Synthetic oligonucleotide
  Target: ATXN1; (-) strand; PAM type: YTN; PAM sequence: TTT
ccttcaggaggtaatggttg

SEQ ID NO: 180553 - DNA, 20 bp, Artificial Sequence
  Description of Artificial Sequence: Synthetic oligonucleotide
  Target: ATXN1; (-) strand; PAM type: YTN; PAM sequence: TTG
tgtatttccttcaggaggta

SEQ ID NO: 180554 - DNA, 20 bp, Artificial Sequence
  Description of Artificial Sequence: Synthetic oligonucleotide
  Target: ATXN1; (-) strand; PAM type: YTN; PAM sequence: TTG
tgttgtgtatttccttcagg

SEQ ID NO: 180555 - DNA, 20 bp, Artificial Sequence
  Description of Artificial Sequence: Synthetic oligonucleotide
  Target: ATXN1; (-) strand; PAM type: YTN; PAM sequence: TTG
gtgttgtgttgtgtatttcc

SEQ ID NO: 180556 - DNA, 20 bp, Artificial Sequence
  Description of Artificial Sequence: Synthetic oligonucleotide
  Target: ATXN1; (-) strand; PAM type: YTN; PAM sequence: TTC
atagttggtgttgtgttgtg

SEQ ID NO: 180557 - DNA, 20 bp, Artificial Sequence
  Description of Artificial Sequence: Synthetic oligonucleotide
  Target: ATXN1; (-) strand; PAM type: YTN; PAM sequence: CTT
catagttggtgttgtgttgt

SEQ ID NO: 180558 - DNA, 20 bp, Artificial Sequence
  Description of Artificial Sequence: Synthetic oligonucleotide
  Target: ATXN1; (-) strand; PAM type: YTN; PAM sequence: CTG
cttcatagttggtgttgtgt

SEQ ID NO: 180559 - DNA, 20 bp, Artificial Sequence
  Description of Artificial Sequence: Synthetic oligonucleotide
  Target: ATXN1; (-) strand; PAM type: YTN; PAM sequence: CTG
actgcttcatagttggtgtt

SEQ ID NO: 180560 - DNA, 20 bp, Artificial Sequence
  Description of Artificial Sequence: Synthetic oligonucleotide
  Target: ATXN1; (-) strand; PAM type: YTN; PAM sequence: TTG
cctgactgcttcatagttgg

SEQ ID NO: 180561 - DNA, 20 bp, Artificial Sequence
  Description of Artificial Sequence: Synthetic oligonucleotide
  Target: ATXN1; (-) strand; PAM type: YTN; PAM sequence: TTT
gcctgactgcttcatagttg

SEQ ID NO: 180562 - DNA, 20 bp, Artificial Sequence
  Description of Artificial Sequence: Synthetic oligonucleotide
  Target: ATXN1; (-) strand; PAM type: YTN; PAM sequence: CTT
tgcctgactgcttcatagtt

SEQ ID NO: 180563 - DNA, 20 bp, Artificial Sequence
  Description of Artificial Sequence: Synthetic oligonucleotide
  Target: ATXN1; (-) strand; PAM type: YTN; PAM sequence: TTG
ctttgcctgactgcttcata

SEQ ID NO: 180564 - DNA, 20 bp, Artificial Sequence
  Description of Artificial Sequence: Synthetic oligonucleotide
  Target: ATXN1; (-) strand; PAM type: YTN; PAM sequence: TTT
gctttgcctgactgcttcat

SEQ ID NO: 180565 - DNA, 20 bp, Artificial Sequence
  Description of Artificial Sequence: Synthetic oligonucleotide
  Target: ATXN1; (-) strand; PAM type: YTN; PAM sequence: CTT
tgctttgcctgactgcttca

SEQ ID NO: 180566 - DNA, 20 bp, Artificial Sequence
  Description of Artificial Sequence: Synthetic oligonucleotide
  Target: ATXN1; (-) strand; PAM type: YTN; PAM sequence: TTG
ctttgctttgcctgactgct

SEQ ID NO: 180567 - DNA, 20 bp, Artificial Sequence
  Description of Artificial Sequence: Synthetic oligonucleotide
  Target: ATXN1; (-) strand; PAM type: YTN; PAM sequence: TTT
gctttgctttgcctgactgc

SEQ ID NO: 180568 - DNA, 20 bp, Artificial Sequence
  Description of Artificial Sequence: Synthetic oligonucleotide
  Target: ATXN1; (-) strand; PAM type: YTN; PAM sequence: TTG
tttgctttgctttgcctgac

SEQ ID NO: 180569 - DNA, 20 bp, Artificial Sequence
  Description of Artificial Sequence: Synthetic oligonucleotide
  Target: ATXN1; (-) strand; PAM type: YTN; PAM sequence: TTT
gtttgctttgctttgcctga

SEQ ID NO: 180570 - DNA, 20 bp, Artificial Sequence
  Description of Artificial Sequence: Synthetic oligonucleotide
  Target: ATXN1; (-) strand; PAM type: YTN; PAM sequence: TTT
tgtttgctttgctttgcctg

SEQ ID NO: 180571 - DNA, 20 bp, Artificial Sequence
  Description of Artificial Sequence: Synthetic oligonucleotide
  Target: ATXN1; (-) strand; PAM type: YTN; PAM sequence: TTG
ttttgtttgctttgctttgc

SEQ ID NO: 180572 - DNA, 20 bp, Artificial Sequence
  Description of Artificial Sequence: Synthetic oligonucleotide
  Target: ATXN1; (-) strand; PAM type: YTN; PAM sequence: CTA
gaggcattgttttgtttgct

SEQ ID NO: 180573 - DNA, 20 bp, Artificial Sequence
  Description of Artificial Sequence: Synthetic oligonucleotide
  Target: ATXN1; (-) strand; PAM type: YTN; PAM sequence: TTC
tagaggcattgttttgtttg

SEQ ID NO: 180574 - DNA, 20 bp, Artificial Sequence
  Description of Artificial Sequence: Synthetic oligonucleotide
  Target: ATXN1; (-) strand; PAM type: YTN; PAM sequence: CTA
ggaagttctagaggcattgt

SEQ ID NO: 180575 - DNA, 20 bp, Artificial Sequence
  Description of Artificial Sequence: Synthetic oligonucleotide
  Target: ATXN1; (-) strand; PAM type: YTN; PAM sequence: TTG
ctaggaagttctagaggcat

SEQ ID NO: 180576 - DNA, 20 bp, Artificial Sequence
  Description of Artificial Sequence: Synthetic oligonucleotide
  Target: ATXN1; (-) strand; PAM type: YTN; PAM sequence: TTG
ggaattgctaggaagttcta

SEQ ID NO: 180577 - DNA, 20 bp, Artificial Sequence
  Description of Artificial Sequence: Synthetic oligonucleotide
  Target: ATXN1; (-) strand; PAM type: YTN; PAM sequence: CTT
gggaattgctaggaagttct

SEQ ID NO: 180578 - DNA, 20 bp, Artificial Sequence
  Description of Artificial Sequence: Synthetic oligonucleotide
  Target: ATXN1; (-) strand; PAM type: YTN; PAM sequence: TTC
ttgggaattgctaggaagtt

SEQ ID NO: 180579 - DNA, 20 bp, Artificial Sequence
  Description of Artificial Sequence: Synthetic oligonucleotide
  Target: ATXN1; (-) strand; PAM type: YTN; PAM sequence: TTT
cttgggaattgctaggaagt

SEQ ID NO: 180580 - DNA, 20 bp, Artificial Sequence
  Description of Artificial Sequence: Synthetic oligonucleotide
  Target: ATXN1; (-) strand; PAM type: YTN; PAM sequence: CTG
aatttcttgggaattgctag

SEQ ID NO: 180581 - DNA, 20 bp, Artificial Sequence
  Description of Artificial Sequence: Synthetic oligonucleotide
  Target: ATXN1; (-) strand; PAM type: YTN; PAM sequence: CTC
ctgaatttcttgggaattgc

SEQ ID NO: 180582 - DNA, 20 bp, Artificial Sequence
  Description of Artificial Sequence: Synthetic oligonucleotide
  Target: ATXN1; (-) strand; PAM type: YTN; PAM sequence: CTG
tctcctgaatttcttgggaa

SEQ ID NO: 180583 - DNA, 20 bp, Artificial Sequence
  Description of Artificial Sequence: Synthetic oligonucleotide
  Target: ATXN1; (-) strand; PAM type: YTN; PAM sequence: CTC
tgtctcctgaatttcttggg

SEQ ID NO: 180584 - DNA, 20 bp, Artificial Sequence
  Description of Artificial Sequence: Synthetic oligonucleotide
  Target: ATXN1; (-) strand; PAM type: YTN; PAM sequence: CTA
agcatgtccctctgtctcct

SEQ ID NO: 180585 - DNA, 20 bp, Artificial Sequence
  Description of Artificial Sequence: Synthetic oligonucleotide
  Target: ATXN1; (-) strand; PAM type: YTN; PAM sequence: TTG
ctaagcatgtccctctgtct

SEQ ID NO: 180586 - DNA, 20 bp, Artificial Sequence
  Description of Artificial Sequence: Synthetic oligonucleotide
  Target: ATXN1; (-) strand; PAM type: YTN; PAM sequence: CTC
catgtggtgttgctaagcat

SEQ ID NO: 180587 - DNA, 20 bp, Artificial Sequence
  Description of Artificial Sequence: Synthetic oligonucleotide
  Target: ATXN1; (-) strand; PAM type: YTN; PAM sequence: TTG
cctccatgtggtgttgctaa

SEQ ID NO: 180588 - DNA, 20 bp, Artificial Sequence
  Description of Artificial Sequence: Synthetic oligonucleotide
  Target: ATXN1; (-) strand; PAM type: YTN; PAM sequence: TTG
gatgattgcctccatgtggt

SEQ ID NO: 180589 - DNA, 20 bp, Artificial Sequence
  Description of Artificial Sequence: Synthetic oligonucleotide
  Target: ATXN1; (-) strand; PAM type: YTN; PAM sequence: TTT
ggatgattgcctccatgtgg

SEQ ID NO: 180590 - DNA, 20 bp, Artificial Sequence
  Description of Artificial Sequence: Synthetic oligonucleotide
  Target: ATXN1; (-) strand; PAM type: YTN; PAM sequence: CTG
ggtttggatgattgcctcca

SEQ ID NO: 180591 - DNA, 20 bp, Artificial Sequence
  Description of Artificial Sequence: Synthetic oligonucleotide
  Target: ATXN1; (-) strand; PAM type: YTN; PAM sequence: TTC
ccacccgtctgggtttggat

SEQ ID NO: 180592 - DNA, 20 bp, Artificial Sequence
  Description of Artificial Sequence: Synthetic oligonucleotide
  Target: ATXN1; (-) strand; PAM type: YTN; PAM sequence: TTT
cccacccgtctgggtttgga

SEQ ID NO: 180593 - DNA, 20 bp, Artificial Sequence
  Description of Artificial Sequence: Synthetic oligonucleotide
  Target: ATXN1; (-) strand; PAM type: YTN; PAM sequence: CTG
gtagaatttcccacccgtct

SEQ ID NO: 180594 - DNA, 20 bp, Artificial Sequence
  Description of Artificial Sequence: Synthetic oligonucleotide
  Target: ATXN1; (-) strand; PAM type: YTN; PAM sequence: TTG
tctggtagaatttcccaccc

SEQ ID NO: 180595 - DNA, 20 bp, Artificial Sequence
  Description of Artificial Sequence: Synthetic oligonucleotide
  Target: ATXN1; (-) strand; PAM type: YTN; PAM sequence: TTT
gtctggtagaatttcccacc

SEQ ID NO: 180596 - DNA, 20 bp, Artificial Sequence
  Description of Artificial Sequence: Synthetic oligonucleotide
  Target: ATXN1; (-) strand; PAM type: YTN; PAM sequence: TTG
agaaaccagaccatttgtct

SEQ ID NO: 180597 - DNA, 20 bp, Artificial Sequence
  Description of Artificial Sequence: Synthetic oligonucleotide
  Target: ATXN1; (-) strand; PAM type: YTN; PAM sequence: CTG
ttgagaaaccagaccatttg

SEQ ID NO: 180598 - DNA, 20 bp, Artificial Sequence
  Description of Artificial Sequence: Synthetic oligonucleotide
  Target: ATXN1; (-) strand; PAM type: YTN; PAM sequence: TTC
tgttgagaaaccagaccatt

SEQ ID NO: 180599 - DNA, 20 bp, Artificial Sequence
  Description of Artificial Sequence: Synthetic oligonucleotide
  Target: ATXN1; (-) strand; PAM type: YTN; PAM sequence: TTT
ctgttgagaaaccagaccat

SEQ ID NO: 180600 - DNA, 20 bp, Artificial Sequence
  Description of Artificial Sequence: Synthetic oligonucleotide
  Target: ATXN1; (-) strand; PAM type: YTN; PAM sequence: TTT
tctgttgagaaaccagacca

SEQ ID NO: 180601 - DNA, 20 bp, Artificial Sequence
  Description of Artificial Sequence: Synthetic oligonucleotide
  Target: ATXN1; (-) strand; PAM type: YTN; PAM sequence: TTT
ttctgttgagaaaccagacc

SEQ ID NO: 180602 - DNA, 20 bp, Artificial Sequence
  Description of Artificial Sequence: Synthetic oligonucleotide
  Target: ATXN1; (-) strand; PAM type: YTN; PAM sequence: TTT
tttctgttgagaaaccagac

SEQ ID NO: 180603 - DNA, 20 bp, Artificial Sequence
  Description of Artificial Sequence: Synthetic oligonucleotide
  Target: ATXN1; (-) strand; PAM type: YTN; PAM sequence: TTG
cagttttttctgttgagaaa

SEQ ID NO: 180604 - DNA, 20 bp, Artificial Sequence
  Description of Artificial Sequence: Synthetic oligonucleotide
  Target: ATXN1; (-) strand; PAM type: YTN; PAM sequence: TTT
gcagttttttctgttgagaa

SEQ ID NO: 180605 - DNA, 20 bp, Artificial Sequence
  Description of Artificial Sequence: Synthetic oligonucleotide
  Target: ATXN1; (-) strand; PAM type: YTN; PAM sequence: TTT
tgcagttttttctgttgaga

SEQ ID NO: 180606 - DNA, 20 bp, Artificial Sequence
  Description of Artificial Sequence: Synthetic oligonucleotide
  Target: ATXN1; (-) strand; PAM type: YTN; PAM sequence: TTA
ttttgcagttttttctgttg

SEQ ID NO: 180607 - DNA, 20 bp, Artificial Sequence
  Description of Artificial Sequence: Synthetic oligonucleotide
  Target: ATXN1; (-) strand; PAM type: YTN; PAM sequence: TTT
attttgcagttttttctgtt

SEQ ID NO: 180608 - DNA, 20 bp, Artificial Sequence
  Description of Artificial Sequence: Synthetic oligonucleotide
  Target: ATXN1; (-) strand; PAM type: YTN; PAM sequence: TTT
tattttgcagttttttctgt

SEQ ID NO: 180609 - DNA, 20 bp, Artificial Sequence
  Description of Artificial Sequence: Synthetic oligonucleotide
  Target: ATXN1; (-) strand; PAM type: YTN; PAM sequence: TTT
ttattttgcagttttttctg

SEQ ID NO: 180610 - DNA, 20 bp, Artificial Sequence
  Description of Artificial Sequence: Synthetic oligonucleotide
  Target: ATXN1; (-) strand; PAM type: YTN; PAM sequence: TTT
tttattttgcagttttttct

SEQ ID NO: 180611 - DNA, 20 bp, Artificial Sequence
  Description of Artificial Sequence: Synthetic oligonucleotide
  Target: ATXN1; (-) strand; PAM type: YTN; PAM sequence: TTT
ttttattttgcagttttttc

SEQ ID NO: 180612 - DNA, 20 bp, Artificial Sequence
  Description of Artificial Sequence: Synthetic oligonucleotide
  Target: ATXN1; (-) strand; PAM type: YTN; PAM sequence: TTT
tttttattttgcagtttttt

SEQ ID NO: 180613 - DNA, 20 bp, Artificial Sequence
  Description of Artificial Sequence: Synthetic oligonucleotide
  Target: ATXN1; (-) strand; PAM type: YTN; PAM sequence: CTT
ttttttattttgcagttttt

SEQ ID NO: 180614 - DNA, 20 bp, Artificial Sequence
  Description of Artificial Sequence: Synthetic oligonucleotide
  Target: ATXN1; (-) strand; PAM type: YTN; PAM sequence: CTA
tgtcttttttttattttgca

SEQ ID NO: 180615 - DNA, 20 bp, Artificial Sequence
  Description of Artificial Sequence: Synthetic oligonucleotide
  Target: ATXN1; (-) strand; PAM type: YTN; PAM sequence: CTC
ggtatcacctatgtcttttt

SEQ ID NO: 180616 - DNA, 20 bp, Artificial Sequence
  Description of Artificial Sequence: Synthetic oligonucleotide
  Target: ATXN1; (-) strand; PAM type: YTN; PAM sequence: CTA
ctcggtatcacctatgtctt

SEQ ID NO: 180617 - DNA, 20 bp, Artificial Sequence
  Description of Artificial Sequence: Synthetic oligonucleotide
  Target: ATXN1; (-) strand; PAM type: YTN; PAM sequence: TTA
cactactcggtatcacctat

SEQ ID NO: 180618 - DNA, 20 bp, Artificial Sequence
  Description of Artificial Sequence: Synthetic oligonucleotide
  Target: ATXN1; (-) strand; PAM type: YTN; PAM sequence: TTT
acactactcggtatcaccta

SEQ ID NO: 180619 - DNA, 20 bp, Artificial Sequence
  Description of Artificial Sequence: Synthetic oligonucleotide
  Target: ATXN1; (-) strand; PAM type: YTN; PAM sequence: TTT
tacactactcggtatcacct

SEQ ID NO: 180620 - DNA, 20 bp, Artificial Sequence
  Description of Artificial Sequence: Synthetic oligonucleotide
  Target: ATXN1; (-) strand; PAM type: YTN; PAM sequence: CTT
ttacactactcggtatcacc

SEQ ID NO: 180621 - DNA, 20 bp, Artificial Sequence
  Description of Artificial Sequence: Synthetic oligonucleotide
  Target: ATXN1; (-) strand; PAM type: YTN; PAM sequence: CTC
ttttacactactcggtatca

SEQ ID NO: 180622 - DNA, 20 bp, Artificial Sequence
  Description of Artificial Sequence: Synthetic oligonucleotide
  Target: ATXN1; (-) strand; PAM type: YTN; PAM sequence: CTA
aacctcttttacactactcg

SEQ ID NO: 180623 - DNA, 20 bp, Artificial Sequence
  Description of Artificial Sequence: Synthetic oligonucleotide
  Target: ATXN1; (-) strand; PAM type: YTN; PAM sequence: CTC
ctaaacctcttttacactac

SEQ ID NO: 180624 - DNA, 20 bp, Artificial Sequence
  Description of Artificial Sequence: Synthetic oligonucleotide
  Target: ATXN1; (-) strand; PAM type: YTN; PAM sequence: TTC
ggtctcctaaacctctttta

SEQ ID NO: 180625 - DNA, 20 bp, Artificial Sequence
  Description of Artificial Sequence: Synthetic oligonucleotide
  Target: ATXN1; (-) strand; PAM type: YTN; PAM sequence: TTT
cggtctcctaaacctctttt

SEQ ID NO: 180626 - DNA, 20 bp, Artificial Sequence
  Description of Artificial Sequence: Synthetic oligonucleotide
  Target: ATXN1; (-) strand; PAM type: YTN; PAM sequence: TTG
aaccaagatccaaataaagg

SEQ ID NO: 180627 - DNA, 20 bp, Artificial Sequence
  Description of Artificial Sequence: Synthetic oligonucleotide
  Target: ATXN1; (-) strand; PAM type: YTN; PAM sequence: TTT
gaaccaagatccaaataaag

SEQ ID NO: 180628 - DNA, 20 bp, Artificial Sequence
  Description of Artificial Sequence: Synthetic oligonucleotide
  Target: ATXN1; (-) strand; PAM type: YTN; PAM sequence: TTA
tttgaaccaagatccaaata

SEQ ID NO: 180629 - DNA, 20 bp, Artificial Sequence
  Description of Artificial Sequence: Synthetic oligonucleotide
  Target: ATXN1; (-) strand; PAM type: YTN; PAM sequence: TTT
atttgaaccaagatccaaat

SEQ ID NO: 180630 - DNA, 20 bp, Artificial Sequence
  Description of Artificial Sequence: Synthetic oligonucleotide
  Target: ATXN1; (-) strand; PAM type: YTN; PAM sequence: TTA
atagtttatttgaaccaaga

SEQ ID NO: 180631 - DNA, 20 bp, Artificial Sequence
  Description of Artificial Sequence: Synthetic oligonucleotide
  Target: ATXN1; (-) strand; PAM type: YTN; PAM sequence: TTT
aatagtttatttgaaccaag

SEQ ID NO: 180632 - DNA, 20 bp, Artificial Sequence
  Description of Artificial Sequence: Synthetic oligonucleotide
  Target: ATXN1; (-) strand; PAM type: YTN; PAM sequence: TTT
taatagtttatttgaaccaa

SEQ ID NO: 180633 - DNA, 20 bp, Artificial Sequence
  Description of Artificial Sequence: Synthetic oligonucleotide
  Target: ATXN1; (-) strand; PAM type: YTN; PAM sequence: TTT
ttaatagtttatttgaacca

SEQ ID NO: 180634 - DNA, 20 bp, Artificial Sequence
  Description of Artificial Sequence: Synthetic oligonucleotide
  Target: ATXN1; (-) strand; PAM type: YTN; PAM sequence: TTT
tttaatagtttatttgaacc

SEQ ID NO: 180635 - DNA, 20 bp, Artificial Sequence
  Description of Artificial Sequence: Synthetic oligonucleotide
  Target: ATXN1; (-) strand; PAM type: YTN; PAM sequence: TTG
taggattttttaatagttta

SEQ ID NO: 180636 - DNA, 20 bp, Artificial Sequence
  Description of Artificial Sequence: Synthetic oligonucleotide
  Target: ATXN1; (-) strand; PAM type: YTN; PAM sequence: TTA
tgttgtaggattttttaata

SEQ ID NO: 180637 - DNA, 20 bp, Artificial Sequence
  Description of Artificial Sequence: Synthetic oligonucleotide
  Target: ATXN1; (-) strand; PAM type: YTN; PAM sequence: TTT
atgttgtaggattttttaat

SEQ ID NO: 180638 - DNA, 20 bp, Artificial Sequence
  Description of Artificial Sequence: Synthetic oligonucleotide
  Target: ATXN1; (-) strand; PAM type: YTN; PAM sequence: TTT
tatgttgtaggattttttaa

SEQ ID NO: 180639 - DNA, 20 bp, Artificial Sequence
  Description of Artificial Sequence: Synthetic oligonucleotide
  Target: ATXN1; (-) strand; PAM type: YTN; PAM sequence: TTA
ttttatgttgtaggattttt

SEQ ID NO: 180640 - DNA, 20 bp, Artificial Sequence
  Description of Artificial Sequence: Synthetic oligonucleotide
  Target: ATXN1; (-) strand; PAM type: YTN; PAM sequence: TTT
attttatgttgtaggatttt

SEQ ID NO: 180641 - DNA, 20 bp, Artificial Sequence
  Description of Artificial Sequence: Synthetic oligonucleotide
  Target: ATXN1; (-) strand; PAM type: YTN; PAM sequence: TTT
tattttatgttgtaggattt

SEQ ID NO: 180642 - DNA, 20 bp, Artificial Sequence
  Description of Artificial Sequence: Synthetic oligonucleotide
  Target: ATXN1; (-) strand; PAM type: YTN; PAM sequence: TTA
ataagttttattttatgttg

SEQ ID NO: 180643 - DNA, 20 bp, Artificial Sequence
  Description of Artificial Sequence: Synthetic oligonucleotide
  Target: ATXN1; (-) strand; PAM type: YTN; PAM sequence: TTA
ttaataagttttattttatg

SEQ ID NO: 180644 - DNA, 20 bp, Artificial Sequence
  Description of Artificial Sequence: Synthetic oligonucleotide
  Target: ATXN1; (-) strand; PAM type: YTN; PAM sequence: CTT
attaataagttttattttat

SEQ ID NO: 180645 - DNA, 20 bp, Artificial Sequence
  Description of Artificial Sequence: Synthetic oligonucleotide
  Target: ATXN1; (-) strand; PAM type: YTN; PAM sequence: TTG
acttattaataagttttatt

SEQ ID NO: 180646 - DNA, 20 bp, Artificial Sequence
  Description of Artificial Sequence: Synthetic oligonucleotide
  Target: ATXN1; (-) strand; PAM type: YTN; PAM sequence: CTA
attgacttattaataagttt

SEQ ID NO: 180647 - DNA, 20 bp, Artificial Sequence
  Description of Artificial Sequence: Synthetic oligonucleotide
  Target: ATXN1; (-) strand; PAM type: YTN; PAM sequence: TTC
ctaattgacttattaataag

SEQ ID NO: 180648 - DNA, 20 bp, Artificial Sequence
  Description of Artificial Sequence: Synthetic oligonucleotide
  Target: ATXN1; (-) strand; PAM type: YTN; PAM sequence: TTT
cctaattgacttattaataa

SEQ ID NO: 180649 - DNA, 20 bp, Artificial Sequence
  Description of Artificial Sequence: Synthetic oligonucleotide
  Target: ATXN1; (-) strand; PAM type: YTN; PAM sequence: TTT
tcctaattgacttattaata

SEQ ID NO: 180650 - DNA, 20 bp, Artificial Sequence
  Description of Artificial Sequence: Synthetic oligonucleotide
  Target: ATXN1; (-) strand; PAM type: YTN; PAM sequence: TTC
atattttcctaattgactta

SEQ ID NO: 180651 - DNA, 20 bp, Artificial Sequence
  Description of Artificial Sequence: Synthetic oligonucleotide
  Target: ATXN1; (-) strand; PAM type: YTN; PAM sequence: CTC
aatatcatcaaatatcccgt

SEQ ID NO: 180652 - DNA, 20 bp, Artificial Sequence
  Description of Artificial Sequence: Synthetic oligonucleotide
  Target: ATXN1; (-) strand; PAM type: YTN; PAM sequence: TTC
tcaatatcatcaaatatccc

SEQ ID NO: 180653 - DNA, 20 bp, Artificial Sequence
  Description of Artificial Sequence: Synthetic oligonucleotide
  Target: ATXN1; (-) strand; PAM type: YTN; PAM sequence: TTT
ctcaatatcatcaaatatcc

SEQ ID NO: 180654 - DNA, 20 bp, Artificial Sequence
  Description of Artificial Sequence: Synthetic oligonucleotide
  Target: ATXN1; (-) strand; PAM type: YTN; PAM sequence: TTA
acagtcatttctcaatatca

SEQ ID NO: 180655 - DNA, 20 bp, Artificial Sequence
  Description of Artificial Sequence: Synthetic oligonucleotide
  Target: ATXN1; (-) strand; PAM type: YTN; PAM sequence: CTA
caacatcatcatcacaccaa

SEQ ID NO: 180656 - DNA, 20 bp, Artificial Sequence
  Description of Artificial Sequence: Synthetic oligonucleotide
  Target: ATXN1; (-) strand; PAM type: YTN; PAM sequence: CTC
atacacaactacaacatcat

SEQ ID NO: 180657 - DNA, 20 bp, Artificial Sequence
  Description of Artificial Sequence: Synthetic oligonucleotide
  Target: ATXN1; (-) strand; PAM type: YTN; PAM sequence: TTC
tcatacacaactacaacatc

SEQ ID NO: 180658 - DNA, 20 bp, Artificial Sequence
  Description of Artificial Sequence: Synthetic oligonucleotide
  Target: ATXN1; (-) strand; PAM type: YTN; PAM sequence: CTT
ctcatacacaactacaacat

SEQ ID NO: 180659 - DNA, 20 bp, Artificial Sequence
  Description of Artificial Sequence: Synthetic oligonucleotide
  Target: ATXN1; (-) strand; PAM type: YTN; PAM sequence: TTC
ttctcatacacaactacaac

SEQ ID NO: 180660 - DNA, 20 bp, Artificial Sequence
  Description of Artificial Sequence: Synthetic oligonucleotide
  Target: ATXN1; (-) strand; PAM type: YTN; PAM sequence: CTT
cttctcatacacaactacaa

SEQ ID NO: 180661 - DNA, 20 bp, Artificial Sequence
  Description of Artificial Sequence: Synthetic oligonucleotide
  Target: ATXN1; (-) strand; PAM type: YTN; PAM sequence: TTC
ttcttctcatacacaactac

SEQ ID NO: 180662 - DNA, 20 bp, Artificial Sequence
  Description of Artificial Sequence: Synthetic oligonucleotide
  Target: ATXN1; (-) strand; PAM type: YTN; PAM sequence: TTA
ggattcttcttctcatacac

SEQ ID NO: 180663 - DNA, 20 bp, Artificial Sequence
  Description of Artificial Sequence: Synthetic oligonucleotide
  Target: ATXN1; (-) strand; PAM type: YTN; PAM sequence: CTA
taaatgattaggattcttct

SEQ ID NO: 180664 - DNA, 20 bp, Artificial Sequence
  Description of Artificial Sequence: Synthetic oligonucleotide
  Target: ATXN1; (-) strand; PAM type: YTN; PAM sequence: TTC
tataaatgattaggattctt

SEQ ID NO: 180665 - DNA, 20 bp, Artificial Sequence
  Description of Artificial Sequence: Synthetic oligonucleotide
  Target: ATXN1; (-) strand; PAM type: YTN; PAM sequence: TTT
ctataaatgattaggattct

SEQ ID NO: 180666 - DNA, 20 bp, Artificial Sequence
  Description of Artificial Sequence: Synthetic oligonucleotide
  Target: ATXN1; (-) strand; PAM type: YTN; PAM sequence: CTA
tttctataaatgattaggat

SEQ ID NO: 180667 - DNA, 20 bp, Artificial Sequence
  Description of Artificial Sequence: Synthetic oligonucleotide
  Target: ATXN1; (-) strand; PAM type: YTN; PAM sequence: TTA
ctatttctataaatgattag

SEQ ID NO: 180668 - DNA, 20 bp, Artificial Sequence
  Description of Artificial Sequence: Synthetic oligonucleotide
  Target: ATXN1; (-) strand; PAM type: YTN; PAM sequence: TTT
actatttctataaatgatta

SEQ ID NO: 180669 - DNA, 20 bp, Artificial Sequence
  Description of Artificial Sequence: Synthetic oligonucleotide
  Target: ATXN1; (-) strand; PAM type: YTN; PAM sequence: TTT
tactatttctataaatgatt

SEQ ID NO: 180670 - DNA, 20 bp, Artificial Sequence
  Description of Artificial Sequence: Synthetic oligonucleotide
  Target: ATXN1; (-) strand; PAM type: YTN; PAM sequence: CTA
taaaatattttactatttct

SEQ ID NO: 180671 - DNA, 20 bp, Artificial Sequence
  Description of Artificial Sequence: Synthetic oligonucleotide
  Target: ATXN1; (-) strand; PAM type: YTN; PAM sequence: CTC
aaaatatctataaaatattt

SEQ ID NO: 180672 - DNA, 20 bp, Artificial Sequence
  Description of Artificial Sequence: Synthetic oligonucleotide
  Target: ATXN1; (-) strand; PAM type: YTN; PAM sequence: TTG
actcaaaatatctataaaat

SEQ ID NO: 180673 - DNA, 20 bp, Artificial Sequence
  Description of Artificial Sequence: Synthetic oligonucleotide
  Target: ATXN1; (-) strand; PAM type: YTN; PAM sequence: CTG
ttgactcaaaatatctataa

SEQ ID NO: 180674 - DNA, 20 bp, Artificial Sequence
  Description of Artificial Sequence: Synthetic oligonucleotide
  Target: ATXN1; (-) strand; PAM type: YTN; PAM sequence: TTG
ctgttgactcaaaatatcta

SEQ ID NO: 180675 - DNA, 20 bp, Artificial Sequence
  Description of Artificial Sequence: Synthetic oligonucleotide
  Target: ATXN1; (-) strand; PAM type: YTN; PAM sequence: TTC
ataacagattgctgttgact

SEQ ID NO: 180676 - DNA, 20 bp, Artificial Sequence
  Description of Artificial Sequence: Synthetic oligonucleotide
  Target: ATXN1; (-) strand; PAM type: YTN; PAM sequence: CTT
cataacagattgctgttgac

SEQ ID NO: 180677 - DNA, 20 bp, Artificial Sequence
  Description of Artificial Sequence: Synthetic oligonucleotide
  Target: ATXN1; (-) strand; PAM type: YTN; PAM sequence: TTG
catcttcataacagattgct

SEQ ID NO: 180678 - DNA, 20 bp, Artificial Sequence
  Description of Artificial Sequence: Synthetic oligonucleotide
  Target: ATXN1; (-) strand; PAM type: YTN; PAM sequence: CTT
gcatcttcataacagattgc

SEQ ID NO: 180679 - DNA, 20 bp, Artificial Sequence
  Description of Artificial Sequence: Synthetic oligonucleotide
  Target: ATXN1; (-) strand; PAM type: YTN; PAM sequence: CTG
gaccttgcatcttcataaca

SEQ ID NO: 180680 - DNA, 20 bp, Artificial Sequence
  Description of Artificial Sequence: Synthetic oligonucleotide
  Target: ATXN1; (-) strand; PAM type: YTN; PAM sequence: TTC
cctggaccttgcatcttcat

SEQ ID NO: 180681 - DNA, 20 bp, Artificial Sequence
  Description of Artificial Sequence: Synthetic oligonucleotide
  Target: ATXN1; (-) strand; PAM type: YTN; PAM sequence: TTC
caaataacagtattccctgg

SEQ ID NO: 180682 - DNA, 20 bp, Artificial Sequence
  Description of Artificial Sequence: Synthetic oligonucleotide
  Target: ATXN1; (-) strand; PAM type: YTN; PAM sequence: TTG
aagcaaattccaaataacag

SEQ ID NO: 180683 - DNA, 20 bp, Artificial Sequence
  Description of Artificial Sequence: Synthetic oligonucleotide
  Target: ATXN1; (-) strand; PAM type: YTN; PAM sequence: TTT
gaagcaaattccaaataaca

SEQ ID NO: 180684 - DNA, 20 bp, Artificial Sequence
  Description of Artificial Sequence: Synthetic oligonucleotide
  Target: ATXN1; (-) strand; PAM type: YTN; PAM sequence: TTT
tgaagcaaattccaaataac

SEQ ID NO: 180685 - DNA, 20 bp, Artificial Sequence
  Description of Artificial Sequence: Synthetic oligonucleotide
  Target: ATXN1; (-) strand; PAM type: YTN; PAM sequence: TTA
ttttgaagcaaattccaaat

SEQ ID NO: 180686 - DNA, 20 bp, Artificial Sequence
  Description of Artificial Sequence: Synthetic oligonucleotide
  Target: ATXN1; (-) strand; PAM type: YTN; PAM sequence: CTG
gattattttgaagcaaattc

SEQ ID NO: 180687 - DNA, 20 bp, Artificial Sequence
  Description of Artificial Sequence: Synthetic oligonucleotide
  Target: ATXN1; (-) strand; PAM type: YTN; PAM sequence: CTG
cacctggattattttgaagc

SEQ ID NO: 180688 - DNA, 20 bp, Artificial Sequence
  Description of Artificial Sequence: Synthetic oligonucleotide
  Target: ATXN1; (-) strand; PAM type: YTN; PAM sequence: CTC
tgcacctggattattttgaa

SEQ ID NO: 180689 - DNA, 20 bp, Artificial Sequence
  Description of Artificial Sequence: Synthetic oligonucleotide
  Target: ATXN1; (-) strand; PAM type: YTN; PAM sequence: CTC
cacctctgcacctggattat

SEQ ID NO: 180690 - DNA, 20 bp, Artificial Sequence
  Description of Artificial Sequence: Synthetic oligonucleotide
  Target: ATXN1; (-) strand; PAM type: YTN; PAM sequence: CTA
ctccacctctgcacctggat

SEQ ID NO: 180691 - DNA, 20 bp, Artificial Sequence
  Description of Artificial Sequence: Synthetic oligonucleotide
  Target: ATXN1; (-) strand; PAM type: YTN; PAM sequence: CTC
tactccacctctgcacctgg

SEQ ID NO: 180692 - DNA, 20 bp, Artificial Sequence
  Description of Artificial Sequence: Synthetic oligonucleotide
  Target: ATXN1; (-) strand; PAM type: YTN; PAM sequence: TTC
tctactccacctctgcacct

SEQ ID NO: 180693 - DNA, 20 bp, Artificial Sequence
  Description of Artificial Sequence: Synthetic oligonucleotide
  Target: ATXN1; (-) strand; PAM type: YTN; PAM sequence: TTT
ctctactccacctctgcacc

SEQ ID NO: 180694 - DNA, 20 bp, Artificial Sequence
  Description of Artificial Sequence: Synthetic oligonucleotide
  Target: ATXN1; (-) strand; PAM type: YTN; PAM sequence: TTT
tctctactccacctctgcac

SEQ ID NO: 180695 - DNA, 20 bp, Artificial Sequence
  Description of Artificial Sequence: Synthetic oligonucleotide
  Target: ATXN1; (-) strand; PAM type: YTN; PAM sequence: TTC
agcagcagagccaacatcgt

SEQ ID NO: 180696 - DNA, 20 bp, Artificial Sequence
  Description of Artificial Sequence: Synthetic oligonucleotide
  Target: ATXN1; (-) strand; PAM type: YTN; PAM sequence: TTG
ccccaccaccccattcagca

SEQ ID NO: 180697 - DNA, 20 bp, Artificial Sequence
  Description of Artificial Sequence: Synthetic oligonucleotide
  Target: ATXN1; (-) strand; PAM type: YTN; PAM sequence: TTT
gccccaccaccccattcagc

SEQ ID NO: 180698 - DNA, 20 bp, Artificial Sequence
  Description of Artificial Sequence: Synthetic oligonucleotide
  Target: ATXN1; (-) strand; PAM type: YTN; PAM sequence: TTT
tgccccaccaccccattcag

SEQ ID NO: 180699 - DNA, 20 bp, Artificial Sequence
  Description of Artificial Sequence: Synthetic oligonucleotide
  Target: ATXN1; (-) strand; PAM type: YTN; PAM sequence: CTT
ttgccccaccaccccattca

SEQ ID NO: 180700 - DNA, 20 bp, Artificial Sequence
  Description of Artificial Sequence: Synthetic oligonucleotide
  Target: ATXN1; (-) strand; PAM type: YTN; PAM sequence: TTG
aaagcagagaggtggtaaat

SEQ ID NO: 180701 - DNA, 20 bp, Artificial Sequence
  Description of Artificial Sequence: Synthetic oligonucleotide
  Target: ATXN1; (-) strand; PAM type: YTN; PAM sequence: TTT
gaaagcagagaggtggtaaa

SEQ ID NO: 180702 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaagaaatatcaaa

SEQ ID NO: 180703 - DNA, 20 bp, Artificial Sequence
  Description of Artificial Sequence: Synthetic oligonucleotide
  Target: ATXN1; (-) strand; PAM type: YTN; PAM sequence: CTT
aaaaaaaaaagaaatatcaa

SEQ ID NO: 180704 - DNA, 20 bp, Artificial Sequence
  Description of Artificial Sequence: Synthetic oligonucleotide
  Target: ATXN1; (-) strand; PAM type: YTN; PAM sequence: TTA
aagtataataataatataaa

SEQ ID NO: 180705 - DNA, 20 bp, Artificial Sequence
  Description of Artificial Sequence: Synthetic oligonucleotide
  Target: ATXN1; (-) strand; PAM type: YTN; PAM sequence: CTT
aaagtataataataatataa

SEQ ID NO: 180706 - DNA, 20 bp, Artificial Sequence
  Description of Artificial Sequence: Synthetic oligonucleotide
  Target: ATXN1; (-) strand; PAM type: YTN; PAM sequence: CTA
aaacttaaagtataataata

SEQ ID NO: 180707 - DNA, 20 bp, Artificial Sequence
  Description of Artificial Sequence: Synthetic oligonucleotide
  Target: ATXN1; (-) strand; PAM type: YTN; PAM sequence: TTG
tgcacatgtaccctaaaact

SEQ ID NO: 180708 - DNA, 20 bp, Artificial Sequence
  Description of Artificial Sequence: Synthetic oligonucleotide
  Target: ATXN1; (-) strand; PAM type: YTN; PAM sequence: CTG
cacattgtgcacatgtaccc

SEQ ID NO: 180709 - DNA, 20 bp, Artificial Sequence
  Description of Artificial Sequence: Synthetic oligonucleotide
  Target: ATXN1; (-) strand; PAM type: YTN; PAM sequence: CTA
acctgcacattgtgcacatg

SEQ ID NO: 180710 - DNA, 20 bp, Artificial Sequence
  Description of Artificial Sequence: Synthetic oligonucleotide
  Target: ATXN1; (-) strand; PAM type: YTN; PAM sequence: CTA
gatgacgaggtaatgggtgc

SEQ ID NO: 180711 - DNA, 20 bp, Artificial Sequence
  Description of Artificial Sequence: Synthetic oligonucleotide
  Target: ATXN1; (-) strand; PAM type: YTN; PAM sequence: CTA
atgctagatgacgaggtaat

SEQ ID NO: 180712 - DNA, 20 bp, Artificial Sequence
  Description of Artificial Sequence: Synthetic oligonucleotide
  Target: ATXN1; (-) strand; PAM type: YTN; PAM sequence: TTA
ggagatacacctaatgctag

SEQ ID NO: 180713 - DNA, 20 bp, Artificial Sequence
  Description of Artificial Sequence: Synthetic oligonucleotide
  Target: ATXN1; (-) strand; PAM type: YTN; PAM sequence: TTG
tggggtggggggagggggga

SEQ ID NO: 180714 - DNA, 20 bp, Artificial Sequence
  Description of Artificial Sequence: Synthetic oligonucleotide
  Target: ATXN1; (-) strand; PAM type: YTN; PAM sequence: CTG
ttgtggggtggggggagggg

SEQ ID NO: 180715 - DNA, 20 bp, Artificial Sequence
  Description of Artificial Sequence: Synthetic oligonucleotide
  Target: ATXN1; (-) strand; PAM type: YTN; PAM sequence: CTG
gggactgttgtggggtgggg

SEQ ID NO: 180716 - DNA, 20 bp, Artificial Sequence
  Description of Artificial Sequence: Synthetic oligonucleotide
  Target: ATXN1; (-) strand; PAM type: YTN; PAM sequence: CTC
tggggactgttgtggggtgg

SEQ ID NO: 180717 - DNA, 20 bp, Artificial Sequence
  Description of Artificial Sequence: Synthetic oligonucleotide
  Target: ATXN1; (-) strand; PAM type: YTN; PAM sequence: TTG
aacaatgagaacacatggac

SEQ ID NO: 180718 - DNA, 20 bp, Artificial Sequence
  Description of Artificial Sequence: Synthetic oligonucleotide
  Target: ATXN1; (-) strand; PAM type: YTN; PAM sequence: CTC
atagatgggaattgaacaat

SEQ ID NO: 180719 - DNA, 20 bp, Artificial Sequence
  Description of Artificial Sequence: Synthetic oligonucleotide
  Target: ATXN1; (-) strand; PAM type: YTN; PAM sequence: CTC
actcatagatgggaattgaa

SEQ ID NO: 180720 - DNA, 20 bp, Artificial Sequence
  Description of Artificial Sequence: Synthetic oligonucleotide
  Target: ATXN1; (-) strand; PAM type: YTN; PAM sequence: TTC
tcactcatagatgggaattg

SEQ ID NO: 180721 - DNA, 20 bp, Artificial Sequence
  Description of Artificial Sequence: Synthetic oligonucleotide
  Target: ATXN1; (-) strand; PAM type: YTN; PAM sequence: CTA
tcacaaggacaaaaaaccaa

SEQ ID NO: 180722 - DNA, 20 bp, Artificial Sequence
  Description of Artificial Sequence: Synthetic oligonucleotide
  Target: ATXN1; (-) strand; PAM type: YTN; PAM sequence: CTC
agtaaactatcacaaggaca

SEQ ID NO: 180723 - DNA, 20 bp, Artificial Sequence
  Description of Artificial Sequence: Synthetic oligonucleotide
  Target: ATXN1; (-) strand; PAM type: YTN; PAM sequence: TTC
tcagtaaactatcacaagga

SEQ ID NO: 180724 - DNA, 20 bp, Artificial Sequence
  Description of Artificial Sequence: Synthetic oligonucleotide
  Target: ATXN1; (-) strand; PAM type: YTN; PAM sequence: TTG
gaaatcatcattctcagtaa

SEQ ID NO: 180725 - DNA, 20 bp, Artificial Sequence
  Description of Artificial Sequence: Synthetic oligonucleotide
  Target: ATXN1; (-) strand; PAM type: YTN; PAM sequence: TTG
tagggacatggatgaaattg

SEQ ID NO: 180726 - DNA, 20 bp, Artificial Sequence
  Description of Artificial Sequence: Synthetic oligonucleotide
  Target: ATXN1; (-) strand; PAM type: YTN; PAM sequence: TTT
gtagggacatggatgaaatt

SEQ ID NO: 180727 - DNA, 20 bp, Artificial Sequence
  Description of Artificial Sequence: Synthetic oligonucleotide
  Target: ATXN1; (-) strand; PAM type: YTN; PAM sequence: CTT
tgtagggacatggatgaaat

SEQ ID NO: 180728 - DNA, 20 bp, Artificial Sequence
  Description of Artificial Sequence: Synthetic oligonucleotide
  Target: ATXN1; (-) strand; PAM type: YTN; PAM sequence: TTC
acgtcctttgtagggacatg

SEQ ID NO: 180729 - DNA, 20 bp, Artificial Sequence
  Description of Artificial Sequence: Synthetic oligonucleotide
  Target: ATXN1; (-) strand; PAM type: YTN; PAM sequence: CTA
tgcagccataaaaaatgatg

SEQ ID NO: 180730 - DNA, 20 bp, Artificial Sequence
  Description of Artificial Sequence: Synthetic oligonucleotide
  Target: ATXN1; (-) strand; PAM type: YTN; PAM sequence: TTA
agaaaatgtggcacatatac

SEQ ID NO: 180731 - DNA, 20 bp, Artificial Sequence
  Description of Artificial Sequence: Synthetic oligonucleotide
  Target: ATXN1; (-) strand; PAM type: YTN; PAM sequence: CTG
gattaagaaaatgtggcaca

SEQ ID NO: 180732 - DNA, 20 bp, Artificial Sequence
  Description of Artificial Sequence: Synthetic oligonucleotide
  Target: ATXN1; (-) strand; PAM type: YTN; PAM sequence: TTG
gaaccaacccaaatgtccaa

SEQ ID NO: 180733 - DNA, 20 bp, Artificial Sequence
  Description of Artificial Sequence: Synthetic oligonucleotide
  Target: ATXN1; (-) strand; PAM type: YTN; PAM sequence: CTT
ggaaccaacccaaatgtcca

SEQ ID NO: 180734 - DNA, 20 bp, Artificial Sequence
  Description of Artificial Sequence: Synthetic oligonucleotide
  Target: ATXN1; (-) strand; PAM type: YTN; PAM sequence: TTC
acaatagcaaagacttggaa

SEQ ID NO: 180735 - DNA, 20 bp, Artificial Sequence
  Description of Artificial Sequence: Synthetic oligonucleotide
  Target: ATXN1; (-) strand; PAM type: YTN; PAM sequence: CTA
ttcacaatagcaaagacttg

SEQ ID NO: 180736 - DNA, 20 bp, Artificial Sequence
  Description of Artificial Sequence: Synthetic oligonucleotide
  Target: ATXN1; (-) strand; PAM type: YTN; PAM sequence: TTA
tggcggcactattcacaata

SEQ ID NO: 180737 - DNA, 20 bp, Artificial Sequence
  Description of Artificial Sequence: Synthetic oligonucleotide
  Target: ATXN1; (-) strand; PAM type: YTN; PAM sequence: TTT
atggcggcactattcacaat

SEQ ID NO: 180738 - DNA, 20 bp, Artificial Sequence
  Description of Artificial Sequence: Synthetic oligonucleotide
  Target: ATXN1; (-) strand; PAM type: YTN; PAM sequence: CTG
caataaagacacatgcacat

SEQ ID NO: 180739 - DNA, 20 bp, Artificial Sequence
  Description of Artificial Sequence: Synthetic oligonucleotide
  Target: ATXN1; (-) strand; PAM type: YTN; PAM sequence: CTA
taaatcatgctgcaataaag

SEQ ID NO: 180740 - DNA, 20 bp, Artificial Sequence
  Description of Artificial Sequence: Synthetic oligonucleotide
  Target: ATXN1; (-) strand; PAM type: YTN; PAM sequence: CTG
ggtatatacccaaaggacta

SEQ ID NO: 180741 - DNA, 20 bp, Artificial Sequence
  Description of Artificial Sequence: Synthetic oligonucleotide
  Target: ATXN1; (-) strand; PAM type: YTN; PAM sequence: TTA
ctgggtatatacccaaagga

SEQ ID NO: 180742 - DNA, 20 bp, Artificial Sequence
  Description of Artificial Sequence: Synthetic oligonucleotide
  Target: ATXN1; (-) strand; PAM type: YTN; PAM sequence: TTG
acccagccatcccattactg

SEQ ID NO: 180743 - DNA, 20 bp, Artificial Sequence
  Description of Artificial Sequence: Synthetic oligonucleotide
  Target: ATXN1; (-) strand; PAM type: YTN; PAM sequence: TTT
gacccagccatcccattact

SEQ ID NO: 180744 - DNA, 20 bp, Artificial Sequence
  Description of Artificial Sequence: Synthetic oligonucleotide
  Target: ATXN1; (-) strand; PAM type: YTN; PAM sequence: CTA
gaaataccatttgacccagc

SEQ ID NO: 180745 - DNA, 20 bp, Artificial Sequence
  Description of Artificial Sequence: Synthetic oligonucleotide
  Target: ATXN1; (-) strand; PAM type: YTN; PAM sequence: CTA
gaactagaaataccatttga

SEQ ID NO: 180746 - DNA, 20 bp, Artificial Sequence
  Description of Artificial Sequence: Synthetic oligonucleotide
  Target: ATXN1; (-) strand; PAM type: YTN; PAM sequence: CTC
agggatctagaactagaaat

SEQ ID NO: 180747 - DNA, 20 bp, Artificial Sequence
  Description of Artificial Sequence: Synthetic oligonucleotide
  Target: ATXN1; (-) strand; PAM type: YTN; PAM sequence: TTC
ctcagggatctagaactaga

SEQ ID NO: 180748 - DNA, 20 bp, Artificial Sequence
  Description of Artificial Sequence: Synthetic oligonucleotide
  Target: ATXN1; (-) strand; PAM type: YTN; PAM sequence: TTG
tggaagtcagtgtggcgatt

SEQ ID NO: 180749 - DNA, 20 bp, Artificial Sequence
  Description of Artificial Sequence: Synthetic oligonucleotide
  Target: ATXN1; (-) strand; PAM type: YTN; PAM sequence: TTC
aaccattgtggaagtcagtg

SEQ ID NO: 180750 - DNA, 20 bp, Artificial Sequence
  Description of Artificial Sequence: Synthetic oligonucleotide
  Target: ATXN1; (-) strand; PAM type: YTN; PAM sequence: CTA
gttcaaccattgtggaagtc

SEQ ID NO: 180751 - DNA, 20 bp, Artificial Sequence
  Description of Artificial Sequence: Synthetic oligonucleotide
  Target: ATXN1; (-) strand; PAM type: YTN; PAM sequence: CTG
taaactagttcaaccattgt

SEQ ID NO: 180752 - DNA, 20 bp, Artificial Sequence
  Description of Artificial Sequence: Synthetic oligonucleotide
  Target: ATXN1; (-) strand; PAM type: YTN; PAM sequence: TTG
gtgggactgtaaactagttc

SEQ ID NO: 180753 - DNA, 20 bp, Artificial Sequence
  Description of Artificial Sequence: Synthetic oligonucleotide
  Target: ATXN1; (-) strand; PAM type: YTN; PAM sequence: CTG
ttggtgggactgtaaactag

SEQ ID NO: 180754 - DNA, 20 bp, Artificial Sequence
  Description of Artificial Sequence: Synthetic oligonucleotide
  Target: ATXN1; (-) strand; PAM type: YTN; PAM sequence: TTA
cactgttggtgggactgtaa

SEQ ID NO: 180755 - DNA, 20 bp, Artificial Sequence
  Description of Artificial Sequence: Synthetic oligonucleotide
  Target: ATXN1; (-) strand; PAM type: YTN; PAM sequence: TTT
acactgttggtgggactgta

SEQ ID NO: 180756 - DNA, 20 bp, Artificial Sequence
  Description of Artificial Sequence: Synthetic oligonucleotide
  Target: ATXN1; (-) strand; PAM type: YTN; PAM sequence: TTT
tacactgttggtgggactgt

SEQ ID NO: 180757 - DNA, 20 bp, Artificial Sequence
  Description of Artificial Sequence: Synthetic oligonucleotide
  Target: ATXN1; (-) strand; PAM type: YTN; PAM sequence: CTT
ttacactgttggtgggactg

SEQ ID NO: 180758 - DNA, 20 bp, Artificial Sequence
  Description of Artificial Sequence: Synthetic oligonucleotide
  Target: ATXN1; (-) strand; PAM type: YTN; PAM sequence: CTG
gagaggatgtggagaaatag

SEQ ID NO: 180759 - DNA, 20 bp, Artificial Sequence
  Description of Artificial Sequence: Synthetic oligonucleotide
  Target: ATXN1; (-) strand; PAM type: YTN; PAM sequence: TTA
aaaagtcaggaaacaacagg

SEQ ID NO: 180760 - DNA, 20 bp, Artificial Sequence
  Description of Artificial Sequence: Synthetic oligonucleotide
  Target: ATXN1; (-) strand; PAM type: YTN; PAM sequence: TTA
gaatggcaatcattaaaaag

SEQ ID NO: 180761 - DNA, 20 bp, Artificial Sequence
  Description of Artificial Sequence: Synthetic oligonucleotide
  Target: ATXN1; (-) strand; PAM type: YTN; PAM sequence: CTC
acaccagttagaatggcaat

SEQ ID NO: 180762 - DNA, 20 bp, Artificial Sequence
  Description of Artificial Sequence: Synthetic oligonucleotide
  Target: ATXN1; (-) strand; PAM type: YTN; PAM sequence: CTG
gccatcagagaaatgcaaat

SEQ ID NO: 180763 - DNA, 20 bp, Artificial Sequence
  Description of Artificial Sequence: Synthetic oligonucleotide
  Target: ATXN1; (-) strand; PAM type: YTN; PAM sequence: CTC
atcatcactggccatcagag

SEQ ID NO: 180764 - DNA, 20 bp, Artificial Sequence
  Description of Artificial Sequence: Synthetic oligonucleotide
  Target: ATXN1; (-) strand; PAM type: YTN; PAM sequence: TTA
tgcagccaaaagacacgtga

SEQ ID NO: 180765 - DNA, 20 bp, Artificial Sequence
  Description of Artificial Sequence: Synthetic oligonucleotide
  Target: ATXN1; (-) strand; PAM type: YTN; PAM sequence: TTT
atgcagccaaaagacacgtg

SEQ ID NO: 180766 - DNA, 20 bp, Artificial Sequence
  Description of Artificial Sequence: Synthetic oligonucleotide
  Target: ATXN1; (-) strand; PAM type: YTN; PAM sequence: CTC
aaaagaagacatttatgcag

SEQ ID NO: 180767 - DNA, 20 bp, Artificial Sequence
  Description of Artificial Sequence: Synthetic oligonucleotide
  Target: ATXN1; (-) strand; PAM type: YTN; PAM sequence: TTC
tcaaaagaagacatttatgc

SEQ ID NO: 180768 - DNA, 20 bp, Artificial Sequence
  Description of Artificial Sequence: Synthetic oligonucleotide
  Target: ATXN1; (-) strand; PAM type: YTN; PAM sequence: CTT
ctcaaaagaagacatttatg

SEQ ID NO: 180769 - DNA, 20 bp, Artificial Sequence
  Description of Artificial Sequence: Synthetic oligonucleotide
  Target: ATXN1; (-) strand; PAM type: YTN; PAM sequence: TTA
acagacacttctcaaaagaa

SEQ ID NO: 180770 - DNA, 20 bp, Artificial Sequence
  Description of Artificial Sequence: Synthetic oligonucleotide
  Target: ATXN1; (-) strand; PAM type: YTN; PAM sequence: TTT
aacagacacttctcaaaaga

SEQ ID NO: 180771 - DNA, 20 bp, Artificial Sequence
  Description of Artificial Sequence: Synthetic oligonucleotide
  Target: ATXN1; (-) strand; PAM type: YTN; PAM sequence: TTA
tagaaatatcaaacacattt

SEQ ID NO: 180772 - DNA, 20 bp, Artificial Sequence
  Description of Artificial Sequence: Synthetic oligonucleotide
  Target: ATXN1; (-) strand; PAM type: YTN; PAM sequence: TTG
tgttatagaaatatcaaaca

SEQ ID NO: 180773 - DNA, 20 bp, Artificial Sequence
  Description of Artificial Sequence: Synthetic oligonucleotide
  Target: ATXN1; (-) strand; PAM type: YTN; PAM sequence: TTT
gtgttatagaaatatcaaac

SEQ ID NO: 180774 - DNA, 20 bp, Artificial Sequence
  Description of Artificial Sequence: Synthetic oligonucleotide
  Target: ATXN1; (-) strand; PAM type: YTN; PAM sequence: CTT
tgtgttatagaaatatcaaa

SEQ ID NO: 180775 - DNA, 20 bp, Artificial Sequence
  Description of Artificial Sequence: Synthetic oligonucleotide
  Target: ATXN1; (-) strand; PAM type: YTN; PAM sequence: TTA
actttgtgttatagaaatat

SEQ ID NO: 180776 - DNA, 20 bp, Artificial Sequence
  Description of Artificial Sequence: Synthetic oligonucleotide
  Target: ATXN1; (-) strand; PAM type: YTN; PAM sequence: TTT
aactttgtgttatagaaata

SEQ ID NO: 180777 - DNA, 20 bp, Artificial Sequence
  Description of Artificial Sequence: Synthetic oligonucleotide
  Target: ATXN1; (-) strand; PAM type: YTN; PAM sequence: CTT
taactttgtgttatagaaat

SEQ ID NO: 180778 - DNA, 20 bp, Artificial Sequence
  Description of Artificial Sequence: Synthetic oligonucleotide
  Target: ATXN1; (-) strand; PAM type: YTN; PAM sequence: TTA
ccaaaggaactttaactttg

SEQ ID NO: 180779 - DNA, 20 bp, Artificial Sequence
  Description of Artificial Sequence: Synthetic oligonucleotide
  Target: ATXN1; (-) strand; PAM type: YTN; PAM sequence: CTG
ccaaattaccaaaggaactt

SEQ ID NO: 180780 - DNA, 20 bp, Artificial Sequence
  Description of Artificial Sequence: Synthetic oligonucleotide
  Target: ATXN1; (-) strand; PAM type: YTN; PAM sequence: TTG
agaaacactgccaaattacc

SEQ ID NO: 180781 - DNA, 20 bp, Artificial Sequence
  Description of Artificial Sequence: Synthetic oligonucleotide
  Target: ATXN1; (-) strand; PAM type: YTN; PAM sequence: TTT
gagaaacactgccaaattac

SEQ ID NO: 180782 - DNA, 20 bp, Artificial Sequence
  Description of Artificial Sequence: Synthetic oligonucleotide
  Target: ATXN1; (-) strand; PAM type: YTN; PAM sequence: CTG
tgggaaaccacatttgagaa

SEQ ID NO: 180783 - DNA, 20 bp, Artificial Sequence
  Description of Artificial Sequence: Synthetic oligonucleotide
  Target: ATXN1; (-) strand; PAM type: YTN; PAM sequence: TTA
acaggcaccccaaaggaagg

SEQ ID NO: 180784 - DNA, 20 bp, Artificial Sequence
  Description of Artificial Sequence: Synthetic oligonucleotide
  Target: ATXN1; (-) strand; PAM type: YTN; PAM sequence: TTT
aacaggcaccccaaaggaag

SEQ ID NO: 180785 - DNA, 20 bp, Artificial Sequence
  Description of Artificial Sequence: Synthetic oligonucleotide
  Target: ATXN1; (-) strand; PAM type: YTN; PAM sequence: TTT
taacaggcaccccaaaggaa

SEQ ID NO: 180786 - DNA, 20 bp, Artificial Sequence
  Description of Artificial Sequence: Synthetic oligonucleotide
  Target: ATXN1; (-) strand; PAM type: YTN; PAM sequence: CTG
atgtcaggaatgtgaatttt

SEQ ID NO: 180787 - DNA, 20 bp, Artificial Sequence
  Description of Artificial Sequence: Synthetic oligonucleotide
  Target: ATXN1; (-) strand; PAM type: YTN; PAM sequence: TTG
agaagtgccccgagtaagct

SEQ ID NO: 180788 - DNA, 20 bp, Artificial Sequence
  Description of Artificial Sequence: Synthetic oligonucleotide
  Target: ATXN1; (-) strand; PAM type: YTN; PAM sequence: TTT
gagaagtgccccgagtaagc

SEQ ID NO: 180789 - DNA, 20 bp, Artificial Sequence
  Description of Artificial Sequence: Synthetic oligonucleotide
  Target: ATXN1; (-) strand; PAM type: YTN; PAM sequence: TTT
tgagaagtgccccgagtaag

SEQ ID NO: 180790 - DNA, 20 bp, Artificial Sequence
  Description of Artificial Sequence: Synthetic oligonucleotide
  Target: ATXN1; (-) strand; PAM type: YTN; PAM sequence: TTC
aattttgagaagtgccccga

SEQ ID NO: 180791 - DNA, 20 bp, Artificial Sequence
  Description of Artificial Sequence: Synthetic oligonucleotide
  Target: ATXN1; (-) strand; PAM type: YTN; PAM sequence: TTT
caattttgagaagtgccccg

SEQ ID NO: 180792 - DNA, 20 bp, Artificial Sequence
  Description of Artificial Sequence: Synthetic oligonucleotide
  Target: ATXN1; (-) strand; PAM type: YTN; PAM sequence: CTT
tcaattttgagaagtgcccc

SEQ ID NO: 180793 - DNA, 20 bp, Artificial Sequence
  Description of Artificial Sequence: Synthetic oligonucleotide
  Target: ATXN1; (-) strand; PAM type: YTN; PAM sequence: TTG
ggcagctttcaattttgaga

SEQ ID NO: 180794 - DNA, 20 bp, Artificial Sequence
  Description of Artificial Sequence: Synthetic oligonucleotide
  Target: ATXN1; (-) strand; PAM type: YTN; PAM sequence: CTG
gggttgggcagctttcaatt

SEQ ID NO: 180795 - DNA, 20 bp, Artificial Sequence
  Description of Artificial Sequence: Synthetic oligonucleotide
  Target: ATXN1; (-) strand; PAM type: YTN; PAM sequence: TTC
acaaatctggggttgggcag

SEQ ID NO: 180796 - DNA, 20 bp, Artificial Sequence
  Description of Artificial Sequence: Synthetic oligonucleotide
  Target: ATXN1; (-) strand; PAM type: YTN; PAM sequence: CTG
attcacaaatctggggttgg

SEQ ID NO: 180797 - DNA, 20 bp, Artificial Sequence
  Description of Artificial Sequence: Synthetic oligonucleotide
  Target: ATXN1; (-) strand; PAM type: YTN; PAM sequence: TTC
tgattcacaaatctggggtt

SEQ ID NO: 180798 - DNA, 20 bp, Artificial Sequence
  Description of Artificial Sequence: Synthetic oligonucleotide
  Target: ATXN1; (-) strand; PAM type: YTN; PAM sequence: CTC
ccaggaattctgattcacaa

SEQ ID NO: 180799 - DNA, 20 bp, Artificial Sequence
  Description of Artificial Sequence: Synthetic oligonucleotide
  Target: ATXN1; (-) strand; PAM type: YTN; PAM sequence: TTC
actcccaggaattctgattc

SEQ ID NO: 180800 - DNA, 20 bp, Artificial Sequence
  Description of Artificial Sequence: Synthetic oligonucleotide
  Target: ATXN1; (-) strand; PAM type: YTN; PAM sequence: CTT
cactcccaggaattctgatt

SEQ ID NO: 180801 - DNA, 20 bp, Artificial Sequence
  Description of Artificial Sequence: Synthetic oligonucleotide
  Target: ATXN1; (-) strand; PAM type: YTN; PAM sequence: CTG
ggcttcactcccaggaattc

SEQ ID NO: 180802 - DNA, 20 bp, Artificial Sequence
  Description of Artificial Sequence: Synthetic oligonucleotide
  Target: ATXN1; (-) strand; PAM type: YTN; PAM sequence: TTC
tgggcttcactcccaggaat

SEQ ID NO: 180803 - DNA, 20 bp, Artificial Sequence
  Description of Artificial Sequence: Synthetic oligonucleotide
  Target: ATXN1; (-) strand; PAM type: YTN; PAM sequence: TTT
ctgggcttcactcccaggaa

SEQ ID NO: 180804 - DNA, 20 bp, Artificial Sequence
  Description of Artificial Sequence: Synthetic oligonucleotide
  Target: ATXN1; (-) strand; PAM type: YTN; PAM sequence: TTT
tctgggcttcactcccagga

SEQ ID NO: 180805 - DNA, 20 bp, Artificial Sequence
  Description of Artificial Sequence: Synthetic oligonucleotide
  Target: ATXN1; (-) strand; PAM type: YTN; PAM sequence: CTG
tatgtaaaatacagttttct

SEQ ID NO: 180806 - DNA, 20 bp, Artificial Sequence
  Description of Artificial Sequence: Synthetic oligonucleotide
  Target: ATXN1; (-) strand; PAM type: YTN; PAM sequence: CTG
catactgtatgtaaaataca

SEQ ID NO: 180807 - DNA, 20 bp, Artificial Sequence
  Description of Artificial Sequence: Synthetic oligonucleotide
  Target: ATXN1; (-) strand; PAM type: YTN; PAM sequence: CTA
cctgcatactgtatgtaaaa

SEQ ID NO: 180808 - DNA, 20 bp, Artificial Sequence
  Description of Artificial Sequence: Synthetic oligonucleotide
  Target: ATXN1; (-) strand; PAM type: YTN; PAM sequence: CTA
aagcaaaatggagtgtgcag

SEQ ID NO: 180809 - DNA, 20 bp, Artificial Sequence
  Description of Artificial Sequence: Synthetic oligonucleotide
  Target: ATXN1; (-) strand; PAM type: YTN; PAM sequence: TTC
atgcaaatgactaaagcaaa

SEQ ID NO: 180810 - DNA, 20 bp, Artificial Sequence
  Description of Artificial Sequence: Synthetic oligonucleotide
  Target: ATXN1; (-) strand; PAM type: YTN; PAM sequence: TTT
catgcaaatgactaaagcaa

SEQ ID NO: 180811 - DNA, 20 bp, Artificial Sequence
  Description of Artificial Sequence: Synthetic oligonucleotide
  Target: ATXN1; (-) strand; PAM type: YTN; PAM sequence: TTA
tttcatgcaaatgactaaag

SEQ ID NO: 180812 - DNA, 20 bp, Artificial Sequence
  Description of Artificial Sequence: Synthetic oligonucleotide
  Target: ATXN1; (-) strand; PAM type: YTN; PAM sequence: TTT
atttcatgcaaatgactaaa

SEQ ID NO: 180813 - DNA, 20 bp, Artificial Sequence
  Description of Artificial Sequence: Synthetic oligonucleotide
  Target: ATXN1; (-) strand; PAM type: YTN; PAM sequence: TTG
aaaaagaaataatttatttc

SEQ ID NO: 180814 - DNA, 20 bp, Artificial Sequence
  Description of Artificial Sequence: Synthetic oligonucleotide
  Target: ATXN1; (-) strand; PAM type: YTN; PAM sequence: TTT
gaaaaagaaataatttattt

SEQ ID NO: 180815 - DNA, 20 bp, Artificial Sequence
  Description of Artificial Sequence: Synthetic oligonucleotide
  Target: ATXN1; (-) strand; PAM type: YTN; PAM sequence: CTT
tgaaaaagaaataatttatt

SEQ ID NO: 180816 - DNA, 20 bp, Artificial Sequence
  Description of Artificial Sequence: Synthetic oligonucleotide
  Target: ATXN1; (-) strand; PAM type: YTN; PAM sequence: TTA
aaccctttgaaaaagaaata

SEQ ID NO: 180817 - DNA, 20 bp, Artificial Sequence
  Description of Artificial Sequence: Synthetic oligonucleotide
  Target: ATXN1; (-) strand; PAM type: YTN; PAM sequence: CTG
ttaaaccctttgaaaaagaa

SEQ ID NO: 180818 - DNA, 20 bp, Artificial Sequence
  Description of Artificial Sequence: Synthetic oligonucleotide
  Target: ATXN1; (-) strand; PAM type: YTN; PAM sequence: TTA
actgttaaaccctttgaaaa

SEQ ID NO: 180819 - DNA, 20 bp, Artificial Sequence
  Description of Artificial Sequence: Synthetic oligonucleotide
  Target: ATXN1; (-) strand; PAM type: YTN; PAM sequence: TTT
aactgttaaaccctttgaaa

SEQ ID NO: 180820 - DNA, 20 bp, Artificial Sequence
  Description of Artificial Sequence: Synthetic oligonucleotide
  Target: ATXN1; (-) strand; PAM type: YTN; PAM sequence: TTA
gatttaactgttaaaccctt

SEQ ID NO: 180821 - DNA, 20 bp, Artificial Sequence
  Description of Artificial Sequence: Synthetic oligonucleotide
  Target: ATXN1; (-) strand; PAM type: YTN; PAM sequence: TTT
agatttaactgttaaaccct

SEQ ID NO: 180822 - DNA, 20 bp, Artificial Sequence
  Description of Artificial Sequence: Synthetic oligonucleotide
  Target: ATXN1; (-) strand; PAM type: YTN; PAM sequence: CTT
tagatttaactgttaaaccc

SEQ ID NO: 180823 - DNA, 20 bp, Artificial Sequence
  Description of Artificial Sequence: Synthetic oligonucleotide
  Target: ATXN1; (-) strand; PAM type: YTN; PAM sequence: TTA
atagaaaaaaaactttagat

SEQ ID NO: 180824 - DNA, 20 bp, Artificial Sequence
  Description of Artificial Sequence: Synthetic oligonucleotide
  Target: ATXN1; (-) strand; PAM type: YTN; PAM sequence: TTT
aatagaaaaaaaactttaga

SEQ ID NO: 180825 - DNA, 20 bp, Artificial Sequence
  Description of Artificial Sequence: Synthetic oligonucleotide
  Target: ATXN1; (-) strand; PAM type: YTN; PAM sequence: CTT
taatagaaaaaaaactttag

SEQ ID NO: 180826 - DNA, 20 bp, Artificial Sequence
  Description of Artificial Sequence: Synthetic oligonucleotide
  Target: ATXN1; (-) strand; PAM type: YTN; PAM sequence: TTC
ctttaatagaaaaaaaactt

SEQ ID NO: 180827 - DNA, 20 bp, Artificial Sequence
  Description of Artificial Sequence: Synthetic oligonucleotide
  Target: ATXN1; (-) strand; PAM type: YTN; PAM sequence: CTG
taaagttcctttaatagaaa

SEQ ID NO: 180828 - DNA, 20 bp, Artificial Sequence
  Description of Artificial Sequence: Synthetic oligonucleotide
  Target: ATXN1; (-) strand; PAM type: YTN; PAM sequence: TTA
ggtcactgtaaagttccttt

SEQ ID NO: 180829 - DNA, 20 bp, Artificial Sequence
  Description of Artificial Sequence: Synthetic oligonucleotide
  Target: ATXN1; (-) strand; PAM type: YTN; PAM sequence: TTT
aggtcactgtaaagttcctt

SEQ ID NO: 180830 - DNA, 20 bp, Artificial Sequence
  Description of Artificial Sequence: Synthetic oligonucleotide
  Target: ATXN1; (-) strand; PAM type: YTN; PAM sequence: TTT
taggtcactgtaaagttcct

SEQ ID NO: 180831 - DNA, 20 bp, Artificial Sequence
  Description of Artificial Sequence: Synthetic oligonucleotide
  Target: ATXN1; (-) strand; PAM type: YTN; PAM sequence: TTA
cagaaatgaaacaacaacat

SEQ ID NO: 180832 - DNA, 20 bp, Artificial Sequence
  Description of Artificial Sequence: Synthetic oligonucleotide
  Target: ATXN1; (-) strand; PAM type: YTN; PAM sequence: TTT
acagaaatgaaacaacaaca

SEQ ID NO: 180833 - DNA, 20 bp, Artificial Sequence
  Description of Artificial Sequence: Synthetic oligonucleotide
  Target: ATXN1; (-) strand; PAM type: YTN; PAM sequence: TTT
tacagaaatgaaacaacaac

SEQ ID NO: 180834 - DNA, 20 bp, Artificial Sequence
  Description of Artificial Sequence: Synthetic oligonucleotide
  Target: ATXN1; (-) strand; PAM type: YTN; PAM sequence: TTG
atagatgacaccaacaggat

SEQ ID NO: 180835 - DNA, 20 bp, Artificial Sequence
  Description of Artificial Sequence: Synthetic oligonucleotide
  Target: ATXN1; (-) strand; PAM type: YTN; PAM sequence: TTG
ttgatagatgacaccaacag

SEQ ID NO: 180836 - DNA, 20 bp, Artificial Sequence
  Description of Artificial Sequence: Synthetic oligonucleotide
  Target: ATXN1; (-) strand; PAM type: YTN; PAM sequence: CTT
gttgatagatgacaccaaca

SEQ ID NO: 180837 - DNA, 20 bp, Artificial Sequence
  Description of Artificial Sequence: Synthetic oligonucleotide
  Target: ATXN1; (-) strand; PAM type: YTN; PAM sequence: CTA
tgtacttgttgatagatgac

SEQ ID NO: 180838 - DNA, 20 bp, Artificial Sequence
  Description of Artificial Sequence: Synthetic oligonucleotide
  Target: ATXN1; (-) strand; PAM type: YTN; PAM sequence: TTA
agactatgtacttgttgata

SEQ ID NO: 180839 - DNA, 20 bp, Artificial Sequence
  Description of Artificial Sequence: Synthetic oligonucleotide
  Target: ATXN1; (-) strand; PAM type: YTN; PAM sequence: TTT
aagactatgtacttgttgat

SEQ ID NO: 180840 - DNA, 20 bp, Artificial Sequence
  Description of Artificial Sequence: Synthetic oligonucleotide
  Target: ATXN1; (-) strand; PAM type: YTN; PAM sequence: TTT
taagactatgtacttgttga

SEQ ID NO: 180841 - DNA, 20 bp, Artificial Sequence
  Description of Artificial Sequence: Synthetic oligonucleotide
  Target: ATXN1; (-) strand; PAM type: YTN; PAM sequence: CTC
ccataataaaaattttaaga

SEQ ID NO: 180842 - DNA, 20 bp, Artificial Sequence
  Description of Artificial Sequence: Synthetic oligonucleotide
  Target: ATXN1; (-) strand; PAM type: YTN; PAM sequence: TTC
tcccataataaaaattttaa

SEQ ID NO: 180843 - DNA, 20 bp, Artificial Sequence
  Description of Artificial Sequence: Synthetic oligonucleotide
  Target: ATXN1; (-) strand; PAM type: YTN; PAM sequence: TTT
ctcccataataaaaatttta

SEQ ID NO: 180844 - DNA, 20 bp, Artificial Sequence
  Description of Artificial Sequence: Synthetic oligonucleotide
  Target: ATXN1; (-) strand; PAM type: YTN; PAM sequence: CTT
tctcccataataaaaatttt

SEQ ID NO: 180845 - DNA, 20 bp, Artificial Sequence
  Description of Artificial Sequence: Synthetic oligonucleotide
  Target: ATXN1; (-) strand; PAM type: YTN; PAM sequence: CTG
atccctttctcccataataa

SEQ ID NO: 180846 - DNA, 20 bp, Artificial Sequence
  Description of Artificial Sequence: Synthetic oligonucleotide
  Target: ATXN1; (-) strand; PAM type: YTN; PAM sequence: CTG
tagagagtatggtctgatcc

SEQ ID NO: 180847 - DNA, 20 bp, Artificial Sequence
  Description of Artificial Sequence: Synthetic oligonucleotide
  Target: ATXN1; (-) strand; PAM type: YTN; PAM sequence: CTC
agcaaactgtagagagtatg

SEQ ID NO: 180848 - DNA, 20 bp, Artificial Sequence
  Description of Artificial Sequence: Synthetic oligonucleotide
  Target: ATXN1; (-) strand; PAM type: YTN; PAM sequence: TTA
accacacgctcagcaaactg

SEQ ID NO: 180849 - DNA, 20 bp, Artificial Sequence
  Description of Artificial Sequence: Synthetic oligonucleotide
  Target: ATXN1; (-) strand; PAM type: YTN; PAM sequence: TTA
ttaaccacacgctcagcaaa

SEQ ID NO: 180850 - DNA, 20 bp, Artificial Sequence
  Description of Artificial Sequence: Synthetic oligonucleotide
  Target: ATXN1; (-) strand; PAM type: YTN; PAM sequence: TTT
attaaccacacgctcagcaa

SEQ ID NO: 180851 - DNA, 20 bp, Artificial Sequence
  Description of Artificial Sequence: Synthetic oligonucleotide
  Target: ATXN1; (-) strand; PAM type: YTN; PAM sequence: CTA
gtttattaaccacacgctca

SEQ ID NO: 180852 - DNA, 20 bp, Artificial Sequence
  Description of Artificial Sequence: Synthetic oligonucleotide
  Target: ATXN1; (-) strand; PAM type: YTN; PAM sequence: CTC
tagtttattaaccacacgct

SEQ ID NO: 180853 - DNA, 20 bp, Artificial Sequence
  Description of Artificial Sequence: Synthetic oligonucleotide
  Target: ATXN1; (-) strand; PAM type: YTN; PAM sequence: TTC
ctctagtttattaaccacac

SEQ ID NO: 180854 - DNA, 20 bp, Artificial Sequence
  Description of Artificial Sequence: Synthetic oligonucleotide
  Target: ATXN1; (-) strand; PAM type: YTN; PAM sequence: TTT
cctctagtttattaaccaca

SEQ ID NO: 180855 - DNA, 20 bp, Artificial Sequence
  Description of Artificial Sequence: Synthetic oligonucleotide
  Target: ATXN1; (-) strand; PAM type: YTN; PAM sequence: CTA
tttcctctagtttattaacc

SEQ ID NO: 180856 - DNA, 20 bp, Artificial Sequence
  Description of Artificial Sequence: Synthetic oligonucleotide
  Target: ATXN1; (-) strand; PAM type: YTN; PAM sequence: CTA
ggctatttcctctagtttat

SEQ ID NO: 180857 - DNA, 20 bp, Artificial Sequence
  Description of Artificial Sequence: Synthetic oligonucleotide
  Target: ATXN1; (-) strand; PAM type: YTN; PAM sequence: CTC
taggctatttcctctagttt

SEQ ID NO: 180858 - DNA, 20 bp, Artificial Sequence
  Description of Artificial Sequence: Synthetic oligonucleotide
  Target: ATXN1; (-) strand; PAM type: YTN; PAM sequence: TTA
ctctaggctatttcctctag

SEQ ID NO: 180859 - DNA, 20 bp, Artificial Sequence
  Description of Artificial Sequence: Synthetic oligonucleotide
  Target: ATXN1; (-) strand; PAM type: YTN; PAM sequence: TTC
atccatgttactctaggcta

SEQ ID NO: 180860 - DNA, 20 bp, Artificial Sequence
  Description of Artificial Sequence: Synthetic oligonucleotide
  Target: ATXN1; (-) strand; PAM type: YTN; PAM sequence: CTT
catccatgttactctaggct

SEQ ID NO: 180861 - DNA, 20 bp, Artificial Sequence
  Description of Artificial Sequence: Synthetic oligonucleotide
  Target: ATXN1; (-) strand; PAM type: YTN; PAM sequence: CTG
tagcttcatccatgttactc

SEQ ID NO: 180862 - DNA, 20 bp, Artificial Sequence
  Description of Artificial Sequence: Synthetic oligonucleotide
  Target: ATXN1; (-) strand; PAM type: YTN; PAM sequence: TTC
tgtagcttcatccatgttac

SEQ ID NO: 180863 - DNA, 20 bp, Artificial Sequence
  Description of Artificial Sequence: Synthetic oligonucleotide
  Target: ATXN1; (-) strand; PAM type: YTN; PAM sequence: TTT
ctgtagcttcatccatgtta

SEQ ID NO: 180864 - DNA, 20 bp, Artificial Sequence
  Description of Artificial Sequence: Synthetic oligonucleotide
  Target: ATXN1; (-) strand; PAM type: YTN; PAM sequence: TTC
catacaaaaggcacatttct

SEQ ID NO: 180865 - DNA, 20 bp, Artificial Sequence
  Description of Artificial Sequence: Synthetic oligonucleotide
  Target: ATXN1; (-) strand; PAM type: YTN; PAM sequence: CTT
ccatacaaaaggcacatttc

SEQ ID NO: 180866 - DNA, 20 bp, Artificial Sequence
  Description of Artificial Sequence: Synthetic oligonucleotide
  Target: ATXN1; (-) strand; PAM type: YTN; PAM sequence: CTG
tcaccaagcatgtcttccat

SEQ ID NO: 180867 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaagcatgtcttcc

SEQ ID NO: 180868 - DNA, 20 bp, Artificial Sequence
  Description of Artificial Sequence: Synthetic oligonucleotide
  Target: ATXN1; (-) strand; PAM type: YTN; PAM sequence: TTC
tctgtcaccaagcatgtctt

SEQ ID NO: 180869 - DNA, 20 bp, Artificial Sequence
  Description of Artificial Sequence: Synthetic oligonucleotide
  Target: ATXN1; (-) strand; PAM type: YTN; PAM sequence: CTT
ctctgtcaccaagcatgtct

SEQ ID NO: 180870 - DNA, 20 bp, Artificial Sequence
  Description of Artificial Sequence: Synthetic oligonucleotide
  Target: ATXN1; (-) strand; PAM type: YTN; PAM sequence: TTA
tcttctctgtcaccaagcat

SEQ ID NO: 180871 - DNA, 20 bp, Artificial Sequence
  Description of Artificial Sequence: Synthetic oligonucleotide
  Target: ATXN1; (-) strand; PAM type: YTN; PAM sequence: CTT
atcttctctgtcaccaagca

SEQ ID NO: 180872 - DNA, 20 bp, Artificial Sequence
  Description of Artificial Sequence: Synthetic oligonucleotide
  Target: ATXN1; (-) strand; PAM type: YTN; PAM sequence: TTA
aaaatgcaaacttatcttct

SEQ ID NO: 180873 - DNA, 20 bp, Artificial Sequence
  Description of Artificial Sequence: Synthetic oligonucleotide
  Target: ATXN1; (-) strand; PAM type: YTN; PAM sequence: TTT
aaaaatgcaaacttatcttc

SEQ ID NO: 180874 - DNA, 20 bp, Artificial Sequence
  Description of Artificial Sequence: Synthetic oligonucleotide
  Target: ATXN1; (-) strand; PAM type: YTN; PAM sequence: TTT
taaaaatgcaaacttatctt

SEQ ID NO: 180875 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatgcaaacttatct

SEQ ID NO: 180876 - DNA, 20 bp, Artificial Sequence
  Description of Artificial Sequence: Synthetic oligonucleotide
  Target: ATXN1; (-) strand; PAM type: YTN; PAM sequence: TTT
tttaaaaatgcaaacttatc

SEQ ID NO: 180877 - DNA, 20 bp, Artificial Sequence
  Description of Artificial Sequence: Synthetic oligonucleotide
  Target: ATXN1; (-) strand; PAM type: YTN; PAM sequence: CTT
ttttaaaaatgcaaacttat

SEQ ID NO: 180878 - DNA, 20 bp, Artificial Sequence
  Description of Artificial Sequence: Synthetic oligonucleotide
  Target: ATXN1; (-) strand; PAM type: YTN; PAM sequence: TTC
aaatcacttttttaaaaatg

SEQ ID NO: 180879 - DNA, 20 bp, Artificial Sequence
  Description of Artificial Sequence: Synthetic oligonucleotide
  Target: ATXN1; (-) strand; PAM type: YTN; PAM sequence: CTG
agttcaaatcacttttttaa

SEQ ID NO: 180880 - DNA, 20 bp, Artificial Sequence
  Description of Artificial Sequence: Synthetic oligonucleotide
  Target: ATXN1; (-) strand; PAM type: YTN; PAM sequence: CTA
tagctgagttcaaatcactt

SEQ ID NO: 180881 - DNA, 20 bp, Artificial Sequence
  Description of Artificial Sequence: Synthetic oligonucleotide
  Target: ATXN1; (-) strand; PAM type: YTN; PAM sequence: CTA
atgctatagctgagttcaaa

SEQ ID NO: 180882 - DNA, 20 bp, Artificial Sequence
  Description of Artificial Sequence: Synthetic oligonucleotide
  Target: ATXN1; (-) strand; PAM type: YTN; PAM sequence: CTG
ggaatatatgctaatgctat

SEQ ID NO: 180883 - DNA, 20 bp, Artificial Sequence
  Description of Artificial Sequence: Synthetic oligonucleotide
  Target: ATXN1; (-) strand; PAM type: YTN; PAM sequence: TTG
tataatctgggaatatatgc

SEQ ID NO: 180884 - DNA, 20 bp, Artificial Sequence
  Description of Artificial Sequence: Synthetic oligonucleotide
  Target: ATXN1; (-) strand; PAM type: YTN; PAM sequence: CTA
ggaatagttgtataatctgg

SEQ ID NO: 180885 - DNA, 20 bp, Artificial Sequence
  Description of Artificial Sequence: Synthetic oligonucleotide
  Target: ATXN1; (-) strand; PAM type: YTN; PAM sequence: TTG
tgagtctaggaatagttgta

SEQ ID NO: 180886 - DNA, 20 bp, Artificial Sequence
  Description of Artificial Sequence: Synthetic oligonucleotide
  Target: ATXN1; (-) strand; PAM type: YTN; PAM sequence: CTT
gtgagtctaggaatagttgt

SEQ ID NO: 180887 - DNA, 20 bp, Artificial Sequence
  Description of Artificial Sequence: Synthetic oligonucleotide
  Target: ATXN1; (-) strand; PAM type: YTN; PAM sequence: TTG
gaaaatagtgcttgtgagtc

SEQ ID NO: 180888 - DNA, 20 bp, Artificial Sequence
  Description of Artificial Sequence: Synthetic oligonucleotide
  Target: ATXN1; (-) strand; PAM type: YTN; PAM sequence: TTT
ggaaaatagtgcttgtgagt

SEQ ID NO: 180889 - DNA, 20 bp, Artificial Sequence
  Description of Artificial Sequence: Synthetic oligonucleotide
  Target: ATXN1; (-) strand; PAM type: YTN; PAM sequence: TTT
tggaaaatagtgcttgtgag

SEQ ID NO: 180890 - DNA, 20 bp, Artificial Sequence
  Description of Artificial Sequence: Synthetic oligonucleotide
  Target: ATXN1; (-) strand; PAM type: YTN; PAM sequence: TTT
ttggaaaatagtgcttgtga

SEQ ID NO: 180891 - DNA, 20 bp, Artificial Sequence
  Description of Artificial Sequence: Synthetic oligonucleotide
  Target: ATXN1; (-) strand; PAM type: YTN; PAM sequence: CTT
tttggaaaatagtgcttgtg

SEQ ID NO: 180892 - DNA, 20 bp, Artificial Sequence
  Description of Artificial Sequence: Synthetic oligonucleotide
  Target: ATXN1; (-) strand; PAM type: YTN; PAM sequence: TTC
tttttggaaaatagtgcttg

SEQ ID NO: 180893 - DNA, 20 bp, Artificial Sequence
  Description of Artificial Sequence: Synthetic oligonucleotide
  Target: ATXN1; (-) strand; PAM type: YTN; PAM sequence: TTA
aggataagggacacattctt

SEQ ID NO: 180894 - DNA, 20 bp, Artificial Sequence
  Description of Artificial Sequence: Synthetic oligonucleotide
  Target: ATXN1; (-) strand; PAM type: YTN; PAM sequence: CTG
tgtgttaaggataagggaca

SEQ ID NO: 180895 - DNA, 20 bp, Artificial Sequence
  Description of Artificial Sequence: Synthetic oligonucleotide
  Target: ATXN1; (-) strand; PAM type: YTN; PAM sequence: TTC
tgtgtgttaaggataaggga

SEQ ID NO: 180896 - DNA, 20 bp, Artificial Sequence
  Description of Artificial Sequence: Synthetic oligonucleotide
  Target: ATXN1; (-) strand; PAM type: YTN; PAM sequence: TTA
tgttctgtgtgttaaggata

SEQ ID NO: 180897 - DNA, 20 bp, Artificial Sequence
  Description of Artificial Sequence: Synthetic oligonucleotide
  Target: ATXN1; (-) strand; PAM type: YTN; PAM sequence: TTA
gaaagaattatgttctgtgt

SEQ ID NO: 180898 - DNA, 20 bp, Artificial Sequence
  Description of Artificial Sequence: Synthetic oligonucleotide
  Target: ATXN1; (-) strand; PAM type: YTN; PAM sequence: CTA
tcattagaaagaattatgtt

SEQ ID NO: 180899 - DNA, 20 bp, Artificial Sequence
  Description of Artificial Sequence: Synthetic oligonucleotide
  Target: ATXN1; (-) strand; PAM type: YTN; PAM sequence: CTA
gtgataagcactatcattag

SEQ ID NO: 180900 - DNA, 20 bp, Artificial Sequence
  Description of Artificial Sequence: Synthetic oligonucleotide
  Target: ATXN1; (-) strand; PAM type: YTN; PAM sequence: TTC
tagtgataagcactatcatt

SEQ ID NO: 180901 - DNA, 20 bp, Artificial Sequence
  Description of Artificial Sequence: Synthetic oligonucleotide
  Target: ATXN1; (-) strand; PAM type: YTN; PAM sequence: CTT
ctagtgataagcactatcat

SEQ ID NO: 180902 - DNA, 20 bp, Artificial Sequence
  Description of Artificial Sequence: Synthetic oligonucleotide
  Target: ATXN1; (-) strand; PAM type: YTN; PAM sequence: CTG
gcttctagtgataagcacta

SEQ ID NO: 180903 - DNA, 20 bp, Artificial Sequence
  Description of Artificial Sequence: Synthetic oligonucleotide
  Target: ATXN1; (-) strand; PAM type: YTN; PAM sequence: CTC
tggcttctagtgataagcac

SEQ ID NO: 180904 - DNA, 20 bp, Artificial Sequence
  Description of Artificial Sequence: Synthetic oligonucleotide
  Target: ATXN1; (-) strand; PAM type: YTN; PAM sequence: TTC
aacaagcctctggcttctag

SEQ ID NO: 180905 - DNA, 20 bp, Artificial Sequence
  Description of Artificial Sequence: Synthetic oligonucleotide
  Target: ATXN1; (-) strand; PAM type: YTN; PAM sequence: CTG
agtcattcaacaagcctctg

SEQ ID NO: 180906 - DNA, 20 bp, Artificial Sequence
  Description of Artificial Sequence: Synthetic oligonucleotide
  Target: ATXN1; (-) strand; PAM type: YTN; PAM sequence: TTC
cagggaaactgagtcattca

SEQ ID NO: 180907 - DNA, 20 bp, Artificial Sequence
  Description of Artificial Sequence: Synthetic oligonucleotide
  Target: ATXN1; (-) strand; PAM type: YTN; PAM sequence: TTT
ccagggaaactgagtcattc

SEQ ID NO: 180908 - DNA, 20 bp, Artificial Sequence
  Description of Artificial Sequence: Synthetic oligonucleotide
  Target: ATXN1; (-) strand; PAM type: YTN; PAM sequence: CTT
tccagggaaactgagtcatt

SEQ ID NO: 180909 - DNA, 20 bp, Artificial Sequence
  Description of Artificial Sequence: Synthetic oligonucleotide
  Target: ATXN1; (-) strand; PAM type: YTN; PAM sequence: TTA
ctttccagggaaactgagtc

SEQ ID NO: 180910 - DNA, 20 bp, Artificial Sequence
  Description of Artificial Sequence: Synthetic oligonucleotide
  Target: ATXN1; (-) strand; PAM type: YTN; PAM sequence: TTT
actttccagggaaactgagt

SEQ ID NO: 180911 - DNA, 20 bp, Artificial Sequence
  Description of Artificial Sequence: Synthetic oligonucleotide
  Target: ATXN1; (-) strand; PAM type: YTN; PAM sequence: CTA
tatttactttccagggaaac

SEQ ID NO: 180912 - DNA, 20 bp, Artificial Sequence
  Description of Artificial Sequence: Synthetic oligonucleotide
  Target: ATXN1; (-) strand; PAM type: YTN; PAM sequence: CTG
tcatcccggtacactatatt

SEQ ID NO: 180913 - DNA, 20 bp, Artificial Sequence
  Description of Artificial Sequence: Synthetic oligonucleotide
  Target: ATXN1; (-) strand; PAM type: YTN; PAM sequence: TTG
tctgtcatcccggtacacta

SEQ ID NO: 180914 - DNA, 20 bp, Artificial Sequence
  Description of Artificial Sequence: Synthetic oligonucleotide
  Target: ATXN1; (-) strand; PAM type: YTN; PAM sequence: CTG
attgtctgtcatcccggtac

SEQ ID NO: 180915 - DNA, 20 bp, Artificial Sequence
  Description of Artificial Sequence: Synthetic oligonucleotide
  Target: ATXN1; (-) strand; PAM type: YTN; PAM sequence: TTC
tgattgtctgtcatcccggt

SEQ ID NO: 180916 - DNA, 20 bp, Artificial Sequence
  Description of Artificial Sequence: Synthetic oligonucleotide
  Target: ATXN1; (-) strand; PAM type: YTN; PAM sequence: TTT
ctgattgtctgtcatcccgg

SEQ ID NO: 180917 - DNA, 20 bp, Artificial Sequence
  Description of Artificial Sequence: Synthetic oligonucleotide
  Target: ATXN1; (-) strand; PAM type: YTN; PAM sequence: CTG
tttctgattgtctgtcatcc

SEQ ID NO: 180918 - DNA, 20 bp, Artificial Sequence
  Description of Artificial Sequence: Synthetic oligonucleotide
  Target: ATXN1; (-) strand; PAM type: YTN; PAM sequence: TTG
atgtctgtttctgattgtct

SEQ ID NO: 180919 - DNA, 20 bp, Artificial Sequence
  Description of Artificial Sequence: Synthetic oligonucleotide
  Target: ATXN1; (-) strand; PAM type: YTN; PAM sequence: CTA
ttgatgtctgtttctgattg

SEQ ID NO: 180920 - DNA, 20 bp, Artificial Sequence
  Description of Artificial Sequence: Synthetic oligonucleotide
  Target: ATXN1; (-) strand; PAM type: YTN; PAM sequence: TTG
ctattgatgtctgtttctga

SEQ ID NO: 180921 - DNA, 20 bp, Artificial Sequence
  Description of Artificial Sequence: Synthetic oligonucleotide
  Target: ATXN1; (-) strand; PAM type: YTN; PAM sequence: TTT
gctattgatgtctgtttctg

SEQ ID NO: 180922 - DNA, 20 bp, Artificial Sequence
  Description of Artificial Sequence: Synthetic oligonucleotide
  Target: ATXN1; (-) strand; PAM type: YTN; PAM sequence: CTT
tgctattgatgtctgtttct

SEQ ID NO: 180923 - DNA, 20 bp, Artificial Sequence
  Description of Artificial Sequence: Synthetic oligonucleotide
  Target: ATXN1; (-) strand; PAM type: YTN; PAM sequence: TTA
aaaaatacctttgctattga

SEQ ID NO: 180924 - DNA, 20 bp, Artificial Sequence
  Description of Artificial Sequence: Synthetic oligonucleotide
  Target: ATXN1; (-) strand; PAM type: YTN; PAM sequence: TTA
aaaaatacaattaaaaaata

SEQ ID NO: 180925 - DNA, 20 bp, Artificial Sequence
  Description of Artificial Sequence: Synthetic oligonucleotide
  Target: ATXN1; (-) strand; PAM type: YTN; PAM sequence: TTT
aaaaaatacaattaaaaaat

SEQ ID NO: 180926 - DNA, 20 bp, Artificial Sequence
  Description of Artificial Sequence: Synthetic oligonucleotide
  Target: ATXN1; (-) strand; PAM type: YTN; PAM sequence: TTT
taaaaaatacaattaaaaaa

SEQ ID NO: 180927 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaatacaattaaaaa

SEQ ID NO: 180928 - DNA, 20 bp, Artificial Sequence
  Description of Artificial Sequence: Synthetic oligonucleotide
  Target: ATXN1; (-) strand; PAM type: YTN; PAM sequence: TTA
aaaatttttaaaaaatacaa

SEQ ID NO: 180929 - DNA, 20 bp, Artificial Sequence
  Description of Artificial Sequence: Synthetic oligonucleotide
  Target: ATXN1; (-) strand; PAM type: YTN; PAM sequence: TTA
attaaaaatttttaaaaaat

SEQ ID NO: 180930 - DNA, 20 bp, Artificial Sequence
  Description of Artificial Sequence: Synthetic oligonucleotide
  Target: ATXN1; (-) strand; PAM type: YTN; PAM sequence: TTA
attaattaaaaatttttaaa

SEQ ID NO: 180931 - DNA, 20 bp, Artificial Sequence
  Description of Artificial Sequence: Synthetic oligonucleotide
  Target: ATXN1; (-) strand; PAM type: YTN; PAM sequence: CTC
aaaaaaattaattaattaaa

SEQ ID NO: 180932 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaattaattaat

SEQ ID NO: 180933 - DNA, 20 bp, Artificial Sequence
  Description of Artificial Sequence: Synthetic oligonucleotide
  Target: ATXN1; (-) strand; PAM type: YTN; PAM sequence: CTA
acgtgggtgacagaacgaga

SEQ ID NO: 180934 - DNA, 20 bp, Artificial Sequence
  Description of Artificial Sequence: Synthetic oligonucleotide
  Target: ATXN1; (-) strand; PAM type: YTN; PAM sequence: CTC
taacgtgggtgacagaacga

SEQ ID NO: 180935 - DNA, 20 bp, Artificial Sequence
  Description of Artificial Sequence: Synthetic oligonucleotide
  Target: ATXN1; (-) strand; PAM type: YTN; PAM sequence: CTG
cactctaacgtgggtgacag

SEQ ID NO: 180936 - DNA, 20 bp, Artificial Sequence
  Description of Artificial Sequence: Synthetic oligonucleotide
  Target: ATXN1; (-) strand; PAM type: YTN; PAM sequence: CTG
agatcatgccactgcactct

SEQ ID NO: 180937 - DNA, 20 bp, Artificial Sequence
  Description of Artificial Sequence: Synthetic oligonucleotide
  Target: ATXN1; (-) strand; PAM type: YTN; PAM sequence: TTG
cagtatgctgagatcatgcc

SEQ ID NO: 180938 - DNA, 20 bp, Artificial Sequence
  Description of Artificial Sequence: Synthetic oligonucleotide
  Target: ATXN1; (-) strand; PAM type: YTN; PAM sequence: TTG
aacccaagaggccaaggttg

SEQ ID NO: 180939 - DNA, 20 bp, Artificial Sequence
  Description of Artificial Sequence: Synthetic oligonucleotide
  Target: ATXN1; (-) strand; PAM type: YTN; PAM sequence: TTT
gaacccaagaggccaaggtt

SEQ ID NO: 180940 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatagtttgaa

SEQ ID NO: 180941 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggagaa

SEQ ID NO: 180942 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 180943 - DNA, 20 bp, Artificial Sequence
  Description of Artificial Sequence: Synthetic oligonucleotide
  Target: ATXN1; (-) strand; PAM type: YTN; PAM sequence: CTG
taataccagctactcaggag

SEQ ID NO: 180944 - DNA, 20 bp, Artificial Sequence
  Description of Artificial Sequence: Synthetic oligonucleotide
  Target: ATXN1; (-) strand; PAM type: YTN; PAM sequence: CTG
ggtgggtggtgggcacctgt

SEQ ID NO: 180945 - DNA, 20 bp, Artificial Sequence
  Description of Artificial Sequence: Synthetic oligonucleotide
  Target: ATXN1; (-) strand; PAM type: YTN; PAM sequence: TTA
gctgggtgggtggtgggcac

SEQ ID NO: 180946 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagctgg

SEQ ID NO: 180947 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 180948 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacccca

SEQ ID NO: 180949 - DNA, 20 bp, Artificial Sequence
  Description of Artificial Sequence: Synthetic oligonucleotide
  Target: ATXN1; (-) strand; PAM type: YTN; PAM sequence: TTG
agacaaacctggccaacatg

SEQ ID NO: 180950 - DNA, 20 bp, Artificial Sequence
  Description of Artificial Sequence: Synthetic oligonucleotide
  Target: ATXN1; (-) strand; PAM type: YTN; PAM sequence: TTT
gagacaaacctggccaacat

SEQ ID NO: 180951 - DNA, 20 bp, Artificial Sequence
  Description of Artificial Sequence: Synthetic oligonucleotide
  Target: ATXN1; (-) strand; PAM type: YTN; PAM sequence: TTG
aggccaggagtttgagacaa

SEQ ID NO: 180952 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagtttgagaca

SEQ ID NO: 180953 - DNA, 20 bp, Artificial Sequence
  Description of Artificial Sequence: Synthetic oligonucleotide
  Target: ATXN1; (-) strand; PAM type: YTN; PAM sequence: CTG
aggcaggtggatcacttgag

SEQ ID NO: 180954 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggtggat

SEQ ID NO: 180955 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaggtgga

SEQ ID NO: 180956 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaggtgg

SEQ ID NO: 180957 - DNA, 20 bp, Artificial Sequence
  Description of Artificial Sequence: Synthetic oligonucleotide
  Target: ATXN1; (-) strand; PAM type: YTN; PAM sequence: CTA
gcactttgggaggctgaggc

SEQ ID NO: 180958 - DNA, 20 bp, Artificial Sequence
  Description of Artificial Sequence: Synthetic oligonucleotide
  Target: ATXN1; (-) strand; PAM type: YTN; PAM sequence: CTA
atcctagcactttgggaggc

SEQ ID NO: 180959 - DNA, 20 bp, Artificial Sequence
  Description of Artificial Sequence: Synthetic oligonucleotide
  Target: ATXN1; (-) strand; PAM type: YTN; PAM sequence: TTC
taatcctagcactttgggag

SEQ ID NO: 180960 - DNA, 20 bp, Artificial Sequence
  Description of Artificial Sequence: Synthetic oligonucleotide
  Target: ATXN1; (-) strand; PAM type: YTN; PAM sequence: CTT
ctaatcctagcactttggga

SEQ ID NO: 180961 - DNA, 20 bp, Artificial Sequence
  Description of Artificial Sequence: Synthetic oligonucleotide
  Target: ATXN1; (-) strand; PAM type: YTN; PAM sequence: CTA
acacttctaatcctagcact

SEQ ID NO: 180962 - DNA, 20 bp, Artificial Sequence
  Description of Artificial Sequence: Synthetic oligonucleotide
  Target: ATXN1; (-) strand; PAM type: YTN; PAM sequence: TTG
ataaaaaataaaaataggca

SEQ ID NO: 180963 - DNA, 20 bp, Artificial Sequence
  Description of Artificial Sequence: Synthetic oligonucleotide
  Target: ATXN1; (-) strand; PAM type: YTN; PAM sequence: CTT
gataaaaaataaaaataggc

SEQ ID NO: 180964 - DNA, 20 bp, Artificial Sequence
  Description of Artificial Sequence: Synthetic oligonucleotide
  Target: ATXN1; (-) strand; PAM type: YTN; PAM sequence: CTG
ccttgataaaaaataaaaat

SEQ ID NO: 180965 - DNA, 20 bp, Artificial Sequence
  Description of Artificial Sequence: Synthetic oligonucleotide
  Target: ATXN1; (-) strand; PAM type: YTN; PAM sequence: TTC
tgccttgataaaaaataaaa

SEQ ID NO: 180966 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagtgcgattctg

SEQ ID NO: 180967 - DNA, 20 bp, Artificial Sequence
  Description of Artificial Sequence: Synthetic oligonucleotide
  Target: ATXN1; (-) strand; PAM type: YTN; PAM sequence: TTC
aaaaccagcctgggcaacat

SEQ ID NO: 180968 - DNA, 20 bp, Artificial Sequence
  Description of Artificial Sequence: Synthetic oligonucleotide
  Target: ATXN1; (-) strand; PAM type: YTN; PAM sequence: TTG
acgccagaagttcaaaacca

SEQ ID NO: 180969 - DNA, 20 bp, Artificial Sequence
  Description of Artificial Sequence: Synthetic oligonucleotide
  Target: ATXN1; (-) strand; PAM type: YTN; PAM sequence: CTT
gacgccagaagttcaaaacc

SEQ ID NO: 180970 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggtgggaggat

SEQ ID NO: 180971 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggtgggagga

SEQ ID NO: 180972 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggtgggagg

SEQ ID NO: 180973 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 180974 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 180975 - DNA, 20 bp, Artificial Sequence
  Description of Artificial Sequence: Synthetic oligonucleotide
  Target: ATXN1; (-) strand; PAM type: YTN; PAM sequence: TTA
ggccaggcgcagtagctcac

SEQ ID NO: 180976 - DNA, 20 bp, Artificial Sequence
  Description of Artificial Sequence: Synthetic oligonucleotide
  Target: ATXN1; (-) strand; PAM type: YTN; PAM sequence: CTA
ttaggccaggcgcagtagct

SEQ ID NO: 180977 - DNA, 20 bp, Artificial Sequence
  Description of Artificial Sequence: Synthetic oligonucleotide
  Target: ATXN1; (-) strand; PAM type: YTN; PAM sequence: TTG
ctattaggccaggcgcagta

SEQ ID NO: 180978 - DNA, 20 bp, Artificial Sequence
  Description of Artificial Sequence: Synthetic oligonucleotide
  Target: ATXN1; (-) strand; PAM type: YTN; PAM sequence: TTT
gctattaggccaggcgcagt

SEQ ID NO: 180979 - DNA, 20 bp, Artificial Sequence
  Description of Artificial Sequence: Synthetic oligonucleotide
  Target: ATXN1; (-) strand; PAM type: YTN; PAM sequence: CTT
tgctattaggccaggcgcag

SEQ ID NO: 180980 - DNA, 20 bp, Artificial Sequence
  Description of Artificial Sequence: Synthetic oligonucleotide
  Target: ATXN1; (-) strand; PAM type: YTN; PAM sequence: TTA
tcagcgcctttgctattagg

SEQ ID NO: 180981 - DNA, 20 bp, Artificial Sequence
  Description of Artificial Sequence: Synthetic oligonucleotide
  Target: ATXN1; (-) strand; PAM type: YTN; PAM sequence: TTT
atcagcgcctttgctattag

SEQ ID NO: 180982 - DNA, 20 bp, Artificial Sequence
  Description of Artificial Sequence: Synthetic oligonucleotide
  Target: ATXN1; (-) strand; PAM type: YTN; PAM sequence: TTT
tatcagcgcctttgctatta

SEQ ID NO: 180983 - DNA, 20 bp, Artificial Sequence
  Description of Artificial Sequence: Synthetic oligonucleotide
  Target: ATXN1; (-) strand; PAM type: YTN; PAM sequence: TTT
ttatcagcgcctttgctatt

SEQ ID NO: 180984 - DNA, 20 bp, Artificial Sequence
  Description of Artificial Sequence: Synthetic oligonucleotide
  Target: ATXN1; (-) strand; PAM type: YTN; PAM sequence: TTT
tttatcagcgcctttgctat

SEQ ID NO: 180985 - DNA, 20 bp, Artificial Sequence
  Description of Artificial Sequence: Synthetic oligonucleotide
  Target: ATXN1; (-) strand; PAM type: YTN; PAM sequence: TTT
ttttatcagcgcctttgcta

SEQ ID NO: 180986 - DNA, 20 bp, Artificial Sequence
  Description of Artificial Sequence: Synthetic oligonucleotide
  Target: ATXN1; (-) strand; PAM type: YTN; PAM sequence: TTT
tttttatcagcgcctttgct

SEQ ID NO: 180987 - DNA, 20 bp, Artificial Sequence
  Description of Artificial Sequence: Synthetic oligonucleotide
  Target: ATXN1; (-) strand; PAM type: YTN; PAM sequence: CTA
ttttttttatcagcgccttt

SEQ ID NO: 180988 - DNA, 20 bp, Artificial Sequence
  Description of Artificial Sequence: Synthetic oligonucleotide
  Target: ATXN1; (-) strand; PAM type: YTN; PAM sequence: CTC
ctattttttttatcagcgcc

SEQ ID NO: 180989 - DNA, 20 bp, Artificial Sequence
  Description of Artificial Sequence: Synthetic oligonucleotide
  Target: ATXN1; (-) strand; PAM type: YTN; PAM sequence: CTC
tcctattttttttatcagcg

SEQ ID NO: 180990 - DNA, 20 bp, Artificial Sequence
  Description of Artificial Sequence: Synthetic oligonucleotide
  Target: ATXN1; (-) strand; PAM type: YTN; PAM sequence: CTG
ctctcctattttttttatca

SEQ ID NO: 180991 - DNA, 20 bp, Artificial Sequence
  Description of Artificial Sequence: Synthetic oligonucleotide
  Target: ATXN1; (-) strand; PAM type: YTN; PAM sequence: TTC
tgctctcctattttttttat

SEQ ID NO: 180992 - DNA, 20 bp, Artificial Sequence
  Description of Artificial Sequence: Synthetic oligonucleotide
  Target: ATXN1; (-) strand; PAM type: YTN; PAM sequence: TTT
ctgctctcctatttttttta

SEQ ID NO: 180993 - DNA, 20 bp, Artificial Sequence
  Description of Artificial Sequence: Synthetic oligonucleotide
  Target: ATXN1; (-) strand; PAM type: YTN; PAM sequence: CTT
tctgctctcctatttttttt

SEQ ID NO: 180994 - DNA, 20 bp, Artificial Sequence
  Description of Artificial Sequence: Synthetic oligonucleotide
  Target: ATXN1; (-) strand; PAM type: YTN; PAM sequence: CTG
tccctttctgctctcctatt

SEQ ID NO: 180995 - DNA, 20 bp, Artificial Sequence
  Description of Artificial Sequence: Synthetic oligonucleotide
  Target: ATXN1; (-) strand; PAM type: YTN; PAM sequence: TTC
tgtccctttctgctctccta

SEQ ID NO: 180996 - DNA, 20 bp, Artificial Sequence
  Description of Artificial Sequence: Synthetic oligonucleotide
  Target: ATXN1; (-) strand; PAM type: YTN; PAM sequence: CTG
gttctgtccctttctgctct

SEQ ID NO: 180997 - DNA, 20 bp, Artificial Sequence
  Description of Artificial Sequence: Synthetic oligonucleotide
  Target: ATXN1; (-) strand; PAM type: YTN; PAM sequence: CTA
agtgctggttctgtcccttt

SEQ ID NO: 180998 - DNA, 20 bp, Artificial Sequence
  Description of Artificial Sequence: Synthetic oligonucleotide
  Target: ATXN1; (-) strand; PAM type: YTN; PAM sequence: TTA
ctaagtgctggttctgtccc

SEQ ID NO: 180999 - DNA, 20 bp, Artificial Sequence
  Description of Artificial Sequence: Synthetic oligonucleotide
  Target: ATXN1; (-) strand; PAM type: YTN; PAM sequence: CTT
actaagtgctggttctgtcc

SEQ ID NO: 181000 - DNA, 20 bp, Artificial Sequence
  Description of Artificial Sequence: Synthetic oligonucleotide
  Target: ATXN1; (-) strand; PAM type: YTN; PAM sequence: TTA
gtaatgcttactaagtgctg

SEQ ID NO: 181001 - DNA, 20 bp, Artificial Sequence
  Description of Artificial Sequence: Synthetic oligonucleotide
  Target: ATXN1; (-) strand; PAM type: YTN; PAM sequence: TTT
agtaatgcttactaagtgct

SEQ ID NO: 181002 - DNA, 20 bp, Artificial Sequence
  Description of Artificial Sequence: Synthetic oligonucleotide
  Target: ATXN1; (-) strand; PAM type: YTN; PAM sequence: TTT
tagtaatgcttactaagtgc

SEQ ID NO: 181003 - DNA, 20 bp, Artificial Sequence
  Description of Artificial Sequence: Synthetic oligonucleotide
  Target: ATXN1; (-) strand; PAM type: YTN; PAM sequence: CTA
gcattttagtaatgcttact

SEQ ID NO: 181004 - DNA, 20 bp, Artificial Sequence
  Description of Artificial Sequence: Synthetic oligonucleotide
  Target: ATXN1; (-) strand; PAM type: YTN; PAM sequence: CTA
agagtgtaactagcatttta

SEQ ID NO: 181005 - DNA, 20 bp, Artificial Sequence
  Description of Artificial Sequence: Synthetic oligonucleotide
  Target: ATXN1; (-) strand; PAM type: YTN; PAM sequence: TTC
taagagtgtaactagcattt

SEQ ID NO: 181006 - DNA, 20 bp, Artificial Sequence
  Description of Artificial Sequence: Synthetic oligonucleotide
  Target: ATXN1; (-) strand; PAM type: YTN; PAM sequence: CTT
ctaagagtgtaactagcatt

SEQ ID NO: 181007 - DNA, 20 bp, Artificial Sequence
  Description of Artificial Sequence: Synthetic oligonucleotide
  Target: ATXN1; (-) strand; PAM type: YTN; PAM sequence: CTA
tataaagcttctaagagtgt

SEQ ID NO: 181008 - DNA, 20 bp, Artificial Sequence
  Description of Artificial Sequence: Synthetic oligonucleotide
  Target: ATXN1; (-) strand; PAM type: YTN; PAM sequence: TTA
gaaatcctatataaagcttc

SEQ ID NO: 181009 - DNA, 20 bp, Artificial Sequence
  Description of Artificial Sequence: Synthetic oligonucleotide
  Target: ATXN1; (-) strand; PAM type: YTN; PAM sequence: TTA
aattagaaatcctatataaa

SEQ ID NO: 181010 - DNA, 20 bp, Artificial Sequence
  Description of Artificial Sequence: Synthetic oligonucleotide
  Target: ATXN1; (-) strand; PAM type: YTN; PAM sequence: TTC
aataaagattaaattagaaa

SEQ ID NO: 181011 - DNA, 20 bp, Artificial Sequence
  Description of Artificial Sequence: Synthetic oligonucleotide
  Target: ATXN1; (-) strand; PAM type: YTN; PAM sequence: CTT
caataaagattaaattagaa

SEQ ID NO: 181012 - DNA, 20 bp, Artificial Sequence
  Description of Artificial Sequence: Synthetic oligonucleotide
  Target: ATXN1; (-) strand; PAM type: YTN; PAM sequence: CTA
caagcttcaataaagattaa

SEQ ID NO: 181013 - DNA, 20 bp, Artificial Sequence
  Description of Artificial Sequence: Synthetic oligonucleotide
  Target: ATXN1; (-) strand; PAM type: YTN; PAM sequence: TTA
aaagctacaagcttcaataa

SEQ ID NO: 181014 - DNA, 20 bp, Artificial Sequence
  Description of Artificial Sequence: Synthetic oligonucleotide
  Target: ATXN1; (-) strand; PAM type: YTN; PAM sequence: TTT
aaaagctacaagcttcaata

SEQ ID NO: 181015 - DNA, 20 bp, Artificial Sequence
  Description of Artificial Sequence: Synthetic oligonucleotide
  Target: ATXN1; (-) strand; PAM type: YTN; PAM sequence: TTA
aataagtttaaaagctacaa

SEQ ID NO: 181016 - DNA, 20 bp, Artificial Sequence
  Description of Artificial Sequence: Synthetic oligonucleotide
  Target: ATXN1; (-) strand; PAM type: YTN; PAM sequence: TTT
aaataagtttaaaagctaca

SEQ ID NO: 181017 - DNA, 20 bp, Artificial Sequence
  Description of Artificial Sequence: Synthetic oligonucleotide
  Target: ATXN1; (-) strand; PAM type: YTN; PAM sequence: TTT
taaataagtttaaaagctac

SEQ ID NO: 181018 - DNA, 20 bp, Artificial Sequence
  Description of Artificial Sequence: Synthetic oligonucleotide
  Target: ATXN1; (-) strand; PAM type: YTN; PAM sequence: CTT
ttaaataagtttaaaagcta

SEQ ID NO: 181019 - DNA, 20 bp, Artificial Sequence
  Description of Artificial Sequence: Synthetic oligonucleotide
  Target: ATXN1; (-) strand; PAM type: YTN; PAM sequence: TTG
gggcttttaaataagtttaa

SEQ ID NO: 181020 - DNA, 20 bp, Artificial Sequence
  Description of Artificial Sequence: Synthetic oligonucleotide
  Target: ATXN1; (-) strand; PAM type: YTN; PAM sequence: TTT
ggggcttttaaataagttta

SEQ ID NO: 181021 - DNA, 20 bp, Artificial Sequence
  Description of Artificial Sequence: Synthetic oligonucleotide
  Target: ATXN1; (-) strand; PAM type: YTN; PAM sequence: CTT
tggggcttttaaataagttt

SEQ ID NO: 181022 - DNA, 20 bp, Artificial Sequence
  Description of Artificial Sequence: Synthetic oligonucleotide
  Target: ATXN1; (-) strand; PAM type: YTN; PAM sequence: TTG
gtagaatctttggggctttt

SEQ ID NO: 181023 - DNA, 20 bp, Artificial Sequence
  Description of Artificial Sequence: Synthetic oligonucleotide
  Target: ATXN1; (-) strand; PAM type: YTN; PAM sequence: CTG
aagcccgttggtagaatctt

SEQ ID NO: 181024 - DNA, 20 bp, Artificial Sequence
  Description of Artificial Sequence: Synthetic oligonucleotide
  Target: ATXN1; (-) strand; PAM type: YTN; PAM sequence: CTC
tgaagcccgttggtagaatc

SEQ ID NO: 181025 - DNA, 20 bp, Artificial Sequence
  Description of Artificial Sequence: Synthetic oligonucleotide
  Target: ATXN1; (-) strand; PAM type: YTN; PAM sequence: TTA
aaaataaaacgcagatgctc

SEQ ID NO: 181026 - DNA, 20 bp, Artificial Sequence
  Description of Artificial Sequence: Synthetic oligonucleotide
  Target: ATXN1; (-) strand; PAM type: YTN; PAM sequence: TTT
aaaaataaaacgcagatgct

SEQ ID NO: 181027 - DNA, 20 bp, Artificial Sequence
  Description of Artificial Sequence: Synthetic oligonucleotide
  Target: ATXN1; (-) strand; PAM type: YTN; PAM sequence: TTC
aatttaaaaataaaacgcag

SEQ ID NO: 181028 - DNA, 20 bp, Artificial Sequence
  Description of Artificial Sequence: Synthetic oligonucleotide
  Target: ATXN1; (-) strand; PAM type: YTN; PAM sequence: TTA
ataatgagaaattcaattta

SEQ ID NO: 181029 - DNA, 20 bp, Artificial Sequence
  Description of Artificial Sequence: Synthetic oligonucleotide
  Target: ATXN1; (-) strand; PAM type: YTN; PAM sequence: CTT
aataatgagaaattcaattt

SEQ ID NO: 181030 - DNA, 20 bp, Artificial Sequence
  Description of Artificial Sequence: Synthetic oligonucleotide
  Target: ATXN1; (-) strand; PAM type: YTN; PAM sequence: TTA
cttaataatgagaaattcaa

SEQ ID NO: 181031 - DNA, 20 bp, Artificial Sequence
  Description of Artificial Sequence: Synthetic oligonucleotide
  Target: ATXN1; (-) strand; PAM type: YTN; PAM sequence: CTA
cagttacttaataatgagaa

SEQ ID NO: 181032 - DNA, 20 bp, Artificial Sequence
  Description of Artificial Sequence: Synthetic oligonucleotide
  Target: ATXN1; (-) strand; PAM type: YTN; PAM sequence: CTG
aaactacagttacttaataa

SEQ ID NO: 181033 - DNA, 20 bp, Artificial Sequence
  Description of Artificial Sequence: Synthetic oligonucleotide
  Target: ATXN1; (-) strand; PAM type: YTN; PAM sequence: TTC
tgaaactacagttacttaat

SEQ ID NO: 181034 - DNA, 20 bp, Artificial Sequence
  Description of Artificial Sequence: Synthetic oligonucleotide
  Target: ATXN1; (-) strand; PAM type: YTN; PAM sequence: TTT
ctgaaactacagttacttaa

SEQ ID NO: 181035 - DNA, 20 bp, Artificial Sequence
  Description of Artificial Sequence: Synthetic oligonucleotide
  Target: ATXN1; (-) strand; PAM type: YTN; PAM sequence: TTT
tctgaaactacagttactta

SEQ ID NO: 181036 - DNA, 20 bp, Artificial Sequence
  Description of Artificial Sequence: Synthetic oligonucleotide
  Target: ATXN1; (-) strand; PAM type: YTN; PAM sequence: CTT
ttctgaaactacagttactt

SEQ ID NO: 181037 - DNA, 20 bp, Artificial Sequence
  Description of Artificial Sequence: Synthetic oligonucleotide
  Target: ATXN1; (-) strand; PAM type: YTN; PAM sequence: CTA
tatggcacatggagagcttt

SEQ ID NO: 181038 - DNA, 20 bp, Artificial Sequence
  Description of Artificial Sequence: Synthetic oligonucleotide
  Target: ATXN1; (-) strand; PAM type: YTN; PAM sequence: CTA
ctatatggcacatggagagc

SEQ ID NO: 181039 - DNA, 20 bp, Artificial Sequence
  Description of Artificial Sequence: Synthetic oligonucleotide
  Target: ATXN1; (-) strand; PAM type: YTN; PAM sequence: TTC
tactatatggcacatggaga

SEQ ID NO: 181040 - DNA, 20 bp, Artificial Sequence
  Description of Artificial Sequence: Synthetic oligonucleotide
  Target: ATXN1; (-) strand; PAM type: YTN; PAM sequence: TTA
ttctactatatggcacatgg

SEQ ID NO: 181041 - DNA, 20 bp, Artificial Sequence
  Description of Artificial Sequence: Synthetic oligonucleotide
  Target: ATXN1; (-) strand; PAM type: YTN; PAM sequence: TTA
agtgttattctactatatgg

SEQ ID NO: 181042 - DNA, 20 bp, Artificial Sequence
  Description of Artificial Sequence: Synthetic oligonucleotide
  Target: ATXN1; (-) strand; PAM type: YTN; PAM sequence: CTG
aattaagtgttattctacta

SEQ ID NO: 181043 - DNA, 20 bp, Artificial Sequence
  Description of Artificial Sequence: Synthetic oligonucleotide
  Target: ATXN1; (-) strand; PAM type: YTN; PAM sequence: CTA
gcccctgaattaagtgttat

SEQ ID NO: 181044 - DNA, 20 bp, Artificial Sequence
  Description of Artificial Sequence: Synthetic oligonucleotide
  Target: ATXN1; (-) strand; PAM type: YTN; PAM sequence: TTA
gaccctagcccctgaattaa

SEQ ID NO: 181045 - DNA, 20 bp, Artificial Sequence
  Description of Artificial Sequence: Synthetic oligonucleotide
  Target: ATXN1; (-) strand; PAM type: YTN; PAM sequence: TTT
agaccctagcccctgaatta

SEQ ID NO: 181046 - DNA, 20 bp, Artificial Sequence
  Description of Artificial Sequence: Synthetic oligonucleotide
  Target: ATXN1; (-) strand; PAM type: YTN; PAM sequence: CTT
tagaccctagcccctgaatt

SEQ ID NO: 181047 - DNA, 20 bp, Artificial Sequence
  Description of Artificial Sequence: Synthetic oligonucleotide
  Target: ATXN1; (-) strand; PAM type: YTN; PAM sequence: TTG
ggtgggaactttagacccta

SEQ ID NO: 181048 - DNA, 20 bp, Artificial Sequence
  Description of Artificial Sequence: Synthetic oligonucleotide
  Target: ATXN1; (-) strand; PAM type: YTN; PAM sequence: CTG
cattgggtgggaactttaga

SEQ ID NO: 181049 - DNA, 20 bp, Artificial Sequence
  Description of Artificial Sequence: Synthetic oligonucleotide
  Target: ATXN1; (-) strand; PAM type: YTN; PAM sequence: CTC
tgcattgggtgggaacttta

SEQ ID NO: 181050 - DNA, 20 bp, Artificial Sequence
  Description of Artificial Sequence: Synthetic oligonucleotide
  Target: ATXN1; (-) strand; PAM type: YTN; PAM sequence: TTG
aacccacacactctgcattg

SEQ ID NO: 181051 - DNA, 20 bp, Artificial Sequence
  Description of Artificial Sequence: Synthetic oligonucleotide
  Target: ATXN1; (-) strand; PAM type: YTN; PAM sequence: TTT
gaacccacacactctgcatt

SEQ ID NO: 181052 - DNA, 20 bp, Artificial Sequence
  Description of Artificial Sequence: Synthetic oligonucleotide
  Target: ATXN1; (-) strand; PAM type: YTN; PAM sequence: TTT
tgaacccacacactctgcat

SEQ ID NO: 181053 - DNA, 20 bp, Artificial Sequence
  Description of Artificial Sequence: Synthetic oligonucleotide
  Target: ATXN1; (-) strand; PAM type: YTN; PAM sequence: CTT
ttgaacccacacactctgca

SEQ ID NO: 181054 - DNA, 20 bp, Artificial Sequence
  Description of Artificial Sequence: Synthetic oligonucleotide
  Target: ATXN1; (-) strand; PAM type: YTN; PAM sequence: TTC
aaggatacttttgaacccac

SEQ ID NO: 181055 - DNA, 20 bp, Artificial Sequence
  Description of Artificial Sequence: Synthetic oligonucleotide
  Target: ATXN1; (-) strand; PAM type: YTN; PAM sequence: TTT
caaggatacttttgaaccca

SEQ ID NO: 181056 - DNA, 20 bp, Artificial Sequence
  Description of Artificial Sequence: Synthetic oligonucleotide
  Target: ATXN1; (-) strand; PAM type: YTN; PAM sequence: TTA
caatttcaaggatacttttg

SEQ ID NO: 181057 - DNA, 20 bp, Artificial Sequence
  Description of Artificial Sequence: Synthetic oligonucleotide
  Target: ATXN1; (-) strand; PAM type: YTN; PAM sequence: CTT
acaatttcaaggatactttt

SEQ ID NO: 181058 - DNA, 20 bp, Artificial Sequence
  Description of Artificial Sequence: Synthetic oligonucleotide
  Target: ATXN1; (-) strand; PAM type: YTN; PAM sequence: TTG
caccttacaatttcaaggat

SEQ ID NO: 181059 - DNA, 20 bp, Artificial Sequence
  Description of Artificial Sequence: Synthetic oligonucleotide
  Target: ATXN1; (-) strand; PAM type: YTN; PAM sequence: TTT
gcaccttacaatttcaagga

SEQ ID NO: 181060 - DNA, 20 bp, Artificial Sequence
  Description of Artificial Sequence: Synthetic oligonucleotide
  Target: ATXN1; (-) strand; PAM type: YTN; PAM sequence: CTG
atttgcaccttacaatttca

SEQ ID NO: 181061 - DNA, 20 bp, Artificial Sequence
  Description of Artificial Sequence: Synthetic oligonucleotide
  Target: ATXN1; (-) strand; PAM type: YTN; PAM sequence: TTA
ggatctgatttgcaccttac

SEQ ID NO: 181062 - DNA, 20 bp, Artificial Sequence
  Description of Artificial Sequence: Synthetic oligonucleotide
  Target: ATXN1; (-) strand; PAM type: YTN; PAM sequence: TTG
agtggaatggtattaggatc

SEQ ID NO: 181063 - DNA, 20 bp, Artificial Sequence
  Description of Artificial Sequence: Synthetic oligonucleotide
  Target: ATXN1; (-) strand; PAM type: YTN; PAM sequence: TTT
gagtggaatggtattaggat

SEQ ID NO: 181064 - DNA, 20 bp, Artificial Sequence
  Description of Artificial Sequence: Synthetic oligonucleotide
  Target: ATXN1; (-) strand; PAM type: YTN; PAM sequence: TTG
aaaggtttgagtggaatggt

SEQ ID NO: 181065 - DNA, 20 bp, Artificial Sequence
  Description of Artificial Sequence: Synthetic oligonucleotide
  Target: ATXN1; (-) strand; PAM type: YTN; PAM sequence: TTA
ccataaatgtaataggaagc

SEQ ID NO: 181066 - DNA, 20 bp, Artificial Sequence
  Description of Artificial Sequence: Synthetic oligonucleotide
  Target: ATXN1; (-) strand; PAM type: YTN; PAM sequence: TTT
accataaatgtaataggaag

SEQ ID NO: 181067 - DNA, 20 bp, Artificial Sequence
  Description of Artificial Sequence: Synthetic oligonucleotide
  Target: ATXN1; (-) strand; PAM type: YTN; PAM sequence: TTT
taccataaatgtaataggaa

SEQ ID NO: 181068 - DNA, 20 bp, Artificial Sequence
  Description of Artificial Sequence: Synthetic oligonucleotide
  Target: ATXN1; (-) strand; PAM type: YTN; PAM sequence: TTT
ttaccataaatgtaatagga

SEQ ID NO: 181069 - DNA, 20 bp, Artificial Sequence
  Description of Artificial Sequence: Synthetic oligonucleotide
  Target: ATXN1; (-) strand; PAM type: YTN; PAM sequence: CTG
tggtttttaccataaatgta

SEQ ID NO: 181070 - DNA, 20 bp, Artificial Sequence
  Description of Artificial Sequence: Synthetic oligonucleotide
  Target: ATXN1; (-) strand; PAM type: YTN; PAM sequence: TTG
acatggaccaggactgtggt

SEQ ID NO: 181071 - DNA, 20 bp, Artificial Sequence
  Description of Artificial Sequence: Synthetic oligonucleotide
  Target: ATXN1; (-) strand; PAM type: YTN; PAM sequence: CTT
gacatggaccaggactgtgg

SEQ ID NO: 181072 - DNA, 20 bp, Artificial Sequence
  Description of Artificial Sequence: Synthetic oligonucleotide
  Target: ATXN1; (-) strand; PAM type: YTN; PAM sequence: CTA
agtcttgacatggaccagga

SEQ ID NO: 181073 - DNA, 20 bp, Artificial Sequence
  Description of Artificial Sequence: Synthetic oligonucleotide
  Target: ATXN1; (-) strand; PAM type: YTN; PAM sequence: TTC
taagtcttgacatggaccag

SEQ ID NO: 181074 - DNA, 20 bp, Artificial Sequence
  Description of Artificial Sequence: Synthetic oligonucleotide
  Target: ATXN1; (-) strand; PAM type: YTN; PAM sequence: CTT
ctaagtcttgacatggacca

SEQ ID NO: 181075 - DNA, 20 bp, Artificial Sequence
  Description of Artificial Sequence: Synthetic oligonucleotide
  Target: ATXN1; (-) strand; PAM type: YTN; PAM sequence: TTG
gggtcagatcatgtagggcc

SEQ ID NO: 181076 - DNA, 20 bp, Artificial Sequence
  Description of Artificial Sequence: Synthetic oligonucleotide
  Target: ATXN1; (-) strand; PAM type: YTN; PAM sequence: TTC
acatagttggggtcagatca

SEQ ID NO: 181077 - DNA, 20 bp, Artificial Sequence
  Description of Artificial Sequence: Synthetic oligonucleotide
  Target: ATXN1; (-) strand; PAM type: YTN; PAM sequence: TTT
cacatagttggggtcagatc

SEQ ID NO: 181078 - DNA, 20 bp, Artificial Sequence
  Description of Artificial Sequence: Synthetic oligonucleotide
  Target: ATXN1; (-) strand; PAM type: YTN; PAM sequence: CTG
gagcagaacatagggaggag

SEQ ID NO: 181079 - DNA, 20 bp, Artificial Sequence
  Description of Artificial Sequence: Synthetic oligonucleotide
  Target: ATXN1; (-) strand; PAM type: YTN; PAM sequence: CTA
tgctggagcagaacataggg

SEQ ID NO: 181080 - DNA, 20 bp, Artificial Sequence
  Description of Artificial Sequence: Synthetic oligonucleotide
  Target: ATXN1; (-) strand; PAM type: YTN; PAM sequence: CTG
gatgtggaagggagtgtgga

SEQ ID NO: 181081 - DNA, 20 bp, Artificial Sequence
  Description of Artificial Sequence: Synthetic oligonucleotide
  Target: ATXN1; (-) strand; PAM type: YTN; PAM sequence: TTG
tgcctggatgtggaagggag

SEQ ID NO: 181082 - DNA, 20 bp, Artificial Sequence
  Description of Artificial Sequence: Synthetic oligonucleotide
  Target: ATXN1; (-) strand; PAM type: YTN; PAM sequence: CTA
ggtaggaccaggattgtgcc

SEQ ID NO: 181083 - DNA, 20 bp, Artificial Sequence
  Description of Artificial Sequence: Synthetic oligonucleotide
  Target: ATXN1; (-) strand; PAM type: YTN; PAM sequence: TTC
taggtaggaccaggattgtg

SEQ ID NO: 181084 - DNA, 20 bp, Artificial Sequence
  Description of Artificial Sequence: Synthetic oligonucleotide
  Target: ATXN1; (-) strand; PAM type: YTN; PAM sequence: TTG
ccagaggagcattctaggta

SEQ ID NO: 181085 - DNA, 20 bp, Artificial Sequence
  Description of Artificial Sequence: Synthetic oligonucleotide
  Target: ATXN1; (-) strand; PAM type: YTN; PAM sequence: TTT
gccagaggagcattctaggt

SEQ ID NO: 181086 - DNA, 20 bp, Artificial Sequence
  Description of Artificial Sequence: Synthetic oligonucleotide
  Target: ATXN1; (-) strand; PAM type: YTN; PAM sequence: CTC
atttgccagaggagcattct

SEQ ID NO: 181087 - DNA, 20 bp, Artificial Sequence
  Description of Artificial Sequence: Synthetic oligonucleotide
  Target: ATXN1; (-) strand; PAM type: YTN; PAM sequence: CTG
aatgaagagaactcatttgc

SEQ ID NO: 181088 - DNA, 20 bp, Artificial Sequence
  Description of Artificial Sequence: Synthetic oligonucleotide
  Target: ATXN1; (-) strand; PAM type: YTN; PAM sequence: TTA
gacaaggcgaccagggaggg

SEQ ID NO: 181089 - DNA, 20 bp, Artificial Sequence
  Description of Artificial Sequence: Synthetic oligonucleotide
  Target: ATXN1; (-) strand; PAM type: YTN; PAM sequence: TTT
agacaaggcgaccagggagg

SEQ ID NO: 181090 - DNA, 20 bp, Artificial Sequence
  Description of Artificial Sequence: Synthetic oligonucleotide
  Target: ATXN1; (-) strand; PAM type: YTN; PAM sequence: TTT
tagacaaggcgaccagggag

SEQ ID NO: 181091 - DNA, 20 bp, Artificial Sequence
  Description of Artificial Sequence: Synthetic oligonucleotide
  Target: ATXN1; (-) strand; PAM type: YTN; PAM sequence: CTT
ttagacaaggcgaccaggga

SEQ ID NO: 181092 - DNA, 20 bp, Artificial Sequence
  Description of Artificial Sequence: Synthetic oligonucleotide
  Target: ATXN1; (-) strand; PAM type: YTN; PAM sequence: CTC
ttttagacaaggcgaccagg

SEQ ID NO: 181093 - DNA, 20 bp, Artificial Sequence
  Description of Artificial Sequence: Synthetic oligonucleotide
  Target: ATXN1; (-) strand; PAM type: YTN; PAM sequence: CTG
ctcttttagacaaggcgacc

SEQ ID NO: 181094 - DNA, 20 bp, Artificial Sequence
  Description of Artificial Sequence: Synthetic oligonucleotide
  Target: ATXN1; (-) strand; PAM type: YTN; PAM sequence: CTG
tgatgaatgaagagaagaat

SEQ ID NO: 181095 - DNA, 20 bp, Artificial Sequence
  Description of Artificial Sequence: Synthetic oligonucleotide
  Target: ATXN1; (-) strand; PAM type: YTN; PAM sequence: TTG
tggtgtaacatcagctgtga

SEQ ID NO: 181096 - DNA, 20 bp, Artificial Sequence
  Description of Artificial Sequence: Synthetic oligonucleotide
  Target: ATXN1; (-) strand; PAM type: YTN; PAM sequence: TTT
gtggtgtaacatcagctgtg

SEQ ID NO: 181097 - DNA, 20 bp, Artificial Sequence
  Description of Artificial Sequence: Synthetic oligonucleotide
  Target: ATXN1; (-) strand; PAM type: YTN; PAM sequence: CTT
tgtggtgtaacatcagctgt

SEQ ID NO: 181098 - DNA, 20 bp, Artificial Sequence
  Description of Artificial Sequence: Synthetic oligonucleotide
  Target: ATXN1; (-) strand; PAM type: YTN; PAM sequence: CTA
gcgcaggaaacaaaccaaca

SEQ ID NO: 181099 - DNA, 20 bp, Artificial Sequence
  Description of Artificial Sequence: Synthetic oligonucleotide
  Target: ATXN1; (-) strand; PAM type: YTN; PAM sequence: TTC
tagcgcaggaaacaaaccaa

SEQ ID NO: 181100 - DNA, 20 bp, Artificial Sequence
  Description of Artificial Sequence: Synthetic oligonucleotide
  Target: ATXN1; (-) strand; PAM type: YTN; PAM sequence: CTG
tgatatatcagtaatgaata

SEQ ID NO: 181101 - DNA, 20 bp, Artificial Sequence
  Description of Artificial Sequence: Synthetic oligonucleotide
  Target: ATXN1; (-) strand; PAM type: YTN; PAM sequence: TTG
tacccccaaaatatgtacac

SEQ ID NO: 181102 - DNA, 20 bp, Artificial Sequence
  Description of Artificial Sequence: Synthetic oligonucleotide
  Target: ATXN1; (-) strand; PAM type: YTN; PAM sequence: CTT
gtacccccaaaatatgtaca

SEQ ID NO: 181103 - DNA, 20 bp, Artificial Sequence
  Description of Artificial Sequence: Synthetic oligonucleotide
  Target: ATXN1; (-) strand; PAM type: YTN; PAM sequence: TTC
aatagtacatatcacttgta

SEQ ID NO: 181104 - DNA, 20 bp, Artificial Sequence
  Description of Artificial Sequence: Synthetic oligonucleotide
  Target: ATXN1; (-) strand; PAM type: YTN; PAM sequence: TTA
ggattcaatagtacatatca

SEQ ID NO: 181105 - DNA, 20 bp, Artificial Sequence
  Description of Artificial Sequence: Synthetic oligonucleotide
  Target: ATXN1; (-) strand; PAM type: YTN; PAM sequence: TTT
aggattcaatagtacatatc

SEQ ID NO: 181106 - DNA, 20 bp, Artificial Sequence
  Description of Artificial Sequence: Synthetic oligonucleotide
  Target: ATXN1; (-) strand; PAM type: YTN; PAM sequence: TTT
taggattcaatagtacatat

SEQ ID NO: 181107 - DNA, 20 bp, Artificial Sequence
  Description of Artificial Sequence: Synthetic oligonucleotide
  Target: ATXN1; (-) strand; PAM type: YTN; PAM sequence: TTA
aatagaaggagtaagtttta

SEQ ID NO: 181108 - DNA, 20 bp, Artificial Sequence
  Description of Artificial Sequence: Synthetic oligonucleotide
  Target: ATXN1; (-) strand; PAM type: YTN; PAM sequence: TTA
atgggtgatacaaaaataca

SEQ ID NO: 181109 - DNA, 20 bp, Artificial Sequence
  Description of Artificial Sequence: Synthetic oligonucleotide
  Target: ATXN1; (-) strand; PAM type: YTN; PAM sequence: TTG
agcaaggatgaagagaagtc

SEQ ID NO: 181110 - DNA, 20 bp, Artificial Sequence
  Description of Artificial Sequence: Synthetic oligonucleotide
  Target: ATXN1; (-) strand; PAM type: YTN; PAM sequence: TTT
gagcaaggatgaagagaagt

SEQ ID NO: 181111 - DNA, 20 bp, Artificial Sequence
  Description of Artificial Sequence: Synthetic oligonucleotide
  Target: ATXN1; (-) strand; PAM type: YTN; PAM sequence: CTG
cagtttgagcaaggatgaag

SEQ ID NO: 181112 - DNA, 20 bp, Artificial Sequence
  Description of Artificial Sequence: Synthetic oligonucleotide
  Target: ATXN1; (-) strand; PAM type: YTN; PAM sequence: CTC
ataggtgctgcagtttgagc

SEQ ID NO: 181113 - DNA, 20 bp, Artificial Sequence
  Description of Artificial Sequence: Synthetic oligonucleotide
  Target: ATXN1; (-) strand; PAM type: YTN; PAM sequence: CTA
agactcataggtgctgcagt

SEQ ID NO: 181114 - DNA, 20 bp, Artificial Sequence
  Description of Artificial Sequence: Synthetic oligonucleotide
  Target: ATXN1; (-) strand; PAM type: YTN; PAM sequence: CTG
tgctaagactcataggtgct

SEQ ID NO: 181115 - DNA, 20 bp, Artificial Sequence
  Description of Artificial Sequence: Synthetic oligonucleotide
  Target: ATXN1; (-) strand; PAM type: YTN; PAM sequence: CTC
tgtgctaagactcataggtg

SEQ ID NO: 181116 - DNA, 20 bp, Artificial Sequence
  Description of Artificial Sequence: Synthetic oligonucleotide
  Target: ATXN1; (-) strand; PAM type: YTN; PAM sequence: TTC
tctgtgctaagactcatagg

SEQ ID NO: 181117 - DNA, 20 bp, Artificial Sequence
  Description of Artificial Sequence: Synthetic oligonucleotide
  Target: ATXN1; (-) strand; PAM type: YTN; PAM sequence: CTT
ctctgtgctaagactcatag

SEQ ID NO: 181118 - DNA, 20 bp, Artificial Sequence
  Description of Artificial Sequence: Synthetic oligonucleotide
  Target: ATXN1; (-) strand; PAM type: YTN; PAM sequence: TTA
cagagtgccttctctgtgct

SEQ ID NO: 181119 - DNA, 20 bp, Artificial Sequence
  Description of Artificial Sequence: Synthetic oligonucleotide
  Target: ATXN1; (-) strand; PAM type: YTN; PAM sequence: CTT
acagagtgccttctctgtgc

SEQ ID NO: 181120 - DNA, 20 bp, Artificial Sequence
  Description of Artificial Sequence: Synthetic oligonucleotide
  Target: ATXN1; (-) strand; PAM type: YTN; PAM sequence: TTG
agccaatacttacagagtgc

SEQ ID NO: 181121 - DNA, 20 bp, Artificial Sequence
  Description of Artificial Sequence: Synthetic oligonucleotide
  Target: ATXN1; (-) strand; PAM type: YTN; PAM sequence: TTA
ttgagccaatacttacagag

SEQ ID NO: 181122 - DNA, 20 bp, Artificial Sequence
  Description of Artificial Sequence: Synthetic oligonucleotide
  Target: ATXN1; (-) strand; PAM type: YTN; PAM sequence: TTT
attgagccaatacttacaga

SEQ ID NO: 181123 - DNA, 20 bp, Artificial Sequence
  Description of Artificial Sequence: Synthetic oligonucleotide
  Target: ATXN1; (-) strand; PAM type: YTN; PAM sequence: TTA
tttattgagccaatacttac

SEQ ID NO: 181124 - DNA, 20 bp, Artificial Sequence
  Description of Artificial Sequence: Synthetic oligonucleotide
  Target: ATXN1; (-) strand; PAM type: YTN; PAM sequence: TTT
atttattgagccaatactta

SEQ ID NO: 181125 - DNA, 20 bp, Artificial Sequence
  Description of Artificial Sequence: Synthetic oligonucleotide
  Target: ATXN1; (-) strand; PAM type: YTN; PAM sequence: TTT
tatttattgagccaatactt

SEQ ID NO: 181126 - DNA, 20 bp, Artificial Sequence
  Description of Artificial Sequence: Synthetic oligonucleotide
  Target: ATXN1; (-) strand; PAM type: YTN; PAM sequence: CTT
ttatttattgagccaatact

SEQ ID NO: 181127 - DNA, 20 bp, Artificial Sequence
  Description of Artificial Sequence: Synthetic oligonucleotide
  Target: ATXN1; (-) strand; PAM type: YTN; PAM sequence: TTG
ggcaatgtaagacactttta

SEQ ID NO: 181128 - DNA, 20 bp, Artificial Sequence
  Description of Artificial Sequence: Synthetic oligonucleotide
  Target: ATXN1; (-) strand; PAM type: YTN; PAM sequence: TTG
ttgggcaatgtaagacactt

SEQ ID NO: 181129 - DNA, 20 bp, Artificial Sequence
  Description of Artificial Sequence: Synthetic oligonucleotide
  Target: ATXN1; (-) strand; PAM type: YTN; PAM sequence: CTT
gttgggcaatgtaagacact

SEQ ID NO: 181130 - DNA, 20 bp, Artificial Sequence
  Description of Artificial Sequence: Synthetic oligonucleotide
  Target: ATXN1; (-) strand; PAM type: YTN; PAM sequence: CTG
tatatagtgtccttgttggg

SEQ ID NO: 181131 - DNA, 20 bp, Artificial Sequence
  Description of Artificial Sequence: Synthetic oligonucleotide
  Target: ATXN1; (-) strand; PAM type: YTN; PAM sequence: TTG
cacagggtggtataaacaaa

SEQ ID NO: 181132 - DNA, 20 bp, Artificial Sequence
  Description of Artificial Sequence: Synthetic oligonucleotide
  Target: ATXN1; (-) strand; PAM type: YTN; PAM sequence: TTG
ttgcacagggtggtataaac

SEQ ID NO: 181133 - DNA, 20 bp, Artificial Sequence
  Description of Artificial Sequence: Synthetic oligonucleotide
  Target: ATXN1; (-) strand; PAM type: YTN; PAM sequence: CTG
tatgtgagcattgttgcaca

SEQ ID NO: 181134 - DNA, 20 bp, Artificial Sequence
  Description of Artificial Sequence: Synthetic oligonucleotide
  Target: ATXN1; (-) strand; PAM type: YTN; PAM sequence: TTC
cactgtatgtgagcattgtt

SEQ ID NO: 181135 - DNA, 20 bp, Artificial Sequence
  Description of Artificial Sequence: Synthetic oligonucleotide
  Target: ATXN1; (-) strand; PAM type: YTN; PAM sequence: TTC
aaattccactgtatgtgagc

SEQ ID NO: 181136 - DNA, 20 bp, Artificial Sequence
  Description of Artificial Sequence: Synthetic oligonucleotide
  Target: ATXN1; (-) strand; PAM type: YTN; PAM sequence: TTT
caaattccactgtatgtgag

SEQ ID NO: 181137 - DNA, 20 bp, Artificial Sequence
  Description of Artificial Sequence: Synthetic oligonucleotide
  Target: ATXN1; (-) strand; PAM type: YTN; PAM sequence: TTT
tcaaattccactgtatgtga

SEQ ID NO: 181138 - DNA, 20 bp, Artificial Sequence
  Description of Artificial Sequence: Synthetic oligonucleotide
  Target: ATXN1; (-) strand; PAM type: YTN; PAM sequence: CTC
agtggttttcaaattccact

SEQ ID NO: 181139 - DNA, 20 bp, Artificial Sequence
  Description of Artificial Sequence: Synthetic oligonucleotide
  Target: ATXN1; (-) strand; PAM type: YTN; PAM sequence: CTA
gctcagtggttttcaaattc

SEQ ID NO: 181140 - DNA, 20 bp, Artificial Sequence
  Description of Artificial Sequence: Synthetic oligonucleotide
  Target: ATXN1; (-) strand; PAM type: YTN; PAM sequence: TTA
gcctagctcagtggttttca

SEQ ID NO: 181141 - DNA, 20 bp, Artificial Sequence
  Description of Artificial Sequence: Synthetic oligonucleotide
  Target: ATXN1; (-) strand; PAM type: YTN; PAM sequence: CTT
agcctagctcagtggttttc

SEQ ID NO: 181142 - DNA, 20 bp, Artificial Sequence
  Description of Artificial Sequence: Synthetic oligonucleotide
  Target: ATXN1; (-) strand; PAM type: YTN; PAM sequence: TTG
ggccttagcctagctcagtg

SEQ ID NO: 181143 - DNA, 20 bp, Artificial Sequence
  Description of Artificial Sequence: Synthetic oligonucleotide
  Target: ATXN1; (-) strand; PAM type: YTN; PAM sequence: CTT
gggccttagcctagctcagt

SEQ ID NO: 181144 - DNA, 20 bp, Artificial Sequence
  Description of Artificial Sequence: Synthetic oligonucleotide
  Target: ATXN1; (-) strand; PAM type: YTN; PAM sequence: CTC
ttgggccttagcctagctca

SEQ ID NO: 181145 - DNA, 20 bp, Artificial Sequence
  Description of Artificial Sequence: Synthetic oligonucleotide
  Target: ATXN1; (-) strand; PAM type: YTN; PAM sequence: TTC
ctcttgggccttagcctagc

SEQ ID NO: 181146 - DNA, 20 bp, Artificial Sequence
  Description of Artificial Sequence: Synthetic oligonucleotide
  Target: ATXN1; (-) strand; PAM type: YTN; PAM sequence: TTT
cctcttgggccttagcctag

SEQ ID NO: 181147 - DNA, 20 bp, Artificial Sequence
  Description of Artificial Sequence: Synthetic oligonucleotide
  Target: ATXN1; (-) strand; PAM type: YTN; PAM sequence: CTT
tcctcttgggccttagccta

SEQ ID NO: 181148 - DNA, 20 bp, Artificial Sequence
  Description of Artificial Sequence: Synthetic oligonucleotide
  Target: ATXN1; (-) strand; PAM type: YTN; PAM sequence: CTG
atgtaggctttcctcttggg

SEQ ID NO: 181149 - DNA, 20 bp, Artificial Sequence
  Description of Artificial Sequence: Synthetic oligonucleotide
  Target: ATXN1; (-) strand; PAM type: YTN; PAM sequence: CTA
gggacatcaaaggtgcagtg

SEQ ID NO: 181150 - DNA, 20 bp, Artificial Sequence
  Description of Artificial Sequence: Synthetic oligonucleotide
  Target: ATXN1; (-) strand; PAM type: YTN; PAM sequence: CTG
ctagggacatcaaaggtgca

SEQ ID NO: 181151 - DNA, 20 bp, Artificial Sequence
  Description of Artificial Sequence: Synthetic oligonucleotide
  Target: ATXN1; (-) strand; PAM type: YTN; PAM sequence: CTC
tgctagggacatcaaaggtg

SEQ ID NO: 181152 - DNA, 20 bp, Artificial Sequence
  Description of Artificial Sequence: Synthetic oligonucleotide
  Target: ATXN1; (-) strand; PAM type: YTN; PAM sequence: TTG
atctctgctagggacatcaa

SEQ ID NO: 181153 - DNA, 20 bp, Artificial Sequence
  Description of Artificial Sequence: Synthetic oligonucleotide
  Target: ATXN1; (-) strand; PAM type: YTN; PAM sequence: CTT
gatctctgctagggacatca

SEQ ID NO: 181154 - DNA, 20 bp, Artificial Sequence
  Description of Artificial Sequence: Synthetic oligonucleotide
  Target: ATXN1; (-) strand; PAM type: YTN; PAM sequence: TTC
atgcaagcaaaaaagcttga

SEQ ID NO: 181155 - DNA, 20 bp, Artificial Sequence
  Description of Artificial Sequence: Synthetic oligonucleotide
  Target: ATXN1; (-) strand; PAM type: YTN; PAM sequence: CTT
catgcaagcaaaaaagcttg

SEQ ID NO: 181156 - DNA, 20 bp, Artificial Sequence
  Description of Artificial Sequence: Synthetic oligonucleotide
  Target: ATXN1; (-) strand; PAM type: YTN; PAM sequence: TTA
agaaaacccttcatgcaagc

SEQ ID NO: 181157 - DNA, 20 bp, Artificial Sequence
  Description of Artificial Sequence: Synthetic oligonucleotide
  Target: ATXN1; (-) strand; PAM type: YTN; PAM sequence: CTA
acaaaatggagttaagaaaa

SEQ ID NO: 181158 - DNA, 20 bp, Artificial Sequence
  Description of Artificial Sequence: Synthetic oligonucleotide
  Target: ATXN1; (-) strand; PAM type: YTN; PAM sequence: TTA
ctaacaaaatggagttaaga

SEQ ID NO: 181159 - DNA, 20 bp, Artificial Sequence
  Description of Artificial Sequence: Synthetic oligonucleotide
  Target: ATXN1; (-) strand; PAM type: YTN; PAM sequence: CTT
actaacaaaatggagttaag

SEQ ID NO: 181160 - DNA, 20 bp, Artificial Sequence
  Description of Artificial Sequence: Synthetic oligonucleotide
  Target: ATXN1; (-) strand; PAM type: YTN; PAM sequence: TTG
aagatgtagagccttactaa

SEQ ID NO: 181161 - DNA, 20 bp, Artificial Sequence
  Description of Artificial Sequence: Synthetic oligonucleotide
  Target: ATXN1; (-) strand; PAM type: YTN; PAM sequence: CTT
gaagatgtagagccttacta

SEQ ID NO: 181162 - DNA, 20 bp, Artificial Sequence
  Description of Artificial Sequence: Synthetic oligonucleotide
  Target: ATXN1; (-) strand; PAM type: YTN; PAM sequence: TTG
gcaaatcttgaagatgtaga

SEQ ID NO: 181163 - DNA, 20 bp, Artificial Sequence
  Description of Artificial Sequence: Synthetic oligonucleotide
  Target: ATXN1; (-) strand; PAM type: YTN; PAM sequence: CTC
acaacaacagcaacaaataa

SEQ ID NO: 181164 - DNA, 20 bp, Artificial Sequence
  Description of Artificial Sequence: Synthetic oligonucleotide
  Target: ATXN1; (-) strand; PAM type: YTN; PAM sequence: TTA
accctcacaacaacagcaac

SEQ ID NO: 181165 - DNA, 20 bp, Artificial Sequence
  Description of Artificial Sequence: Synthetic oligonucleotide
  Target: ATXN1; (-) strand; PAM type: YTN; PAM sequence: TTT
aaccctcacaacaacagcaa

SEQ ID NO: 181166 - DNA, 20 bp, Artificial Sequence
  Description of Artificial Sequence: Synthetic oligonucleotide
  Target: ATXN1; (-) strand; PAM type: YTN; PAM sequence: CTT
taaccctcacaacaacagca

SEQ ID NO: 181167 - DNA, 20 bp, Artificial Sequence
  Description of Artificial Sequence: Synthetic oligonucleotide
  Target: ATXN1; (-) strand; PAM type: YTN; PAM sequence: CTA
tcccctttaaccctcacaac

SEQ ID NO: 181168 - DNA, 20 bp, Artificial Sequence
  Description of Artificial Sequence: Synthetic oligonucleotide
  Target: ATXN1; (-) strand; PAM type: YTN; PAM sequence: TTG
ctatcccctttaaccctcac

SEQ ID NO: 181169 - DNA, 20 bp, Artificial Sequence
  Description of Artificial Sequence: Synthetic oligonucleotide
  Target: ATXN1; (-) strand; PAM type: YTN; PAM sequence: CTT
gctatcccctttaaccctca

SEQ ID NO: 181170 - DNA, 20 bp, Artificial Sequence
  Description of Artificial Sequence: Synthetic oligonucleotide
  Target: ATXN1; (-) strand; PAM type: YTN; PAM sequence: CTC
ttgctatcccctttaaccct

SEQ ID NO: 181171 - DNA, 20 bp, Artificial Sequence
  Description of Artificial Sequence: Synthetic oligonucleotide
  Target: ATXN1; (-) strand; PAM type: YTN; PAM sequence: TTC
agaagaactcttgctatccc

SEQ ID NO: 181172 - DNA, 20 bp, Artificial Sequence
  Description of Artificial Sequence: Synthetic oligonucleotide
  Target: ATXN1; (-) strand; PAM type: YTN; PAM sequence: CTT
cagaagaactcttgctatcc

SEQ ID NO: 181173 - DNA, 20 bp, Artificial Sequence
  Description of Artificial Sequence: Synthetic oligonucleotide
  Target: ATXN1; (-) strand; PAM type: YTN; PAM sequence: CTA
acttcagaagaactcttgct

SEQ ID NO: 181174 - DNA, 20 bp, Artificial Sequence
  Description of Artificial Sequence: Synthetic oligonucleotide
  Target: ATXN1; (-) strand; PAM type: YTN; PAM sequence: CTA
agaatctaacttcagaagaa

SEQ ID NO: 181175 - DNA, 20 bp, Artificial Sequence
  Description of Artificial Sequence: Synthetic oligonucleotide
  Target: ATXN1; (-) strand; PAM type: YTN; PAM sequence: TTA
acggggtaactaagaatcta

SEQ ID NO: 181176 - DNA, 20 bp, Artificial Sequence
  Description of Artificial Sequence: Synthetic oligonucleotide
  Target: ATXN1; (-) strand; PAM type: YTN; PAM sequence: TTG
attaacggggtaactaagaa

SEQ ID NO: 181177 - DNA, 20 bp, Artificial Sequence
  Description of Artificial Sequence: Synthetic oligonucleotide
  Target: ATXN1; (-) strand; PAM type: YTN; PAM sequence: TTT
gattaacggggtaactaaga

SEQ ID NO: 181178 - DNA, 20 bp, Artificial Sequence
  Description of Artificial Sequence: Synthetic oligonucleotide
  Target: ATXN1; (-) strand; PAM type: YTN; PAM sequence: TTA
catttgattaacggggtaac

SEQ ID NO: 181179 - DNA, 20 bp, Artificial Sequence
  Description of Artificial Sequence: Synthetic oligonucleotide
  Target: ATXN1; (-) strand; PAM type: YTN; PAM sequence: TTG
tggcaatgccaggatggaag

SEQ ID NO: 181180 - DNA, 20 bp, Artificial Sequence
  Description of Artificial Sequence: Synthetic oligonucleotide
  Target: ATXN1; (-) strand; PAM type: YTN; PAM sequence: TTA
gtagttgtggcaatgccagg

SEQ ID NO: 181181 - DNA, 20 bp, Artificial Sequence
  Description of Artificial Sequence: Synthetic oligonucleotide
  Target: ATXN1; (-) strand; PAM type: YTN; PAM sequence: CTG
gcccattagtagttgtggca

SEQ ID NO: 181182 - DNA, 20 bp, Artificial Sequence
  Description of Artificial Sequence: Synthetic oligonucleotide
  Target: ATXN1; (-) strand; PAM type: YTN; PAM sequence: CTG
gcagtatggtctggcccatt

SEQ ID NO: 181183 - DNA, 20 bp, Artificial Sequence
  Description of Artificial Sequence: Synthetic oligonucleotide
  Target: ATXN1; (-) strand; PAM type: YTN; PAM sequence: CTA
cacaagcctggcagtatggt

SEQ ID NO: 181184 - DNA, 20 bp, Artificial Sequence
  Description of Artificial Sequence: Synthetic oligonucleotide
  Target: ATXN1; (-) strand; PAM type: YTN; PAM sequence: TTG
agatctacacaagcctggca

SEQ ID NO: 181185 - DNA, 20 bp, Artificial Sequence
  Description of Artificial Sequence: Synthetic oligonucleotide
  Target: ATXN1; (-) strand; PAM type: YTN; PAM sequence: TTT
gagatctacacaagcctggc

SEQ ID NO: 181186 - DNA, 20 bp, Artificial Sequence
  Description of Artificial Sequence: Synthetic oligonucleotide
  Target: ATXN1; (-) strand; PAM type: YTN; PAM sequence: TTT
tgagatctacacaagcctgg

SEQ ID NO: 181187 - DNA, 20 bp, Artificial Sequence
  Description of Artificial Sequence: Synthetic oligonucleotide
  Target: ATXN1; (-) strand; PAM type: YTN; PAM sequence: TTA
ttttgagatctacacaagcc

SEQ ID NO: 181188 - DNA, 20 bp, Artificial Sequence
  Description of Artificial Sequence: Synthetic oligonucleotide
  Target: ATXN1; (-) strand; PAM type: YTN; PAM sequence: TTT
attttgagatctacacaagc

SEQ ID NO: 181189 - DNA, 20 bp, Artificial Sequence
  Description of Artificial Sequence: Synthetic oligonucleotide
  Target: ATXN1; (-) strand; PAM type: YTN; PAM sequence: CTT
tattttgagatctacacaag

SEQ ID NO: 181190 - DNA, 20 bp, Artificial Sequence
  Description of Artificial Sequence: Synthetic oligonucleotide
  Target: ATXN1; (-) strand; PAM type: YTN; PAM sequence: CTG
agatgacgggatacctttat

SEQ ID NO: 181191 - DNA, 20 bp, Artificial Sequence
  Description of Artificial Sequence: Synthetic oligonucleotide
  Target: ATXN1; (-) strand; PAM type: YTN; PAM sequence: CTG
agaaacaggatgtcactgag

SEQ ID NO: 181192 - DNA, 20 bp, Artificial Sequence
  Description of Artificial Sequence: Synthetic oligonucleotide
  Target: ATXN1; (-) strand; PAM type: YTN; PAM sequence: CTA
cctgagaaacaggatgtcac

SEQ ID NO: 181193 - DNA, 20 bp, Artificial Sequence
  Description of Artificial Sequence: Synthetic oligonucleotide
  Target: ATXN1; (-) strand; PAM type: YTN; PAM sequence: TTC
tacctgagaaacaggatgtc

SEQ ID NO: 181194 - DNA, 20 bp, Artificial Sequence
  Description of Artificial Sequence: Synthetic oligonucleotide
  Target: ATXN1; (-) strand; PAM type: YTN; PAM sequence: TTT
ctacctgagaaacaggatgt

SEQ ID NO: 181195 - DNA, 20 bp, Artificial Sequence
  Description of Artificial Sequence: Synthetic oligonucleotide
  Target: ATXN1; (-) strand; PAM type: YTN; PAM sequence: CTT
tctacctgagaaacaggatg

SEQ ID NO: 181196 - DNA, 20 bp, Artificial Sequence
  Description of Artificial Sequence: Synthetic oligonucleotide
  Target: ATXN1; (-) strand; PAM type: YTN; PAM sequence: CTA
caacctttctacctgagaaa

SEQ ID NO: 181197 - DNA, 20 bp, Artificial Sequence
  Description of Artificial Sequence: Synthetic oligonucleotide
  Target: ATXN1; (-) strand; PAM type: YTN; PAM sequence: TTA
aaaaaagcaatggtagcgct

SEQ ID NO: 181198 - DNA, 20 bp, Artificial Sequence
  Description of Artificial Sequence: Synthetic oligonucleotide
  Target: ATXN1; (-) strand; PAM type: YTN; PAM sequence: TTT
aaaaaaagcaatggtagcgc

SEQ ID NO: 181199 - DNA, 20 bp, Artificial Sequence
  Description of Artificial Sequence: Synthetic oligonucleotide
  Target: ATXN1; (-) strand; PAM type: YTN; PAM sequence: TTA
tatgtttaaaaaaagcaatg

SEQ ID NO: 181200 - DNA, 20 bp, Artificial Sequence
  Description of Artificial Sequence: Synthetic oligonucleotide
  Target: ATXN1; (-) strand; PAM type: YTN; PAM sequence: TTT
atatgtttaaaaaaagcaat

SEQ ID NO: 181201 - DNA, 20 bp, Artificial Sequence
  Description of Artificial Sequence: Synthetic oligonucleotide
  Target: ATXN1; (-) strand; PAM type: YTN; PAM sequence: TTA
agtttatatgtttaaaaaaa

SEQ ID NO: 181202 - DNA, 20 bp, Artificial Sequence
  Description of Artificial Sequence: Synthetic oligonucleotide
  Target: ATXN1; (-) strand; PAM type: YTN; PAM sequence: CTT
aagtttatatgtttaaaaaa

SEQ ID NO: 181203 - DNA, 20 bp, Artificial Sequence
  Description of Artificial Sequence: Synthetic oligonucleotide
  Target: ATXN1; (-) strand; PAM type: YTN; PAM sequence: TTC
atgcaagtggacgtagggag

SEQ ID NO: 181204 - DNA, 20 bp, Artificial Sequence
  Description of Artificial Sequence: Synthetic oligonucleotide
  Target: ATXN1; (-) strand; PAM type: YTN; PAM sequence: TTT
catgcaagtggacgtaggga

SEQ ID NO: 181205 - DNA, 20 bp, Artificial Sequence
  Description of Artificial Sequence: Synthetic oligonucleotide
  Target: ATXN1; (-) strand; PAM type: YTN; PAM sequence: TTG
tgaaatttcatgcaagtgga

SEQ ID NO: 181206 - DNA, 20 bp, Artificial Sequence
  Description of Artificial Sequence: Synthetic oligonucleotide
  Target: ATXN1; (-) strand; PAM type: YTN; PAM sequence: CTT
gtgaaatttcatgcaagtgg

SEQ ID NO: 181207 - DNA, 20 bp, Artificial Sequence
  Description of Artificial Sequence: Synthetic oligonucleotide
  Target: ATXN1; (-) strand; PAM type: YTN; PAM sequence: CTC
acttgtgaaatttcatgcaa

SEQ ID NO: 181208 - DNA, 20 bp, Artificial Sequence
  Description of Artificial Sequence: Synthetic oligonucleotide
  Target: ATXN1; (-) strand; PAM type: YTN; PAM sequence: CTA
gggtgctcacttgtgaaatt

SEQ ID NO: 181209 - DNA, 20 bp, Artificial Sequence
  Description of Artificial Sequence: Synthetic oligonucleotide
  Target: ATXN1; (-) strand; PAM type: YTN; PAM sequence: CTG
tactagggtgctcacttgtg

SEQ ID NO: 181210 - DNA, 20 bp, Artificial Sequence
  Description of Artificial Sequence: Synthetic oligonucleotide
  Target: ATXN1; (-) strand; PAM type: YTN; PAM sequence: CTC
atgctgtactagggtgctca

SEQ ID NO: 181211 - DNA, 20 bp, Artificial Sequence
  Description of Artificial Sequence: Synthetic oligonucleotide
  Target: ATXN1; (-) strand; PAM type: YTN; PAM sequence: TTG
tccatgatacactcatgctg

SEQ ID NO: 181212 - DNA, 20 bp, Artificial Sequence
  Description of Artificial Sequence: Synthetic oligonucleotide
  Target: ATXN1; (-) strand; PAM type: YTN; PAM sequence: TTA
attgtccatgatacactcat

SEQ ID NO: 181213 - DNA, 20 bp, Artificial Sequence
  Description of Artificial Sequence: Synthetic oligonucleotide
  Target: ATXN1; (-) strand; PAM type: YTN; PAM sequence: TTG
gccgttaattgtccatgata

SEQ ID NO: 181214 - DNA, 20 bp, Artificial Sequence
  Description of Artificial Sequence: Synthetic oligonucleotide
  Target: ATXN1; (-) strand; PAM type: YTN; PAM sequence: CTT
ggccgttaattgtccatgat

SEQ ID NO: 181215 - DNA, 20 bp, Artificial Sequence
  Description of Artificial Sequence: Synthetic oligonucleotide
  Target: ATXN1; (-) strand; PAM type: YTN; PAM sequence: CTG
gtcttggccgttaattgtcc

SEQ ID NO: 181216 - DNA, 20 bp, Artificial Sequence
  Description of Artificial Sequence: Synthetic oligonucleotide
  Target: ATXN1; (-) strand; PAM type: YTN; PAM sequence: TTG
tctggtcttggccgttaatt

SEQ ID NO: 181217 - DNA, 20 bp, Artificial Sequence
  Description of Artificial Sequence: Synthetic oligonucleotide
  Target: ATXN1; (-) strand; PAM type: YTN; PAM sequence: TTT
gtctggtcttggccgttaat

SEQ ID NO: 181218 - DNA, 20 bp, Artificial Sequence
  Description of Artificial Sequence: Synthetic oligonucleotide
  Target: ATXN1; (-) strand; PAM type: YTN; PAM sequence: TTT
tgtctggtcttggccgttaa

SEQ ID NO: 181219 - DNA, 20 bp, Artificial Sequence
  Description of Artificial Sequence: Synthetic oligonucleotide
  Target: ATXN1; (-) strand; PAM type: YTN; PAM sequence: CTC
agggtgttttgtctggtctt

SEQ ID NO: 181220 - DNA, 20 bp, Artificial Sequence
  Description of Artificial Sequence: Synthetic oligonucleotide
  Target: ATXN1; (-) strand; PAM type: YTN; PAM sequence: CTG
aggacaagaactcagggtgt

SEQ ID NO: 181221 - DNA, 20 bp, Artificial Sequence
  Description of Artificial Sequence: Synthetic oligonucleotide
  Target: ATXN1; (-) strand; PAM type: YTN; PAM sequence: TTC
actgaggacaagaactcagg

SEQ ID NO: 181222 - DNA, 20 bp, Artificial Sequence
  Description of Artificial Sequence: Synthetic oligonucleotide
  Target: ATXN1; (-) strand; PAM type: YTN; PAM sequence: TTA
cataccaaaattcactgagg

SEQ ID NO: 181223 - DNA, 20 bp, Artificial Sequence
  Description of Artificial Sequence: Synthetic oligonucleotide
  Target: ATXN1; (-) strand; PAM type: YTN; PAM sequence: TTA
ttacataccaaaattcactg

SEQ ID NO: 181224 - DNA, 20 bp, Artificial Sequence
  Description of Artificial Sequence: Synthetic oligonucleotide
  Target: ATXN1; (-) strand; PAM type: YTN; PAM sequence: TTT
attacataccaaaattcact

SEQ ID NO: 181225 - DNA, 20 bp, Artificial Sequence
  Description of Artificial Sequence: Synthetic oligonucleotide
  Target: ATXN1; (-) strand; PAM type: YTN; PAM sequence: TTA
tttattacataccaaaattc

SEQ ID NO: 181226 - DNA, 20 bp, Artificial Sequence
  Description of Artificial Sequence: Synthetic oligonucleotide
  Target: ATXN1; (-) strand; PAM type: YTN; PAM sequence: TTT
atttattacataccaaaatt

SEQ ID NO: 181227 - DNA, 20 bp, Artificial Sequence
  Description of Artificial Sequence: Synthetic oligonucleotide
  Target: ATXN1; (-) strand; PAM type: YTN; PAM sequence: CTA
catgtttatttattacatac

SEQ ID NO: 181228 - DNA, 20 bp, Artificial Sequence
  Description of Artificial Sequence: Synthetic oligonucleotide
  Target: ATXN1; (-) strand; PAM type: YTN; PAM sequence: TTA
tactacatgtttatttatta

SEQ ID NO: 181229 - DNA, 20 bp, Artificial Sequence
  Description of Artificial Sequence: Synthetic oligonucleotide
  Target: ATXN1; (-) strand; PAM type: YTN; PAM sequence: TTT
atactacatgtttatttatt

SEQ ID NO: 181230 - DNA, 20 bp, Artificial Sequence
  Description of Artificial Sequence: Synthetic oligonucleotide
  Target: ATXN1; (-) strand; PAM type: YTN; PAM sequence: TTT
tatactacatgtttatttat

SEQ ID NO: 181231 - DNA, 20 bp, Artificial Sequence
  Description of Artificial Sequence: Synthetic oligonucleotide
  Target: ATXN1; (-) strand; PAM type: YTN; PAM sequence: TTA
caccattttatactacatgt

SEQ ID NO: 181232 - DNA, 20 bp, Artificial Sequence
  Description of Artificial Sequence: Synthetic oligonucleotide
  Target: ATXN1; (-) strand; PAM type: YTN; PAM sequence: TTA
ttacaccattttatactaca

SEQ ID NO: 181233 - DNA, 20 bp, Artificial Sequence
  Description of Artificial Sequence: Synthetic oligonucleotide
  Target: ATXN1; (-) strand; PAM type: YTN; PAM sequence: TTT
attacaccattttatactac

SEQ ID NO: 181234 - DNA, 20 bp, Artificial Sequence
  Description of Artificial Sequence: Synthetic oligonucleotide
  Target: ATXN1; (-) strand; PAM type: YTN; PAM sequence: TTT
tattacaccattttatacta

SEQ ID NO: 181235 - DNA, 20 bp, Artificial Sequence
  Description of Artificial Sequence: Synthetic oligonucleotide
  Target: ATXN1; (-) strand; PAM type: YTN; PAM sequence: TTA
attttattacaccattttat

SEQ ID NO: 181236 - DNA, 20 bp, Artificial Sequence
  Description of Artificial Sequence: Synthetic oligonucleotide
  Target: ATXN1; (-) strand; PAM type: YTN; PAM sequence: TTT
aattttattacaccatttta

SEQ ID NO: 181237 - DNA, 20 bp, Artificial Sequence
  Description of Artificial Sequence: Synthetic oligonucleotide
  Target: ATXN1; (-) strand; PAM type: YTN; PAM sequence: TTA
atgccaataatttaatttta

SEQ ID NO: 181238 - DNA, 20 bp, Artificial Sequence
  Description of Artificial Sequence: Synthetic oligonucleotide
  Target: ATXN1; (-) strand; PAM type: YTN; PAM sequence: TTT
aatgccaataatttaatttt

SEQ ID NO: 181239 - DNA, 20 bp, Artificial Sequence
  Description of Artificial Sequence: Synthetic oligonucleotide
  Target: ATXN1; (-) strand; PAM type: YTN; PAM sequence: CTG
acagtttaatgccaataatt

SEQ ID NO: 181240 - DNA, 20 bp, Artificial Sequence
  Description of Artificial Sequence: Synthetic oligonucleotide
  Target: ATXN1; (-) strand; PAM type: YTN; PAM sequence: CTA
ccataagcatggtatgtctg

SEQ ID NO: 181241 - DNA, 20 bp, Artificial Sequence
  Description of Artificial Sequence: Synthetic oligonucleotide
  Target: ATXN1; (-) strand; PAM type: YTN; PAM sequence: TTG
gctaccataagcatggtatg

SEQ ID NO: 181242 - DNA, 20 bp, Artificial Sequence
  Description of Artificial Sequence: Synthetic oligonucleotide
  Target: ATXN1; (-) strand; PAM type: YTN; PAM sequence: CTG
acattggctaccataagcat

SEQ ID NO: 181243 - DNA, 20 bp, Artificial Sequence
  Description of Artificial Sequence: Synthetic oligonucleotide
  Target: ATXN1; (-) strand; PAM type: YTN; PAM sequence: CTC
tgacattggctaccataagc

SEQ ID NO: 181244 - DNA, 20 bp, Artificial Sequence
  Description of Artificial Sequence: Synthetic oligonucleotide
  Target: ATXN1; (-) strand; PAM type: YTN; PAM sequence: TTA
atctctgacattggctacca

SEQ ID NO: 181245 - DNA, 20 bp, Artificial Sequence
  Description of Artificial Sequence: Synthetic oligonucleotide
  Target: ATXN1; (-) strand; PAM type: YTN; PAM sequence: TTT
aatctctgacattggctacc

SEQ ID NO: 181246 - DNA, 20 bp, Artificial Sequence
  Description of Artificial Sequence: Synthetic oligonucleotide
  Target: ATXN1; (-) strand; PAM type: YTN; PAM sequence: TTA
gatttaatctctgacattgg

SEQ ID NO: 181247 - DNA, 20 bp, Artificial Sequence
  Description of Artificial Sequence: Synthetic oligonucleotide
  Target: ATXN1; (-) strand; PAM type: YTN; PAM sequence: TTT
agatttaatctctgacattg

SEQ ID NO: 181248 - DNA, 20 bp, Artificial Sequence
  Description of Artificial Sequence: Synthetic oligonucleotide
  Target: ATXN1; (-) strand; PAM type: YTN; PAM sequence: CTT
tagatttaatctctgacatt

SEQ ID NO: 181249 - DNA, 20 bp, Artificial Sequence
  Description of Artificial Sequence: Synthetic oligonucleotide
  Target: ATXN1; (-) strand; PAM type: YTN; PAM sequence: TTG
aactttagatttaatctctg

SEQ ID NO: 181250 - DNA, 20 bp, Artificial Sequence
  Description of Artificial Sequence: Synthetic oligonucleotide
  Target: ATXN1; (-) strand; PAM type: YTN; PAM sequence: CTT
gaactttagatttaatctct

SEQ ID NO: 181251 - DNA, 20 bp, Artificial Sequence
  Description of Artificial Sequence: Synthetic oligonucleotide
  Target: ATXN1; (-) strand; PAM type: YTN; PAM sequence: TTG
catggtgggtccaatcttga

SEQ ID NO: 181252 - DNA, 20 bp, Artificial Sequence
  Description of Artificial Sequence: Synthetic oligonucleotide
  Target: ATXN1; (-) strand; PAM type: YTN; PAM sequence: TTT
gcatggtgggtccaatcttg

SEQ ID NO: 181253 - DNA, 20 bp, Artificial Sequence
  Description of Artificial Sequence: Synthetic oligonucleotide
  Target: ATXN1; (-) strand; PAM type: YTN; PAM sequence: CTT
tgcatggtgggtccaatctt

SEQ ID NO: 181254 - DNA, 20 bp, Artificial Sequence
  Description of Artificial Sequence: Synthetic oligonucleotide
  Target: ATXN1; (-) strand; PAM type: YTN; PAM sequence: TTG
ctttgcatggtgggtccaat

SEQ ID NO: 181255 - DNA, 20 bp, Artificial Sequence
  Description of Artificial Sequence: Synthetic oligonucleotide
  Target: ATXN1; (-) strand; PAM type: YTN; PAM sequence: TTT
gctttgcatggtgggtccaa

SEQ ID NO: 181256 - DNA, 20 bp, Artificial Sequence
  Description of Artificial Sequence: Synthetic oligonucleotide
  Target: ATXN1; (-) strand; PAM type: YTN; PAM sequence: CTT
tgctttgcatggtgggtcca

SEQ ID NO: 181257 - DNA, 20 bp, Artificial Sequence
  Description of Artificial Sequence: Synthetic oligonucleotide
  Target: ATXN1; (-) strand; PAM type: YTN; PAM sequence: TTG
tctttgctttgcatggtggg

SEQ ID NO: 181258 - DNA, 20 bp, Artificial Sequence
  Description of Artificial Sequence: Synthetic oligonucleotide
  Target: ATXN1; (-) strand; PAM type: YTN; PAM sequence: TTA
gaaggaagaaattgtctttg

SEQ ID NO: 181259 - DNA, 20 bp, Artificial Sequence
  Description of Artificial Sequence: Synthetic oligonucleotide
  Target: ATXN1; (-) strand; PAM type: YTN; PAM sequence: TTT
agaaggaagaaattgtcttt

SEQ ID NO: 181260 - DNA, 20 bp, Artificial Sequence
  Description of Artificial Sequence: Synthetic oligonucleotide
  Target: ATXN1; (-) strand; PAM type: YTN; PAM sequence: TTT
tagaaggaagaaattgtctt

SEQ ID NO: 181261 - DNA, 20 bp, Artificial Sequence
  Description of Artificial Sequence: Synthetic oligonucleotide
  Target: ATXN1; (-) strand; PAM type: YTN; PAM sequence: TTC
aattttagaaggaagaaatt

SEQ ID NO: 181262 - DNA, 20 bp, Artificial Sequence
  Description of Artificial Sequence: Synthetic oligonucleotide
  Target: ATXN1; (-) strand; PAM type: YTN; PAM sequence: TTT
caattttagaaggaagaaat

SEQ ID NO: 181263 - DNA, 20 bp, Artificial Sequence
  Description of Artificial Sequence: Synthetic oligonucleotide
  Target: ATXN1; (-) strand; PAM type: YTN; PAM sequence: CTT
tcaattttagaaggaagaaa

SEQ ID NO: 181264 - DNA, 20 bp, Artificial Sequence
  Description of Artificial Sequence: Synthetic oligonucleotide
  Target: ATXN1; (-) strand; PAM type: YTN; PAM sequence: CTC
tttcaattttagaaggaaga

SEQ ID NO: 181265 - DNA, 20 bp, Artificial Sequence
  Description of Artificial Sequence: Synthetic oligonucleotide
  Target: ATXN1; (-) strand; PAM type: YTN; PAM sequence: CTC
atctctttcaattttagaag

SEQ ID NO: 181266 - DNA, 20 bp, Artificial Sequence
  Description of Artificial Sequence: Synthetic oligonucleotide
  Target: ATXN1; (-) strand; PAM type: YTN; PAM sequence: CTG
agggagggctcatctctttc

SEQ ID NO: 181267 - DNA, 20 bp, Artificial Sequence
  Description of Artificial Sequence: Synthetic oligonucleotide
  Target: ATXN1; (-) strand; PAM type: YTN; PAM sequence: CTC
ataagcctgagggagggctc

SEQ ID NO: 181268 - DNA, 20 bp, Artificial Sequence
  Description of Artificial Sequence: Synthetic oligonucleotide
  Target: ATXN1; (-) strand; PAM type: YTN; PAM sequence: TTA
aaaaacaagaagaagaagaa

SEQ ID NO: 181269 - DNA, 20 bp, Artificial Sequence
  Description of Artificial Sequence: Synthetic oligonucleotide
  Target: ATXN1; (-) strand; PAM type: YTN; PAM sequence: CTT
aaaaaacaagaagaagaaga

SEQ ID NO: 181270 - DNA, 20 bp, Artificial Sequence
  Description of Artificial Sequence: Synthetic oligonucleotide
  Target: ATXN1; (-) strand; PAM type: YTN; PAM sequence: TTG
atgtacttaaaaaacaagaa

SEQ ID NO: 181271 - DNA, 20 bp, Artificial Sequence
  Description of Artificial Sequence: Synthetic oligonucleotide
  Target: ATXN1; (-) strand; PAM type: YTN; PAM sequence: CTC
attgatgtacttaaaaaaca

SEQ ID NO: 181272 - DNA, 20 bp, Artificial Sequence
  Description of Artificial Sequence: Synthetic oligonucleotide
  Target: ATXN1; (-) strand; PAM type: YTN; PAM sequence: TTA
atgagatgctcattgatgta

SEQ ID NO: 181273 - DNA, 20 bp, Artificial Sequence
  Description of Artificial Sequence: Synthetic oligonucleotide
  Target: ATXN1; (-) strand; PAM type: YTN; PAM sequence: TTA
taacattaatgagatgctca

SEQ ID NO: 181274 - DNA, 20 bp, Artificial Sequence
  Description of Artificial Sequence: Synthetic oligonucleotide
  Target: ATXN1; (-) strand; PAM type: YTN; PAM sequence: TTA
aattataacattaatgagat

SEQ ID NO: 181275 - DNA, 20 bp, Artificial Sequence
  Description of Artificial Sequence: Synthetic oligonucleotide
  Target: ATXN1; (-) strand; PAM type: YTN; PAM sequence: TTT
aaattataacattaatgaga

SEQ ID NO: 181276 - DNA, 20 bp, Artificial Sequence
  Description of Artificial Sequence: Synthetic oligonucleotide
  Target: ATXN1; (-) strand; PAM type: YTN; PAM sequence: TTT
taaattataacattaatgag

SEQ ID NO: 181277 - DNA, 20 bp, Artificial Sequence
  Description of Artificial Sequence: Synthetic oligonucleotide
  Target: ATXN1; (-) strand; PAM type: YTN; PAM sequence: TTT
ttaaattataacattaatga

SEQ ID NO: 181278 - DNA, 20 bp, Artificial Sequence
  Description of Artificial Sequence: Synthetic oligonucleotide
  Target: ATXN1; (-) strand; PAM type: YTN; PAM sequence: CTT
tttaaattataacattaatg

SEQ ID NO: 181279 - DNA, 20 bp, Artificial Sequence
  Description of Artificial Sequence: Synthetic oligonucleotide
  Target: ATXN1; (-) strand; PAM type: YTN; PAM sequence: TTA
gagggagaaaacacttttta

SEQ ID NO: 181280 - DNA, 20 bp, Artificial Sequence
  Description of Artificial Sequence: Synthetic oligonucleotide
  Target: ATXN1; (-) strand; PAM type: YTN; PAM sequence: TTC
cattagagggagaaaacact

SEQ ID NO: 181281 - DNA, 20 bp, Artificial Sequence
  Description of Artificial Sequence: Synthetic oligonucleotide
  Target: ATXN1; (-) strand; PAM type: YTN; PAM sequence: CTT
ccattagagggagaaaacac

SEQ ID NO: 181282 - DNA, 20 bp, Artificial Sequence
  Description of Artificial Sequence: Synthetic oligonucleotide
  Target: ATXN1; (-) strand; PAM type: YTN; PAM sequence: CTA
aatcttccattagagggaga

SEQ ID NO: 181283 - DNA, 20 bp, Artificial Sequence
  Description of Artificial Sequence: Synthetic oligonucleotide
  Target: ATXN1; (-) strand; PAM type: YTN; PAM sequence: CTA
gcctaaatcttccattagag

SEQ ID NO: 181284 - DNA, 20 bp, Artificial Sequence
  Description of Artificial Sequence: Synthetic oligonucleotide
  Target: ATXN1; (-) strand; PAM type: YTN; PAM sequence: CTC
tagcctaaatcttccattag

SEQ ID NO: 181285 - DNA, 20 bp, Artificial Sequence
  Description of Artificial Sequence: Synthetic oligonucleotide
  Target: ATXN1; (-) strand; PAM type: YTN; PAM sequence: TTC
ctctagcctaaatcttccat

SEQ ID NO: 181286 - DNA, 20 bp, Artificial Sequence
  Description of Artificial Sequence: Synthetic oligonucleotide
  Target: ATXN1; (-) strand; PAM type: YTN; PAM sequence: CTT
cctctagcctaaatcttcca

SEQ ID NO: 181287 - DNA, 20 bp, Artificial Sequence
  Description of Artificial Sequence: Synthetic oligonucleotide
  Target: ATXN1; (-) strand; PAM type: YTN; PAM sequence: TTG
gaggaccaatgatagcttcc

SEQ ID NO: 181288 - DNA, 20 bp, Artificial Sequence
  Description of Artificial Sequence: Synthetic oligonucleotide
  Target: ATXN1; (-) strand; PAM type: YTN; PAM sequence: TTT
ggaggaccaatgatagcttc

SEQ ID NO: 181289 - DNA, 20 bp, Artificial Sequence
  Description of Artificial Sequence: Synthetic oligonucleotide
  Target: ATXN1; (-) strand; PAM type: YTN; PAM sequence: CTG
cgatttggaggaccaatgat

SEQ ID NO: 181290 - DNA, 20 bp, Artificial Sequence
  Description of Artificial Sequence: Synthetic oligonucleotide
  Target: ATXN1; (-) strand; PAM type: YTN; PAM sequence: TTG
gtaagcctgcgatttggagg

SEQ ID NO: 181291 - DNA, 20 bp, Artificial Sequence
  Description of Artificial Sequence: Synthetic oligonucleotide
  Target: ATXN1; (-) strand; PAM type: YTN; PAM sequence: TTA
attggtaagcctgcgatttg

SEQ ID NO: 181292 - DNA, 20 bp, Artificial Sequence
  Description of Artificial Sequence: Synthetic oligonucleotide
  Target: ATXN1; (-) strand; PAM type: YTN; PAM sequence: TTT
aattggtaagcctgcgattt

SEQ ID NO: 181293 - DNA, 20 bp, Artificial Sequence
  Description of Artificial Sequence: Synthetic oligonucleotide
  Target: ATXN1; (-) strand; PAM type: YTN; PAM sequence: TTT
taattggtaagcctgcgatt

SEQ ID NO: 181294 - DNA, 20 bp, Artificial Sequence
  Description of Artificial Sequence: Synthetic oligonucleotide
  Target: ATXN1; (-) strand; PAM type: YTN; PAM sequence: TTT
ttaattggtaagcctgcgat

SEQ ID NO: 181295 - DNA, 20 bp, Artificial Sequence
  Description of Artificial Sequence: Synthetic oligonucleotide
  Target: ATXN1; (-) strand; PAM type: YTN; PAM sequence: TTT
tttaattggtaagcctgcga

SEQ ID NO: 181296 - DNA, 20 bp, Artificial Sequence
  Description of Artificial Sequence: Synthetic oligonucleotide
  Target: ATXN1; (-) strand; PAM type: YTN; PAM sequence: TTA
cattttttaattggtaagcc

SEQ ID NO: 181297 - DNA, 20 bp, Artificial Sequence
  Description of Artificial Sequence: Synthetic oligonucleotide
  Target: ATXN1; (-) strand; PAM type: YTN; PAM sequence: TTT
acattttttaattggtaagc

SEQ ID NO: 181298 - DNA, 20 bp, Artificial Sequence
  Description of Artificial Sequence: Synthetic oligonucleotide
  Target: ATXN1; (-) strand; PAM type: YTN; PAM sequence: CTA
acaatgtgaaaccatttaca

SEQ ID NO: 181299 - DNA, 20 bp, Artificial Sequence
  Description of Artificial Sequence: Synthetic oligonucleotide
  Target: ATXN1; (-) strand; PAM type: YTN; PAM sequence: CTG
atatcgctaacaatgtgaaa

SEQ ID NO: 181300 - DNA, 20 bp, Artificial Sequence
  Description of Artificial Sequence: Synthetic oligonucleotide
  Target: ATXN1; (-) strand; PAM type: YTN; PAM sequence: TTC
aaagctgatatcgctaacaa

SEQ ID NO: 181301 - DNA, 20 bp, Artificial Sequence
  Description of Artificial Sequence: Synthetic oligonucleotide
  Target: ATXN1; (-) strand; PAM type: YTN; PAM sequence: TTT
caaagctgatatcgctaaca

SEQ ID NO: 181302 - DNA, 20 bp, Artificial Sequence
  Description of Artificial Sequence: Synthetic oligonucleotide
  Target: ATXN1; (-) strand; PAM type: YTN; PAM sequence: CTT
tcaaagctgatatcgctaac

SEQ ID NO: 181303 - DNA, 20 bp, Artificial Sequence
  Description of Artificial Sequence: Synthetic oligonucleotide
  Target: ATXN1; (-) strand; PAM type: YTN; PAM sequence: TTC
tttcaaagctgatatcgcta

SEQ ID NO: 181304 - DNA, 20 bp, Artificial Sequence
  Description of Artificial Sequence: Synthetic oligonucleotide
  Target: ATXN1; (-) strand; PAM type: YTN; PAM sequence: CTT
ctttcaaagctgatatcgct

SEQ ID NO: 181305 - DNA, 20 bp, Artificial Sequence
  Description of Artificial Sequence: Synthetic oligonucleotide
  Target: ATXN1; (-) strand; PAM type: YTN; PAM sequence: TTA
aaacaaaaggaagaaaagaa

SEQ ID NO: 181306 - DNA, 20 bp, Artificial Sequence
  Description of Artificial Sequence: Synthetic oligonucleotide
  Target: ATXN1; (-) strand; PAM type: YTN; PAM sequence: CTT
aaaacaaaaggaagaaaaga

SEQ ID NO: 181307 - DNA, 20 bp, Artificial Sequence
  Description of Artificial Sequence: Synthetic oligonucleotide
  Target: ATXN1; (-) strand; PAM type: YTN; PAM sequence: TTC
acttaaaacaaaaggaagaa

SEQ ID NO: 181308 - DNA, 20 bp, Artificial Sequence
  Description of Artificial Sequence: Synthetic oligonucleotide
  Target: ATXN1; (-) strand; PAM type: YTN; PAM sequence: TTA
aaacgtgttcacttaaaaca

SEQ ID NO: 181309 - DNA, 20 bp, Artificial Sequence
  Description of Artificial Sequence: Synthetic oligonucleotide
  Target: ATXN1; (-) strand; PAM type: YTN; PAM sequence: CTT
aaaacgtgttcacttaaaac

SEQ ID NO: 181310 - DNA, 20 bp, Artificial Sequence
  Description of Artificial Sequence: Synthetic oligonucleotide
  Target: ATXN1; (-) strand; PAM type: YTN; PAM sequence: TTA
tccacttaaaacgtgttcac

SEQ ID NO: 181311 - DNA, 20 bp, Artificial Sequence
  Description of Artificial Sequence: Synthetic oligonucleotide
  Target: ATXN1; (-) strand; PAM type: YTN; PAM sequence: CTT
atccacttaaaacgtgttca

SEQ ID NO: 181312 - DNA, 20 bp, Artificial Sequence
  Description of Artificial Sequence: Synthetic oligonucleotide
  Target: ATXN1; (-) strand; PAM type: YTN; PAM sequence: TTA
aacttatccacttaaaacgt

SEQ ID NO: 181313 - DNA, 20 bp, Artificial Sequence
  Description of Artificial Sequence: Synthetic oligonucleotide
  Target: ATXN1; (-) strand; PAM type: YTN; PAM sequence: TTT
aaacttatccacttaaaacg

SEQ ID NO: 181314 - DNA, 20 bp, Artificial Sequence
  Description of Artificial Sequence: Synthetic oligonucleotide
  Target: ATXN1; (-) strand; PAM type: YTN; PAM sequence: CTT
taaacttatccacttaaaac

SEQ ID NO: 181315 - DNA, 20 bp, Artificial Sequence
  Description of Artificial Sequence: Synthetic oligonucleotide
  Target: ATXN1; (-) strand; PAM type: YTN; PAM sequence: TTC
ctttaaacttatccacttaa

SEQ ID NO: 181316 - DNA, 20 bp, Artificial Sequence
  Description of Artificial Sequence: Synthetic oligonucleotide
  Target: ATXN1; (-) strand; PAM type: YTN; PAM sequence: TTT
cctttaaacttatccactta

SEQ ID NO: 181317 - DNA, 20 bp, Artificial Sequence
  Description of Artificial Sequence: Synthetic oligonucleotide
  Target: ATXN1; (-) strand; PAM type: YTN; PAM sequence: TTT
tcctttaaacttatccactt

SEQ ID NO: 181318 - DNA, 20 bp, Artificial Sequence
  Description of Artificial Sequence: Synthetic oligonucleotide
  Target: ATXN1; (-) strand; PAM type: YTN; PAM sequence: CTC
aggatatgttttcctttaaa

SEQ ID NO: 181319 - DNA, 20 bp, Artificial Sequence
  Description of Artificial Sequence: Synthetic oligonucleotide
  Target: ATXN1; (-) strand; PAM type: YTN; PAM sequence: TTG
caagctcaggatatgttttc

SEQ ID NO: 181320 - DNA, 20 bp, Artificial Sequence
  Description of Artificial Sequence: Synthetic oligonucleotide
  Target: ATXN1; (-) strand; PAM type: YTN; PAM sequence: CTT
gcaagctcaggatatgtttt

SEQ ID NO: 181321 - DNA, 20 bp, Artificial Sequence
  Description of Artificial Sequence: Synthetic oligonucleotide
  Target: ATXN1; (-) strand; PAM type: YTN; PAM sequence: TTA
ccttgcaagctcaggatatg

SEQ ID NO: 181322 - DNA, 20 bp, Artificial Sequence
  Description of Artificial Sequence: Synthetic oligonucleotide
  Target: ATXN1; (-) strand; PAM type: YTN; PAM sequence: TTA
aacagttaccttgcaagctc

SEQ ID NO: 181323 - DNA, 20 bp, Artificial Sequence
  Description of Artificial Sequence: Synthetic oligonucleotide
  Target: ATXN1; (-) strand; PAM type: YTN; PAM sequence: TTT
aaacagttaccttgcaagct

SEQ ID NO: 181324 - DNA, 20 bp, Artificial Sequence
  Description of Artificial Sequence: Synthetic oligonucleotide
  Target: ATXN1; (-) strand; PAM type: YTN; PAM sequence: TTT
taaacagttaccttgcaagc

SEQ ID NO: 181325 - DNA, 20 bp, Artificial Sequence
  Description of Artificial Sequence: Synthetic oligonucleotide
  Target: ATXN1; (-) strand; PAM type: YTN; PAM sequence: TTT
ttaaacagttaccttgcaag

SEQ ID NO: 181326 - DNA, 20 bp, Artificial Sequence
  Description of Artificial Sequence: Synthetic oligonucleotide
  Target: ATXN1; (-) strand; PAM type: YTN; PAM sequence: TTT
tttaaacagttaccttgcaa

SEQ ID NO: 181327 - DNA, 20 bp, Artificial Sequence
  Description of Artificial Sequence: Synthetic oligonucleotide
  Target: ATXN1; (-) strand; PAM type: YTN; PAM sequence: TTT
ttttaaacagttaccttgca

SEQ ID NO: 181328 - DNA, 20 bp, Artificial Sequence
  Description of Artificial Sequence: Synthetic oligonucleotide
  Target: ATXN1; (-) strand; PAM type: YTN; PAM sequence: TTA
tttttttaaacagttacctt

SEQ ID NO: 181329 - DNA, 20 bp, Artificial Sequence
  Description of Artificial Sequence: Synthetic oligonucleotide
  Target: ATXN1; (-) strand; PAM type: YTN; PAM sequence: TTT
atttttttaaacagttacct

SEQ ID NO: 181330 - DNA, 20 bp, Artificial Sequence
  Description of Artificial Sequence: Synthetic oligonucleotide
  Target: ATXN1; (-) strand; PAM type: YTN; PAM sequence: TTT
tatttttttaaacagttacc

SEQ ID NO: 181331 - DNA, 20 bp, Artificial Sequence
  Description of Artificial Sequence: Synthetic oligonucleotide
  Target: ATXN1; (-) strand; PAM type: YTN; PAM sequence: TTG
ttttatttttttaaacagtt

SEQ ID NO: 181332 - DNA, 20 bp, Artificial Sequence
  Description of Artificial Sequence: Synthetic oligonucleotide
  Target: ATXN1; (-) strand; PAM type: YTN; PAM sequence: TTG
caaataataatgagttgttt

SEQ ID NO: 181333 - DNA, 20 bp, Artificial Sequence
  Description of Artificial Sequence: Synthetic oligonucleotide
  Target: ATXN1; (-) strand; PAM type: YTN; PAM sequence: CTA
aaataaggagttgcaaataa

SEQ ID NO: 181334 - DNA, 20 bp, Artificial Sequence
  Description of Artificial Sequence: Synthetic oligonucleotide
  Target: ATXN1; (-) strand; PAM type: YTN; PAM sequence: TTC
cctaaaataaggagttgcaa

SEQ ID NO: 181335 - DNA, 20 bp, Artificial Sequence
  Description of Artificial Sequence: Synthetic oligonucleotide
  Target: ATXN1; (-) strand; PAM type: YTN; PAM sequence: CTG
attccctaaaataaggagtt

SEQ ID NO: 181336 - DNA, 20 bp, Artificial Sequence
  Description of Artificial Sequence: Synthetic oligonucleotide
  Target: ATXN1; (-) strand; PAM type: YTN; PAM sequence: TTG
agaaaaccctgattccctaa

SEQ ID NO: 181337 - DNA, 20 bp, Artificial Sequence
  Description of Artificial Sequence: Synthetic oligonucleotide
  Target: ATXN1; (-) strand; PAM type: YTN; PAM sequence: TTG
tgcagtattgagaaaaccct

SEQ ID NO: 181338 - DNA, 20 bp, Artificial Sequence
  Description of Artificial Sequence: Synthetic oligonucleotide
  Target: ATXN1; (-) strand; PAM type: YTN; PAM sequence: TTG
ttgtgcagtattgagaaaac

SEQ ID NO: 181339 - DNA, 20 bp, Artificial Sequence
  Description of Artificial Sequence: Synthetic oligonucleotide
  Target: ATXN1; (-) strand; PAM type: YTN; PAM sequence: TTA
tgttgttgtgcagtattgag

SEQ ID NO: 181340 - DNA, 20 bp, Artificial Sequence
  Description of Artificial Sequence: Synthetic oligonucleotide
  Target: ATXN1; (-) strand; PAM type: YTN; PAM sequence: TTT
atgttgttgtgcagtattga

SEQ ID NO: 181341 - DNA, 20 bp, Artificial Sequence
  Description of Artificial Sequence: Synthetic oligonucleotide
  Target: ATXN1; (-) strand; PAM type: YTN; PAM sequence: TTT
tatgttgttgtgcagtattg

SEQ ID NO: 181342 - DNA, 20 bp, Artificial Sequence
  Description of Artificial Sequence: Synthetic oligonucleotide
  Target: ATXN1; (-) strand; PAM type: YTN; PAM sequence: TTT
ttatgttgttgtgcagtatt

SEQ ID NO: 181343 - DNA, 20 bp, Artificial Sequence
  Description of Artificial Sequence: Synthetic oligonucleotide
  Target: ATXN1; (-) strand; PAM type: YTN; PAM sequence: TTT
tttatgttgttgtgcagtat

SEQ ID NO: 181344 - DNA, 20 bp, Artificial Sequence
  Description of Artificial Sequence: Synthetic oligonucleotide
  Target: ATXN1; (-) strand; PAM type: YTN; PAM sequence: TTA
ggtatattttttatgttgtt

SEQ ID NO: 181345 - DNA, 20 bp, Artificial Sequence
  Description of Artificial Sequence: Synthetic oligonucleotide
  Target: ATXN1; (-) strand; PAM type: YTN; PAM sequence: TTG
ttaggtatattttttatgtt

SEQ ID NO: 181346 - DNA, 20 bp, Artificial Sequence
  Description of Artificial Sequence: Synthetic oligonucleotide
  Target: ATXN1; (-) strand; PAM type: YTN; PAM sequence: TTG
ttgttaggtatattttttat

SEQ ID NO: 181347 - DNA, 20 bp, Artificial Sequence
  Description of Artificial Sequence: Synthetic oligonucleotide
  Target: ATXN1; (-) strand; PAM type: YTN; PAM sequence: TTT
gttgttaggtatatttttta

SEQ ID NO: 181348 - DNA, 20 bp, Artificial Sequence
  Description of Artificial Sequence: Synthetic oligonucleotide
  Target: ATXN1; (-) strand; PAM type: YTN; PAM sequence: TTT
tgttgttaggtatatttttt

SEQ ID NO: 181349 - DNA, 20 bp, Artificial Sequence
  Description of Artificial Sequence: Synthetic oligonucleotide
  Target: ATXN1; (-) strand; PAM type: YTN; PAM sequence: CTT
ttgttgttaggtatattttt

SEQ ID NO: 181350 - DNA, 20 bp, Artificial Sequence
  Description of Artificial Sequence: Synthetic oligonucleotide
  Target: ATXN1; (-) strand; PAM type: YTN; PAM sequence: TTG
ccttttgttgttaggtatat

SEQ ID NO: 181351 - DNA, 20 bp, Artificial Sequence
  Description of Artificial Sequence: Synthetic oligonucleotide
  Target: ATXN1; (-) strand; PAM type: YTN; PAM sequence: TTA
ttgccttttgttgttaggta

SEQ ID NO: 181352 - DNA, 20 bp, Artificial Sequence
  Description of Artificial Sequence: Synthetic oligonucleotide
  Target: ATXN1; (-) strand; PAM type: YTN; PAM sequence: TTT
attgccttttgttgttaggt

SEQ ID NO: 181353 - DNA, 20 bp, Artificial Sequence
  Description of Artificial Sequence: Synthetic oligonucleotide
  Target: ATXN1; (-) strand; PAM type: YTN; PAM sequence: TTC
caatttattgccttttgttg

SEQ ID NO: 181354 - DNA, 20 bp, Artificial Sequence
  Description of Artificial Sequence: Synthetic oligonucleotide
  Target: ATXN1; (-) strand; PAM type: YTN; PAM sequence: TTT
ccaatttattgccttttgtt

SEQ ID NO: 181355 - DNA, 20 bp, Artificial Sequence
  Description of Artificial Sequence: Synthetic oligonucleotide
  Target: ATXN1; (-) strand; PAM type: YTN; PAM sequence: TTC
agtttccaatttattgcctt

SEQ ID NO: 181356 - DNA, 20 bp, Artificial Sequence
  Description of Artificial Sequence: Synthetic oligonucleotide
  Target: ATXN1; (-) strand; PAM type: YTN; PAM sequence: CTT
cagtttccaatttattgcct

SEQ ID NO: 181357 - DNA, 20 bp, Artificial Sequence
  Description of Artificial Sequence: Synthetic oligonucleotide
  Target: ATXN1; (-) strand; PAM type: YTN; PAM sequence: TTA
acttcagtttccaatttatt

SEQ ID NO: 181358 - DNA, 20 bp, Artificial Sequence
  Description of Artificial Sequence: Synthetic oligonucleotide
  Target: ATXN1; (-) strand; PAM type: YTN; PAM sequence: TTT
aacttcagtttccaatttat

SEQ ID NO: 181359 - DNA, 20 bp, Artificial Sequence
  Description of Artificial Sequence: Synthetic oligonucleotide
  Target: ATXN1; (-) strand; PAM type: YTN; PAM sequence: CTT
taacttcagtttccaattta

SEQ ID NO: 181360 - DNA, 20 bp, Artificial Sequence
  Description of Artificial Sequence: Synthetic oligonucleotide
  Target: ATXN1; (-) strand; PAM type: YTN; PAM sequence: TTC
tttaacttcagtttccaatt

SEQ ID NO: 181361 - DNA, 20 bp, Artificial Sequence
  Description of Artificial Sequence: Synthetic oligonucleotide
  Target: ATXN1; (-) strand; PAM type: YTN; PAM sequence: CTT
ctttaacttcagtttccaat

SEQ ID NO: 181362 - DNA, 20 bp, Artificial Sequence
  Description of Artificial Sequence: Synthetic oligonucleotide
  Target: ATXN1; (-) strand; PAM type: YTN; PAM sequence: CTG
caatcttctttaacttcagt

SEQ ID NO: 181363 - DNA, 20 bp, Artificial Sequence
  Description of Artificial Sequence: Synthetic oligonucleotide
  Target: ATXN1; (-) strand; PAM type: YTN; PAM sequence: TTA
gagatgacagctgcaatctt

SEQ ID NO: 181364 - DNA, 20 bp, Artificial Sequence
  Description of Artificial Sequence: Synthetic oligonucleotide
  Target: ATXN1; (-) strand; PAM type: YTN; PAM sequence: TTG
aaagcagtgttagagatgac

SEQ ID NO: 181365 - DNA, 20 bp, Artificial Sequence
  Description of Artificial Sequence: Synthetic oligonucleotide
  Target: ATXN1; (-) strand; PAM type: YTN; PAM sequence: TTT
gaaagcagtgttagagatga

SEQ ID NO: 181366 - DNA, 20 bp, Artificial Sequence
  Description of Artificial Sequence: Synthetic oligonucleotide
  Target: ATXN1; (-) strand; PAM type: YTN; PAM sequence: TTG
tgatgaacacagaaatttga

SEQ ID NO: 181367 - DNA, 20 bp, Artificial Sequence
  Description of Artificial Sequence: Synthetic oligonucleotide
  Target: ATXN1; (-) strand; PAM type: YTN; PAM sequence: TTT
gtgatgaacacagaaatttg

SEQ ID NO: 181368 - DNA, 20 bp, Artificial Sequence
  Description of Artificial Sequence: Synthetic oligonucleotide
  Target: ATXN1; (-) strand; PAM type: YTN; PAM sequence: CTT
tgtgatgaacacagaaattt

SEQ ID NO: 181369 - DNA, 20 bp, Artificial Sequence
  Description of Artificial Sequence: Synthetic oligonucleotide
  Target: ATXN1; (-) strand; PAM type: YTN; PAM sequence: TTA
taaaatcaagaagaaagaac

SEQ ID NO: 181370 - DNA, 20 bp, Artificial Sequence
  Description of Artificial Sequence: Synthetic oligonucleotide
  Target: ATXN1; (-) strand; PAM type: YTN; PAM sequence: CTT
ataaaatcaagaagaaagaa

SEQ ID NO: 181371 - DNA, 20 bp, Artificial Sequence
  Description of Artificial Sequence: Synthetic oligonucleotide
  Target: ATXN1; (-) strand; PAM type: YTN; PAM sequence: CTG
acttataaaatcaagaagaa

SEQ ID NO: 181372 - DNA, 20 bp, Artificial Sequence
  Description of Artificial Sequence: Synthetic oligonucleotide
  Target: ATXN1; (-) strand; PAM type: YTN; PAM sequence: TTC
agcgtgtaatgctgacttat

SEQ ID NO: 181373 - DNA, 20 bp, Artificial Sequence
  Description of Artificial Sequence: Synthetic oligonucleotide
  Target: ATXN1; (-) strand; PAM type: YTN; PAM sequence: TTT
cagcgtgtaatgctgactta

SEQ ID NO: 181374 - DNA, 20 bp, Artificial Sequence
  Description of Artificial Sequence: Synthetic oligonucleotide
  Target: ATXN1; (-) strand; PAM type: YTN; PAM sequence: TTA
gatttcagcgtgtaatgctg

SEQ ID NO: 181375 - DNA, 20 bp, Artificial Sequence
  Description of Artificial Sequence: Synthetic oligonucleotide
  Target: ATXN1; (-) strand; PAM type: YTN; PAM sequence: TTA
gcataatgtatgttagattt

SEQ ID NO: 181376 - DNA, 20 bp, Artificial Sequence
  Description of Artificial Sequence: Synthetic oligonucleotide
  Target: ATXN1; (-) strand; PAM type: YTN; PAM sequence: TTG
ttagcataatgtatgttaga

SEQ ID NO: 181377 - DNA, 20 bp, Artificial Sequence
  Description of Artificial Sequence: Synthetic oligonucleotide
  Target: ATXN1; (-) strand; PAM type: YTN; PAM sequence: TTT
gttagcataatgtatgttag

SEQ ID NO: 181378 - DNA, 20 bp, Artificial Sequence
  Description of Artificial Sequence: Synthetic oligonucleotide
  Target: ATXN1; (-) strand; PAM type: YTN; PAM sequence: TTT
tgttagcataatgtatgtta

SEQ ID NO: 181379 - DNA, 20 bp, Artificial Sequence
  Description of Artificial Sequence: Synthetic oligonucleotide
  Target: ATXN1; (-) strand; PAM type: YTN; PAM sequence: CTC
aacatatgaaacgaataaag

SEQ ID NO: 181380 - DNA, 20 bp, Artificial Sequence
  Description of Artificial Sequence: Synthetic oligonucleotide
  Target: ATXN1; (-) strand; PAM type: YTN; PAM sequence: TTG
aaacctcaacatatgaaacg

SEQ ID NO: 181381 - DNA, 20 bp, Artificial Sequence
  Description of Artificial Sequence: Synthetic oligonucleotide
  Target: ATXN1; (-) strand; PAM type: YTN; PAM sequence: CTT
gaaacctcaacatatgaaac

SEQ ID NO: 181382 - DNA, 20 bp, Artificial Sequence
  Description of Artificial Sequence: Synthetic oligonucleotide
  Target: ATXN1; (-) strand; PAM type: YTN; PAM sequence: TTC
aaacacaatcttgaaacctc

SEQ ID NO: 181383 - DNA, 20 bp, Artificial Sequence
  Description of Artificial Sequence: Synthetic oligonucleotide
  Target: ATXN1; (-) strand; PAM type: YTN; PAM sequence: TTT
caaacacaatcttgaaacct

SEQ ID NO: 181384 - DNA, 20 bp, Artificial Sequence
  Description of Artificial Sequence: Synthetic oligonucleotide
  Target: ATXN1; (-) strand; PAM type: YTN; PAM sequence: TTT
tcaaacacaatcttgaaacc

SEQ ID NO: 181385 - DNA, 20 bp, Artificial Sequence
  Description of Artificial Sequence: Synthetic oligonucleotide
  Target: ATXN1; (-) strand; PAM type: YTN; PAM sequence: TTT
ttcaaacacaatcttgaaac

SEQ ID NO: 181386 - DNA, 20 bp, Artificial Sequence
  Description of Artificial Sequence: Synthetic oligonucleotide
  Target: ATXN1; (-) strand; PAM type: YTN; PAM sequence: CTT
tttcaaacacaatcttgaaa

SEQ ID NO: 181387 - DNA, 20 bp, Artificial Sequence
  Description of Artificial Sequence: Synthetic oligonucleotide
  Target: ATXN1; (-) strand; PAM type: YTN; PAM sequence: TTC
tttttcaaacacaatcttga

SEQ ID NO: 181388 - DNA, 20 bp, Artificial Sequence
  Description of Artificial Sequence: Synthetic oligonucleotide
  Target: ATXN1; (-) strand; PAM type: YTN; PAM sequence: CTT
ctttttcaaacacaatcttg

SEQ ID NO: 181389 - DNA, 20 bp, Artificial Sequence
  Description of Artificial Sequence: Synthetic oligonucleotide
  Target: ATXN1; (-) strand; PAM type: YTN; PAM sequence: CTA
cttctttttcaaacacaatc

SEQ ID NO: 181390 - DNA, 20 bp, Artificial Sequence
  Description of Artificial Sequence: Synthetic oligonucleotide
  Target: ATXN1; (-) strand; PAM type: YTN; PAM sequence: CTC
tacttctttttcaaacacaa

SEQ ID NO: 181391 - DNA, 20 bp, Artificial Sequence
  Description of Artificial Sequence: Synthetic oligonucleotide
  Target: ATXN1; (-) strand; PAM type: YTN; PAM sequence: TTA
gtctctacttctttttcaaa

SEQ ID NO: 181392 - DNA, 20 bp, Artificial Sequence
  Description of Artificial Sequence: Synthetic oligonucleotide
  Target: ATXN1; (-) strand; PAM type: YTN; PAM sequence: TTT
agtctctacttctttttcaa

SEQ ID NO: 181393 - DNA, 20 bp, Artificial Sequence
  Description of Artificial Sequence: Synthetic oligonucleotide
  Target: ATXN1; (-) strand; PAM type: YTN; PAM sequence: TTT
tagtctctacttctttttca

SEQ ID NO: 181394 - DNA, 20 bp, Artificial Sequence
  Description of Artificial Sequence: Synthetic oligonucleotide
  Target: ATXN1; (-) strand; PAM type: YTN; PAM sequence: TTT
ttagtctctacttctttttc

SEQ ID NO: 181395 - DNA, 20 bp, Artificial Sequence
  Description of Artificial Sequence: Synthetic oligonucleotide
  Target: ATXN1; (-) strand; PAM type: YTN; PAM sequence: TTA
caaatatttttagtctctac

SEQ ID NO: 181396 - DNA, 20 bp, Artificial Sequence
  Description of Artificial Sequence: Synthetic oligonucleotide
  Target: ATXN1; (-) strand; PAM type: YTN; PAM sequence: TTT
acaaatatttttagtctcta

SEQ ID NO: 181397 - DNA, 20 bp, Artificial Sequence
  Description of Artificial Sequence: Synthetic oligonucleotide
  Target: ATXN1; (-) strand; PAM type: YTN; PAM sequence: TTG
gaggtttacaaatattttta

SEQ ID NO: 181398 - DNA, 20 bp, Artificial Sequence
  Description of Artificial Sequence: Synthetic oligonucleotide
  Target: ATXN1; (-) strand; PAM type: YTN; PAM sequence: CTT
ggaggtttacaaatattttt

SEQ ID NO: 181399 - DNA, 20 bp, Artificial Sequence
  Description of Artificial Sequence: Synthetic oligonucleotide
  Target: ATXN1; (-) strand; PAM type: YTN; PAM sequence: TTA
cttggaggtttacaaatatt

SEQ ID NO: 181400 - DNA, 20 bp, Artificial Sequence
  Description of Artificial Sequence: Synthetic oligonucleotide
  Target: ATXN1; (-) strand; PAM type: YTN; PAM sequence: TTT
acttggaggtttacaaatat

SEQ ID NO: 181401 - DNA, 20 bp, Artificial Sequence
  Description of Artificial Sequence: Synthetic oligonucleotide
  Target: ATXN1; (-) strand; PAM type: YTN; PAM sequence: CTT
tacttggaggtttacaaata

SEQ ID NO: 181402 - DNA, 20 bp, Artificial Sequence
  Description of Artificial Sequence: Synthetic oligonucleotide
  Target: ATXN1; (-) strand; PAM type: YTN; PAM sequence: TTG
cctttacttggaggtttaca

SEQ ID NO: 181403 - DNA, 20 bp, Artificial Sequence
  Description of Artificial Sequence: Synthetic oligonucleotide
  Target: ATXN1; (-) strand; PAM type: YTN; PAM sequence: TTC
attgcctttacttggaggtt

SEQ ID NO: 181404 - DNA, 20 bp, Artificial Sequence
  Description of Artificial Sequence: Synthetic oligonucleotide
  Target: ATXN1; (-) strand; PAM type: YTN; PAM sequence: CTG
tatcattcattgcctttact

SEQ ID NO: 181405 - DNA, 20 bp, Artificial Sequence
  Description of Artificial Sequence: Synthetic oligonucleotide
  Target: ATXN1; (-) strand; PAM type: YTN; PAM sequence: TTC
tgtatcattcattgccttta

SEQ ID NO: 181406 - DNA, 20 bp, Artificial Sequence
  Description of Artificial Sequence: Synthetic oligonucleotide
  Target: ATXN1; (-) strand; PAM type: YTN; PAM sequence: CTA
tggcagtgatcacccacagg

SEQ ID NO: 181407 - DNA, 20 bp, Artificial Sequence
  Description of Artificial Sequence: Synthetic oligonucleotide
  Target: ATXN1; (-) strand; PAM type: YTN; PAM sequence: TTA
tatagctatggcagtgatca

SEQ ID NO: 181408 - DNA, 20 bp, Artificial Sequence
  Description of Artificial Sequence: Synthetic oligonucleotide
  Target: ATXN1; (-) strand; PAM type: YTN; PAM sequence: TTA
ggcattatatagctatggca

SEQ ID NO: 181409 - DNA, 20 bp, Artificial Sequence
  Description of Artificial Sequence: Synthetic oligonucleotide
  Target: ATXN1; (-) strand; PAM type: YTN; PAM sequence: TTT
aggcattatatagctatggc

SEQ ID NO: 181410 - DNA, 20 bp, Artificial Sequence
  Description of Artificial Sequence: Synthetic oligonucleotide
  Target: ATXN1; (-) strand; PAM type: YTN; PAM sequence: CTG
tatttaggcattatatagct

SEQ ID NO: 181411 - DNA, 20 bp, Artificial Sequence
  Description of Artificial Sequence: Synthetic oligonucleotide
  Target: ATXN1; (-) strand; PAM type: YTN; PAM sequence: TTC
ctgtatttaggcattatata

SEQ ID NO: 181412 - DNA, 20 bp, Artificial Sequence
  Description of Artificial Sequence: Synthetic oligonucleotide
  Target: ATXN1; (-) strand; PAM type: YTN; PAM sequence: TTT
cctgtatttaggcattatat

SEQ ID NO: 181413 - DNA, 20 bp, Artificial Sequence
  Description of Artificial Sequence: Synthetic oligonucleotide
  Target: ATXN1; (-) strand; PAM type: YTN; PAM sequence: CTT
tcctgtatttaggcattata

SEQ ID NO: 181414 - DNA, 20 bp, Artificial Sequence
  Description of Artificial Sequence: Synthetic oligonucleotide
  Target: ATXN1; (-) strand; PAM type: YTN; PAM sequence: CTC
tttcctgtatttaggcatta

SEQ ID NO: 181415 - DNA, 20 bp, Artificial Sequence
  Description of Artificial Sequence: Synthetic oligonucleotide
  Target: ATXN1; (-) strand; PAM type: YTN; PAM sequence: TTC
tctttcctgtatttaggcat

SEQ ID NO: 181416 - DNA, 20 bp, Artificial Sequence
  Description of Artificial Sequence: Synthetic oligonucleotide
  Target: ATXN1; (-) strand; PAM type: YTN; PAM sequence: CTT
ctctttcctgtatttaggca

SEQ ID NO: 181417 - DNA, 20 bp, Artificial Sequence
  Description of Artificial Sequence: Synthetic oligonucleotide
  Target: ATXN1; (-) strand; PAM type: YTN; PAM sequence: TTG
cttctctttcctgtatttag

SEQ ID NO: 181418 - DNA, 20 bp, Artificial Sequence
  Description of Artificial Sequence: Synthetic oligonucleotide
  Target: ATXN1; (-) strand; PAM type: YTN; PAM sequence: TTT
gcttctctttcctgtattta

SEQ ID NO: 181419 - DNA, 20 bp, Artificial Sequence
  Description of Artificial Sequence: Synthetic oligonucleotide
  Target: ATXN1; (-) strand; PAM type: YTN; PAM sequence: TTT
tgcttctctttcctgtattt

SEQ ID NO: 181420 - DNA, 20 bp, Artificial Sequence
  Description of Artificial Sequence: Synthetic oligonucleotide
  Target: ATXN1; (-) strand; PAM type: YTN; PAM sequence: CTT
ttgcttctctttcctgtatt

SEQ ID NO: 181421 - DNA, 20 bp, Artificial Sequence
  Description of Artificial Sequence: Synthetic oligonucleotide
  Target: ATXN1; (-) strand; PAM type: YTN; PAM sequence: TTG
taaacttttgcttctctttc

SEQ ID NO: 181422 - DNA, 20 bp, Artificial Sequence
  Description of Artificial Sequence: Synthetic oligonucleotide
  Target: ATXN1; (-) strand; PAM type: YTN; PAM sequence: TTT
gtaaacttttgcttctcttt

SEQ ID NO: 181423 - DNA, 20 bp, Artificial Sequence
  Description of Artificial Sequence: Synthetic oligonucleotide
  Target: ATXN1; (-) strand; PAM type: YTN; PAM sequence: TTT
tgtaaacttttgcttctctt

SEQ ID NO: 181424 - DNA, 20 bp, Artificial Sequence
  Description of Artificial Sequence: Synthetic oligonucleotide
  Target: ATXN1; (-) strand; PAM type: YTN; PAM sequence: TTT
ttgtaaacttttgcttctct

SEQ ID NO: 181425 - DNA, 20 bp, Artificial Sequence
  Description of Artificial Sequence: Synthetic oligonucleotide
  Target: ATXN1; (-) strand; PAM type: YTN; PAM sequence: TTC
ccacaaggaccggtttttgt

SEQ ID NO: 181426 - DNA, 20 bp, Artificial Sequence
  Description of Artificial Sequence: Synthetic oligonucleotide
  Target: ATXN1; (-) strand; PAM type: YTN; PAM sequence: TTG
caatcatataggggagcata

SEQ ID NO: 181427 - DNA, 20 bp, Artificial Sequence
  Description of Artificial Sequence: Synthetic oligonucleotide
  Target: ATXN1; (-) strand; PAM type: YTN; PAM sequence: TTT
gcaatcatataggggagcat

SEQ ID NO: 181428 - DNA, 20 bp, Artificial Sequence
  Description of Artificial Sequence: Synthetic oligonucleotide
  Target: ATXN1; (-) strand; PAM type: YTN; PAM sequence: CTG
agtgtttgcaatcatatagg

SEQ ID NO: 181429 - DNA, 20 bp, Artificial Sequence
  Description of Artificial Sequence: Synthetic oligonucleotide
  Target: ATXN1; (-) strand; PAM type: YTN; PAM sequence: TTA
tatctgagtgtttgcaatca

SEQ ID NO: 181430 - DNA, 20 bp, Artificial Sequence
  Description of Artificial Sequence: Synthetic oligonucleotide
  Target: ATXN1; (-) strand; PAM type: YTN; PAM sequence: CTT
atatctgagtgtttgcaatc

SEQ ID NO: 181431 - DNA, 20 bp, Artificial Sequence
  Description of Artificial Sequence: Synthetic oligonucleotide
  Target: ATXN1; (-) strand; PAM type: YTN; PAM sequence: TTA
cttatatctgagtgtttgca

SEQ ID NO: 181432 - DNA, 20 bp, Artificial Sequence
  Description of Artificial Sequence: Synthetic oligonucleotide
  Target: ATXN1; (-) strand; PAM type: YTN; PAM sequence: TTC
atatattacttatatctgag

SEQ ID NO: 181433 - DNA, 20 bp, Artificial Sequence
  Description of Artificial Sequence: Synthetic oligonucleotide
  Target: ATXN1; (-) strand; PAM type: YTN; PAM sequence: TTA
agtaagtcattcatatatta

SEQ ID NO: 181434 - DNA, 20 bp, Artificial Sequence
  Description of Artificial Sequence: Synthetic oligonucleotide
  Target: ATXN1; (-) strand; PAM type: YTN; PAM sequence: CTC
ccaaacatgtgaaaaagaag

SEQ ID NO: 181435 - DNA, 20 bp, Artificial Sequence
  Description of Artificial Sequence: Synthetic oligonucleotide
  Target: ATXN1; (-) strand; PAM type: YTN; PAM sequence: TTG
ctcccaaacatgtgaaaaag

SEQ ID NO: 181436 - DNA, 20 bp, Artificial Sequence
  Description of Artificial Sequence: Synthetic oligonucleotide
  Target: ATXN1; (-) strand; PAM type: YTN; PAM sequence: CTT
gctcccaaacatgtgaaaaa

SEQ ID NO: 181437 - DNA, 20 bp, Artificial Sequence
  Description of Artificial Sequence: Synthetic oligonucleotide
  Target: ATXN1; (-) strand; PAM type: YTN; PAM sequence: CTA
cttgctcccaaacatgtgaa

SEQ ID NO: 181438 - DNA, 20 bp, Artificial Sequence
  Description of Artificial Sequence: Synthetic oligonucleotide
  Target: ATXN1; (-) strand; PAM type: YTN; PAM sequence: TTG
cctacttgctcccaaacatg

SEQ ID NO: 181439 - DNA, 20 bp, Artificial Sequence
  Description of Artificial Sequence: Synthetic oligonucleotide
  Target: ATXN1; (-) strand; PAM type: YTN; PAM sequence: TTT
gcctacttgctcccaaacat

SEQ ID NO: 181440 - DNA, 20 bp, Artificial Sequence
  Description of Artificial Sequence: Synthetic oligonucleotide
  Target: ATXN1; (-) strand; PAM type: YTN; PAM sequence: CTT
tgcctacttgctcccaaaca

SEQ ID NO: 181441 - DNA, 20 bp, Artificial Sequence
  Description of Artificial Sequence: Synthetic oligonucleotide
  Target: ATXN1; (-) strand; PAM type: YTN; PAM sequence: TTC
caggctttgcctacttgctc

SEQ ID NO: 181442 - DNA, 20 bp, Artificial Sequence
  Description of Artificial Sequence: Synthetic oligonucleotide
  Target: ATXN1; (-) strand; PAM type: YTN; PAM sequence: TTG
ttccaggctttgcctacttg

SEQ ID NO: 181443 - DNA, 20 bp, Artificial Sequence
  Description of Artificial Sequence: Synthetic oligonucleotide
  Target: ATXN1; (-) strand; PAM type: YTN; PAM sequence: TTG
catcagtgattgttccaggc

SEQ ID NO: 181444 - DNA, 20 bp, Artificial Sequence
  Description of Artificial Sequence: Synthetic oligonucleotide
  Target: ATXN1; (-) strand; PAM type: YTN; PAM sequence: CTA
agaaccatgcatgtgtgtaa

SEQ ID NO: 181445 - DNA, 20 bp, Artificial Sequence
  Description of Artificial Sequence: Synthetic oligonucleotide
  Target: ATXN1; (-) strand; PAM type: YTN; PAM sequence: CTC
taagaaccatgcatgtgtgt

SEQ ID NO: 181446 - DNA, 20 bp, Artificial Sequence
  Description of Artificial Sequence: Synthetic oligonucleotide
  Target: ATXN1; (-) strand; PAM type: YTN; PAM sequence: TTC
tctaagaaccatgcatgtgt

SEQ ID NO: 181447 - DNA, 20 bp, Artificial Sequence
  Description of Artificial Sequence: Synthetic oligonucleotide
  Target: ATXN1; (-) strand; PAM type: YTN; PAM sequence: TTC
cattctctaagaaccatgca

SEQ ID NO: 181448 - DNA, 20 bp, Artificial Sequence
  Description of Artificial Sequence: Synthetic oligonucleotide
  Target: ATXN1; (-) strand; PAM type: YTN; PAM sequence: CTT
ccattctctaagaaccatgc

SEQ ID NO: 181449 - DNA, 20 bp, Artificial Sequence
  Description of Artificial Sequence: Synthetic oligonucleotide
  Target: ATXN1; (-) strand; PAM type: YTN; PAM sequence: CTG
tccttccattctctaagaac

SEQ ID NO: 181450 - DNA, 20 bp, Artificial Sequence
  Description of Artificial Sequence: Synthetic oligonucleotide
  Target: ATXN1; (-) strand; PAM type: YTN; PAM sequence: CTC
ctgtccttccattctctaag

SEQ ID NO: 181451 - DNA, 20 bp, Artificial Sequence
  Description of Artificial Sequence: Synthetic oligonucleotide
  Target: ATXN1; (-) strand; PAM type: YTN; PAM sequence: TTC
agctcctgtccttccattct

SEQ ID NO: 181452 - DNA, 20 bp, Artificial Sequence
  Description of Artificial Sequence: Synthetic oligonucleotide
  Target: ATXN1; (-) strand; PAM type: YTN; PAM sequence: CTA
ttcagctcctgtccttccat

SEQ ID NO: 181453 - DNA, 20 bp, Artificial Sequence
  Description of Artificial Sequence: Synthetic oligonucleotide
  Target: ATXN1; (-) strand; PAM type: YTN; PAM sequence: CTG
gcagatggaactattcagct

SEQ ID NO: 181454 - DNA, 20 bp, Artificial Sequence
  Description of Artificial Sequence: Synthetic oligonucleotide
  Target: ATXN1; (-) strand; PAM type: YTN; PAM sequence: TTA
tcactggcagatggaactat

SEQ ID NO: 181455 - DNA, 20 bp, Artificial Sequence
  Description of Artificial Sequence: Synthetic oligonucleotide
  Target: ATXN1; (-) strand; PAM type: YTN; PAM sequence: CTA
cattatcactggcagatgga

SEQ ID NO: 181456 - DNA, 20 bp, Artificial Sequence
  Description of Artificial Sequence: Synthetic oligonucleotide
  Target: ATXN1; (-) strand; PAM type: YTN; PAM sequence: CTA
gatgggaagggtgatgggag

SEQ ID NO: 181457 - DNA, 20 bp, Artificial Sequence
  Description of Artificial Sequence: Synthetic oligonucleotide
  Target: ATXN1; (-) strand; PAM type: YTN; PAM sequence: TTG
aatcagagagcactagatgg

SEQ ID NO: 181458 - DNA, 20 bp, Artificial Sequence
  Description of Artificial Sequence: Synthetic oligonucleotide
  Target: ATXN1; (-) strand; PAM type: YTN; PAM sequence: CTT
gaatcagagagcactagatg

SEQ ID NO: 181459 - DNA, 20 bp, Artificial Sequence
  Description of Artificial Sequence: Synthetic oligonucleotide
  Target: ATXN1; (-) strand; PAM type: YTN; PAM sequence: TTC
ccttgaatcagagagcacta

SEQ ID NO: 181460 - DNA, 20 bp, Artificial Sequence
  Description of Artificial Sequence: Synthetic oligonucleotide
  Target: ATXN1; (-) strand; PAM type: YTN; PAM sequence: CTT
cccttgaatcagagagcact

SEQ ID NO: 181461 - DNA, 20 bp, Artificial Sequence
  Description of Artificial Sequence: Synthetic oligonucleotide
  Target: ATXN1; (-) strand; PAM type: YTN; PAM sequence: TTC
cttcccttgaatcagagagc

SEQ ID NO: 181462 - DNA, 20 bp, Artificial Sequence
  Description of Artificial Sequence: Synthetic oligonucleotide
  Target: ATXN1; (-) strand; PAM type: YTN; PAM sequence: TTC
caaagcacattccttccctt

SEQ ID NO: 181463 - DNA, 20 bp, Artificial Sequence
  Description of Artificial Sequence: Synthetic oligonucleotide
  Target: ATXN1; (-) strand; PAM type: YTN; PAM sequence: CTT
ccaaagcacattccttccct

SEQ ID NO: 181464 - DNA, 20 bp, Artificial Sequence
  Description of Artificial Sequence: Synthetic oligonucleotide
  Target: ATXN1; (-) strand; PAM type: YTN; PAM sequence: CTC
ttccaaagcacattccttcc

SEQ ID NO: 181465 - DNA, 20 bp, Artificial Sequence
  Description of Artificial Sequence: Synthetic oligonucleotide
  Target: ATXN1; (-) strand; PAM type: YTN; PAM sequence: CTC
tcttccaaagcacattcctt

SEQ ID NO: 181466 - DNA, 20 bp, Artificial Sequence
  Description of Artificial Sequence: Synthetic oligonucleotide
  Target: ATXN1; (-) strand; PAM type: YTN; PAM sequence: CTG
ccctctcttccaaagcacat

SEQ ID NO: 181467 - DNA, 20 bp, Artificial Sequence
  Description of Artificial Sequence: Synthetic oligonucleotide
  Target: ATXN1; (-) strand; PAM type: YTN; PAM sequence: CTG
agtaataagcccctgccctc

SEQ ID NO: 181468 - DNA, 20 bp, Artificial Sequence
  Description of Artificial Sequence: Synthetic oligonucleotide
  Target: ATXN1; (-) strand; PAM type: YTN; PAM sequence: CTC
tgagtaataagcccctgccc

SEQ ID NO: 181469 - DNA, 20 bp, Artificial Sequence
  Description of Artificial Sequence: Synthetic oligonucleotide
  Target: ATXN1; (-) strand; PAM type: YTN; PAM sequence: CTC
tctgagtaataagcccctgc

SEQ ID NO: 181470 - DNA, 20 bp, Artificial Sequence
  Description of Artificial Sequence: Synthetic oligonucleotide
  Target: ATXN1; (-) strand; PAM type: YTN; PAM sequence: CTA
cgtctctctgagtaataagc

SEQ ID NO: 181471 - DNA, 20 bp, Artificial Sequence
  Description of Artificial Sequence: Synthetic oligonucleotide
  Target: ATXN1; (-) strand; PAM type: YTN; PAM sequence: TTG
aacctacgtctctctgagta

SEQ ID NO: 181472 - DNA, 20 bp, Artificial Sequence
  Description of Artificial Sequence: Synthetic oligonucleotide
  Target: ATXN1; (-) strand; PAM type: YTN; PAM sequence: TTT
gaacctacgtctctctgagt

SEQ ID NO: 181473 - DNA, 20 bp, Artificial Sequence
  Description of Artificial Sequence: Synthetic oligonucleotide
  Target: ATXN1; (-) strand; PAM type: YTN; PAM sequence: CTT
tgaacctacgtctctctgag

SEQ ID NO: 181474 - DNA, 20 bp, Artificial Sequence
  Description of Artificial Sequence: Synthetic oligonucleotide
  Target: ATXN1; (-) strand; PAM type: YTN; PAM sequence: CTG
gctttgaacctacgtctctc

SEQ ID NO: 181475 - DNA, 20 bp, Artificial Sequence
  Description of Artificial Sequence: Synthetic oligonucleotide
  Target: ATXN1; (-) strand; PAM type: YTN; PAM sequence: CTA
ataataaacgtgctggcttt

SEQ ID NO: 181476 - DNA, 20 bp, Artificial Sequence
  Description of Artificial Sequence: Synthetic oligonucleotide
  Target: ATXN1; (-) strand; PAM type: YTN; PAM sequence: CTG
ctaataataaacgtgctggc

SEQ ID NO: 181477 - DNA, 20 bp, Artificial Sequence
  Description of Artificial Sequence: Synthetic oligonucleotide
  Target: ATXN1; (-) strand; PAM type: YTN; PAM sequence: CTC
tgctaataataaacgtgctg

SEQ ID NO: 181478 - DNA, 20 bp, Artificial Sequence
  Description of Artificial Sequence: Synthetic oligonucleotide
  Target: ATXN1; (-) strand; PAM type: YTN; PAM sequence: TTA
ctctgctaataataaacgtg

SEQ ID NO: 181479 - DNA, 20 bp, Artificial Sequence
  Description of Artificial Sequence: Synthetic oligonucleotide
  Target: ATXN1; (-) strand; PAM type: YTN; PAM sequence: TTC
agagttactctgctaataat

SEQ ID NO: 181480 - DNA, 20 bp, Artificial Sequence
  Description of Artificial Sequence: Synthetic oligonucleotide
  Target: ATXN1; (-) strand; PAM type: YTN; PAM sequence: CTC
gatggaatgggagtgagtca

SEQ ID NO: 181481 - DNA, 20 bp, Artificial Sequence
  Description of Artificial Sequence: Synthetic oligonucleotide
  Target: ATXN1; (-) strand; PAM type: YTN; PAM sequence: TTG
cagataaaagaggctcgatg

SEQ ID NO: 181482 - DNA, 20 bp, Artificial Sequence
  Description of Artificial Sequence: Synthetic oligonucleotide
  Target: ATXN1; (-) strand; PAM type: YTN; PAM sequence: CTC
catgttgcagataaaagagg

SEQ ID NO: 181483 - DNA, 20 bp, Artificial Sequence
  Description of Artificial Sequence: Synthetic oligonucleotide
  Target: ATXN1; (-) strand; PAM type: YTN; PAM sequence: CTC
atagcatctccatgttgcag

SEQ ID NO: 181484 - DNA, 20 bp, Artificial Sequence
  Description of Artificial Sequence: Synthetic oligonucleotide
  Target: ATXN1; (-) strand; PAM type: YTN; PAM sequence: TTC
agaaactcatagcatctcca

SEQ ID NO: 181485 - DNA, 20 bp, Artificial Sequence
  Description of Artificial Sequence: Synthetic oligonucleotide
  Target: ATXN1; (-) strand; PAM type: YTN; PAM sequence: CTT
cagaaactcatagcatctcc

SEQ ID NO: 181486 - DNA, 20 bp, Artificial Sequence
  Description of Artificial Sequence: Synthetic oligonucleotide
  Target: ATXN1; (-) strand; PAM type: YTN; PAM sequence: TTA
aggaatcttcagaaactcat

SEQ ID NO: 181487 - DNA, 20 bp, Artificial Sequence
  Description of Artificial Sequence: Synthetic oligonucleotide
  Target: ATXN1; (-) strand; PAM type: YTN; PAM sequence: TTA
tgagatattaaggaatcttc

SEQ ID NO: 181488 - DNA, 20 bp, Artificial Sequence
  Description of Artificial Sequence: Synthetic oligonucleotide
  Target: ATXN1; (-) strand; PAM type: YTN; PAM sequence: TTT
atgagatattaaggaatctt

SEQ ID NO: 181489 - DNA, 20 bp, Artificial Sequence
  Description of Artificial Sequence: Synthetic oligonucleotide
  Target: ATXN1; (-) strand; PAM type: YTN; PAM sequence: TTT
tatgagatattaaggaatct

SEQ ID NO: 181490 - DNA, 20 bp, Artificial Sequence
  Description of Artificial Sequence: Synthetic oligonucleotide
  Target: ATXN1; (-) strand; PAM type: YTN; PAM sequence: TTT
ttatgagatattaaggaatc

SEQ ID NO: 181491 - DNA, 20 bp, Artificial Sequence
  Description of Artificial Sequence: Synthetic oligonucleotide
  Target: ATXN1; (-) strand; PAM type: YTN; PAM sequence: TTA
tttttatgagatattaagga

SEQ ID NO: 181492 - DNA, 20 bp, Artificial Sequence
  Description of Artificial Sequence: Synthetic oligonucleotide
  Target: ATXN1; (-) strand; PAM type: YTN; PAM sequence: TTA
tgttatttttatgagatatt

SEQ ID NO: 181493 - DNA, 20 bp, Artificial Sequence
  Description of Artificial Sequence: Synthetic oligonucleotide
  Target: ATXN1; (-) strand; PAM type: YTN; PAM sequence: TTT
atgttatttttatgagatat

SEQ ID NO: 181494 - DNA, 20 bp, Artificial Sequence
  Description of Artificial Sequence: Synthetic oligonucleotide
  Target: ATXN1; (-) strand; PAM type: YTN; PAM sequence: TTT
tatgttatttttatgagata

SEQ ID NO: 181495 - DNA, 20 bp, Artificial Sequence
  Description of Artificial Sequence: Synthetic oligonucleotide
  Target: ATXN1; (-) strand; PAM type: YTN; PAM sequence: TTC
atatggaggtggttttatgt

SEQ ID NO: 181496 - DNA, 20 bp, Artificial Sequence
  Description of Artificial Sequence: Synthetic oligonucleotide
  Target: ATXN1; (-) strand; PAM type: YTN; PAM sequence: CTT
catatggaggtggttttatg

SEQ ID NO: 181497 - DNA, 20 bp, Artificial Sequence
  Description of Artificial Sequence: Synthetic oligonucleotide
  Target: ATXN1; (-) strand; PAM type: YTN; PAM sequence: TTG
aatacttcatatggaggtgg

SEQ ID NO: 181498 - DNA, 20 bp, Artificial Sequence
  Description of Artificial Sequence: Synthetic oligonucleotide
  Target: ATXN1; (-) strand; PAM type: YTN; PAM sequence: TTC
attgaatacttcatatggag

SEQ ID NO: 181499 - DNA, 20 bp, Artificial Sequence
  Description of Artificial Sequence: Synthetic oligonucleotide
  Target: ATXN1; (-) strand; PAM type: YTN; PAM sequence: CTA
ttcattgaatacttcatatg

SEQ ID NO: 181500 - DNA, 20 bp, Artificial Sequence
  Description of Artificial Sequence: Synthetic oligonucleotide
  Target: ATXN1; (-) strand; PAM type: YTN; PAM sequence: CTA
caaggtccccagaagggagg

SEQ ID NO: 181501 - DNA, 20 bp, Artificial Sequence
  Description of Artificial Sequence: Synthetic oligonucleotide
  Target: ATXN1; (-) strand; PAM type: YTN; PAM sequence: TTC
tacaaggtccccagaaggga

SEQ ID NO: 181502 - DNA, 20 bp, Artificial Sequence
  Description of Artificial Sequence: Synthetic oligonucleotide
  Target: ATXN1; (-) strand; PAM type: YTN; PAM sequence: TTT
ctacaaggtccccagaaggg

SEQ ID NO: 181503 - DNA, 20 bp, Artificial Sequence
  Description of Artificial Sequence: Synthetic oligonucleotide
  Target: ATXN1; (-) strand; PAM type: YTN; PAM sequence: CTC
atcagcatttctacaaggtc

SEQ ID NO: 181504 - DNA, 20 bp, Artificial Sequence
  Description of Artificial Sequence: Synthetic oligonucleotide
  Target: ATXN1; (-) strand; PAM type: YTN; PAM sequence: CTG
gagcagcctcatcagcattt

SEQ ID NO: 181505 - DNA, 20 bp, Artificial Sequence
  Description of Artificial Sequence: Synthetic oligonucleotide
  Target: ATXN1; (-) strand; PAM type: YTN; PAM sequence: TTG
gtcgctggagcagcctcatc

SEQ ID NO: 181506 - DNA, 20 bp, Artificial Sequence
  Description of Artificial Sequence: Synthetic oligonucleotide
  Target: ATXN1; (-) strand; PAM type: YTN; PAM sequence: TTT
ggtcgctggagcagcctcat

SEQ ID NO: 181507 - DNA, 20 bp, Artificial Sequence
  Description of Artificial Sequence: Synthetic oligonucleotide
  Target: ATXN1; (-) strand; PAM type: YTN; PAM sequence: TTT
tggtcgctggagcagcctca

SEQ ID NO: 181508 - DNA, 20 bp, Artificial Sequence
  Description of Artificial Sequence: Synthetic oligonucleotide
  Target: ATXN1; (-) strand; PAM type: YTN; PAM sequence: TTG
attttggtcgctggagcagc

SEQ ID NO: 181509 - DNA, 20 bp, Artificial Sequence
  Description of Artificial Sequence: Synthetic oligonucleotide
  Target: ATXN1; (-) strand; PAM type: YTN; PAM sequence: TTG
gacattgattttggtcgctg

SEQ ID NO: 181510 - DNA, 20 bp, Artificial Sequence
  Description of Artificial Sequence: Synthetic oligonucleotide
  Target: ATXN1; (-) strand; PAM type: YTN; PAM sequence: TTC
ccaagattggacattgattt

SEQ ID NO: 181511 - DNA, 20 bp, Artificial Sequence
  Description of Artificial Sequence: Synthetic oligonucleotide
  Target: ATXN1; (-) strand; PAM type: YTN; PAM sequence: TTT
cccaagattggacattgatt

SEQ ID NO: 181512 - DNA, 20 bp, Artificial Sequence
  Description of Artificial Sequence: Synthetic oligonucleotide
  Target: ATXN1; (-) strand; PAM type: YTN; PAM sequence: CTT
tcccaagattggacattgat

SEQ ID NO: 181513 - DNA, 20 bp, Artificial Sequence
  Description of Artificial Sequence: Synthetic oligonucleotide
  Target: ATXN1; (-) strand; PAM type: YTN; PAM sequence: CTA
gaaggtcctttcccaagatt

SEQ ID NO: 181514 - DNA, 20 bp, Artificial Sequence
  Description of Artificial Sequence: Synthetic oligonucleotide
  Target: ATXN1; (-) strand; PAM type: YTN; PAM sequence: TTC
acctagaaggtcctttccca

SEQ ID NO: 181515 - DNA, 20 bp, Artificial Sequence
  Description of Artificial Sequence: Synthetic oligonucleotide
  Target: ATXN1; (-) strand; PAM type: YTN; PAM sequence: CTT
cacctagaaggtcctttccc

SEQ ID NO: 181516 - DNA, 20 bp, Artificial Sequence
  Description of Artificial Sequence: Synthetic oligonucleotide
  Target: ATXN1; (-) strand; PAM type: YTN; PAM sequence: TTG
acatccttcacctagaaggt

SEQ ID NO: 181517 - DNA, 20 bp, Artificial Sequence
  Description of Artificial Sequence: Synthetic oligonucleotide
  Target: ATXN1; (-) strand; PAM type: YTN; PAM sequence: TTA
ggaatggggttgacatcctt

SEQ ID NO: 181518 - DNA, 20 bp, Artificial Sequence
  Description of Artificial Sequence: Synthetic oligonucleotide
  Target: ATXN1; (-) strand; PAM type: YTN; PAM sequence: TTT
aggaatggggttgacatcct

SEQ ID NO: 181519 - DNA, 20 bp, Artificial Sequence
  Description of Artificial Sequence: Synthetic oligonucleotide
  Target: ATXN1; (-) strand; PAM type: YTN; PAM sequence: CTC
catgatgtttaggaatgggg

SEQ ID NO: 181520 - DNA, 20 bp, Artificial Sequence
  Description of Artificial Sequence: Synthetic oligonucleotide
  Target: ATXN1; (-) strand; PAM type: YTN; PAM sequence: CTC
tccatgatgtttaggaatgg

SEQ ID NO: 181521 - DNA, 20 bp, Artificial Sequence
  Description of Artificial Sequence: Synthetic oligonucleotide
  Target: ATXN1; (-) strand; PAM type: YTN; PAM sequence: CTG
agaggacctctccatgatgt

SEQ ID NO: 181522 - DNA, 20 bp, Artificial Sequence
  Description of Artificial Sequence: Synthetic oligonucleotide
  Target: ATXN1; (-) strand; PAM type: YTN; PAM sequence: TTC
tgagaggacctctccatgat

SEQ ID NO: 181523 - DNA, 20 bp, Artificial Sequence
  Description of Artificial Sequence: Synthetic oligonucleotide
  Target: ATXN1; (-) strand; PAM type: YTN; PAM sequence: TTT
ctgagaggacctctccatga

SEQ ID NO: 181524 - DNA, 20 bp, Artificial Sequence
  Description of Artificial Sequence: Synthetic oligonucleotide
  Target: ATXN1; (-) strand; PAM type: YTN; PAM sequence: CTG
tatttctgagaggacctctc

SEQ ID NO: 181525 - DNA, 20 bp, Artificial Sequence
  Description of Artificial Sequence: Synthetic oligonucleotide
  Target: ATXN1; (-) strand; PAM type: YTN; PAM sequence: TTA
ggatggggatggacacctgt

SEQ ID NO: 181526 - DNA, 20 bp, Artificial Sequence
  Description of Artificial Sequence: Synthetic oligonucleotide
  Target: ATXN1; (-) strand; PAM type: YTN; PAM sequence: CTG
aaagaggttaggatggggat

SEQ ID NO: 181527 - DNA, 20 bp, Artificial Sequence
  Description of Artificial Sequence: Synthetic oligonucleotide
  Target: ATXN1; (-) strand; PAM type: YTN; PAM sequence: CTA
aagtgaggctgaaagaggtt

SEQ ID NO: 181528 - DNA, 20 bp, Artificial Sequence
  Description of Artificial Sequence: Synthetic oligonucleotide
  Target: ATXN1; (-) strand; PAM type: YTN; PAM sequence: TTC
acagataaccactaaagtga

SEQ ID NO: 181529 - DNA, 20 bp, Artificial Sequence
  Description of Artificial Sequence: Synthetic oligonucleotide
  Target: ATXN1; (-) strand; PAM type: YTN; PAM sequence: CTC
atggatcaggtgcgttcaca

SEQ ID NO: 181530 - DNA, 20 bp, Artificial Sequence
  Description of Artificial Sequence: Synthetic oligonucleotide
  Target: ATXN1; (-) strand; PAM type: YTN; PAM sequence: TTA
atcctcatggatcaggtgcg

SEQ ID NO: 181531 - DNA, 20 bp, Artificial Sequence
  Description of Artificial Sequence: Synthetic oligonucleotide
  Target: ATXN1; (-) strand; PAM type: YTN; PAM sequence: TTT
aatcctcatggatcaggtgc

SEQ ID NO: 181532 - DNA, 20 bp, Artificial Sequence
  Description of Artificial Sequence: Synthetic oligonucleotide
  Target: ATXN1; (-) strand; PAM type: YTN; PAM sequence: TTT
taatcctcatggatcaggtg

SEQ ID NO: 181533 - DNA, 20 bp, Artificial Sequence
  Description of Artificial Sequence: Synthetic oligonucleotide
  Target: ATXN1; (-) strand; PAM type: YTN; PAM sequence: CTT
ttaatcctcatggatcaggt

SEQ ID NO: 181534 - DNA, 20 bp, Artificial Sequence
  Description of Artificial Sequence: Synthetic oligonucleotide
  Target: ATXN1; (-) strand; PAM type: YTN; PAM sequence: TTG
tccttttaatcctcatggat

SEQ ID NO: 181535 - DNA, 20 bp, Artificial Sequence
  Description of Artificial Sequence: Synthetic oligonucleotide
  Target: ATXN1; (-) strand; PAM type: YTN; PAM sequence: CTG
ttgtccttttaatcctcatg

SEQ ID NO: 181536 - DNA, 20 bp, Artificial Sequence
  Description of Artificial Sequence: Synthetic oligonucleotide
  Target: ATXN1; (-) strand; PAM type: YTN; PAM sequence: CTA
acccccgccgcccctgttgt

SEQ ID NO: 181537 - DNA, 20 bp, Artificial Sequence
  Description of Artificial Sequence: Synthetic oligonucleotide
  Target: ATXN1; (-) strand; PAM type: YTN; PAM sequence: TTC
taacccccgccgcccctgtt

SEQ ID NO: 181538 - DNA, 20 bp, Artificial Sequence
  Description of Artificial Sequence: Synthetic oligonucleotide
  Target: ATXN1; (-) strand; PAM type: YTN; PAM sequence: TTG
ttctaacccccgccgcccct

SEQ ID NO: 181539 - DNA, 20 bp, Artificial Sequence
  Description of Artificial Sequence: Synthetic oligonucleotide
  Target: ATXN1; (-) strand; PAM type: YTN; PAM sequence: TTT
gttctaacccccgccgcccc

SEQ ID NO: 181540 - DNA, 20 bp, Artificial Sequence
  Description of Artificial Sequence: Synthetic oligonucleotide
  Target: ATXN1; (-) strand; PAM type: YTN; PAM sequence: CTT
tgttctaacccccgccgccc

SEQ ID NO: 181541 - DNA, 20 bp, Artificial Sequence
  Description of Artificial Sequence: Synthetic oligonucleotide
  Target: ATXN1; (-) strand; PAM type: YTN; PAM sequence: TTA
atctttgttctaacccccgc

SEQ ID NO: 181542 - DNA, 20 bp, Artificial Sequence
  Description of Artificial Sequence: Synthetic oligonucleotide
  Target: ATXN1; (-) strand; PAM type: YTN; PAM sequence: TTT
aatctttgttctaacccccg

SEQ ID NO: 181543 - DNA, 20 bp, Artificial Sequence
  Description of Artificial Sequence: Synthetic oligonucleotide
  Target: ATXN1; (-) strand; PAM type: YTN; PAM sequence: CTT
taatctttgttctaaccccc

SEQ ID NO: 181544 - DNA, 20 bp, Artificial Sequence
  Description of Artificial Sequence: Synthetic oligonucleotide
  Target: ATXN1; (-) strand; PAM type: YTN; PAM sequence: CTA
ctttaatctttgttctaacc

SEQ ID NO: 181545 - DNA, 20 bp, Artificial Sequence
  Description of Artificial Sequence: Synthetic oligonucleotide
  Target: ATXN1; (-) strand; PAM type: YTN; PAM sequence: TTG
ggggggtctactttaatctt

SEQ ID NO: 181546 - DNA, 20 bp, Artificial Sequence
  Description of Artificial Sequence: Synthetic oligonucleotide
  Target: ATXN1; (-) strand; PAM type: YTN; PAM sequence: CTT
gggggggtctactttaatct

SEQ ID NO: 181547 - DNA, 20 bp, Artificial Sequence
  Description of Artificial Sequence: Synthetic oligonucleotide
  Target: ATXN1; (-) strand; PAM type: YTN; PAM sequence: TTG
gcccttgggggggtctactt

SEQ ID NO: 181548 - DNA, 20 bp, Artificial Sequence
  Description of Artificial Sequence: Synthetic oligonucleotide
  Target: ATXN1; (-) strand; PAM type: YTN; PAM sequence: TTC
atagcgttggcccttggggg

SEQ ID NO: 181549 - DNA, 20 bp, Artificial Sequence
  Description of Artificial Sequence: Synthetic oligonucleotide
  Target: ATXN1; (-) strand; PAM type: YTN; PAM sequence: CTT
catagcgttggcccttgggg

SEQ ID NO: 181550 - DNA, 20 bp, Artificial Sequence
  Description of Artificial Sequence: Synthetic oligonucleotide
  Target: ATXN1; (-) strand; PAM type: YTN; PAM sequence: CTC
ttcatagcgttggcccttgg

SEQ ID NO: 181551 - DNA, 20 bp, Artificial Sequence
  Description of Artificial Sequence: Synthetic oligonucleotide
  Target: ATXN1; (-) strand; PAM type: YTN; PAM sequence: CTC
aaggaatggccatgtggctc

SEQ ID NO: 181552 - DNA, 20 bp, Artificial Sequence
  Description of Artificial Sequence: Synthetic oligonucleotide
  Target: ATXN1; (-) strand; PAM type: YTN; PAM sequence: TTC
tcaaggaatggccatgtggc

SEQ ID NO: 181553 - DNA, 20 bp, Artificial Sequence
  Description of Artificial Sequence: Synthetic oligonucleotide
  Target: ATXN1; (-) strand; PAM type: YTN; PAM sequence: TTA
gtaattctcaaggaatggcc

SEQ ID NO: 181554 - DNA, 20 bp, Artificial Sequence
  Description of Artificial Sequence: Synthetic oligonucleotide
  Target: ATXN1; (-) strand; PAM type: YTN; PAM sequence: TTC
atgattagtaattctcaagg

SEQ ID NO: 181555 - DNA, 20 bp, Artificial Sequence
  Description of Artificial Sequence: Synthetic oligonucleotide
  Target: ATXN1; (-) strand; PAM type: YTN; PAM sequence: CTG
gagaaccgaatgattcatga

SEQ ID NO: 181556 - DNA, 20 bp, Artificial Sequence
  Description of Artificial Sequence: Synthetic oligonucleotide
  Target: ATXN1; (-) strand; PAM type: YTN; PAM sequence: TTA
agccaaaggagcatcctgga

SEQ ID NO: 181557 - DNA, 20 bp, Artificial Sequence
  Description of Artificial Sequence: Synthetic oligonucleotide
  Target: ATXN1; (-) strand; PAM type: YTN; PAM sequence: TTT
aagccaaaggagcatcctgg

SEQ ID NO: 181558 - DNA, 20 bp, Artificial Sequence
  Description of Artificial Sequence: Synthetic oligonucleotide
  Target: ATXN1; (-) strand; PAM type: YTN; PAM sequence: TTC
ggtttaagccaaaggagcat

SEQ ID NO: 181559 - DNA, 20 bp, Artificial Sequence
  Description of Artificial Sequence: Synthetic oligonucleotide
  Target: ATXN1; (-) strand; PAM type: YTN; PAM sequence: CTT
cggtttaagccaaaggagca

SEQ ID NO: 181560 - DNA, 20 bp, Artificial Sequence
  Description of Artificial Sequence: Synthetic oligonucleotide
  Target: ATXN1; (-) strand; PAM type: YTN; PAM sequence: TTG
acttcggtttaagccaaagg

SEQ ID NO: 181561 - DNA, 20 bp, Artificial Sequence
  Description of Artificial Sequence: Synthetic oligonucleotide
  Target: ATXN1; (-) strand; PAM type: YTN; PAM sequence: TTA
gaaaagattgacttcggttt

SEQ ID NO: 181562 - DNA, 20 bp, Artificial Sequence
  Description of Artificial Sequence: Synthetic oligonucleotide
  Target: ATXN1; (-) strand; PAM type: YTN; PAM sequence: CTT
agaaaagattgacttcggtt

SEQ ID NO: 181563 - DNA, 20 bp, Artificial Sequence
  Description of Artificial Sequence: Synthetic oligonucleotide
  Target: ATXN1; (-) strand; PAM type: YTN; PAM sequence: TTA
atgcttagaaaagattgact

SEQ ID NO: 181564 - DNA, 20 bp, Artificial Sequence
  Description of Artificial Sequence: Synthetic oligonucleotide
  Target: ATXN1; (-) strand; PAM type: YTN; PAM sequence: TTT
aatgcttagaaaagattgac

SEQ ID NO: 181565 - DNA, 20 bp, Artificial Sequence
  Description of Artificial Sequence: Synthetic oligonucleotide
  Target: ATXN1; (-) strand; PAM type: YTN; PAM sequence: TTA
aatgggaagagaagatgtcc

SEQ ID NO: 181566 - DNA, 20 bp, Artificial Sequence
  Description of Artificial Sequence: Synthetic oligonucleotide
  Target: ATXN1; (-) strand; PAM type: YTN; PAM sequence: TTT
aaatgggaagagaagatgtc

SEQ ID NO: 181567 - DNA, 20 bp, Artificial Sequence
  Description of Artificial Sequence: Synthetic oligonucleotide
  Target: ATXN1; (-) strand; PAM type: YTN; PAM sequence: TTT
taaatgggaagagaagatgt

SEQ ID NO: 181568 - DNA, 20 bp, Artificial Sequence
  Description of Artificial Sequence: Synthetic oligonucleotide
  Target: ATXN1; (-) strand; PAM type: YTN; PAM sequence: CTT
ttaaatgggaagagaagatg

SEQ ID NO: 181569 - DNA, 20 bp, Artificial Sequence
  Description of Artificial Sequence: Synthetic oligonucleotide
  Target: ATXN1; (-) strand; PAM type: YTN; PAM sequence: TTG
cttttaaatgggaagagaag

SEQ ID NO: 181570 - DNA, 20 bp, Artificial Sequence
  Description of Artificial Sequence: Synthetic oligonucleotide
  Target: ATXN1; (-) strand; PAM type: YTN; PAM sequence: CTT
gcttttaaatgggaagagaa

SEQ ID NO: 181571 - DNA, 20 bp, Artificial Sequence
  Description of Artificial Sequence: Synthetic oligonucleotide
  Target: ATXN1; (-) strand; PAM type: YTN; PAM sequence: CTG
cttgcttttaaatgggaaga

SEQ ID NO: 181572 - DNA, 20 bp, Artificial Sequence
  Description of Artificial Sequence: Synthetic oligonucleotide
  Target: ATXN1; (-) strand; PAM type: YTN; PAM sequence: CTG
aagtggcaactgcttgcttt

SEQ ID NO: 181573 - DNA, 20 bp, Artificial Sequence
  Description of Artificial Sequence: Synthetic oligonucleotide
  Target: ATXN1; (-) strand; PAM type: YTN; PAM sequence: TTG
tacagctgaagtggcaactg

SEQ ID NO: 181574 - DNA, 20 bp, Artificial Sequence
  Description of Artificial Sequence: Synthetic oligonucleotide
  Target: ATXN1; (-) strand; PAM type: YTN; PAM sequence: TTT
gtacagctgaagtggcaact

SEQ ID NO: 181575 - DNA, 20 bp, Artificial Sequence
  Description of Artificial Sequence: Synthetic oligonucleotide
  Target: ATXN1; (-) strand; PAM type: YTN; PAM sequence: CTA
tataatttgtacagctgaag

SEQ ID NO: 181576 - DNA, 20 bp, Artificial Sequence
  Description of Artificial Sequence: Synthetic oligonucleotide
  Target: ATXN1; (-) strand; PAM type: YTN; PAM sequence: TTC
aatcctatataatttgtaca

SEQ ID NO: 181577 - DNA, 20 bp, Artificial Sequence
  Description of Artificial Sequence: Synthetic oligonucleotide
  Target: ATXN1; (-) strand; PAM type: YTN; PAM sequence: TTT
caatcctatataatttgtac

SEQ ID NO: 181578 - DNA, 20 bp, Artificial Sequence
  Description of Artificial Sequence: Synthetic oligonucleotide
  Target: ATXN1; (-) strand; PAM type: YTN; PAM sequence: TTT
tcaatcctatataatttgta

SEQ ID NO: 181579 - DNA, 20 bp, Artificial Sequence
  Description of Artificial Sequence: Synthetic oligonucleotide
  Target: ATXN1; (-) strand; PAM type: YTN; PAM sequence: CTA
ttttcaatcctatataattt

SEQ ID NO: 181580 - DNA, 20 bp, Artificial Sequence
  Description of Artificial Sequence: Synthetic oligonucleotide
  Target: ATXN1; (-) strand; PAM type: YTN; PAM sequence: TTA
tactattttcaatcctatat

SEQ ID NO: 181581 - DNA, 20 bp, Artificial Sequence
  Description of Artificial Sequence: Synthetic oligonucleotide
  Target: ATXN1; (-) strand; PAM type: YTN; PAM sequence: CTG
tgcccaaccagttatactat

SEQ ID NO: 181582 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagcaactgtgcc

SEQ ID NO: 181583 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagcaac

SEQ ID NO: 181584 - DNA, 20 bp, Artificial Sequence
  Description of Artificial Sequence: Synthetic oligonucleotide
  Target: ATXN1; (-) strand; PAM type: YTN; PAM sequence: TTC
tgggattacaggcgtgagca

SEQ ID NO: 181585 - DNA, 20 bp, Artificial Sequence
  Description of Artificial Sequence: Synthetic oligonucleotide
  Target: ATXN1; (-) strand; PAM type: YTN; PAM sequence: CTG
ggcatcccaaagttctggga

SEQ ID NO: 181586 - DNA, 20 bp, Artificial Sequence
  Description of Artificial Sequence: Synthetic oligonucleotide
  Target: ATXN1; (-) strand; PAM type: YTN; PAM sequence: TTG
gtgatccacccacctgggca

SEQ ID NO: 181587 - DNA, 20 bp, Artificial Sequence
  Description of Artificial Sequence: Synthetic oligonucleotide
  Target: ATXN1; (-) strand; PAM type: YTN; PAM sequence: TTT
ggtgatccacccacctgggc

SEQ ID NO: 181588 - DNA, 20 bp, Artificial Sequence
  Description of Artificial Sequence: Synthetic oligonucleotide
  Target: ATXN1; (-) strand; PAM type: YTN; PAM sequence: CTT
tggtgatccacccacctggg

SEQ ID NO: 181589 - DNA, 20 bp, Artificial Sequence
  Description of Artificial Sequence: Synthetic oligonucleotide
  Target: ATXN1; (-) strand; PAM type: YTN; PAM sequence: CTG
acctttggtgatccacccac

SEQ ID NO: 181590 - DNA, 20 bp, Artificial Sequence
  Description of Artificial Sequence: Synthetic oligonucleotide
  Target: ATXN1; (-) strand; PAM type: YTN; PAM sequence: TTC
ctgacctttggtgatccacc

SEQ ID NO: 181591 - DNA, 20 bp, Artificial Sequence
  Description of Artificial Sequence: Synthetic oligonucleotide
  Target: ATXN1; (-) strand; PAM type: YTN; PAM sequence: CTC
gaattcctgacctttggtga

SEQ ID NO: 181592 - DNA, 20 bp, Artificial Sequence
  Description of Artificial Sequence: Synthetic oligonucleotide
  Target: ATXN1; (-) strand; PAM type: YTN; PAM sequence: TTG
tctcgaattcctgacctttg

SEQ ID NO: 181593 - DNA, 20 bp, Artificial Sequence
  Description of Artificial Sequence: Synthetic oligonucleotide
  Target: ATXN1; (-) strand; PAM type: YTN; PAM sequence: CTT
gtctcgaattcctgaccttt

SEQ ID NO: 181594 - DNA, 20 bp, Artificial Sequence
  Description of Artificial Sequence: Synthetic oligonucleotide
  Target: ATXN1; (-) strand; PAM type: YTN; PAM sequence: TTG
gccaggcttgtctcgaattc

SEQ ID NO: 181595 - DNA, 20 bp, Artificial Sequence
  Description of Artificial Sequence: Synthetic oligonucleotide
  Target: ATXN1; (-) strand; PAM type: YTN; PAM sequence: CTG
tgttggccaggcttgtctcg

SEQ ID NO: 181596 - DNA, 20 bp, Artificial Sequence
  Description of Artificial Sequence: Synthetic oligonucleotide
  Target: ATXN1; (-) strand; PAM type: YTN; PAM sequence: TTC
actgtgttggccaggcttgt

SEQ ID NO: 181597 - DNA, 20 bp, Artificial Sequence
  Description of Artificial Sequence: Synthetic oligonucleotide
  Target: ATXN1; (-) strand; PAM type: YTN; PAM sequence: TTT
cactgtgttggccaggcttg

SEQ ID NO: 181598 - DNA, 20 bp, Artificial Sequence
  Description of Artificial Sequence: Synthetic oligonucleotide
  Target: ATXN1; (-) strand; PAM type: YTN; PAM sequence: TTA
gtagagacagtgtttcactg

SEQ ID NO: 181599 - DNA, 20 bp, Artificial Sequence
  Description of Artificial Sequence: Synthetic oligonucleotide
  Target: ATXN1; (-) strand; PAM type: YTN; PAM sequence: TTT
agtagagacagtgtttcact

SEQ ID NO: 181600 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagtgtttcac

SEQ ID NO: 181601 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagtgtttca

SEQ ID NO: 181602 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacagtg

SEQ ID NO: 181603 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagt

SEQ ID NO: 181604 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 181605 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 181606 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 181607 - DNA, 20 bp, Artificial Sequence
  Description of Artificial Sequence: Synthetic oligonucleotide
  Target: ATXN1; (-) strand; PAM type: YTN; PAM sequence: TTC
agtagagactaatttttgta

SEQ ID NO: 181608 - DNA, 20 bp, Artificial Sequence
  Description of Artificial Sequence: Synthetic oligonucleotide
  Target: ATXN1; (-) strand; PAM type: YTN; PAM sequence: TTT
cagtagagactaatttttgt

SEQ ID NO: 181609 - DNA, 20 bp, Artificial Sequence
  Description of Artificial Sequence: Synthetic oligonucleotide
  Target: ATXN1; (-) strand; PAM type: YTN; PAM sequence: TTT
tcagtagagactaatttttg

SEQ ID NO: 181610 - DNA, 20 bp, Artificial Sequence
  Description of Artificial Sequence: Synthetic oligonucleotide
  Target: ATXN1; (-) strand; PAM type: YTN; PAM sequence: TTG
tattttcagtagagactaat

SEQ ID NO: 181611 - DNA, 20 bp, Artificial Sequence
  Description of Artificial Sequence: Synthetic oligonucleotide
  Target: ATXN1; (-) strand; PAM type: YTN; PAM sequence: TTT
gtattttcagtagagactaa

SEQ ID NO: 181612 - DNA, 20 bp, Artificial Sequence
  Description of Artificial Sequence: Synthetic oligonucleotide
  Target: ATXN1; (-) strand; PAM type: YTN; PAM sequence: TTT
tgtattttcagtagagacta

SEQ ID NO: 181613 - DNA, 20 bp, Artificial Sequence
  Description of Artificial Sequence: Synthetic oligonucleotide
  Target: ATXN1; (-) strand; PAM type: YTN; PAM sequence: TTT
ttgtattttcagtagagact

SEQ ID NO: 181614 - DNA, 20 bp, Artificial Sequence
  Description of Artificial Sequence: Synthetic oligonucleotide
  Target: ATXN1; (-) strand; PAM type: YTN; PAM sequence: CTA
atttttgtattttcagtaga

SEQ ID NO: 181615 - DNA, 20 bp, Artificial Sequence
  Description of Artificial Sequence: Synthetic oligonucleotide
  Target: ATXN1; (-) strand; PAM type: YTN; PAM sequence: CTA
actaatttttgtattttcag

SEQ ID NO: 181616 - DNA, 20 bp, Artificial Sequence
  Description of Artificial Sequence: Synthetic oligonucleotide
  Target: ATXN1; (-) strand; PAM type: YTN; PAM sequence: CTG
agtagctaactaatttttgt

SEQ ID NO: 181617 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctaactaatttt

SEQ ID NO: 181618 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctaact

SEQ ID NO: 181619 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 181620 - DNA, 20 bp, Artificial Sequence
  Description of Artificial Sequence: Synthetic oligonucleotide
  Target: ATXN1; (-) strand; PAM type: YTN; PAM sequence: TTC
tgcctcagcctcctgagtag

SEQ ID NO: 181621 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagcctcctgagta

SEQ ID NO: 181622 - DNA, 20 bp, Artificial Sequence
  Description of Artificial Sequence: Synthetic oligonucleotide
  Target: ATXN1; (-) strand; PAM type: YTN; PAM sequence: TTC
ttctgcctcagcctcctgag

SEQ ID NO: 181623 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgcctcag

SEQ ID NO: 181624 - DNA, 20 bp, Artificial Sequence
  Description of Artificial Sequence: Synthetic oligonucleotide
  Target: ATXN1; (-) strand; PAM type: YTN; PAM sequence: CTC
gggttcaagtgattcttctg

SEQ ID NO: 181625 - DNA, 20 bp, Artificial Sequence
  Description of Artificial Sequence: Synthetic oligonucleotide
  Target: ATXN1; (-) strand; PAM type: YTN; PAM sequence: CTG
gccctcgggttcaagtgatt

SEQ ID NO: 181626 - DNA, 20 bp, Artificial Sequence
  Description of Artificial Sequence: Synthetic oligonucleotide
  Target: ATXN1; (-) strand; PAM type: YTN; PAM sequence: CTC
tggccctcgggttcaagtga

SEQ ID NO: 181627 - DNA, 20 bp, Artificial Sequence
  Description of Artificial Sequence: Synthetic oligonucleotide
  Target: ATXN1; (-) strand; PAM type: YTN; PAM sequence: CTG
caaactctggccctcgggtt

SEQ ID NO: 181628 - DNA, 20 bp, Artificial Sequence
  Description of Artificial Sequence: Synthetic oligonucleotide
  Target: ATXN1; (-) strand; PAM type: YTN; PAM sequence: CTC
actgcaaactctggccctcg

SEQ ID NO: 181629 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaaactctggcc

SEQ ID NO: 181630 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaaactctggc

SEQ ID NO: 181631 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctt

SEQ ID NO: 181632 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 181633 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtgc

SEQ ID NO: 181634 - DNA, 20 bp, Artificial Sequence
  Description of Artificial Sequence: Synthetic oligonucleotide
  Target: ATXN1; (-) strand; PAM type: YTN; PAM sequence: CTC
gctctgtcgcccaggctgga

SEQ ID NO: 181635 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcgctctgtc

SEQ ID NO: 181636 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcgctctgt

SEQ ID NO: 181637 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcgctctg

SEQ ID NO: 181638 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcgctct

SEQ ID NO: 181639 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtctcgctc

SEQ ID NO: 181640 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtctcgct

SEQ ID NO: 181641 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtctcgc

SEQ ID NO: 181642 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtctcg

SEQ ID NO: 181643 - DNA, 20 bp, Artificial Sequence
  Description of Artificial Sequence: Synthetic oligonucleotide
  Target: ATXN1; (-) strand; PAM type: YTN; PAM sequence: CTT
tttttttgagacggagtctc

SEQ ID NO: 181644 - DNA, 20 bp, Artificial Sequence
  Description of Artificial Sequence: Synthetic oligonucleotide
  Target: ATXN1; (-) strand; PAM type: YTN; PAM sequence: CTG
gcctttttttttgagacgga

SEQ ID NO: 181645 - DNA, 20 bp, Artificial Sequence
  Description of Artificial Sequence: Synthetic oligonucleotide
  Target: ATXN1; (-) strand; PAM type: YTN; PAM sequence: CTG
cacctggcctttttttttga

SEQ ID NO: 181646 - DNA, 20 bp, Artificial Sequence
  Description of Artificial Sequence: Synthetic oligonucleotide
  Target: ATXN1; (-) strand; PAM type: YTN; PAM sequence: TTA
caggcatgaggcactgcacc

SEQ ID NO: 181647 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgaggcac

SEQ ID NO: 181648 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 181649 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 181650 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 181651 - DNA, 20 bp, Artificial Sequence
  Description of Artificial Sequence: Synthetic oligonucleotide
  Target: ATXN1; (-) strand; PAM type: YTN; PAM sequence: CTG
ccggccttggcctcccaaag

SEQ ID NO: 181652 - DNA, 20 bp, Artificial Sequence
  Description of Artificial Sequence: Synthetic oligonucleotide
  Target: ATXN1; (-) strand; PAM type: YTN; PAM sequence: CTC
aggtgatctgccggccttgg

SEQ ID NO: 181653 - DNA, 20 bp, Artificial Sequence
  Description of Artificial Sequence: Synthetic oligonucleotide
  Target: ATXN1; (-) strand; PAM type: YTN; PAM sequence: CTC
ccgacctcaggtgatctgcc

SEQ ID NO: 181654 - DNA, 20 bp, Artificial Sequence
  Description of Artificial Sequence: Synthetic oligonucleotide
  Target: ATXN1; (-) strand; PAM type: YTN; PAM sequence: CTC
caactcccgacctcaggtga

SEQ ID NO: 181655 - DNA, 20 bp, Artificial Sequence
  Description of Artificial Sequence: Synthetic oligonucleotide
  Target: ATXN1; (-) strand; PAM type: YTN; PAM sequence: CTG
gtctccaactcccgacctca

SEQ ID NO: 181656 - DNA, 20 bp, Artificial Sequence
  Description of Artificial Sequence: Synthetic oligonucleotide
  Target: ATXN1; (-) strand; PAM type: YTN; PAM sequence: TTG
gtcgggctggtctccaactc

SEQ ID NO: 181657 - DNA, 20 bp, Artificial Sequence
  Description of Artificial Sequence: Synthetic oligonucleotide
  Target: ATXN1; (-) strand; PAM type: YTN; PAM sequence: CTC
catgttggtcgggctggtct

SEQ ID NO: 181658 - DNA, 20 bp, Artificial Sequence
  Description of Artificial Sequence: Synthetic oligonucleotide
  Target: ATXN1; (-) strand; PAM type: YTN; PAM sequence: TTC
ctccatgttggtcgggctgg

SEQ ID NO: 181659 - DNA, 20 bp, Artificial Sequence
  Description of Artificial Sequence: Synthetic oligonucleotide
  Target: ATXN1; (-) strand; PAM type: YTN; PAM sequence: TTA
gcagagatgaggttcctcca

SEQ ID NO: 181660 - DNA, 20 bp, Artificial Sequence
  Description of Artificial Sequence: Synthetic oligonucleotide
  Target: ATXN1; (-) strand; PAM type: YTN; PAM sequence: TTT
agcagagatgaggttcctcc

SEQ ID NO: 181661 - DNA, 20 bp, Artificial Sequence
  Description of Artificial Sequence: Synthetic oligonucleotide
  Target: ATXN1; (-) strand; PAM type: YTN; PAM sequence: TTT
tagcagagatgaggttcctc

SEQ ID NO: 181662 - DNA, 20 bp, Artificial Sequence
  Description of Artificial Sequence: Synthetic oligonucleotide
  Target: ATXN1; (-) strand; PAM type: YTN; PAM sequence: TTT
ttagcagagatgaggttcct

SEQ ID NO: 181663 - DNA, 20 bp, Artificial Sequence
  Description of Artificial Sequence: Synthetic oligonucleotide
  Target: ATXN1; (-) strand; PAM type: YTN; PAM sequence: TTA
catttttagcagagatgagg

SEQ ID NO: 181664 - DNA, 20 bp, Artificial Sequence
  Description of Artificial Sequence: Synthetic oligonucleotide
  Target: ATXN1; (-) strand; PAM type: YTN; PAM sequence: TTT
acatttttagcagagatgag

SEQ ID NO: 181665 - DNA, 20 bp, Artificial Sequence
  Description of Artificial Sequence: Synthetic oligonucleotide
  Target: ATXN1; (-) strand; PAM type: YTN; PAM sequence: TTT
tacatttttagcagagatga

SEQ ID NO: 181666 - DNA, 20 bp, Artificial Sequence
  Description of Artificial Sequence: Synthetic oligonucleotide
  Target: ATXN1; (-) strand; PAM type: YTN; PAM sequence: CTA
attttacatttttagcagag

SEQ ID NO: 181667 - DNA, 20 bp, Artificial Sequence
  Description of Artificial Sequence: Synthetic oligonucleotide
  Target: ATXN1; (-) strand; PAM type: YTN; PAM sequence: TTA
caggcatgtgccaccacgcc

SEQ ID NO: 181668 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgtgccac

SEQ ID NO: 181669 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacaggca

SEQ ID NO: 181670 - DNA, 20 bp, Artificial Sequence
  Description of Artificial Sequence: Synthetic oligonucleotide
  Target: ATXN1; (-) strand; PAM type: YTN; PAM sequence: TTC
tgagtagctgggattacagg

SEQ ID NO: 181671 - DNA, 20 bp, Artificial Sequence
  Description of Artificial Sequence: Synthetic oligonucleotide
  Target: ATXN1; (-) strand; PAM type: YTN; PAM sequence: CTT
ctgagtagctgggattacag

SEQ ID NO: 181672 - DNA, 20 bp, Artificial Sequence
  Description of Artificial Sequence: Synthetic oligonucleotide
  Target: ATXN1; (-) strand; PAM type: YTN; PAM sequence: CTC
agccttctgagtagctggga

SEQ ID NO: 181673 - DNA, 20 bp, Artificial Sequence
  Description of Artificial Sequence: Synthetic oligonucleotide
  Target: ATXN1; (-) strand; PAM type: YTN; PAM sequence: CTG
cctcagccttctgagtagct

SEQ ID NO: 181674 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagccttctgagta

SEQ ID NO: 181675 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagccttctgag

SEQ ID NO: 181676 - DNA, 20 bp, Artificial Sequence
  Description of Artificial Sequence: Synthetic oligonucleotide
  Target: ATXN1; (-) strand; PAM type: YTN; PAM sequence: TTC
aagtggttctcctgcctcag

SEQ ID NO: 181677 - DNA, 20 bp, Artificial Sequence
  Description of Artificial Sequence: Synthetic oligonucleotide
  Target: ATXN1; (-) strand; PAM type: YTN; PAM sequence: CTG
ggttcaagtggttctcctgc

SEQ ID NO: 181678 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagtggttctcc

SEQ ID NO: 181679 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcaagtgg

SEQ ID NO: 181680 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcctgggtt

SEQ ID NO: 181681 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctcctg

SEQ ID NO: 181682 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccgcct

SEQ ID NO: 181683 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccgcc

SEQ ID NO: 181684 - DNA, 20 bp, Artificial Sequence
  Description of Artificial Sequence: Synthetic oligonucleotide
  Target: ATXN1; (-) strand; PAM type: YTN; PAM sequence: CTG
gagagcaatggcacgatctt

SEQ ID NO: 181685 - DNA, 20 bp, Artificial Sequence
  Description of Artificial Sequence: Synthetic oligonucleotide
  Target: ATXN1; (-) strand; PAM type: YTN; PAM sequence: TTG
cccacgctggagagcaatgg

SEQ ID NO: 181686 - DNA, 20 bp, Artificial Sequence
  Description of Artificial Sequence: Synthetic oligonucleotide
  Target: ATXN1; (-) strand; PAM type: YTN; PAM sequence: TTG
ttgcccacgctggagagcaa

SEQ ID NO: 181687 - DNA, 20 bp, Artificial Sequence
  Description of Artificial Sequence: Synthetic oligonucleotide
  Target: ATXN1; (-) strand; PAM type: YTN; PAM sequence: CTT
gttgcccacgctggagagca

SEQ ID NO: 181688 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccacgctggagag

SEQ ID NO: 181689 - DNA, 20 bp, Artificial Sequence
  Description of Artificial Sequence: Synthetic oligonucleotide
  Target: ATXN1; (-) strand; PAM type: YTN; PAM sequence: TTG
ctcttgttgcccacgctgga

SEQ ID NO: 181690 - DNA, 20 bp, Artificial Sequence
  Description of Artificial Sequence: Synthetic oligonucleotide
  Target: ATXN1; (-) strand; PAM type: YTN; PAM sequence: TTT
gctcttgttgcccacgctgg

SEQ ID NO: 181691 - DNA, 20 bp, Artificial Sequence
  Description of Artificial Sequence: Synthetic oligonucleotide
  Target: ATXN1; (-) strand; PAM type: YTN; PAM sequence: TTT
tgctcttgttgcccacgctg

SEQ ID NO: 181692 - DNA, 20 bp, Artificial Sequence
  Description of Artificial Sequence: Synthetic oligonucleotide
  Target: ATXN1; (-) strand; PAM type: YTN; PAM sequence: TTG
agacggagttttgctcttgt

SEQ ID NO: 181693 - DNA, 20 bp, Artificial Sequence
  Description of Artificial Sequence: Synthetic oligonucleotide
  Target: ATXN1; (-) strand; PAM type: YTN; PAM sequence: TTT
gagacggagttttgctcttg

SEQ ID NO: 181694 - DNA, 20 bp, Artificial Sequence
  Description of Artificial Sequence: Synthetic oligonucleotide
  Target: ATXN1; (-) strand; PAM type: YTN; PAM sequence: TTT
tgagacggagttttgctctt

SEQ ID NO: 181695 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagttttgctct

SEQ ID NO: 181696 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagttttgctc

SEQ ID NO: 181697 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagttttgct

SEQ ID NO: 181698 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagttttgc

SEQ ID NO: 181699 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagttttg

SEQ ID NO: 181700 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtttt

SEQ ID NO: 181701 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagttt

SEQ ID NO: 181702 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtt

SEQ ID NO: 181703 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 181704 - DNA, 20 bp, Artificial Sequence
  Description of Artificial Sequence: Synthetic oligonucleotide
  Target: ATXN1; (-) strand; PAM type: YTN; PAM sequence: CTT
tttttttttttgagacggag

SEQ ID NO: 181705 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttgagacgg

SEQ ID NO: 181706 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttgagacg

SEQ ID NO: 181707 - DNA, 20 bp, Artificial Sequence
  Description of Artificial Sequence: Synthetic oligonucleotide
  Target: ATXN1; (-) strand; PAM type: YTN; PAM sequence: CTT
tctttttttttttttgagac

SEQ ID NO: 181708 - DNA, 20 bp, Artificial Sequence
  Description of Artificial Sequence: Synthetic oligonucleotide
  Target: ATXN1; (-) strand; PAM type: YTN; PAM sequence: TTC
tttctttttttttttttgag

SEQ ID NO: 181709 - DNA, 20 bp, Artificial Sequence
  Description of Artificial Sequence: Synthetic oligonucleotide
  Target: ATXN1; (-) strand; PAM type: YTN; PAM sequence: TTT
ctttctttttttttttttga

SEQ ID NO: 181710 - DNA, 20 bp, Artificial Sequence
  Description of Artificial Sequence: Synthetic oligonucleotide
  Target: ATXN1; (-) strand; PAM type: YTN; PAM sequence: TTT
tctttctttttttttttttg

SEQ ID NO: 181711 - DNA, 20 bp, Artificial Sequence
  Description of Artificial Sequence: Synthetic oligonucleotide
  Target: ATXN1; (-) strand; PAM type: YTN; PAM sequence: CTA
ttttctttcttttttttttt

SEQ ID NO: 181712 - DNA, 20 bp, Artificial Sequence
  Description of Artificial Sequence: Synthetic oligonucleotide
  Target: ATXN1; (-) strand; PAM type: YTN; PAM sequence: CTA
tactattttctttctttttt

SEQ ID NO: 181713 - DNA, 20 bp, Artificial Sequence
  Description of Artificial Sequence: Synthetic oligonucleotide
  Target: ATXN1; (-) strand; PAM type: YTN; PAM sequence: TTC
aactatactattttctttct

SEQ ID NO: 181714 - DNA, 20 bp, Artificial Sequence
  Description of Artificial Sequence: Synthetic oligonucleotide
  Target: ATXN1; (-) strand; PAM type: YTN; PAM sequence: TTT
caactatactattttctttc

SEQ ID NO: 181715 - DNA, 20 bp, Artificial Sequence
  Description of Artificial Sequence: Synthetic oligonucleotide
  Target: ATXN1; (-) strand; PAM type: YTN; PAM sequence: CTT
tcaactatactattttcttt

SEQ ID NO: 181716 - DNA, 20 bp, Artificial Sequence
  Description of Artificial Sequence: Synthetic oligonucleotide
  Target: ATXN1; (-) strand; PAM type: YTN; PAM sequence: TTC
tttcaactatactattttct

SEQ ID NO: 181717 - DNA, 20 bp, Artificial Sequence
  Description of Artificial Sequence: Synthetic oligonucleotide
  Target: ATXN1; (-) strand; PAM type: YTN; PAM sequence: TTT
ctttcaactatactattttc

SEQ ID NO: 181718 - DNA, 20 bp, Artificial Sequence
  Description of Artificial Sequence: Synthetic oligonucleotide
  Target: ATXN1; (-) strand; PAM type: YTN; PAM sequence: CTC
cacgtttctttcaactatac

SEQ ID NO: 181719 - DNA, 20 bp, Artificial Sequence
  Description of Artificial Sequence: Synthetic oligonucleotide
  Target: ATXN1; (-) strand; PAM type: YTN; PAM sequence: TTA
caaactccacgtttctttca

SEQ ID NO: 181720 - DNA, 20 bp, Artificial Sequence
  Description of Artificial Sequence: Synthetic oligonucleotide
  Target: ATXN1; (-) strand; PAM type: YTN; PAM sequence: CTA
attacaaactccacgtttct

SEQ ID NO: 181721 - DNA, 20 bp, Artificial Sequence
  Description of Artificial Sequence: Synthetic oligonucleotide
  Target: ATXN1; (-) strand; PAM type: YTN; PAM sequence: CTC
taattacaaactccacgttt

SEQ ID NO: 181722 - DNA, 20 bp, Artificial Sequence
  Description of Artificial Sequence: Synthetic oligonucleotide
  Target: ATXN1; (-) strand; PAM type: YTN; PAM sequence: TTG
agaatgggggaaaagagaac

SEQ ID NO: 181723 - DNA, 20 bp, Artificial Sequence
  Description of Artificial Sequence: Synthetic oligonucleotide
  Target: ATXN1; (-) strand; PAM type: YTN; PAM sequence: TTT
gagaatgggggaaaagagaa

SEQ ID NO: 181724 - DNA, 20 bp, Artificial Sequence
  Description of Artificial Sequence: Synthetic oligonucleotide
  Target: ATXN1; (-) strand; PAM type: YTN; PAM sequence: CTT
tgagaatgggggaaaagaga

SEQ ID NO: 181725 - DNA, 20 bp, Artificial Sequence
  Description of Artificial Sequence: Synthetic oligonucleotide
  Target: ATXN1; (-) strand; PAM type: YTN; PAM sequence: TTG
ctttgagaatgggggaaaag

SEQ ID NO: 181726 - DNA, 20 bp, Artificial Sequence
  Description of Artificial Sequence: Synthetic oligonucleotide
  Target: ATXN1; (-) strand; PAM type: YTN; PAM sequence: TTT
gctttgagaatgggggaaaa

SEQ ID NO: 181727 - DNA, 20 bp, Artificial Sequence
  Description of Artificial Sequence: Synthetic oligonucleotide
  Target: ATXN1; (-) strand; PAM type: YTN; PAM sequence: CTG
tttgctttgagaatggggga

SEQ ID NO: 181728 - DNA, 20 bp, Artificial Sequence
  Description of Artificial Sequence: Synthetic oligonucleotide
  Target: ATXN1; (-) strand; PAM type: YTN; PAM sequence: TTC
tgtttgctttgagaatgggg

SEQ ID NO: 181729 - DNA, 20 bp, Artificial Sequence
  Description of Artificial Sequence: Synthetic oligonucleotide
  Target: ATXN1; (-) strand; PAM type: YTN; PAM sequence: TTT
ctgtttgctttgagaatggg

SEQ ID NO: 181730 - DNA, 20 bp, Artificial Sequence
  Description of Artificial Sequence: Synthetic oligonucleotide
  Target: ATXN1; (-) strand; PAM type: YTN; PAM sequence: TTG
tttctgtttgctttgagaat

SEQ ID NO: 181731 - DNA, 20 bp, Artificial Sequence
  Description of Artificial Sequence: Synthetic oligonucleotide
  Target: ATXN1; (-) strand; PAM type: YTN; PAM sequence: TTT
gtttctgtttgctttgagaa

SEQ ID NO: 181732 - DNA, 20 bp, Artificial Sequence
  Description of Artificial Sequence: Synthetic oligonucleotide
  Target: ATXN1; (-) strand; PAM type: YTN; PAM sequence: TTG
tgaaatttgtttctgtttgc

SEQ ID NO: 181733 - DNA, 20 bp, Artificial Sequence
  Description of Artificial Sequence: Synthetic oligonucleotide
  Target: ATXN1; (-) strand; PAM type: YTN; PAM sequence: TTT
gtgaaatttgtttctgtttg

SEQ ID NO: 181734 - DNA, 20 bp, Artificial Sequence
  Description of Artificial Sequence: Synthetic oligonucleotide
  Target: ATXN1; (-) strand; PAM type: YTN; PAM sequence: TTT
tgtgaaatttgtttctgttt

SEQ ID NO: 181735 - DNA, 20 bp, Artificial Sequence
  Description of Artificial Sequence: Synthetic oligonucleotide
  Target: ATXN1; (-) strand; PAM type: YTN; PAM sequence: TTT
ttgtgaaatttgtttctgtt

SEQ ID NO: 181736 - DNA, 20 bp, Artificial Sequence
  Description of Artificial Sequence: Synthetic oligonucleotide
  Target: ATXN1; (-) strand; PAM type: YTN; PAM sequence: TTG
tttttgtgaaatttgtttct

SEQ ID NO: 181737 - DNA, 20 bp, Artificial Sequence
  Description of Artificial Sequence: Synthetic oligonucleotide
  Target: ATXN1; (-) strand; PAM type: YTN; PAM sequence: CTT
gtttttgtgaaatttgtttc

SEQ ID NO: 181738 - DNA, 20 bp, Artificial Sequence
  Description of Artificial Sequence: Synthetic oligonucleotide
  Target: ATXN1; (-) strand; PAM type: YTN; PAM sequence: TTA
aacaacttgtttttgtgaaa

SEQ ID NO: 181739 - DNA, 20 bp, Artificial Sequence
  Description of Artificial Sequence: Synthetic oligonucleotide
  Target: ATXN1; (-) strand; PAM type: YTN; PAM sequence: TTT
aaacaacttgtttttgtgaa

SEQ ID NO: 181740 - DNA, 20 bp, Artificial Sequence
  Description of Artificial Sequence: Synthetic oligonucleotide
  Target: ATXN1; (-) strand; PAM type: YTN; PAM sequence: TTT
taaacaacttgtttttgtga

SEQ ID NO: 181741 - DNA, 20 bp, Artificial Sequence
  Description of Artificial Sequence: Synthetic oligonucleotide
  Target: ATXN1; (-) strand; PAM type: YTN; PAM sequence: CTT
ttaaacaacttgtttttgtg

SEQ ID NO: 181742 - DNA, 20 bp, Artificial Sequence
  Description of Artificial Sequence: Synthetic oligonucleotide
  Target: ATXN1; (-) strand; PAM type: YTN; PAM sequence: CTG
aagatagaaacaggaggata

SEQ ID NO: 181743 - DNA, 20 bp, Artificial Sequence
  Description of Artificial Sequence: Synthetic oligonucleotide
  Target: ATXN1; (-) strand; PAM type: YTN; PAM sequence: TTA
gaaagacaaagacagcaaga

SEQ ID NO: 181744 - DNA, 20 bp, Artificial Sequence
  Description of Artificial Sequence: Synthetic oligonucleotide
  Target: ATXN1; (-) strand; PAM type: YTN; PAM sequence: CTT
agaaagacaaagacagcaag

SEQ ID NO: 181745 - DNA, 20 bp, Artificial Sequence
  Description of Artificial Sequence: Synthetic oligonucleotide
  Target: ATXN1; (-) strand; PAM type: YTN; PAM sequence: CTG
gcatcttagaaagacaaaga

SEQ ID NO: 181746 - DNA, 20 bp, Artificial Sequence
  Description of Artificial Sequence: Synthetic oligonucleotide
  Target: ATXN1; (-) strand; PAM type: YTN; PAM sequence: CTC
tggcatcttagaaagacaaa

SEQ ID NO: 181747 - DNA, 20 bp, Artificial Sequence
  Description of Artificial Sequence: Synthetic oligonucleotide
  Target: ATXN1; (-) strand; PAM type: YTN; PAM sequence: TTC
tctggcatcttagaaagaca

SEQ ID NO: 181748 - DNA, 20 bp, Artificial Sequence
  Description of Artificial Sequence: Synthetic oligonucleotide
  Target: ATXN1; (-) strand; PAM type: YTN; PAM sequence: CTT
ctctggcatcttagaaagac

SEQ ID NO: 181749 - DNA, 20 bp, Artificial Sequence
  Description of Artificial Sequence: Synthetic oligonucleotide
  Target: ATXN1; (-) strand; PAM type: YTN; PAM sequence: CTA
tatgcagaggaaacttctct

SEQ ID NO: 181750 - DNA, 20 bp, Artificial Sequence
  Description of Artificial Sequence: Synthetic oligonucleotide
  Target: ATXN1; (-) strand; PAM type: YTN; PAM sequence: TTC
tatatgcagaggaaacttct

SEQ ID NO: 181751 - DNA, 20 bp, Artificial Sequence
  Description of Artificial Sequence: Synthetic oligonucleotide
  Target: ATXN1; (-) strand; PAM type: YTN; PAM sequence: TTT
ctatatgcagaggaaacttc

SEQ ID NO: 181752 - DNA, 20 bp, Artificial Sequence
  Description of Artificial Sequence: Synthetic oligonucleotide
  Target: ATXN1; (-) strand; PAM type: YTN; PAM sequence: TTT
tctatatgcagaggaaactt

SEQ ID NO: 181753 - DNA, 20 bp, Artificial Sequence
  Description of Artificial Sequence: Synthetic oligonucleotide
  Target: ATXN1; (-) strand; PAM type: YTN; PAM sequence: CTA
gtgagggcacaagacagaca

SEQ ID NO: 181754 - DNA, 20 bp, Artificial Sequence
  Description of Artificial Sequence: Synthetic oligonucleotide
  Target: ATXN1; (-) strand; PAM type: YTN; PAM sequence: TTC
cctagtgagggcacaagaca

SEQ ID NO: 181755 - DNA, 20 bp, Artificial Sequence
  Description of Artificial Sequence: Synthetic oligonucleotide
  Target: ATXN1; (-) strand; PAM type: YTN; PAM sequence: CTT
ccctagtgagggcacaagac

SEQ ID NO: 181756 - DNA, 20 bp, Artificial Sequence
  Description of Artificial Sequence: Synthetic oligonucleotide
  Target: ATXN1; (-) strand; PAM type: YTN; PAM sequence: CTA
aggggacttccctagtgagg

SEQ ID NO: 181757 - DNA, 20 bp, Artificial Sequence
  Description of Artificial Sequence: Synthetic oligonucleotide
  Target: ATXN1; (-) strand; PAM type: YTN; PAM sequence: TTC
ggacgcctaaggggacttcc

SEQ ID NO: 181758 - DNA, 20 bp, Artificial Sequence
  Description of Artificial Sequence: Synthetic oligonucleotide
  Target: ATXN1; (-) strand; PAM type: YTN; PAM sequence: CTG
acattcggacgcctaagggg

SEQ ID NO: 181759 - DNA, 20 bp, Artificial Sequence
  Description of Artificial Sequence: Synthetic oligonucleotide
  Target: ATXN1; (-) strand; PAM type: YTN; PAM sequence: CTA
agaacggcctgacattcgga

SEQ ID NO: 181760 - DNA, 20 bp, Artificial Sequence
  Description of Artificial Sequence: Synthetic oligonucleotide
  Target: ATXN1; (-) strand; PAM type: YTN; PAM sequence: TTA
taggcaaaaaggcaatctaa

SEQ ID NO: 181761 - DNA, 20 bp, Artificial Sequence
  Description of Artificial Sequence: Synthetic oligonucleotide
  Target: ATXN1; (-) strand; PAM type: YTN; PAM sequence: CTC
gtgtgttataggcaaaaagg

SEQ ID NO: 181762 - DNA, 20 bp, Artificial Sequence
  Description of Artificial Sequence: Synthetic oligonucleotide
  Target: ATXN1; (-) strand; PAM type: YTN; PAM sequence: TTA
caacctcgtgtgttataggc

SEQ ID NO: 181763 - DNA, 20 bp, Artificial Sequence
  Description of Artificial Sequence: Synthetic oligonucleotide
  Target: ATXN1; (-) strand; PAM type: YTN; PAM sequence: TTC
atgagccacattacaacctc

SEQ ID NO: 181764 - DNA, 20 bp, Artificial Sequence
  Description of Artificial Sequence: Synthetic oligonucleotide
  Target: ATXN1; (-) strand; PAM type: YTN; PAM sequence: TTG
ttcatgagccacattacaac

SEQ ID NO: 181765 - DNA, 20 bp, Artificial Sequence
  Description of Artificial Sequence: Synthetic oligonucleotide
  Target: ATXN1; (-) strand; PAM type: YTN; PAM sequence: CTT
gttcatgagccacattacaa

SEQ ID NO: 181766 - DNA, 20 bp, Artificial Sequence
  Description of Artificial Sequence: Synthetic oligonucleotide
  Target: ATXN1; (-) strand; PAM type: YTN; PAM sequence: CTG
tcttgttcatgagccacatt

SEQ ID NO: 181767 - DNA, 20 bp, Artificial Sequence
  Description of Artificial Sequence: Synthetic oligonucleotide
  Target: ATXN1; (-) strand; PAM type: YTN; PAM sequence: CTA
tagtaggcatctgtcttgtt

SEQ ID NO: 181768 - DNA, 20 bp, Artificial Sequence
  Description of Artificial Sequence: Synthetic oligonucleotide
  Target: ATXN1; (-) strand; PAM type: YTN; PAM sequence: TTG
ctatagtaggcatctgtctt

SEQ ID NO: 181769 - DNA, 20 bp, Artificial Sequence
  Description of Artificial Sequence: Synthetic oligonucleotide
  Target: ATXN1; (-) strand; PAM type: YTN; PAM sequence: CTT
gctatagtaggcatctgtct

SEQ ID NO: 181770 - DNA, 20 bp, Artificial Sequence
  Description of Artificial Sequence: Synthetic oligonucleotide
  Target: ATXN1; (-) strand; PAM type: YTN; PAM sequence: CTA
cttgctatagtaggcatctg

SEQ ID NO: 181771 - DNA, 20 bp, Artificial Sequence
  Description of Artificial Sequence: Synthetic oligonucleotide
  Target: ATXN1; (-) strand; PAM type: YTN; PAM sequence: TTC
tacttgctatagtaggcatc

SEQ ID NO: 181772 - DNA, 20 bp, Artificial Sequence
  Description of Artificial Sequence: Synthetic oligonucleotide
  Target: ATXN1; (-) strand; PAM type: YTN; PAM sequence: TTG
cagaattctacttgctatag

SEQ ID NO: 181773 - DNA, 20 bp, Artificial Sequence
  Description of Artificial Sequence: Synthetic oligonucleotide
  Target: ATXN1; (-) strand; PAM type: YTN; PAM sequence: TTT
gcagaattctacttgctata

SEQ ID NO: 181774 - DNA, 20 bp, Artificial Sequence
  Description of Artificial Sequence: Synthetic oligonucleotide
  Target: ATXN1; (-) strand; PAM type: YTN; PAM sequence: TTG
aatgtcgtttgcagaattct

SEQ ID NO: 181775 - DNA, 20 bp, Artificial Sequence
  Description of Artificial Sequence: Synthetic oligonucleotide
  Target: ATXN1; (-) strand; PAM type: YTN; PAM sequence: CTG
tggatgtcattgaatgtcgt

SEQ ID NO: 181776 - DNA, 20 bp, Artificial Sequence
  Description of Artificial Sequence: Synthetic oligonucleotide
  Target: ATXN1; (-) strand; PAM type: YTN; PAM sequence: CTC
tgtggatgtcattgaatgtc

SEQ ID NO: 181777 - DNA, 20 bp, Artificial Sequence
  Description of Artificial Sequence: Synthetic oligonucleotide
  Target: ATXN1; (-) strand; PAM type: YTN; PAM sequence: CTC
tctgtggatgtcattgaatg

SEQ ID NO: 181778 - DNA, 20 bp, Artificial Sequence
  Description of Artificial Sequence: Synthetic oligonucleotide
  Target: ATXN1; (-) strand; PAM type: YTN; PAM sequence: TTC
tctctgtggatgtcattgaa

SEQ ID NO: 181779 - DNA, 20 bp, Artificial Sequence
  Description of Artificial Sequence: Synthetic oligonucleotide
  Target: ATXN1; (-) strand; PAM type: YTN; PAM sequence: CTT
ctctctgtggatgtcattga

SEQ ID NO: 181780 - DNA, 20 bp, Artificial Sequence
  Description of Artificial Sequence: Synthetic oligonucleotide
  Target: ATXN1; (-) strand; PAM type: YTN; PAM sequence: TTG
caggtcttctctctgtggat

SEQ ID NO: 181781 - DNA, 20 bp, Artificial Sequence
  Description of Artificial Sequence: Synthetic oligonucleotide
  Target: ATXN1; (-) strand; PAM type: YTN; PAM sequence: CTA
ccgagttgcaggtcttctct

SEQ ID NO: 181782 - DNA, 20 bp, Artificial Sequence
  Description of Artificial Sequence: Synthetic oligonucleotide
  Target: ATXN1; (-) strand; PAM type: YTN; PAM sequence: TTC
taccgagttgcaggtcttct

SEQ ID NO: 181783 - DNA, 20 bp, Artificial Sequence
  Description of Artificial Sequence: Synthetic oligonucleotide
  Target: ATXN1; (-) strand; PAM type: YTN; PAM sequence: TTT
ctaccgagttgcaggtcttc

SEQ ID NO: 181784 - DNA, 20 bp, Artificial Sequence
  Description of Artificial Sequence: Synthetic oligonucleotide
  Target: ATXN1; (-) strand; PAM type: YTN; PAM sequence: TTT
tctaccgagttgcaggtctt

SEQ ID NO: 181785 - DNA, 20 bp, Artificial Sequence
  Description of Artificial Sequence: Synthetic oligonucleotide
  Target: ATXN1; (-) strand; PAM type: YTN; PAM sequence: CTT
ttctaccgagttgcaggtct

SEQ ID NO: 181786 - DNA, 20 bp, Artificial Sequence
  Description of Artificial Sequence: Synthetic oligonucleotide
  Target: ATXN1; (-) strand; PAM type: YTN; PAM sequence: TTC
ttttctaccgagttgcaggt

SEQ ID NO: 181787 - DNA, 20 bp, Artificial Sequence
  Description of Artificial Sequence: Synthetic oligonucleotide
  Target: ATXN1; (-) strand; PAM type: YTN; PAM sequence: TTT
cttttctaccgagttgcagg

SEQ ID NO: 181788 - DNA, 20 bp, Artificial Sequence
  Description of Artificial Sequence: Synthetic oligonucleotide
  Target: ATXN1; (-) strand; PAM type: YTN; PAM sequence: TTG
accaaacatcgtgtttcttt

SEQ ID NO: 181789 - DNA, 20 bp, Artificial Sequence
  Description of Artificial Sequence: Synthetic oligonucleotide
  Target: ATXN1; (-) strand; PAM type: YTN; PAM sequence: CTC
agttgaccaaacatcgtgtt

SEQ ID NO: 181790 - DNA, 20 bp, Artificial Sequence
  Description of Artificial Sequence: Synthetic oligonucleotide
  Target: ATXN1; (-) strand; PAM type: YTN; PAM sequence: CTG
gtgctcagttgaccaaacat

SEQ ID NO: 181791 - DNA, 20 bp, Artificial Sequence
  Description of Artificial Sequence: Synthetic oligonucleotide
  Target: ATXN1; (-) strand; PAM type: YTN; PAM sequence: CTC
acagtctggtgctcagttga

SEQ ID NO: 181792 - DNA, 20 bp, Artificial Sequence
  Description of Artificial Sequence: Synthetic oligonucleotide
  Target: ATXN1; (-) strand; PAM type: YTN; PAM sequence: CTC
aaaaagctcacagtctggtg

SEQ ID NO: 181793 - DNA, 20 bp, Artificial Sequence
  Description of Artificial Sequence: Synthetic oligonucleotide
  Target: ATXN1; (-) strand; PAM type: YTN; PAM sequence: TTA
ccctcaaaaagctcacagtc

SEQ ID NO: 181794 - DNA, 20 bp, Artificial Sequence
  Description of Artificial Sequence: Synthetic oligonucleotide
  Target: ATXN1; (-) strand; PAM type: YTN; PAM sequence: TTT
accctcaaaaagctcacagt

SEQ ID NO: 181795 - DNA, 20 bp, Artificial Sequence
  Description of Artificial Sequence: Synthetic oligonucleotide
  Target: ATXN1; (-) strand; PAM type: YTN; PAM sequence: CTT
taccctcaaaaagctcacag

SEQ ID NO: 181796 - DNA, 20 bp, Artificial Sequence
  Description of Artificial Sequence: Synthetic oligonucleotide
  Target: ATXN1; (-) strand; PAM type: YTN; PAM sequence: CTC
ggagaaaacataatctttac

SEQ ID NO: 181797 - DNA, 20 bp, Artificial Sequence
  Description of Artificial Sequence: Synthetic oligonucleotide
  Target: ATXN1; (-) strand; PAM type: YTN; PAM sequence: CTG
aactcggagaaaacataatc

SEQ ID NO: 181798 - DNA, 20 bp, Artificial Sequence
  Description of Artificial Sequence: Synthetic oligonucleotide
  Target: ATXN1; (-) strand; PAM type: YTN; PAM sequence: TTG
aatgccagcaatacaccctg

SEQ ID NO: 181799 - DNA, 20 bp, Artificial Sequence
  Description of Artificial Sequence: Synthetic oligonucleotide
  Target: ATXN1; (-) strand; PAM type: YTN; PAM sequence: TTA
ttgaatgccagcaatacacc

SEQ ID NO: 181800 - DNA, 20 bp, Artificial Sequence
  Description of Artificial Sequence: Synthetic oligonucleotide
  Target: ATXN1; (-) strand; PAM type: YTN; PAM sequence: TTT
attgaatgccagcaatacac

SEQ ID NO: 181801 - DNA, 20 bp, Artificial Sequence
  Description of Artificial Sequence: Synthetic oligonucleotide
  Target: ATXN1; (-) strand; PAM type: YTN; PAM sequence: CTA
aatatttattgaatgccagc

SEQ ID NO: 181802 - DNA, 20 bp, Artificial Sequence
  Description of Artificial Sequence: Synthetic oligonucleotide
  Target: ATXN1; (-) strand; PAM type: YTN; PAM sequence: TTC
cctaaatatttattgaatgc

SEQ ID NO: 181803 - DNA, 20 bp, Artificial Sequence
  Description of Artificial Sequence: Synthetic oligonucleotide
  Target: ATXN1; (-) strand; PAM type: YTN; PAM sequence: TTC
attccctaaatatttattga

SEQ ID NO: 181804 - DNA, 20 bp, Artificial Sequence
  Description of Artificial Sequence: Synthetic oligonucleotide
  Target: ATXN1; (-) strand; PAM type: YTN; PAM sequence: CTG
catgtattcattccctaaat

SEQ ID NO: 181805 - DNA, 20 bp, Artificial Sequence
  Description of Artificial Sequence: Synthetic oligonucleotide
  Target: ATXN1; (-) strand; PAM type: YTN; PAM sequence: TTC
atccctgcatgtattcattc

SEQ ID NO: 181806 - DNA, 20 bp, Artificial Sequence
  Description of Artificial Sequence: Synthetic oligonucleotide
  Target: ATXN1; (-) strand; PAM type: YTN; PAM sequence: TTC
atcacatattcatccctgca

SEQ ID NO: 181807 - DNA, 20 bp, Artificial Sequence
  Description of Artificial Sequence: Synthetic oligonucleotide
  Target: ATXN1; (-) strand; PAM type: YTN; PAM sequence: CTG
ttcatcacatattcatccct

SEQ ID NO: 181808 - DNA, 20 bp, Artificial Sequence
  Description of Artificial Sequence: Synthetic oligonucleotide
  Target: ATXN1; (-) strand; PAM type: YTN; PAM sequence: TTG
taacctgttcatcacatatt

SEQ ID NO: 181809 - DNA, 20 bp, Artificial Sequence
  Description of Artificial Sequence: Synthetic oligonucleotide
  Target: ATXN1; (-) strand; PAM type: YTN; PAM sequence: TTT
gtaacctgttcatcacatat

SEQ ID NO: 181810 - DNA, 20 bp, Artificial Sequence
  Description of Artificial Sequence: Synthetic oligonucleotide
  Target: ATXN1; (-) strand; PAM type: YTN; PAM sequence: CTG
aaccgtatttgtaacctgtt

SEQ ID NO: 181811 - DNA, 20 bp, Artificial Sequence
  Description of Artificial Sequence: Synthetic oligonucleotide
  Target: ATXN1; (-) strand; PAM type: YTN; PAM sequence: TTC
tgaaccgtatttgtaacctg

SEQ ID NO: 181812 - DNA, 20 bp, Artificial Sequence
  Description of Artificial Sequence: Synthetic oligonucleotide
  Target: ATXN1; (-) strand; PAM type: YTN; PAM sequence: TTA
tgaattctgaaccgtatttg

SEQ ID NO: 181813 - DNA, 20 bp, Artificial Sequence
  Description of Artificial Sequence: Synthetic oligonucleotide
  Target: ATXN1; (-) strand; PAM type: YTN; PAM sequence: CTA
gttatgaattctgaaccgta

SEQ ID NO: 181814 - DNA, 20 bp, Artificial Sequence
  Description of Artificial Sequence: Synthetic oligonucleotide
  Target: ATXN1; (-) strand; PAM type: YTN; PAM sequence: TTA
ctagttatgaattctgaacc

SEQ ID NO: 181815 - DNA, 20 bp, Artificial Sequence
  Description of Artificial Sequence: Synthetic oligonucleotide
  Target: ATXN1; (-) strand; PAM type: YTN; PAM sequence: TTC
attactagttatgaattctg

SEQ ID NO: 181816 - DNA, 20 bp, Artificial Sequence
  Description of Artificial Sequence: Synthetic oligonucleotide
  Target: ATXN1; (-) strand; PAM type: YTN; PAM sequence: CTC
atatcattcattactagtta

SEQ ID NO: 181817 - DNA, 20 bp, Artificial Sequence
  Description of Artificial Sequence: Synthetic oligonucleotide
  Target: ATXN1; (-) strand; PAM type: YTN; PAM sequence: TTC
tcatatcattcattactagt

SEQ ID NO: 181818 - DNA, 20 bp, Artificial Sequence
  Description of Artificial Sequence: Synthetic oligonucleotide
  Target: ATXN1; (-) strand; PAM type: YTN; PAM sequence: TTT
ctcatatcattcattactag

SEQ ID NO: 181819 - DNA, 20 bp, Artificial Sequence
  Description of Artificial Sequence: Synthetic oligonucleotide
  Target: ATXN1; (-) strand; PAM type: YTN; PAM sequence: CTT
tctcatatcattcattacta

SEQ ID NO: 181820 - DNA, 20 bp, Artificial Sequence
  Description of Artificial Sequence: Synthetic oligonucleotide
  Target: ATXN1; (-) strand; PAM type: YTN; PAM sequence: TTA
ctttctcatatcattcatta

SEQ ID NO: 181821 - DNA, 20 bp, Artificial Sequence
  Description of Artificial Sequence: Synthetic oligonucleotide
  Target: ATXN1; (-) strand; PAM type: YTN; PAM sequence: TTT
actttctcatatcattcatt

SEQ ID NO: 181822 - DNA, 20 bp, Artificial Sequence
  Description of Artificial Sequence: Synthetic oligonucleotide
  Target: ATXN1; (-) strand; PAM type: YTN; PAM sequence: CTG
gaaaggtttactttctcata

SEQ ID NO: 181823 - DNA, 20 bp, Artificial Sequence
  Description of Artificial Sequence: Synthetic oligonucleotide
  Target: ATXN1; (-) strand; PAM type: YTN; PAM sequence: CTA
tcaacaaaatctggaaaggt

SEQ ID NO: 181824 - DNA, 20 bp, Artificial Sequence
  Description of Artificial Sequence: Synthetic oligonucleotide
  Target: ATXN1; (-) strand; PAM type: YTN; PAM sequence: TTA
tgctatcaacaaaatctgga

SEQ ID NO: 181825 - DNA, 20 bp, Artificial Sequence
  Description of Artificial Sequence: Synthetic oligonucleotide
  Target: ATXN1; (-) strand; PAM type: YTN; PAM sequence: CTT
atgctatcaacaaaatctgg

SEQ ID NO: 181826 - DNA, 20 bp, Artificial Sequence
  Description of Artificial Sequence: Synthetic oligonucleotide
  Target: ATXN1; (-) strand; PAM type: YTN; PAM sequence: TTA
atcttatgctatcaacaaaa

SEQ ID NO: 181827 - DNA, 20 bp, Artificial Sequence
  Description of Artificial Sequence: Synthetic oligonucleotide
  Target: ATXN1; (-) strand; PAM type: YTN; PAM sequence: TTT
aatcttatgctatcaacaaa

SEQ ID NO: 181828 - DNA, 20 bp, Artificial Sequence
  Description of Artificial Sequence: Synthetic oligonucleotide
  Target: ATXN1; (-) strand; PAM type: YTN; PAM sequence: CTG
aatttaatcttatgctatca

SEQ ID NO: 181829 - DNA, 20 bp, Artificial Sequence
  Description of Artificial Sequence: Synthetic oligonucleotide
  Target: ATXN1; (-) strand; PAM type: YTN; PAM sequence: TTC
cagctgaatttaatcttatg

SEQ ID NO: 181830 - DNA, 20 bp, Artificial Sequence
  Description of Artificial Sequence: Synthetic oligonucleotide
  Target: ATXN1; (-) strand; PAM type: YTN; PAM sequence: TTT
ccagctgaatttaatcttat

SEQ ID NO: 181831 - DNA, 20 bp, Artificial Sequence
  Description of Artificial Sequence: Synthetic oligonucleotide
  Target: ATXN1; (-) strand; PAM type: YTN; PAM sequence: TTT
tccagctgaatttaatctta

SEQ ID NO: 181832 - DNA, 20 bp, Artificial Sequence
  Description of Artificial Sequence: Synthetic oligonucleotide
  Target: ATXN1; (-) strand; PAM type: YTN; PAM sequence: CTT
ttccagctgaatttaatctt

SEQ ID NO: 181833 - DNA, 20 bp, Artificial Sequence
  Description of Artificial Sequence: Synthetic oligonucleotide
  Target: ATXN1; (-) strand; PAM type: YTN; PAM sequence: TTC
cttttccagctgaatttaat

SEQ ID NO: 181834 - DNA, 20 bp, Artificial Sequence
  Description of Artificial Sequence: Synthetic oligonucleotide
  Target: ATXN1; (-) strand; PAM type: YTN; PAM sequence: TTT
ccttttccagctgaatttaa

SEQ ID NO: 181835 - DNA, 20 bp, Artificial Sequence
  Description of Artificial Sequence: Synthetic oligonucleotide
  Target: ATXN1; (-) strand; PAM type: YTN; PAM sequence: TTT
tccttttccagctgaattta

SEQ ID NO: 181836 - DNA, 20 bp, Artificial Sequence
  Description of Artificial Sequence: Synthetic oligonucleotide
  Target: ATXN1; (-) strand; PAM type: YTN; PAM sequence: CTA
aatgttttccttttccagct

SEQ ID NO: 181837 - DNA, 20 bp, Artificial Sequence
  Description of Artificial Sequence: Synthetic oligonucleotide
  Target: ATXN1; (-) strand; PAM type: YTN; PAM sequence: CTC
agagatggataatcctaaat

SEQ ID NO: 181838 - DNA, 20 bp, Artificial Sequence
  Description of Artificial Sequence: Synthetic oligonucleotide
  Target: ATXN1; (-) strand; PAM type: YTN; PAM sequence: CTG
acacacaatcactcagagat

SEQ ID NO: 181839 - DNA, 20 bp, Artificial Sequence
  Description of Artificial Sequence: Synthetic oligonucleotide
  Target: ATXN1; (-) strand; PAM type: YTN; PAM sequence: CTG
aagactgacacacaatcact

SEQ ID NO: 181840 - DNA, 20 bp, Artificial Sequence
  Description of Artificial Sequence: Synthetic oligonucleotide
  Target: ATXN1; (-) strand; PAM type: YTN; PAM sequence: CTC
tgaagactgacacacaatca

SEQ ID NO: 181841 - DNA, 20 bp, Artificial Sequence
  Description of Artificial Sequence: Synthetic oligonucleotide
  Target: ATXN1; (-) strand; PAM type: YTN; PAM sequence: TTC
ctctgaagactgacacacaa

SEQ ID NO: 181842 - DNA, 20 bp, Artificial Sequence
  Description of Artificial Sequence: Synthetic oligonucleotide
  Target: ATXN1; (-) strand; PAM type: YTN; PAM sequence: TTT
cctctgaagactgacacaca

SEQ ID NO: 181843 - DNA, 20 bp, Artificial Sequence
  Description of Artificial Sequence: Synthetic oligonucleotide
  Target: ATXN1; (-) strand; PAM type: YTN; PAM sequence: TTT
tcctctgaagactgacacac

SEQ ID NO: 181844 - DNA, 20 bp, Artificial Sequence
  Description of Artificial Sequence: Synthetic oligonucleotide
  Target: ATXN1; (-) strand; PAM type: YTN; PAM sequence: TTT
ttcctctgaagactgacaca

SEQ ID NO: 181845 - DNA, 20 bp, Artificial Sequence
  Description of Artificial Sequence: Synthetic oligonucleotide
  Target: ATXN1; (-) strand; PAM type: YTN; PAM sequence: TTC
agtttttcctctgaagactg

SEQ ID NO: 181846 - DNA, 20 bp, Artificial Sequence
  Description of Artificial Sequence: Synthetic oligonucleotide
  Target: ATXN1; (-) strand; PAM type: YTN; PAM sequence: TTA
aaagaaaaattcagtttttc

SEQ ID NO: 181847 - DNA, 20 bp, Artificial Sequence
  Description of Artificial Sequence: Synthetic oligonucleotide
  Target: ATXN1; (-) strand; PAM type: YTN; PAM sequence: TTT
aaaagaaaaattcagttttt

SEQ ID NO: 181848 - DNA, 20 bp, Artificial Sequence
  Description of Artificial Sequence: Synthetic oligonucleotide
  Target: ATXN1; (-) strand; PAM type: YTN; PAM sequence: TTT
taaaagaaaaattcagtttt

SEQ ID NO: 181849 - DNA, 20 bp, Artificial Sequence
  Description of Artificial Sequence: Synthetic oligonucleotide
  Target: ATXN1; (-) strand; PAM type: YTN; PAM sequence: TTT
ttaaaagaaaaattcagttt

SEQ ID NO: 181850 - DNA, 20 bp, Artificial Sequence
  Description of Artificial Sequence: Synthetic oligonucleotide
  Target: ATXN1; (-) strand; PAM type: YTN; PAM sequence: CTT
tttaaaagaaaaattcagtt

SEQ ID NO: 181851 - DNA, 20 bp, Artificial Sequence
  Description of Artificial Sequence: Synthetic oligonucleotide
  Target: ATXN1; (-) strand; PAM type: YTN; PAM sequence: CTG
gctttttaaaagaaaaattc

SEQ ID NO: 181852 - DNA, 20 bp, Artificial Sequence
  Description of Artificial Sequence: Synthetic oligonucleotide
  Target: ATXN1; (-) strand; PAM type: YTN; PAM sequence: CTG
tcccactggctttttaaaag

SEQ ID NO: 181853 - DNA, 20 bp, Artificial Sequence
  Description of Artificial Sequence: Synthetic oligonucleotide
  Target: ATXN1; (-) strand; PAM type: YTN; PAM sequence: TTC
agaaatgactgtcccactgg

SEQ ID NO: 181854 - DNA, 20 bp, Artificial Sequence
  Description of Artificial Sequence: Synthetic oligonucleotide
  Target: ATXN1; (-) strand; PAM type: YTN; PAM sequence: TTT
cagaaatgactgtcccactg

SEQ ID NO: 181855 - DNA, 20 bp, Artificial Sequence
  Description of Artificial Sequence: Synthetic oligonucleotide
  Target: ATXN1; (-) strand; PAM type: YTN; PAM sequence: TTT
tcagaaatgactgtcccact

SEQ ID NO: 181856 - DNA, 20 bp, Artificial Sequence
  Description of Artificial Sequence: Synthetic oligonucleotide
  Target: ATXN1; (-) strand; PAM type: YTN; PAM sequence: TTC
acaaatgagttttcagaaat

SEQ ID NO: 181857 - DNA, 20 bp, Artificial Sequence
  Description of Artificial Sequence: Synthetic oligonucleotide
  Target: ATXN1; (-) strand; PAM type: YTN; PAM sequence: TTG
attcacaaatgagttttcag

SEQ ID NO: 181858 - DNA, 20 bp, Artificial Sequence
  Description of Artificial Sequence: Synthetic oligonucleotide
  Target: ATXN1; (-) strand; PAM type: YTN; PAM sequence: TTT
gattcacaaatgagttttca

SEQ ID NO: 181859 - DNA, 20 bp, Artificial Sequence
  Description of Artificial Sequence: Synthetic oligonucleotide
  Target: ATXN1; (-) strand; PAM type: YTN; PAM sequence: TTT
tgattcacaaatgagttttc

SEQ ID NO: 181860 - DNA, 20 bp, Artificial Sequence
  Description of Artificial Sequence: Synthetic oligonucleotide
  Target: ATXN1; (-) strand; PAM type: YTN; PAM sequence: CTG
gttttgattcacaaatgagt

SEQ ID NO: 181861 - DNA, 20 bp, Artificial Sequence
  Description of Artificial Sequence: Synthetic oligonucleotide
  Target: ATXN1; (-) strand; PAM type: YTN; PAM sequence: CTC
tggttttgattcacaaatga

SEQ ID NO: 181862 - DNA, 20 bp, Artificial Sequence
  Description of Artificial Sequence: Synthetic oligonucleotide
  Target: ATXN1; (-) strand; PAM type: YTN; PAM sequence: CTA
ctctggttttgattcacaaa

SEQ ID NO: 181863 - DNA, 20 bp, Artificial Sequence
  Description of Artificial Sequence: Synthetic oligonucleotide
  Target: ATXN1; (-) strand; PAM type: YTN; PAM sequence: TTG
gtctactctggttttgattc

SEQ ID NO: 181864 - DNA, 20 bp, Artificial Sequence
  Description of Artificial Sequence: Synthetic oligonucleotide
  Target: ATXN1; (-) strand; PAM type: YTN; PAM sequence: CTT
ggtctactctggttttgatt

SEQ ID NO: 181865 - DNA, 20 bp, Artificial Sequence
  Description of Artificial Sequence: Synthetic oligonucleotide
  Target: ATXN1; (-) strand; PAM type: YTN; PAM sequence: CTC
agtcacttggtctactctgg

SEQ ID NO: 181866 - DNA, 20 bp, Artificial Sequence
  Description of Artificial Sequence: Synthetic oligonucleotide
  Target: ATXN1; (-) strand; PAM type: YTN; PAM sequence: TTG
gaatgctcagtcacttggtc

SEQ ID NO: 181867 - DNA, 20 bp, Artificial Sequence
  Description of Artificial Sequence: Synthetic oligonucleotide
  Target: ATXN1; (-) strand; PAM type: YTN; PAM sequence: TTC
attggaatgctcagtcactt

SEQ ID NO: 181868 - DNA, 20 bp, Artificial Sequence
  Description of Artificial Sequence: Synthetic oligonucleotide
  Target: ATXN1; (-) strand; PAM type: YTN; PAM sequence: TTT
cattggaatgctcagtcact

SEQ ID NO: 181869 - DNA, 20 bp, Artificial Sequence
  Description of Artificial Sequence: Synthetic oligonucleotide
  Target: ATXN1; (-) strand; PAM type: YTN; PAM sequence: CTT
tcattggaatgctcagtcac

SEQ ID NO: 181870 - DNA, 20 bp, Artificial Sequence
  Description of Artificial Sequence: Synthetic oligonucleotide
  Target: ATXN1; (-) strand; PAM type: YTN; PAM sequence: TTA
ccctttcattggaatgctca

SEQ ID NO: 181871 - DNA, 20 bp, Artificial Sequence
  Description of Artificial Sequence: Synthetic oligonucleotide
  Target: ATXN1; (-) strand; PAM type: YTN; PAM sequence: TTT
accctttcattggaatgctc

SEQ ID NO: 181872 - DNA, 20 bp, Artificial Sequence
  Description of Artificial Sequence: Synthetic oligonucleotide
  Target: ATXN1; (-) strand; PAM type: YTN; PAM sequence: TTT
taccctttcattggaatgct

SEQ ID NO: 181873 - DNA, 20 bp, Artificial Sequence
  Description of Artificial Sequence: Synthetic oligonucleotide
  Target: ATXN1; (-) strand; PAM type: YTN; PAM sequence: TTT
ttaccctttcattggaatgc

SEQ ID NO: 181874 - DNA, 20 bp, Artificial Sequence
  Description of Artificial Sequence: Synthetic oligonucleotide
  Target: ATXN1; (-) strand; PAM type: YTN; PAM sequence: TTT
tttaccctttcattggaatg

SEQ ID NO: 181875 - DNA, 20 bp, Artificial Sequence
  Description of Artificial Sequence: Synthetic oligonucleotide
  Target: ATXN1; (-) strand; PAM type: YTN; PAM sequence: TTT
ttttaccctttcattggaat

SEQ ID NO: 181876 - DNA, 20 bp, Artificial Sequence
  Description of Artificial Sequence: Synthetic oligonucleotide
  Target: ATXN1; (-) strand; PAM type: YTN; PAM sequence: CTT
tttttaccctttcattggaa

SEQ ID NO: 181877 - DNA, 20 bp, Artificial Sequence
  Description of Artificial Sequence: Synthetic oligonucleotide
  Target: ATXN1; (-) strand; PAM type: YTN; PAM sequence: CTG
ctttttttaccctttcattg

SEQ ID NO: 181878 - DNA, 20 bp, Artificial Sequence
  Description of Artificial Sequence: Synthetic oligonucleotide
  Target: ATXN1; (-) strand; PAM type: YTN; PAM sequence: TTC
tgctttttttaccctttcat

SEQ ID NO: 181879 - DNA, 20 bp, Artificial Sequence
  Description of Artificial Sequence: Synthetic oligonucleotide
  Target: ATXN1; (-) strand; PAM type: YTN; PAM sequence: TTT
ctgctttttttaccctttca

SEQ ID NO: 181880 - DNA, 20 bp, Artificial Sequence
  Description of Artificial Sequence: Synthetic oligonucleotide
  Target: ATXN1; (-) strand; PAM type: YTN; PAM sequence: CTC
acaccagtgagagtgggaaa

SEQ ID NO: 181881 - DNA, 20 bp, Artificial Sequence
  Description of Artificial Sequence: Synthetic oligonucleotide
  Target: ATXN1; (-) strand; PAM type: YTN; PAM sequence: TTA
aaatctcacaccagtgagag

SEQ ID NO: 181882 - DNA, 20 bp, Artificial Sequence
  Description of Artificial Sequence: Synthetic oligonucleotide
  Target: ATXN1; (-) strand; PAM type: YTN; PAM sequence: TTT
aaaatctcacaccagtgaga

SEQ ID NO: 181883 - DNA, 20 bp, Artificial Sequence
  Description of Artificial Sequence: Synthetic oligonucleotide
  Target: ATXN1; (-) strand; PAM type: YTN; PAM sequence: CTT
taaaatctcacaccagtgag

SEQ ID NO: 181884 - DNA, 20 bp, Artificial Sequence
  Description of Artificial Sequence: Synthetic oligonucleotide
  Target: ATXN1; (-) strand; PAM type: YTN; PAM sequence: TTG
acaggaaggaatgtctttaa

SEQ ID NO: 181885 - DNA, 20 bp, Artificial Sequence
  Description of Artificial Sequence: Synthetic oligonucleotide
  Target: ATXN1; (-) strand; PAM type: YTN; PAM sequence: TTT
gacaggaaggaatgtcttta

SEQ ID NO: 181886 - DNA, 20 bp, Artificial Sequence
  Description of Artificial Sequence: Synthetic oligonucleotide
  Target: ATXN1; (-) strand; PAM type: YTN; PAM sequence: TTT
tgacaggaaggaatgtcttt

SEQ ID NO: 181887 - DNA, 20 bp, Artificial Sequence
  Description of Artificial Sequence: Synthetic oligonucleotide
  Target: ATXN1; (-) strand; PAM type: YTN; PAM sequence: CTT
ttgacaggaaggaatgtctt

SEQ ID NO: 181888 - DNA, 20 bp, Artificial Sequence
  Description of Artificial Sequence: Synthetic oligonucleotide
  Target: ATXN1; (-) strand; PAM type: YTN; PAM sequence: TTG
acgccatccttttgacagga

SEQ ID NO: 181889 - DNA, 20 bp, Artificial Sequence
  Description of Artificial Sequence: Synthetic oligonucleotide
  Target: ATXN1; (-) strand; PAM type: YTN; PAM sequence: TTT
gacgccatccttttgacagg

SEQ ID NO: 181890 - DNA, 20 bp, Artificial Sequence
  Description of Artificial Sequence: Synthetic oligonucleotide
  Target: ATXN1; (-) strand; PAM type: YTN; PAM sequence: TTA
aaatacatttgacgccatcc

SEQ ID NO: 181891 - DNA, 20 bp, Artificial Sequence
  Description of Artificial Sequence: Synthetic oligonucleotide
  Target: ATXN1; (-) strand; PAM type: YTN; PAM sequence: CTT
aaaatacatttgacgccatc

SEQ ID NO: 181892 - DNA, 20 bp, Artificial Sequence
  Description of Artificial Sequence: Synthetic oligonucleotide
  Target: ATXN1; (-) strand; PAM type: YTN; PAM sequence: TTA
tgtcgatacttaaaatacat

SEQ ID NO: 181893 - DNA, 20 bp, Artificial Sequence
  Description of Artificial Sequence: Synthetic oligonucleotide
  Target: ATXN1; (-) strand; PAM type: YTN; PAM sequence: TTT
atgtcgatacttaaaataca

SEQ ID NO: 181894 - DNA, 20 bp, Artificial Sequence
  Description of Artificial Sequence: Synthetic oligonucleotide
  Target: ATXN1; (-) strand; PAM type: YTN; PAM sequence: CTA
taagaacaagagggatatga

SEQ ID NO: 181895 - DNA, 20 bp, Artificial Sequence
  Description of Artificial Sequence: Synthetic oligonucleotide
  Target: ATXN1; (-) strand; PAM type: YTN; PAM sequence: TTG
tggtggaatgagacaagaat

SEQ ID NO: 181896 - DNA, 20 bp, Artificial Sequence
  Description of Artificial Sequence: Synthetic oligonucleotide
  Target: ATXN1; (-) strand; PAM type: YTN; PAM sequence: TTG
ttgtggtggaatgagacaag

SEQ ID NO: 181897 - DNA, 20 bp, Artificial Sequence
  Description of Artificial Sequence: Synthetic oligonucleotide
  Target: ATXN1; (-) strand; PAM type: YTN; PAM sequence: CTT
gttgtggtggaatgagacaa

SEQ ID NO: 181898 - DNA, 20 bp, Artificial Sequence
  Description of Artificial Sequence: Synthetic oligonucleotide
  Target: ATXN1; (-) strand; PAM type: YTN; PAM sequence: TTA
taaaacttgttgtggtggaa

SEQ ID NO: 181899 - DNA, 20 bp, Artificial Sequence
  Description of Artificial Sequence: Synthetic oligonucleotide
  Target: ATXN1; (-) strand; PAM type: YTN; PAM sequence: CTA
ttataaaacttgttgtggtg

SEQ ID NO: 181900 - DNA, 20 bp, Artificial Sequence
  Description of Artificial Sequence: Synthetic oligonucleotide
  Target: ATXN1; (-) strand; PAM type: YTN; PAM sequence: CTG
ctattataaaacttgttgtg

SEQ ID NO: 181901 - DNA, 20 bp, Artificial Sequence
  Description of Artificial Sequence: Synthetic oligonucleotide
  Target: ATXN1; (-) strand; PAM type: YTN; PAM sequence: CTA
cctgctattataaaacttgt

SEQ ID NO: 181902 - DNA, 20 bp, Artificial Sequence
  Description of Artificial Sequence: Synthetic oligonucleotide
  Target: ATXN1; (-) strand; PAM type: YTN; PAM sequence: TTC
aaaagataaaagtgataaat

SEQ ID NO: 181903 - DNA, 20 bp, Artificial Sequence
  Description of Artificial Sequence: Synthetic oligonucleotide
  Target: ATXN1; (-) strand; PAM type: YTN; PAM sequence: TTT
caaaagataaaagtgataaa

SEQ ID NO: 181904 - DNA, 20 bp, Artificial Sequence
  Description of Artificial Sequence: Synthetic oligonucleotide
  Target: ATXN1; (-) strand; PAM type: YTN; PAM sequence: TTT
tcaaaagataaaagtgataa

SEQ ID NO: 181905 - DNA, 20 bp, Artificial Sequence
  Description of Artificial Sequence: Synthetic oligonucleotide
  Target: ATXN1; (-) strand; PAM type: YTN; PAM sequence: CTG
taacattttcaaaagataaa

SEQ ID NO: 181906 - DNA, 20 bp, Artificial Sequence
  Description of Artificial Sequence: Synthetic oligonucleotide
  Target: ATXN1; (-) strand; PAM type: YTN; PAM sequence: TTG
tctgtaacattttcaaaaga

SEQ ID NO: 181907 - DNA, 20 bp, Artificial Sequence
  Description of Artificial Sequence: Synthetic oligonucleotide
  Target: ATXN1; (-) strand; PAM type: YTN; PAM sequence: TTA
attgtctgtaacattttcaa

SEQ ID NO: 181908 - DNA, 20 bp, Artificial Sequence
  Description of Artificial Sequence: Synthetic oligonucleotide
  Target: ATXN1; (-) strand; PAM type: YTN; PAM sequence: TTA
atgtgaattaattgtctgta

SEQ ID NO: 181909 - DNA, 20 bp, Artificial Sequence
  Description of Artificial Sequence: Synthetic oligonucleotide
  Target: ATXN1; (-) strand; PAM type: YTN; PAM sequence: TTT
aatgtgaattaattgtctgt

SEQ ID NO: 181910 - DNA, 20 bp, Artificial Sequence
  Description of Artificial Sequence: Synthetic oligonucleotide
  Target: ATXN1; (-) strand; PAM type: YTN; PAM sequence: TTT
taatgtgaattaattgtctg

SEQ ID NO: 181911 - DNA, 20 bp, Artificial Sequence
  Description of Artificial Sequence: Synthetic oligonucleotide
  Target: ATXN1; (-) strand; PAM type: YTN; PAM sequence: TTA
aatcagtaatagagttttaa

SEQ ID NO: 181912 - DNA, 20 bp, Artificial Sequence
  Description of Artificial Sequence: Synthetic oligonucleotide
  Target: ATXN1; (-) strand; PAM type: YTN; PAM sequence: TTT
aaatcagtaatagagtttta

SEQ ID NO: 181913 - DNA, 20 bp, Artificial Sequence
  Description of Artificial Sequence: Synthetic oligonucleotide
  Target: ATXN1; (-) strand; PAM type: YTN; PAM sequence: TTT
taaatcagtaatagagtttt

SEQ ID NO: 181914 - DNA, 20 bp, Artificial Sequence
  Description of Artificial Sequence: Synthetic oligonucleotide
  Target: ATXN1; (-) strand; PAM type: YTN; PAM sequence: CTT
ttaaatcagtaatagagttt

SEQ ID NO: 181915 - DNA, 20 bp, Artificial Sequence
  Description of Artificial Sequence: Synthetic oligonucleotide
  Target: ATXN1; (-) strand; PAM type: YTN; PAM sequence: TTG
aacttttaaatcagtaatag

SEQ ID NO: 181916 - DNA, 20 bp, Artificial Sequence
  Description of Artificial Sequence: Synthetic oligonucleotide
  Target: ATXN1; (-) strand; PAM type: YTN; PAM sequence: CTT
gaacttttaaatcagtaata

SEQ ID NO: 181917 - DNA, 20 bp, Artificial Sequence
  Description of Artificial Sequence: Synthetic oligonucleotide
  Target: ATXN1; (-) strand; PAM type: YTN; PAM sequence: CTA
aatcttgaacttttaaatca

SEQ ID NO: 181918 - DNA, 20 bp, Artificial Sequence
  Description of Artificial Sequence: Synthetic oligonucleotide
  Target: ATXN1; (-) strand; PAM type: YTN; PAM sequence: TTC
taaatcttgaacttttaaat

SEQ ID NO: 181919 - DNA, 20 bp, Artificial Sequence
  Description of Artificial Sequence: Synthetic oligonucleotide
  Target: ATXN1; (-) strand; PAM type: YTN; PAM sequence: TTA
aattctaaatcttgaacttt

SEQ ID NO: 181920 - DNA, 20 bp, Artificial Sequence
  Description of Artificial Sequence: Synthetic oligonucleotide
  Target: ATXN1; (-) strand; PAM type: YTN; PAM sequence: CTT
aaattctaaatcttgaactt

SEQ ID NO: 181921 - DNA, 20 bp, Artificial Sequence
  Description of Artificial Sequence: Synthetic oligonucleotide
  Target: ATXN1; (-) strand; PAM type: YTN; PAM sequence: TTC
atcagaatccttaaattcta

SEQ ID NO: 181922 - DNA, 20 bp, Artificial Sequence
  Description of Artificial Sequence: Synthetic oligonucleotide
  Target: ATXN1; (-) strand; PAM type: YTN; PAM sequence: TTT
catcagaatccttaaattct

SEQ ID NO: 181923 - DNA, 20 bp, Artificial Sequence
  Description of Artificial Sequence: Synthetic oligonucleotide
  Target: ATXN1; (-) strand; PAM type: YTN; PAM sequence: CTT
tcatcagaatccttaaattc

SEQ ID NO: 181924 - DNA, 20 bp, Artificial Sequence
  Description of Artificial Sequence: Synthetic oligonucleotide
  Target: ATXN1; (-) strand; PAM type: YTN; PAM sequence: CTA
aactttcatcagaatcctta

SEQ ID NO: 181925 - DNA, 20 bp, Artificial Sequence
  Description of Artificial Sequence: Synthetic oligonucleotide
  Target: ATXN1; (-) strand; PAM type: YTN; PAM sequence: TTA
cgctaaactttcatcagaat

SEQ ID NO: 181926 - DNA, 20 bp, Artificial Sequence
  Description of Artificial Sequence: Synthetic oligonucleotide
  Target: ATXN1; (-) strand; PAM type: YTN; PAM sequence: TTT
acgctaaactttcatcagaa

SEQ ID NO: 181927 - DNA, 20 bp, Artificial Sequence
  Description of Artificial Sequence: Synthetic oligonucleotide
  Target: ATXN1; (-) strand; PAM type: YTN; PAM sequence: CTA
aagtaggtttacgctaaact

SEQ ID NO: 181928 - DNA, 20 bp, Artificial Sequence
  Description of Artificial Sequence: Synthetic oligonucleotide
  Target: ATXN1; (-) strand; PAM type: YTN; PAM sequence: CTA
gtcagctaaagtaggtttac

SEQ ID NO: 181929 - DNA, 20 bp, Artificial Sequence
  Description of Artificial Sequence: Synthetic oligonucleotide
  Target: ATXN1; (-) strand; PAM type: YTN; PAM sequence: TTA
aaaaatctagtcagctaaag

SEQ ID NO: 181930 - DNA, 20 bp, Artificial Sequence
  Description of Artificial Sequence: Synthetic oligonucleotide
  Target: ATXN1; (-) strand; PAM type: YTN; PAM sequence: TTT
aaaaaatctagtcagctaaa

SEQ ID NO: 181931 - DNA, 20 bp, Artificial Sequence
  Description of Artificial Sequence: Synthetic oligonucleotide
  Target: ATXN1; (-) strand; PAM type: YTN; PAM sequence: TTT
taaaaaatctagtcagctaa

SEQ ID NO: 181932 - DNA, 20 bp, Artificial Sequence
  Description of Artificial Sequence: Synthetic oligonucleotide
  Target: ATXN1; (-) strand; PAM type: YTN; PAM sequence: CTT
ttaaaaaatctagtcagcta

SEQ ID NO: 181933 - DNA, 20 bp, Artificial Sequence
  Description of Artificial Sequence: Synthetic oligonucleotide
  Target: ATXN1; (-) strand; PAM type: YTN; PAM sequence: CTA
aaccttttaaaaaatctagt

SEQ ID NO: 181934 - DNA, 20 bp, Artificial Sequence
  Description of Artificial Sequence: Synthetic oligonucleotide
  Target: ATXN1; (-) strand; PAM type: YTN; PAM sequence: TTC
ctaaaccttttaaaaaatct

SEQ ID NO: 181935 - DNA, 20 bp, Artificial Sequence
  Description of Artificial Sequence: Synthetic oligonucleotide
  Target: ATXN1; (-) strand; PAM type: YTN; PAM sequence: TTA
aaggaggtaaacaattccta

SEQ ID NO: 181936 - DNA, 20 bp, Artificial Sequence
  Description of Artificial Sequence: Synthetic oligonucleotide
  Target: ATXN1; (-) strand; PAM type: YTN; PAM sequence: CTT
aaaggaggtaaacaattcct

SEQ ID NO: 181937 - DNA, 20 bp, Artificial Sequence
  Description of Artificial Sequence: Synthetic oligonucleotide
  Target: ATXN1; (-) strand; PAM type: YTN; PAM sequence: TTA
ataatgcttaaaggaggtaa

SEQ ID NO: 181938 - DNA, 20 bp, Artificial Sequence
  Description of Artificial Sequence: Synthetic oligonucleotide
  Target: ATXN1; (-) strand; PAM type: YTN; PAM sequence: TTT
aataatgcttaaaggaggta

SEQ ID NO: 181939 - DNA, 20 bp, Artificial Sequence
  Description of Artificial Sequence: Synthetic oligonucleotide
  Target: ATXN1; (-) strand; PAM type: YTN; PAM sequence: CTG
gatgcaaatgatggtgataa

SEQ ID NO: 181940 - DNA, 20 bp, Artificial Sequence
  Description of Artificial Sequence: Synthetic oligonucleotide
  Target: ATXN1; (-) strand; PAM type: YTN; PAM sequence: TTG
tctggatgcaaatgatggtg

SEQ ID NO: 181941 - DNA, 20 bp, Artificial Sequence
  Description of Artificial Sequence: Synthetic oligonucleotide
  Target: ATXN1; (-) strand; PAM type: YTN; PAM sequence: CTA
gcatgttgtctggatgcaaa

SEQ ID NO: 181942 - DNA, 20 bp, Artificial Sequence
  Description of Artificial Sequence: Synthetic oligonucleotide
  Target: ATXN1; (-) strand; PAM type: YTN; PAM sequence: TTC
gactagcatgttgtctggat

SEQ ID NO: 181943 - DNA, 20 bp, Artificial Sequence
  Description of Artificial Sequence: Synthetic oligonucleotide
  Target: ATXN1; (-) strand; PAM type: YTN; PAM sequence: TTT
cgactagcatgttgtctgga

SEQ ID NO: 181944 - DNA, 20 bp, Artificial Sequence
  Description of Artificial Sequence: Synthetic oligonucleotide
  Target: ATXN1; (-) strand; PAM type: YTN; PAM sequence: CTT
tcgactagcatgttgtctgg

SEQ ID NO: 181945 - DNA, 20 bp, Artificial Sequence
  Description of Artificial Sequence: Synthetic oligonucleotide
  Target: ATXN1; (-) strand; PAM type: YTN; PAM sequence: CTA
aatcactttcgactagcatg

SEQ ID NO: 181946 - DNA, 20 bp, Artificial Sequence
  Description of Artificial Sequence: Synthetic oligonucleotide
  Target: ATXN1; (-) strand; PAM type: YTN; PAM sequence: TTA
aagactaaatcactttcgac

SEQ ID NO: 181947 - DNA, 20 bp, Artificial Sequence
  Description of Artificial Sequence: Synthetic oligonucleotide
  Target: ATXN1; (-) strand; PAM type: YTN; PAM sequence: TTT
aaagactaaatcactttcga

SEQ ID NO: 181948 - DNA, 20 bp, Artificial Sequence
  Description of Artificial Sequence: Synthetic oligonucleotide
  Target: ATXN1; (-) strand; PAM type: YTN; PAM sequence: CTT
taaagactaaatcactttcg

SEQ ID NO: 181949 - DNA, 20 bp, Artificial Sequence
  Description of Artificial Sequence: Synthetic oligonucleotide
  Target: ATXN1; (-) strand; PAM type: YTN; PAM sequence: TTA
ctttaaagactaaatcactt

SEQ ID NO: 181950 - DNA, 20 bp, Artificial Sequence
  Description of Artificial Sequence: Synthetic oligonucleotide
  Target: ATXN1; (-) strand; PAM type: YTN; PAM sequence: TTA
taaagaattactttaaagac

SEQ ID NO: 181951 - DNA, 20 bp, Artificial Sequence
  Description of Artificial Sequence: Synthetic oligonucleotide
  Target: ATXN1; (-) strand; PAM type: YTN; PAM sequence: TTT
ataaagaattactttaaaga

SEQ ID NO: 181952 - DNA, 20 bp, Artificial Sequence
  Description of Artificial Sequence: Synthetic oligonucleotide
  Target: ATXN1; (-) strand; PAM type: YTN; PAM sequence: TTT
tataaagaattactttaaag

SEQ ID NO: 181953 - DNA, 20 bp, Artificial Sequence
  Description of Artificial Sequence: Synthetic oligonucleotide
  Target: ATXN1; (-) strand; PAM type: YTN; PAM sequence: CTA
ataaaattttataaagaatt

SEQ ID NO: 181954 - DNA, 20 bp, Artificial Sequence
  Description of Artificial Sequence: Synthetic oligonucleotide
  Target: ATXN1; (-) strand; PAM type: YTN; PAM sequence: CTC
cacaccaaatctaataaaat

SEQ ID NO: 181955 - DNA, 20 bp, Artificial Sequence
  Description of Artificial Sequence: Synthetic oligonucleotide
  Target: ATXN1; (-) strand; PAM type: YTN; PAM sequence: TTC
ctccacaccaaatctaataa

SEQ ID NO: 181956 - DNA, 20 bp, Artificial Sequence
  Description of Artificial Sequence: Synthetic oligonucleotide
  Target: ATXN1; (-) strand; PAM type: YTN; PAM sequence: TTT
cctccacaccaaatctaata

SEQ ID NO: 181957 - DNA, 20 bp, Artificial Sequence
  Description of Artificial Sequence: Synthetic oligonucleotide
  Target: ATXN1; (-) strand; PAM type: YTN; PAM sequence: TTT
tcctccacaccaaatctaat

SEQ ID NO: 181958 - DNA, 20 bp, Artificial Sequence
  Description of Artificial Sequence: Synthetic oligonucleotide
  Target: ATXN1; (-) strand; PAM type: YTN; PAM sequence: CTT
ttcctccacaccaaatctaa

SEQ ID NO: 181959 - DNA, 20 bp, Artificial Sequence
  Description of Artificial Sequence: Synthetic oligonucleotide
  Target: ATXN1; (-) strand; PAM type: YTN; PAM sequence: CTC
acgtcaacttttcctccaca

SEQ ID NO: 181960 - DNA, 20 bp, Artificial Sequence
  Description of Artificial Sequence: Synthetic oligonucleotide
  Target: ATXN1; (-) strand; PAM type: YTN; PAM sequence: TTC
tcacgtcaacttttcctcca

SEQ ID NO: 181961 - DNA, 20 bp, Artificial Sequence
  Description of Artificial Sequence: Synthetic oligonucleotide
  Target: ATXN1; (-) strand; PAM type: YTN; PAM sequence: TTT
ctcacgtcaacttttcctcc

SEQ ID NO: 181962 - DNA, 20 bp, Artificial Sequence
  Description of Artificial Sequence: Synthetic oligonucleotide
  Target: ATXN1; (-) strand; PAM type: YTN; PAM sequence: TTT
tctcacgtcaacttttcctc

SEQ ID NO: 181963 - DNA, 20 bp, Artificial Sequence
  Description of Artificial Sequence: Synthetic oligonucleotide
  Target: ATXN1; (-) strand; PAM type: YTN; PAM sequence: TTA
ttttctcacgtcaacttttc

SEQ ID NO: 181964 - DNA, 20 bp, Artificial Sequence
  Description of Artificial Sequence: Synthetic oligonucleotide
  Target: ATXN1; (-) strand; PAM type: YTN; PAM sequence: TTT
attttctcacgtcaactttt

SEQ ID NO: 181965 - DNA, 20 bp, Artificial Sequence
  Description of Artificial Sequence: Synthetic oligonucleotide
  Target: ATXN1; (-) strand; PAM type: YTN; PAM sequence: TTT
tattttctcacgtcaacttt

SEQ ID NO: 181966 - DNA, 20 bp, Artificial Sequence
  Description of Artificial Sequence: Synthetic oligonucleotide
  Target: ATXN1; (-) strand; PAM type: YTN; PAM sequence: TTT
ttattttctcacgtcaactt

SEQ ID NO: 181967 - DNA, 20 bp, Artificial Sequence
  Description of Artificial Sequence: Synthetic oligonucleotide
  Target: ATXN1; (-) strand; PAM type: YTN; PAM sequence: TTT
tttattttctcacgtcaact

SEQ ID NO: 181968 - DNA, 20 bp, Artificial Sequence
  Description of Artificial Sequence: Synthetic oligonucleotide
  Target: ATXN1; (-) strand; PAM type: YTN; PAM sequence: TTT
ttttattttctcacgtcaac

SEQ ID NO: 181969 - DNA, 20 bp, Artificial Sequence
  Description of Artificial Sequence: Synthetic oligonucleotide
  Target: ATXN1; (-) strand; PAM type: YTN; PAM sequence: TTG
aacccagtttttttattttc

SEQ ID NO: 181970 - DNA, 20 bp, Artificial Sequence
  Description of Artificial Sequence: Synthetic oligonucleotide
  Target: ATXN1; (-) strand; PAM type: YTN; PAM sequence: CTT
gaacccagtttttttatttt

SEQ ID NO: 181971 - DNA, 20 bp, Artificial Sequence
  Description of Artificial Sequence: Synthetic oligonucleotide
  Target: ATXN1; (-) strand; PAM type: YTN; PAM sequence: TTA
cacaagtgaaacacaccaaa

SEQ ID NO: 181972 - DNA, 20 bp, Artificial Sequence
  Description of Artificial Sequence: Synthetic oligonucleotide
  Target: ATXN1; (-) strand; PAM type: YTN; PAM sequence: TTA
tgtaagattacacaagtgaa

SEQ ID NO: 181973 - DNA, 20 bp, Artificial Sequence
  Description of Artificial Sequence: Synthetic oligonucleotide
  Target: ATXN1; (-) strand; PAM type: YTN; PAM sequence: CTG
agaaaagtaacatgattatg

SEQ ID NO: 181974 - DNA, 20 bp, Artificial Sequence
  Description of Artificial Sequence: Synthetic oligonucleotide
  Target: ATXN1; (-) strand; PAM type: YTN; PAM sequence: CTG
atgctgagaaaagtaacatg

SEQ ID NO: 181975 - DNA, 20 bp, Artificial Sequence
  Description of Artificial Sequence: Synthetic oligonucleotide
  Target: ATXN1; (-) strand; PAM type: YTN; PAM sequence: CTA
tcaatgatgagactgatgct

SEQ ID NO: 181976 - DNA, 20 bp, Artificial Sequence
  Description of Artificial Sequence: Synthetic oligonucleotide
  Target: ATXN1; (-) strand; PAM type: YTN; PAM sequence: CTC
tatcaatgatgagactgatg

SEQ ID NO: 181977 - DNA, 20 bp, Artificial Sequence
  Description of Artificial Sequence: Synthetic oligonucleotide
  Target: ATXN1; (-) strand; PAM type: YTN; PAM sequence: CTG
agagtgtaccccctctatca

SEQ ID NO: 181978 - DNA, 20 bp, Artificial Sequence
  Description of Artificial Sequence: Synthetic oligonucleotide
  Target: ATXN1; (-) strand; PAM type: YTN; PAM sequence: CTC
ggcatcccaaagtgctgaga

SEQ ID NO: 181979 - DNA, 20 bp, Artificial Sequence
  Description of Artificial Sequence: Synthetic oligonucleotide
  Target: ATXN1; (-) strand; PAM type: YTN; PAM sequence: TTG
tgatccacccgcctcggcat

SEQ ID NO: 181980 - DNA, 20 bp, Artificial Sequence
  Description of Artificial Sequence: Synthetic oligonucleotide
  Target: ATXN1; (-) strand; PAM type: YTN; PAM sequence: CTT
gtgatccacccgcctcggca

SEQ ID NO: 181981 - DNA, 20 bp, Artificial Sequence
  Description of Artificial Sequence: Synthetic oligonucleotide
  Target: ATXN1; (-) strand; PAM type: YTN; PAM sequence: CTG
accttgtgatccacccgcct

SEQ ID NO: 181982 - DNA, 20 bp, Artificial Sequence
  Description of Artificial Sequence: Synthetic oligonucleotide
  Target: ATXN1; (-) strand; PAM type: YTN; PAM sequence: CTC
ctgaccttgtgatccacccg

SEQ ID NO: 181983 - DNA, 20 bp, Artificial Sequence
  Description of Artificial Sequence: Synthetic oligonucleotide
  Target: ATXN1; (-) strand; PAM type: YTN; PAM sequence: CTC
gatctcctgaccttgtgatc

SEQ ID NO: 181984 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 181985 - DNA, 20 bp, Artificial Sequence
  Description of Artificial Sequence: Synthetic oligonucleotide
  Target: ATXN1; (-) strand; PAM type: YTN; PAM sequence: TTC
accgtgttagccaggatggt

SEQ ID NO: 181986 - DNA, 20 bp, Artificial Sequence
  Description of Artificial Sequence: Synthetic oligonucleotide
  Target: ATXN1; (-) strand; PAM type: YTN; PAM sequence: TTT
caccgtgttagccaggatgg

SEQ ID NO: 181987 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcaccg

SEQ ID NO: 181988 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcacc

SEQ ID NO: 181989 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 181990 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 181991 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 181992 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 181993 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 181994 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 181995 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 181996 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttttagtagaga

SEQ ID NO: 181997 - DNA, 20 bp, Artificial Sequence
  Description of Artificial Sequence: Synthetic oligonucleotide
  Target: ATXN1; (-) strand; PAM type: YTN; PAM sequence: CTA
atttttttgtatttttagta

SEQ ID NO: 181998 - DNA, 20 bp, Artificial Sequence
  Description of Artificial Sequence: Synthetic oligonucleotide
  Target: ATXN1; (-) strand; PAM type: YTN; PAM sequence: CTA
cgcccagctaatttttttgt

SEQ ID NO: 181999 - DNA, 20 bp, Artificial Sequence
  Description of Artificial Sequence: Synthetic oligonucleotide
  Target: ATXN1; (-) strand; PAM type: YTN; PAM sequence: CTG
ccactacgcccagctaattt

SEQ ID NO: 182000 - DNA, 20 bp, Artificial Sequence
  Description of Artificial Sequence: Synthetic oligonucleotide
  Target: ATXN1; (-) strand; PAM type: YTN; PAM sequence: CTA
caggcacctgccactacgcc

SEQ ID NO: 182001 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcacctgccac

SEQ ID NO: 182002 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactacaggca

SEQ ID NO: 182003 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggactacag

SEQ ID NO: 182004 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 182005 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 182006 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 182007 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 182008 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 182009 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagcgattctcc

SEQ ID NO: 182010 - DNA, 20 bp, Artificial Sequence
  Description of Artificial Sequence: Synthetic oligonucleotide
  Target: ATXN1; (-) strand; PAM type: YTN; PAM sequence: CTG
cctcccgggttcaagcgatt

SEQ ID NO: 182011 - DNA, 20 bp, Artificial Sequence
  Description of Artificial Sequence: Synthetic oligonucleotide
  Target: ATXN1; (-) strand; PAM type: YTN; PAM sequence: CTC
tgcctcccgggttcaagcga

SEQ ID NO: 182012 - DNA, 20 bp, Artificial Sequence
  Description of Artificial Sequence: Synthetic oligonucleotide
  Target: ATXN1; (-) strand; PAM type: YTN; PAM sequence: TTC
aacctctgcctcccgggttc

SEQ ID NO: 182013 - DNA, 20 bp, Artificial Sequence
  Description of Artificial Sequence: Synthetic oligonucleotide
  Target: ATXN1; (-) strand; PAM type: YTN; PAM sequence: CTT
caacctctgcctcccgggtt

SEQ ID NO: 182014 - DNA, 20 bp, Artificial Sequence
  Description of Artificial Sequence: Synthetic oligonucleotide
  Target: ATXN1; (-) strand; PAM type: YTN; PAM sequence: CTC
acttcaacctctgcctcccg

SEQ ID NO: 182015 - DNA, 20 bp, Artificial Sequence
  Description of Artificial Sequence: Synthetic oligonucleotide
  Target: ATXN1; (-) strand; PAM type: YTN; PAM sequence: TTG
gctcacttcaacctctgcct

SEQ ID NO: 182016 - DNA, 20 bp, Artificial Sequence
  Description of Artificial Sequence: Synthetic oligonucleotide
  Target: ATXN1; (-) strand; PAM type: YTN; PAM sequence: CTT
ggctcacttcaacctctgcc

SEQ ID NO: 182017 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgcaatctt

SEQ ID NO: 182018 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 182019 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtgc

SEQ ID NO: 182020 - DNA, 20 bp, Artificial Sequence
  Description of Artificial Sequence: Synthetic oligonucleotide
  Target: ATXN1; (-) strand; PAM type: YTN; PAM sequence: CTC
actctgtcgcccaggctgga

SEQ ID NO: 182021 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcactctgtc

SEQ ID NO: 182022 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcactctgt

SEQ ID NO: 182023 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcactctg

SEQ ID NO: 182024 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcactct

SEQ ID NO: 182025 - DNA, 20 bp, Artificial Sequence
  Description of Artificial Sequence: Synthetic oligonucleotide
  Target: ATXN1; (-) strand; PAM type: YTN; PAM sequence: TTA
tttttgagacggagtctcac

SEQ ID NO: 182026 - DNA, 20 bp, Artificial Sequence
  Description of Artificial Sequence: Synthetic oligonucleotide
  Target: ATXN1; (-) strand; PAM type: YTN; PAM sequence: TTT
atttttgagacggagtctca

SEQ ID NO: 182027 - DNA, 20 bp, Artificial Sequence
  Description of Artificial Sequence: Synthetic oligonucleotide
  Target: ATXN1; (-) strand; PAM type: YTN; PAM sequence: TTT
tatttttgagacggagtctc

SEQ ID NO: 182028 - DNA, 20 bp, Artificial Sequence
  Description of Artificial Sequence: Synthetic oligonucleotide
  Target: ATXN1; (-) strand; PAM type: YTN; PAM sequence: TTA
ttttatttttgagacggagt

SEQ ID NO: 182029 - DNA, 20 bp, Artificial Sequence
  Description of Artificial Sequence: Synthetic oligonucleotide
  Target: ATXN1; (-) strand; PAM type: YTN; PAM sequence: TTT
attttatttttgagacggag

SEQ ID NO: 182030 - DNA, 20 bp, Artificial Sequence
  Description of Artificial Sequence: Synthetic oligonucleotide
  Target: ATXN1; (-) strand; PAM type: YTN; PAM sequence: TTT
tattttatttttgagacgga

SEQ ID NO: 182031 - DNA, 20 bp, Artificial Sequence
  Description of Artificial Sequence: Synthetic oligonucleotide
  Target: ATXN1; (-) strand; PAM type: YTN; PAM sequence: TTA
ttttattttatttttgagac

SEQ ID NO: 182032 - DNA, 20 bp, Artificial Sequence
  Description of Artificial Sequence: Synthetic oligonucleotide
  Target: ATXN1; (-) strand; PAM type: YTN; PAM sequence: TTT
attttattttatttttgaga

SEQ ID NO: 182033 - DNA, 20 bp, Artificial Sequence
  Description of Artificial Sequence: Synthetic oligonucleotide
  Target: ATXN1; (-) strand; PAM type: YTN; PAM sequence: CTT
tattttattttatttttgag

SEQ ID NO: 182034 - DNA, 20 bp, Artificial Sequence
  Description of Artificial Sequence: Synthetic oligonucleotide
  Target: ATXN1; (-) strand; PAM type: YTN; PAM sequence: CTC
tttattttattttatttttg

SEQ ID NO: 182035 - DNA, 20 bp, Artificial Sequence
  Description of Artificial Sequence: Synthetic oligonucleotide
  Target: ATXN1; (-) strand; PAM type: YTN; PAM sequence: TTA
ccccctctttattttatttt

SEQ ID NO: 182036 - DNA, 20 bp, Artificial Sequence
  Description of Artificial Sequence: Synthetic oligonucleotide
  Target: ATXN1; (-) strand; PAM type: YTN; PAM sequence: TTT
accccctctttattttattt

SEQ ID NO: 182037 - DNA, 20 bp, Artificial Sequence
  Description of Artificial Sequence: Synthetic oligonucleotide
  Target: ATXN1; (-) strand; PAM type: YTN; PAM sequence: TTT
taccccctctttattttatt

SEQ ID NO: 182038 - DNA, 20 bp, Artificial Sequence
  Description of Artificial Sequence: Synthetic oligonucleotide
  Target: ATXN1; (-) strand; PAM type: YTN; PAM sequence: TTT
ttaccccctctttattttat

SEQ ID NO: 182039 - DNA, 20 bp, Artificial Sequence
  Description of Artificial Sequence: Synthetic oligonucleotide
  Target: ATXN1; (-) strand; PAM type: YTN; PAM sequence: TTT
tttaccccctctttatttta

SEQ ID NO: 182040 - DNA, 20 bp, Artificial Sequence
  Description of Artificial Sequence: Synthetic oligonucleotide
  Target: ATXN1; (-) strand; PAM type: YTN; PAM sequence: TTA
tggttttttaccccctcttt

SEQ ID NO: 182041 - DNA, 20 bp, Artificial Sequence
  Description of Artificial Sequence: Synthetic oligonucleotide
  Target: ATXN1; (-) strand; PAM type: YTN; PAM sequence: TTA
gacaattatggttttttacc

SEQ ID NO: 182042 - DNA, 20 bp, Artificial Sequence
  Description of Artificial Sequence: Synthetic oligonucleotide
  Target: ATXN1; (-) strand; PAM type: YTN; PAM sequence: CTT
agacaattatggttttttac

SEQ ID NO: 182043 - DNA, 20 bp, Artificial Sequence
  Description of Artificial Sequence: Synthetic oligonucleotide
  Target: ATXN1; (-) strand; PAM type: YTN; PAM sequence: TTC
ttagacaattatggtttttt

SEQ ID NO: 182044 - DNA, 20 bp, Artificial Sequence
  Description of Artificial Sequence: Synthetic oligonucleotide
  Target: ATXN1; (-) strand; PAM type: YTN; PAM sequence: CTC
agagcaattcttagacaatt

SEQ ID NO: 182045 - DNA, 20 bp, Artificial Sequence
  Description of Artificial Sequence: Synthetic oligonucleotide
  Target: ATXN1; (-) strand; PAM type: YTN; PAM sequence: CTG
atgtaatcctcagagcaatt

SEQ ID NO: 182046 - DNA, 20 bp, Artificial Sequence
  Description of Artificial Sequence: Synthetic oligonucleotide
  Target: ATXN1; (-) strand; PAM type: YTN; PAM sequence: TTA
cactgatgtaatcctcagag

SEQ ID NO: 182047 - DNA, 20 bp, Artificial Sequence
  Description of Artificial Sequence: Synthetic oligonucleotide
  Target: ATXN1; (-) strand; PAM type: YTN; PAM sequence: CTT
acactgatgtaatcctcaga

SEQ ID NO: 182048 - DNA, 20 bp, Artificial Sequence
  Description of Artificial Sequence: Synthetic oligonucleotide
  Target: ATXN1; (-) strand; PAM type: YTN; PAM sequence: TTA
ccttacactgatgtaatcct

SEQ ID NO: 182049 - DNA, 20 bp, Artificial Sequence
  Description of Artificial Sequence: Synthetic oligonucleotide
  Target: ATXN1; (-) strand; PAM type: YTN; PAM sequence: TTC
attaccttacactgatgtaa

SEQ ID NO: 182050 - DNA, 20 bp, Artificial Sequence
  Description of Artificial Sequence: Synthetic oligonucleotide
  Target: ATXN1; (-) strand; PAM type: YTN; PAM sequence: TTC
agtaaagttcattaccttac

SEQ ID NO: 182051 - DNA, 20 bp, Artificial Sequence
  Description of Artificial Sequence: Synthetic oligonucleotide
  Target: ATXN1; (-) strand; PAM type: YTN; PAM sequence: TTT
cagtaaagttcattacctta

SEQ ID NO: 182052 - DNA, 20 bp, Artificial Sequence
  Description of Artificial Sequence: Synthetic oligonucleotide
  Target: ATXN1; (-) strand; PAM type: YTN; PAM sequence: TTG
catacatttcagtaaagttc

SEQ ID NO: 182053 - DNA, 20 bp, Artificial Sequence
  Description of Artificial Sequence: Synthetic oligonucleotide
  Target: ATXN1; (-) strand; PAM type: YTN; PAM sequence: TTT
gcatacatttcagtaaagtt

SEQ ID NO: 182054 - DNA, 20 bp, Artificial Sequence
  Description of Artificial Sequence: Synthetic oligonucleotide
  Target: ATXN1; (-) strand; PAM type: YTN; PAM sequence: TTT
tgcatacatttcagtaaagt

SEQ ID NO: 182055 - DNA, 20 bp, Artificial Sequence
  Description of Artificial Sequence: Synthetic oligonucleotide
  Target: ATXN1; (-) strand; PAM type: YTN; PAM sequence: TTT
ttgcatacatttcagtaaag

SEQ ID NO: 182056 - DNA, 20 bp, Artificial Sequence
  Description of Artificial Sequence: Synthetic oligonucleotide
  Target: ATXN1; (-) strand; PAM type: YTN; PAM sequence: TTT
tttgcatacatttcagtaaa

SEQ ID NO: 182057 - DNA, 20 bp, Artificial Sequence
  Description of Artificial Sequence: Synthetic oligonucleotide
  Target: ATXN1; (-) strand; PAM type: YTN; PAM sequence: TTA
aagtatcaggtgaagatgat

SEQ ID NO: 182058 - DNA, 20 bp, Artificial Sequence
  Description of Artificial Sequence: Synthetic oligonucleotide
  Target: ATXN1; (-) strand; PAM type: YTN; PAM sequence: TTT
aaagtatcaggtgaagatga

SEQ ID NO: 182059 - DNA, 20 bp, Artificial Sequence
  Description of Artificial Sequence: Synthetic oligonucleotide
  Target: ATXN1; (-) strand; PAM type: YTN; PAM sequence: TTT
taaagtatcaggtgaagatg

SEQ ID NO: 182060 - DNA, 20 bp, Artificial Sequence
  Description of Artificial Sequence: Synthetic oligonucleotide
  Target: ATXN1; (-) strand; PAM type: YTN; PAM sequence: TTT
ttaaagtatcaggtgaagat

SEQ ID NO: 182061 - DNA, 20 bp, Artificial Sequence
  Description of Artificial Sequence: Synthetic oligonucleotide
  Target: ATXN1; (-) strand; PAM type: YTN; PAM sequence: TTG
aagtttttaaagtatcaggt

SEQ ID NO: 182062 - DNA, 20 bp, Artificial Sequence
  Description of Artificial Sequence: Synthetic oligonucleotide
  Target: ATXN1; (-) strand; PAM type: YTN; PAM sequence: TTT
gaagtttttaaagtatcagg

SEQ ID NO: 182063 - DNA, 20 bp, Artificial Sequence
  Description of Artificial Sequence: Synthetic oligonucleotide
  Target: ATXN1; (-) strand; PAM type: YTN; PAM sequence: TTC
atttgaagtttttaaagtat

SEQ ID NO: 182064 - DNA, 20 bp, Artificial Sequence
  Description of Artificial Sequence: Synthetic oligonucleotide
  Target: ATXN1; (-) strand; PAM type: YTN; PAM sequence: TTT
catttgaagtttttaaagta

SEQ ID NO: 182065 - DNA, 20 bp, Artificial Sequence
  Description of Artificial Sequence: Synthetic oligonucleotide
  Target: ATXN1; (-) strand; PAM type: YTN; PAM sequence: CTT
tcatttgaagtttttaaagt

SEQ ID NO: 182066 - DNA, 20 bp, Artificial Sequence
  Description of Artificial Sequence: Synthetic oligonucleotide
  Target: ATXN1; (-) strand; PAM type: YTN; PAM sequence: CTC
tttcatttgaagtttttaaa

SEQ ID NO: 182067 - DNA, 20 bp, Artificial Sequence
  Description of Artificial Sequence: Synthetic oligonucleotide
  Target: ATXN1; (-) strand; PAM type: YTN; PAM sequence: TTA
ccctctttcatttgaagttt

SEQ ID NO: 182068 - DNA, 20 bp, Artificial Sequence
  Description of Artificial Sequence: Synthetic oligonucleotide
  Target: ATXN1; (-) strand; PAM type: YTN; PAM sequence: CTT
accctctttcatttgaagtt

SEQ ID NO: 182069 - DNA, 20 bp, Artificial Sequence
  Description of Artificial Sequence: Synthetic oligonucleotide
  Target: ATXN1; (-) strand; PAM type: YTN; PAM sequence: TTC
ttaccctctttcatttgaag

SEQ ID NO: 182070 - DNA, 20 bp, Artificial Sequence
  Description of Artificial Sequence: Synthetic oligonucleotide
  Target: ATXN1; (-) strand; PAM type: YTN; PAM sequence: TTT
cttaccctctttcatttgaa

SEQ ID NO: 182071 - DNA, 20 bp, Artificial Sequence
  Description of Artificial Sequence: Synthetic oligonucleotide
  Target: ATXN1; (-) strand; PAM type: YTN; PAM sequence: CTT
tcttaccctctttcatttga

SEQ ID NO: 182072 - DNA, 20 bp, Artificial Sequence
  Description of Artificial Sequence: Synthetic oligonucleotide
  Target: ATXN1; (-) strand; PAM type: YTN; PAM sequence: TTC
tttcttaccctctttcattt

SEQ ID NO: 182073 - DNA, 20 bp, Artificial Sequence
  Description of Artificial Sequence: Synthetic oligonucleotide
  Target: ATXN1; (-) strand; PAM type: YTN; PAM sequence: CTG
tagcacaatgccaggtacag

SEQ ID NO: 182074 - DNA, 20 bp, Artificial Sequence
  Description of Artificial Sequence: Synthetic oligonucleotide
  Target: ATXN1; (-) strand; PAM type: YTN; PAM sequence: CTA
aaagtgacatatgcacaacc

SEQ ID NO: 182075 - DNA, 20 bp, Artificial Sequence
  Description of Artificial Sequence: Synthetic oligonucleotide
  Target: ATXN1; (-) strand; PAM type: YTN; PAM sequence: TTG
taacctaaaagtgacatatg

SEQ ID NO: 182076 - DNA, 20 bp, Artificial Sequence
  Description of Artificial Sequence: Synthetic oligonucleotide
  Target: ATXN1; (-) strand; PAM type: YTN; PAM sequence: TTG
ttgtaacctaaaagtgacat

SEQ ID NO: 182077 - DNA, 20 bp, Artificial Sequence
  Description of Artificial Sequence: Synthetic oligonucleotide
  Target: ATXN1; (-) strand; PAM type: YTN; PAM sequence: CTG
ttgttgtaacctaaaagtga

SEQ ID NO: 182078 - DNA, 20 bp, Artificial Sequence
  Description of Artificial Sequence: Synthetic oligonucleotide
  Target: ATXN1; (-) strand; PAM type: YTN; PAM sequence: TTG
ggctgttgttgtaacctaaa

SEQ ID NO: 182079 - DNA, 20 bp, Artificial Sequence
  Description of Artificial Sequence: Synthetic oligonucleotide
  Target: ATXN1; (-) strand; PAM type: YTN; PAM sequence: TTA
tgtgtagacagttgggctgt

SEQ ID NO: 182080 - DNA, 20 bp, Artificial Sequence
  Description of Artificial Sequence: Synthetic oligonucleotide
  Target: ATXN1; (-) strand; PAM type: YTN; PAM sequence: TTT
atgtgtagacagttgggctg

SEQ ID NO: 182081 - DNA, 20 bp, Artificial Sequence
  Description of Artificial Sequence: Synthetic oligonucleotide
  Target: ATXN1; (-) strand; PAM type: YTN; PAM sequence: CTA
tacagcagatataaatttat

SEQ ID NO: 182082 - DNA, 20 bp, Artificial Sequence
  Description of Artificial Sequence: Synthetic oligonucleotide
  Target: ATXN1; (-) strand; PAM type: YTN; PAM sequence: TTC
ctatacagcagatataaatt

SEQ ID NO: 182083 - DNA, 20 bp, Artificial Sequence
  Description of Artificial Sequence: Synthetic oligonucleotide
  Target: ATXN1; (-) strand; PAM type: YTN; PAM sequence: TTA
ttcctatacagcagatataa

SEQ ID NO: 182084 - DNA, 20 bp, Artificial Sequence
  Description of Artificial Sequence: Synthetic oligonucleotide
  Target: ATXN1; (-) strand; PAM type: YTN; PAM sequence: TTT
attcctatacagcagatata

SEQ ID NO: 182085 - DNA, 20 bp, Artificial Sequence
  Description of Artificial Sequence: Synthetic oligonucleotide
  Target: ATXN1; (-) strand; PAM type: YTN; PAM sequence: TTA
gaaatatagtttattcctat

SEQ ID NO: 182086 - DNA, 20 bp, Artificial Sequence
  Description of Artificial Sequence: Synthetic oligonucleotide
  Target: ATXN1; (-) strand; PAM type: YTN; PAM sequence: TTC
cagaattagaaatatagttt

SEQ ID NO: 182087 - DNA, 20 bp, Artificial Sequence
  Description of Artificial Sequence: Synthetic oligonucleotide
  Target: ATXN1; (-) strand; PAM type: YTN; PAM sequence: TTT
ccagaattagaaatatagtt

SEQ ID NO: 182088 - DNA, 20 bp, Artificial Sequence
  Description of Artificial Sequence: Synthetic oligonucleotide
  Target: ATXN1; (-) strand; PAM type: YTN; PAM sequence: TTT
tccagaattagaaatatagt

SEQ ID NO: 182089 - DNA, 20 bp, Artificial Sequence
  Description of Artificial Sequence: Synthetic oligonucleotide
  Target: ATXN1; (-) strand; PAM type: YTN; PAM sequence: CTC
attttccagaattagaaata

SEQ ID NO: 182090 - DNA, 20 bp, Artificial Sequence
  Description of Artificial Sequence: Synthetic oligonucleotide
  Target: ATXN1; (-) strand; PAM type: YTN; PAM sequence: CTG
cacctcattttccagaatta

SEQ ID NO: 182091 - DNA, 20 bp, Artificial Sequence
  Description of Artificial Sequence: Synthetic oligonucleotide
  Target: ATXN1; (-) strand; PAM type: YTN; PAM sequence: CTC
tgcacctcattttccagaat

SEQ ID NO: 182092 - DNA, 20 bp, Artificial Sequence
  Description of Artificial Sequence: Synthetic oligonucleotide
  Target: ATXN1; (-) strand; PAM type: YTN; PAM sequence: CTC
tctgcacctcattttccaga

SEQ ID NO: 182093 - DNA, 20 bp, Artificial Sequence
  Description of Artificial Sequence: Synthetic oligonucleotide
  Target: ATXN1; (-) strand; PAM type: YTN; PAM sequence: TTA
atcctctctgcacctcattt

SEQ ID NO: 182094 - DNA, 20 bp, Artificial Sequence
  Description of Artificial Sequence: Synthetic oligonucleotide
  Target: ATXN1; (-) strand; PAM type: YTN; PAM sequence: CTT
aatcctctctgcacctcatt

SEQ ID NO: 182095 - DNA, 20 bp, Artificial Sequence
  Description of Artificial Sequence: Synthetic oligonucleotide
  Target: ATXN1; (-) strand; PAM type: YTN; PAM sequence: TTA
cttaatcctctctgcacctc

SEQ ID NO: 182096 - DNA, 20 bp, Artificial Sequence
  Description of Artificial Sequence: Synthetic oligonucleotide
  Target: ATXN1; (-) strand; PAM type: YTN; PAM sequence: TTC
aagcatgttacttaatcctc

SEQ ID NO: 182097 - DNA, 20 bp, Artificial Sequence
  Description of Artificial Sequence: Synthetic oligonucleotide
  Target: ATXN1; (-) strand; PAM type: YTN; PAM sequence: TTG
aattcaagcatgttacttaa

SEQ ID NO: 182098 - DNA, 20 bp, Artificial Sequence
  Description of Artificial Sequence: Synthetic oligonucleotide
  Target: ATXN1; (-) strand; PAM type: YTN; PAM sequence: CTT
gaattcaagcatgttactta

SEQ ID NO: 182099 - DNA, 20 bp, Artificial Sequence
  Description of Artificial Sequence: Synthetic oligonucleotide
  Target: ATXN1; (-) strand; PAM type: YTN; PAM sequence: TTG
aagcatacttgaattcaagc

SEQ ID NO: 182100 - DNA, 20 bp, Artificial Sequence
  Description of Artificial Sequence: Synthetic oligonucleotide
  Target: ATXN1; (-) strand; PAM type: YTN; PAM sequence: TTA
ttgaagcatacttgaattca

SEQ ID NO: 182101 - DNA, 20 bp, Artificial Sequence
  Description of Artificial Sequence: Synthetic oligonucleotide
  Target: ATXN1; (-) strand; PAM type: YTN; PAM sequence: TTA
attattgaagcatacttgaa

SEQ ID NO: 182102 - DNA, 20 bp, Artificial Sequence
  Description of Artificial Sequence: Synthetic oligonucleotide
  Target: ATXN1; (-) strand; PAM type: YTN; PAM sequence: TTT
aattattgaagcatacttga

SEQ ID NO: 182103 - DNA, 20 bp, Artificial Sequence
  Description of Artificial Sequence: Synthetic oligonucleotide
  Target: ATXN1; (-) strand; PAM type: YTN; PAM sequence: TTC
gatttaattattgaagcata

SEQ ID NO: 182104 - DNA, 20 bp, Artificial Sequence
  Description of Artificial Sequence: Synthetic oligonucleotide
  Target: ATXN1; (-) strand; PAM type: YTN; PAM sequence: CTT
cgatttaattattgaagcat

SEQ ID NO: 182105 - DNA, 20 bp, Artificial Sequence
  Description of Artificial Sequence: Synthetic oligonucleotide
  Target: ATXN1; (-) strand; PAM type: YTN; PAM sequence: CTC
gcccagcttcgatttaatta

SEQ ID NO: 182106 - DNA, 20 bp, Artificial Sequence
  Description of Artificial Sequence: Synthetic oligonucleotide
  Target: ATXN1; (-) strand; PAM type: YTN; PAM sequence: TTA
caagtgtgagccatctcgcc

SEQ ID NO: 182107 - DNA, 20 bp, Artificial Sequence
  Description of Artificial Sequence: Synthetic oligonucleotide
  Target: ATXN1; (-) strand; PAM type: YTN; PAM sequence: CTG
ggattacaagtgtgagccat

SEQ ID NO: 182108 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacaa

SEQ ID NO: 182109 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 182110 - DNA, 20 bp, Artificial Sequence
  Description of Artificial Sequence: Synthetic oligonucleotide
  Target: ATXN1; (-) strand; PAM type: YTN; PAM sequence: CTG
actcagcctcccaaagtgct

SEQ ID NO: 182111 - DNA, 20 bp, Artificial Sequence
  Description of Artificial Sequence: Synthetic oligonucleotide
  Target: ATXN1; (-) strand; PAM type: YTN; PAM sequence: CTC
aagtgatccgcctgactcag

SEQ ID NO: 182112 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatccgcctga

SEQ ID NO: 182113 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatccgcc

SEQ ID NO: 182114 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaagtgat

SEQ ID NO: 182115 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaagtga

SEQ ID NO: 182116 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 182117 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactc

SEQ ID NO: 182118 - DNA, 20 bp, Artificial Sequence
  Description of Artificial Sequence: Synthetic oligonucleotide
  Target: ATXN1; (-) strand; PAM type: YTN; PAM sequence: TTG
ccatgttggccaggctggtc

SEQ ID NO: 182119 - DNA, 20 bp, Artificial Sequence
  Description of Artificial Sequence: Synthetic oligonucleotide
  Target: ATXN1; (-) strand; PAM type: YTN; PAM sequence: TTT
gccatgttggccaggctggt

SEQ ID NO: 182120 - DNA, 20 bp, Artificial Sequence
  Description of Artificial Sequence: Synthetic oligonucleotide
  Target: ATXN1; (-) strand; PAM type: YTN; PAM sequence: TTT
tgccatgttggccaggctgg

SEQ ID NO: 182121 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggttttgcca

SEQ ID NO: 182122 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggttttgcc

SEQ ID NO: 182123 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggttttgc

SEQ ID NO: 182124 - DNA, 20 bp, Artificial Sequence
  Description of Artificial Sequence: Synthetic oligonucleotide
  Target: ATXN1; (-) strand; PAM type: YTN; PAM sequence: TTG
tagttttagtagagacgggg

SEQ ID NO: 182125 - DNA, 20 bp, Artificial Sequence
  Description of Artificial Sequence: Synthetic oligonucleotide
  Target: ATXN1; (-) strand; PAM type: YTN; PAM sequence: TTT
gtagttttagtagagacggg

SEQ ID NO: 182126 - DNA, 20 bp, Artificial Sequence
  Description of Artificial Sequence: Synthetic oligonucleotide
  Target: ATXN1; (-) strand; PAM type: YTN; PAM sequence: TTT
tgtagttttagtagagacgg

SEQ ID NO: 182127 - DNA, 20 bp, Artificial Sequence
  Description of Artificial Sequence: Synthetic oligonucleotide
  Target: ATXN1; (-) strand; PAM type: YTN; PAM sequence: TTT
ttgtagttttagtagagacg

SEQ ID NO: 182128 - DNA, 20 bp, Artificial Sequence
  Description of Artificial Sequence: Synthetic oligonucleotide
  Target: ATXN1; (-) strand; PAM type: YTN; PAM sequence: TTT
tttgtagttttagtagagac

SEQ ID NO: 182129 - DNA, 20 bp, Artificial Sequence
  Description of Artificial Sequence: Synthetic oligonucleotide
  Target: ATXN1; (-) strand; PAM type: YTN; PAM sequence: CTT
ttttgtagttttagtagaga

SEQ ID NO: 182130 - DNA, 20 bp, Artificial Sequence
  Description of Artificial Sequence: Synthetic oligonucleotide
  Target: ATXN1; (-) strand; PAM type: YTN; PAM sequence: CTA
accttttttgtagttttagt

SEQ ID NO: 182131 - DNA, 20 bp, Artificial Sequence
  Description of Artificial Sequence: Synthetic oligonucleotide
  Target: ATXN1; (-) strand; PAM type: YTN; PAM sequence: CTG
gctaaccttttttgtagttt

SEQ ID NO: 182132 - DNA, 20 bp, Artificial Sequence
  Description of Artificial Sequence: Synthetic oligonucleotide
  Target: ATXN1; (-) strand; PAM type: YTN; PAM sequence: TTA
caggcacgtgccaccatgcc

SEQ ID NO: 182133 - DNA, 20 bp, Artificial Sequence
  Description of Artificial Sequence: Synthetic oligonucleotide
  Target: ATXN1; (-) strand; PAM type: YTN; PAM sequence: CTG
gaattacaggcacgtgccac

SEQ ID NO: 182134 - DNA, 20 bp, Artificial Sequence
  Description of Artificial Sequence: Synthetic oligonucleotide
  Target: ATXN1; (-) strand; PAM type: YTN; PAM sequence: CTG
agtagctggaattacaggca

SEQ ID NO: 182135 - DNA, 20 bp, Artificial Sequence
  Description of Artificial Sequence: Synthetic oligonucleotide
  Target: ATXN1; (-) strand; PAM type: YTN; PAM sequence: TTG
tctgagtagctggaattaca

SEQ ID NO: 182136 - DNA, 20 bp, Artificial Sequence
  Description of Artificial Sequence: Synthetic oligonucleotide
  Target: ATXN1; (-) strand; PAM type: YTN; PAM sequence: TTC
aagcgattgtctgagtagct

SEQ ID NO: 182137 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattgtctgag

SEQ ID NO: 182138 - DNA, 20 bp, Artificial Sequence
  Description of Artificial Sequence: Synthetic oligonucleotide
  Target: ATXN1; (-) strand; PAM type: YTN; PAM sequence: TTC
ctgggttcaagcgattgtct

SEQ ID NO: 182139 - DNA, 20 bp, Artificial Sequence
  Description of Artificial Sequence: Synthetic oligonucleotide
  Target: ATXN1; (-) strand; PAM type: YTN; PAM sequence: CTT
cctgggttcaagcgattgtc

SEQ ID NO: 182140 - DNA, 20 bp, Artificial Sequence
  Description of Artificial Sequence: Synthetic oligonucleotide
  Target: ATXN1; (-) strand; PAM type: YTN; PAM sequence: CTC
cacttcctgggttcaagcga

SEQ ID NO: 182141 - DNA, 20 bp, Artificial Sequence
  Description of Artificial Sequence: Synthetic oligonucleotide
  Target: ATXN1; (-) strand; PAM type: YTN; PAM sequence: CTG
caacctccacttcctgggtt

SEQ ID NO: 182142 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacttcctg

SEQ ID NO: 182143 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctccact

SEQ ID NO: 182144 - DNA, 20 bp, Artificial Sequence
  Description of Artificial Sequence: Synthetic oligonucleotide
  Target: ATXN1; (-) strand; PAM type: YTN; PAM sequence: CTG
gagtccagccatctcagctc

SEQ ID NO: 182145 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtccagcca

SEQ ID NO: 182146 - DNA, 20 bp, Artificial Sequence
  Description of Artificial Sequence: Synthetic oligonucleotide
  Target: ATXN1; (-) strand; PAM type: YTN; PAM sequence: TTA
ttgcccaggctggagtccag

SEQ ID NO: 182147 - DNA, 20 bp, Artificial Sequence
  Description of Artificial Sequence: Synthetic oligonucleotide
  Target: ATXN1; (-) strand; PAM type: YTN; PAM sequence: CTT
attgcccaggctggagtcca

SEQ ID NO: 182148 - DNA, 20 bp, Artificial Sequence
  Description of Artificial Sequence: Synthetic oligonucleotide
  Target: ATXN1; (-) strand; PAM type: YTN; PAM sequence: CTC
ttattgcccaggctggagtc

SEQ ID NO: 182149 - DNA, 20 bp, Artificial Sequence
  Description of Artificial Sequence: Synthetic oligonucleotide
  Target: ATXN1; (-) strand; PAM type: YTN; PAM sequence: CTC
gctcttattgcccaggctgg

SEQ ID NO: 182150 - DNA, 20 bp, Artificial Sequence
  Description of Artificial Sequence: Synthetic oligonucleotide
  Target: ATXN1; (-) strand; PAM type: YTN; PAM sequence: TTG
agacagagtctcgctcttat

SEQ ID NO: 182151 - DNA, 20 bp, Artificial Sequence
  Description of Artificial Sequence: Synthetic oligonucleotide
  Target: ATXN1; (-) strand; PAM type: YTN; PAM sequence: TTT
gagacagagtctcgctctta

SEQ ID NO: 182152 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtctcgctctt

SEQ ID NO: 182153 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtctcgctct

SEQ ID NO: 182154 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtctcgctc

SEQ ID NO: 182155 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtctcgct

SEQ ID NO: 182156 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtctcgc

SEQ ID NO: 182157 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtctcg

SEQ ID NO: 182158 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtctc

SEQ ID NO: 182159 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagtct

SEQ ID NO: 182160 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtc

SEQ ID NO: 182161 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 182162 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 182163 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaga

SEQ ID NO: 182164 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacag

SEQ ID NO: 182165 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagaca

SEQ ID NO: 182166 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 182167 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 182168 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 182169 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 182170 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 182171 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182172 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182173 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182174 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182175 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182176 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182177 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 182178 - DNA, 20 bp, Artificial Sequence
  Description of Artificial Sequence: Synthetic oligonucleotide
  Target: ATXN1; (-) strand; PAM type: YTN; PAM sequence: CTG
tttttttttttttttttttt

SEQ ID NO: 182179 - DNA, 20 bp, Artificial Sequence
  Description of Artificial Sequence: Synthetic oligonucleotide
  Target: ATXN1; (-) strand; PAM type: YTN; PAM sequence: TTC
tgtttttttttttttttttt

SEQ ID NO: 182180 - DNA, 20 bp, Artificial Sequence
  Description of Artificial Sequence: Synthetic oligonucleotide
  Target: ATXN1; (-) strand; PAM type: YTN; PAM sequence: CTT
ctgttttttttttttttttt

SEQ ID NO: 182181 - DNA, 20 bp, Artificial Sequence
  Description of Artificial Sequence: Synthetic oligonucleotide
  Target: ATXN1; (-) strand; PAM type: YTN; PAM sequence: TTC
ttctgttttttttttttttt

SEQ ID NO: 182182 - DNA, 20 bp, Artificial Sequence
  Description of Artificial Sequence: Synthetic oligonucleotide
  Target: ATXN1; (-) strand; PAM type: YTN; PAM sequence: CTA
attcttctgttttttttttt

SEQ ID NO: 182183 - DNA, 20 bp, Artificial Sequence
  Description of Artificial Sequence: Synthetic oligonucleotide
  Target: ATXN1; (-) strand; PAM type: YTN; PAM sequence: TTA
tcgatctaattcttctgttt

SEQ ID NO: 182184 - DNA, 20 bp, Artificial Sequence
  Description of Artificial Sequence: Synthetic oligonucleotide
  Target: ATXN1; (-) strand; PAM type: YTN; PAM sequence: TTT
atcgatctaattcttctgtt

SEQ ID NO: 182185 - DNA, 20 bp, Artificial Sequence
  Description of Artificial Sequence: Synthetic oligonucleotide
  Target: ATXN1; (-) strand; PAM type: YTN; PAM sequence: CTC
agtaaatatttatcgatcta

SEQ ID NO: 182186 - DNA, 20 bp, Artificial Sequence
  Description of Artificial Sequence: Synthetic oligonucleotide
  Target: ATXN1; (-) strand; PAM type: YTN; PAM sequence: CTG
taagcactcagtaaatattt

SEQ ID NO: 182187 - DNA, 20 bp, Artificial Sequence
  Description of Artificial Sequence: Synthetic oligonucleotide
  Target: ATXN1; (-) strand; PAM type: YTN; PAM sequence: TTG
gcacactgtaagcactcagt

SEQ ID NO: 182188 - DNA, 20 bp, Artificial Sequence
  Description of Artificial Sequence: Synthetic oligonucleotide
  Target: ATXN1; (-) strand; PAM type: YTN; PAM sequence: CTT
ggcacactgtaagcactcag

SEQ ID NO: 182189 - DNA, 20 bp, Artificial Sequence
  Description of Artificial Sequence: Synthetic oligonucleotide
  Target: ATXN1; (-) strand; PAM type: YTN; PAM sequence: CTA
aatcagtacttggcacactg

SEQ ID NO: 182190 - DNA, 20 bp, Artificial Sequence
  Description of Artificial Sequence: Synthetic oligonucleotide
  Target: ATXN1; (-) strand; PAM type: YTN; PAM sequence: CTG
tacctaaatcagtacttggc

SEQ ID NO: 182191 - DNA, 20 bp, Artificial Sequence
  Description of Artificial Sequence: Synthetic oligonucleotide
  Target: ATXN1; (-) strand; PAM type: YTN; PAM sequence: CTA
tccctgtacctaaatcagta

SEQ ID NO: 182192 - DNA, 20 bp, Artificial Sequence
  Description of Artificial Sequence: Synthetic oligonucleotide
  Target: ATXN1; (-) strand; PAM type: YTN; PAM sequence: CTC
tatccctgtacctaaatcag

SEQ ID NO: 182193 - DNA, 20 bp, Artificial Sequence
  Description of Artificial Sequence: Synthetic oligonucleotide
  Target: ATXN1; (-) strand; PAM type: YTN; PAM sequence: CTG
ctctatccctgtacctaaat

SEQ ID NO: 182194 - DNA, 20 bp, Artificial Sequence
  Description of Artificial Sequence: Synthetic oligonucleotide
  Target: ATXN1; (-) strand; PAM type: YTN; PAM sequence: CTC
actgctctatccctgtacct

SEQ ID NO: 182195 - DNA, 20 bp, Artificial Sequence
  Description of Artificial Sequence: Synthetic oligonucleotide
  Target: ATXN1; (-) strand; PAM type: YTN; PAM sequence: CTC
agctcactgctctatccctg

SEQ ID NO: 182196 - DNA, 20 bp, Artificial Sequence
  Description of Artificial Sequence: Synthetic oligonucleotide
  Target: ATXN1; (-) strand; PAM type: YTN; PAM sequence: CTG
ctcagctcactgctctatcc

SEQ ID NO: 182197 - DNA, 20 bp, Artificial Sequence
  Description of Artificial Sequence: Synthetic oligonucleotide
  Target: ATXN1; (-) strand; PAM type: YTN; PAM sequence: TTG
tctgctcagctcactgctct

SEQ ID NO: 182198 - DNA, 20 bp, Artificial Sequence
  Description of Artificial Sequence: Synthetic oligonucleotide
  Target: ATXN1; (-) strand; PAM type: YTN; PAM sequence: TTT
gtctgctcagctcactgctc

SEQ ID NO: 182199 - DNA, 20 bp, Artificial Sequence
  Description of Artificial Sequence: Synthetic oligonucleotide
  Target: ATXN1; (-) strand; PAM type: YTN; PAM sequence: TTT
tgtctgctcagctcactgct

SEQ ID NO: 182200 - DNA, 20 bp, Artificial Sequence
  Description of Artificial Sequence: Synthetic oligonucleotide
  Target: ATXN1; (-) strand; PAM type: YTN; PAM sequence: CTG
atggcagggattttgtctgc

SEQ ID NO: 182201 - DNA, 20 bp, Artificial Sequence
  Description of Artificial Sequence: Synthetic oligonucleotide
  Target: ATXN1; (-) strand; PAM type: YTN; PAM sequence: CTC
tgatggcagggattttgtct

SEQ ID NO: 182202 - DNA, 20 bp, Artificial Sequence
  Description of Artificial Sequence: Synthetic oligonucleotide
  Target: ATXN1; (-) strand; PAM type: YTN; PAM sequence: CTC
tctgatggcagggattttgt

SEQ ID NO: 182203 - DNA, 20 bp, Artificial Sequence
  Description of Artificial Sequence: Synthetic oligonucleotide
  Target: ATXN1; (-) strand; PAM type: YTN; PAM sequence: CTG
gtcagctctctgatggcagg

SEQ ID NO: 182204 - DNA, 20 bp, Artificial Sequence
  Description of Artificial Sequence: Synthetic oligonucleotide
  Target: ATXN1; (-) strand; PAM type: YTN; PAM sequence: TTC
ctggtcagctctctgatggc

SEQ ID NO: 182205 - DNA, 20 bp, Artificial Sequence
  Description of Artificial Sequence: Synthetic oligonucleotide
  Target: ATXN1; (-) strand; PAM type: YTN; PAM sequence: TTC
agttcctggtcagctctctg

SEQ ID NO: 182206 - DNA, 20 bp, Artificial Sequence
  Description of Artificial Sequence: Synthetic oligonucleotide
  Target: ATXN1; (-) strand; PAM type: YTN; PAM sequence: TTC
agaagaattcagttcctggt

SEQ ID NO: 182207 - DNA, 20 bp, Artificial Sequence
  Description of Artificial Sequence: Synthetic oligonucleotide
  Target: ATXN1; (-) strand; PAM type: YTN; PAM sequence: TTG
aattcagaagaattcagttc

SEQ ID NO: 182208 - DNA, 20 bp, Artificial Sequence
  Description of Artificial Sequence: Synthetic oligonucleotide
  Target: ATXN1; (-) strand; PAM type: YTN; PAM sequence: TTT
gaattcagaagaattcagtt

SEQ ID NO: 182209 - DNA, 20 bp, Artificial Sequence
  Description of Artificial Sequence: Synthetic oligonucleotide
  Target: ATXN1; (-) strand; PAM type: YTN; PAM sequence: TTT
tgaattcagaagaattcagt

SEQ ID NO: 182210 - DNA, 20 bp, Artificial Sequence
  Description of Artificial Sequence: Synthetic oligonucleotide
  Target: ATXN1; (-) strand; PAM type: YTN; PAM sequence: CTG
gcacaatatggagtggggaa

SEQ ID NO: 182211 - DNA, 20 bp, Artificial Sequence
  Description of Artificial Sequence: Synthetic oligonucleotide
  Target: ATXN1; (-) strand; PAM type: YTN; PAM sequence: TTA
gagagagcaagtgcaagccc

SEQ ID NO: 182212 - DNA, 20 bp, Artificial Sequence
  Description of Artificial Sequence: Synthetic oligonucleotide
  Target: ATXN1; (-) strand; PAM type: YTN; PAM sequence: TTT
agagagagcaagtgcaagcc

SEQ ID NO: 182213 - DNA, 20 bp, Artificial Sequence
  Description of Artificial Sequence: Synthetic oligonucleotide
  Target: ATXN1; (-) strand; PAM type: YTN; PAM sequence: CTT
tagagagagcaagtgcaagc

SEQ ID NO: 182214 - DNA, 20 bp, Artificial Sequence
  Description of Artificial Sequence: Synthetic oligonucleotide
  Target: ATXN1; (-) strand; PAM type: YTN; PAM sequence: TTC
ctttagagagagcaagtgca

SEQ ID NO: 182215 - DNA, 20 bp, Artificial Sequence
  Description of Artificial Sequence: Synthetic oligonucleotide
  Target: ATXN1; (-) strand; PAM type: YTN; PAM sequence: CTA
tacaagtagttcctttagag

SEQ ID NO: 182216 - DNA, 20 bp, Artificial Sequence
  Description of Artificial Sequence: Synthetic oligonucleotide
  Target: ATXN1; (-) strand; PAM type: YTN; PAM sequence: TTC
tatacaagtagttcctttag

SEQ ID NO: 182217 - DNA, 20 bp, Artificial Sequence
  Description of Artificial Sequence: Synthetic oligonucleotide
  Target: ATXN1; (-) strand; PAM type: YTN; PAM sequence: TTT
ctatacaagtagttccttta

SEQ ID NO: 182218 - DNA, 20 bp, Artificial Sequence
  Description of Artificial Sequence: Synthetic oligonucleotide
  Target: ATXN1; (-) strand; PAM type: YTN; PAM sequence: TTT
tctatacaagtagttccttt

SEQ ID NO: 182219 - DNA, 20 bp, Artificial Sequence
  Description of Artificial Sequence: Synthetic oligonucleotide
  Target: ATXN1; (-) strand; PAM type: YTN; PAM sequence: TTA
ttttctatacaagtagttcc

SEQ ID NO: 182220 - DNA, 20 bp, Artificial Sequence
  Description of Artificial Sequence: Synthetic oligonucleotide
  Target: ATXN1; (-) strand; PAM type: YTN; PAM sequence: CTG
cccagatgttattttctata

SEQ ID NO: 182221 - DNA, 20 bp, Artificial Sequence
  Description of Artificial Sequence: Synthetic oligonucleotide
  Target: ATXN1; (-) strand; PAM type: YTN; PAM sequence: CTG
ctgcccagatgttattttct

SEQ ID NO: 182222 - DNA, 20 bp, Artificial Sequence
  Description of Artificial Sequence: Synthetic oligonucleotide
  Target: ATXN1; (-) strand; PAM type: YTN; PAM sequence: TTA
tgctgctgcccagatgttat

SEQ ID NO: 182223 - DNA, 20 bp, Artificial Sequence
  Description of Artificial Sequence: Synthetic oligonucleotide
  Target: ATXN1; (-) strand; PAM type: YTN; PAM sequence: TTA
tgcaattatgctgctgccca

SEQ ID NO: 182224 - DNA, 20 bp, Artificial Sequence
  Description of Artificial Sequence: Synthetic oligonucleotide
  Target: ATXN1; (-) strand; PAM type: YTN; PAM sequence: TTT
atgcaattatgctgctgccc

SEQ ID NO: 182225 - DNA, 20 bp, Artificial Sequence
  Description of Artificial Sequence: Synthetic oligonucleotide
  Target: ATXN1; (-) strand; PAM type: YTN; PAM sequence: TTA
accatttatgcaattatgct

SEQ ID NO: 182226 - DNA, 20 bp, Artificial Sequence
  Description of Artificial Sequence: Synthetic oligonucleotide
  Target: ATXN1; (-) strand; PAM type: YTN; PAM sequence: CTA
gcagggggggttaaccattt

SEQ ID NO: 182227 - DNA, 20 bp, Artificial Sequence
  Description of Artificial Sequence: Synthetic oligonucleotide
  Target: ATXN1; (-) strand; PAM type: YTN; PAM sequence: CTA
cagagcccctagcagggggg

SEQ ID NO: 182228 - DNA, 20 bp, Artificial Sequence
  Description of Artificial Sequence: Synthetic oligonucleotide
  Target: ATXN1; (-) strand; PAM type: YTN; PAM sequence: CTG
aggctacagagcccctagca

SEQ ID NO: 182229 - DNA, 20 bp, Artificial Sequence
  Description of Artificial Sequence: Synthetic oligonucleotide
  Target: ATXN1; (-) strand; PAM type: YTN; PAM sequence: TTG
acccctgaggctacagagcc

SEQ ID NO: 182230 - DNA, 20 bp, Artificial Sequence
  Description of Artificial Sequence: Synthetic oligonucleotide
  Target: ATXN1; (-) strand; PAM type: YTN; PAM sequence: CTT
gacccctgaggctacagagc

SEQ ID NO: 182231 - DNA, 20 bp, Artificial Sequence
  Description of Artificial Sequence: Synthetic oligonucleotide
  Target: ATXN1; (-) strand; PAM type: YTN; PAM sequence: CTC
aggcagccttgacccctgag

SEQ ID NO: 182232 - DNA, 20 bp, Artificial Sequence
  Description of Artificial Sequence: Synthetic oligonucleotide
  Target: ATXN1; (-) strand; PAM type: YTN; PAM sequence: CTC
agccctcaggcagccttgac

SEQ ID NO: 182233 - DNA, 20 bp, Artificial Sequence
  Description of Artificial Sequence: Synthetic oligonucleotide
  Target: ATXN1; (-) strand; PAM type: YTN; PAM sequence: TTG
cctcagccctcaggcagcct

SEQ ID NO: 182234 - DNA, 20 bp, Artificial Sequence
  Description of Artificial Sequence: Synthetic oligonucleotide
  Target: ATXN1; (-) strand; PAM type: YTN; PAM sequence: CTA
caggtatatccaagtatgga

SEQ ID NO: 182235 - DNA, 20 bp, Artificial Sequence
  Description of Artificial Sequence: Synthetic oligonucleotide
  Target: ATXN1; (-) strand; PAM type: YTN; PAM sequence: TTA
caaatgggctacaggtatat

SEQ ID NO: 182236 - DNA, 20 bp, Artificial Sequence
  Description of Artificial Sequence: Synthetic oligonucleotide
  Target: ATXN1; (-) strand; PAM type: YTN; PAM sequence: TTG
ttacaaatgggctacaggta

SEQ ID NO: 182237 - DNA, 20 bp, Artificial Sequence
  Description of Artificial Sequence: Synthetic oligonucleotide
  Target: ATXN1; (-) strand; PAM type: YTN; PAM sequence: TTT
gttacaaatgggctacaggt

SEQ ID NO: 182238 - DNA, 20 bp, Artificial Sequence
  Description of Artificial Sequence: Synthetic oligonucleotide
  Target: ATXN1; (-) strand; PAM type: YTN; PAM sequence: CTC
aagccagtttgttacaaatg

SEQ ID NO: 182239 - DNA, 20 bp, Artificial Sequence
  Description of Artificial Sequence: Synthetic oligonucleotide
  Target: ATXN1; (-) strand; PAM type: YTN; PAM sequence: TTC
tcaagccagtttgttacaaa

SEQ ID NO: 182240 - DNA, 20 bp, Artificial Sequence
  Description of Artificial Sequence: Synthetic oligonucleotide
  Target: ATXN1; (-) strand; PAM type: YTN; PAM sequence: CTT
ctcaagccagtttgttacaa

SEQ ID NO: 182241 - DNA, 20 bp, Artificial Sequence
  Description of Artificial Sequence: Synthetic oligonucleotide
  Target: ATXN1; (-) strand; PAM type: YTN; PAM sequence: CTG
tagataatgcagcttctcaa

SEQ ID NO: 182242 - DNA, 20 bp, Artificial Sequence
  Description of Artificial Sequence: Synthetic oligonucleotide
  Target: ATXN1; (-) strand; PAM type: YTN; PAM sequence: CTA
cactgtagataatgcagctt

SEQ ID NO: 182243 - DNA, 20 bp, Artificial Sequence
  Description of Artificial Sequence: Synthetic oligonucleotide
  Target: ATXN1; (-) strand; PAM type: YTN; PAM sequence: TTG
gctacactgtagataatgca

SEQ ID NO: 182244 - DNA, 20 bp, Artificial Sequence
  Description of Artificial Sequence: Synthetic oligonucleotide
  Target: ATXN1; (-) strand; PAM type: YTN; PAM sequence: CTG
aatcattggctacactgtag

SEQ ID NO: 182245 - DNA, 20 bp, Artificial Sequence
  Description of Artificial Sequence: Synthetic oligonucleotide
  Target: ATXN1; (-) strand; PAM type: YTN; PAM sequence: TTC
ctgaatcattggctacactg

SEQ ID NO: 182246 - DNA, 20 bp, Artificial Sequence
  Description of Artificial Sequence: Synthetic oligonucleotide
  Target: ATXN1; (-) strand; PAM type: YTN; PAM sequence: TTA
gggatattcctgaatcattg

SEQ ID NO: 182247 - DNA, 20 bp, Artificial Sequence
  Description of Artificial Sequence: Synthetic oligonucleotide
  Target: ATXN1; (-) strand; PAM type: YTN; PAM sequence: TTA
acatgggaggaaatcagtac

SEQ ID NO: 182248 - DNA, 20 bp, Artificial Sequence
  Description of Artificial Sequence: Synthetic oligonucleotide
  Target: ATXN1; (-) strand; PAM type: YTN; PAM sequence: CTG
tgtagcaataataattaaca

SEQ ID NO: 182249 - DNA, 20 bp, Artificial Sequence
  Description of Artificial Sequence: Synthetic oligonucleotide
  Target: ATXN1; (-) strand; PAM type: YTN; PAM sequence: TTA
catgtactgtgtagcaataa

SEQ ID NO: 182250 - DNA, 20 bp, Artificial Sequence
  Description of Artificial Sequence: Synthetic oligonucleotide
  Target: ATXN1; (-) strand; PAM type: YTN; PAM sequence: CTG
tataatacaattacatgtac

SEQ ID NO: 182251 - DNA, 20 bp, Artificial Sequence
  Description of Artificial Sequence: Synthetic oligonucleotide
  Target: ATXN1; (-) strand; PAM type: YTN; PAM sequence: CTC
tgtataatacaattacatgt

SEQ ID NO: 182252 - DNA, 20 bp, Artificial Sequence
  Description of Artificial Sequence: Synthetic oligonucleotide
  Target: ATXN1; (-) strand; PAM type: YTN; PAM sequence: TTC
cagtctctgtataatacaat

SEQ ID NO: 182253 - DNA, 20 bp, Artificial Sequence
  Description of Artificial Sequence: Synthetic oligonucleotide
  Target: ATXN1; (-) strand; PAM type: YTN; PAM sequence: CTG
ttccagtctctgtataatac

SEQ ID NO: 182254 - DNA, 20 bp, Artificial Sequence
  Description of Artificial Sequence: Synthetic oligonucleotide
  Target: ATXN1; (-) strand; PAM type: YTN; PAM sequence: CTA
tggcagtaagagagtggaaa

SEQ ID NO: 182255 - DNA, 20 bp, Artificial Sequence
  Description of Artificial Sequence: Synthetic oligonucleotide
  Target: ATXN1; (-) strand; PAM type: YTN; PAM sequence: CTA
agtctatggcagtaagagag

SEQ ID NO: 182256 - DNA, 20 bp, Artificial Sequence
  Description of Artificial Sequence: Synthetic oligonucleotide
  Target: ATXN1; (-) strand; PAM type: YTN; PAM sequence: CTG
ccaaaagcactaagtctatg

SEQ ID NO: 182257 - DNA, 20 bp, Artificial Sequence
  Description of Artificial Sequence: Synthetic oligonucleotide
  Target: ATXN1; (-) strand; PAM type: YTN; PAM sequence: CTG
acctgccaaaagcactaagt

SEQ ID NO: 182258 - DNA, 20 bp, Artificial Sequence
  Description of Artificial Sequence: Synthetic oligonucleotide
  Target: ATXN1; (-) strand; PAM type: YTN; PAM sequence: TTG
ctgacctgccaaaagcacta

SEQ ID NO: 182259 - DNA, 20 bp, Artificial Sequence
  Description of Artificial Sequence: Synthetic oligonucleotide
  Target: ATXN1; (-) strand; PAM type: YTN; PAM sequence: CTT
gctgacctgccaaaagcact

SEQ ID NO: 182260 - DNA, 20 bp, Artificial Sequence
  Description of Artificial Sequence: Synthetic oligonucleotide
  Target: ATXN1; (-) strand; PAM type: YTN; PAM sequence: CTC
atcttgctgacctgccaaaa

SEQ ID NO: 182261 - DNA, 20 bp, Artificial Sequence
  Description of Artificial Sequence: Synthetic oligonucleotide
  Target: ATXN1; (-) strand; PAM type: YTN; PAM sequence: TTG
acctcatcttgctgacctgc

SEQ ID NO: 182262 - DNA, 20 bp, Artificial Sequence
  Description of Artificial Sequence: Synthetic oligonucleotide
  Target: ATXN1; (-) strand; PAM type: YTN; PAM sequence: TTT
gacctcatcttgctgacctg

SEQ ID NO: 182263 - DNA, 20 bp, Artificial Sequence
  Description of Artificial Sequence: Synthetic oligonucleotide
  Target: ATXN1; (-) strand; PAM type: YTN; PAM sequence: TTT
tgacctcatcttgctgacct

SEQ ID NO: 182264 - DNA, 20 bp, Artificial Sequence
  Description of Artificial Sequence: Synthetic oligonucleotide
  Target: ATXN1; (-) strand; PAM type: YTN; PAM sequence: TTG
ttttgacctcatcttgctga

SEQ ID NO: 182265 - DNA, 20 bp, Artificial Sequence
  Description of Artificial Sequence: Synthetic oligonucleotide
  Target: ATXN1; (-) strand; PAM type: YTN; PAM sequence: CTA
caaaggttgttttgacctca

SEQ ID NO: 182266 - DNA, 20 bp, Artificial Sequence
  Description of Artificial Sequence: Synthetic oligonucleotide
  Target: ATXN1; (-) strand; PAM type: YTN; PAM sequence: CTG
actacaaaggttgttttgac

SEQ ID NO: 182267 - DNA, 20 bp, Artificial Sequence
  Description of Artificial Sequence: Synthetic oligonucleotide
  Target: ATXN1; (-) strand; PAM type: YTN; PAM sequence: CTG
ctgactacaaaggttgtttt

SEQ ID NO: 182268 - DNA, 20 bp, Artificial Sequence
  Description of Artificial Sequence: Synthetic oligonucleotide
  Target: ATXN1; (-) strand; PAM type: YTN; PAM sequence: TTG
tctgctgactacaaaggttg

SEQ ID NO: 182269 - DNA, 20 bp, Artificial Sequence
  Description of Artificial Sequence: Synthetic oligonucleotide
  Target: ATXN1; (-) strand; PAM type: YTN; PAM sequence: TTT
gtctgctgactacaaaggtt

SEQ ID NO: 182270 - DNA, 20 bp, Artificial Sequence
  Description of Artificial Sequence: Synthetic oligonucleotide
  Target: ATXN1; (-) strand; PAM type: YTN; PAM sequence: TTT
tgtctgctgactacaaaggt

SEQ ID NO: 182271 - DNA, 20 bp, Artificial Sequence
  Description of Artificial Sequence: Synthetic oligonucleotide
  Target: ATXN1; (-) strand; PAM type: YTN; PAM sequence: TTA
gttttgtctgctgactacaa

SEQ ID NO: 182272 - DNA, 20 bp, Artificial Sequence
  Description of Artificial Sequence: Synthetic oligonucleotide
  Target: ATXN1; (-) strand; PAM type: YTN; PAM sequence: TTT
agttttgtctgctgactaca

SEQ ID NO: 182273 - DNA, 20 bp, Artificial Sequence
  Description of Artificial Sequence: Synthetic oligonucleotide
  Target: ATXN1; (-) strand; PAM type: YTN; PAM sequence: CTG
tttagttttgtctgctgact

SEQ ID NO: 182274 - DNA, 20 bp, Artificial Sequence
  Description of Artificial Sequence: Synthetic oligonucleotide
  Target: ATXN1; (-) strand; PAM type: YTN; PAM sequence: CTG
atggctgtttagttttgtct

SEQ ID NO: 182275 - DNA, 20 bp, Artificial Sequence
  Description of Artificial Sequence: Synthetic oligonucleotide
  Target: ATXN1; (-) strand; PAM type: YTN; PAM sequence: TTC
tgatggctgtttagttttgt

SEQ ID NO: 182276 - DNA, 20 bp, Artificial Sequence
  Description of Artificial Sequence: Synthetic oligonucleotide
  Target: ATXN1; (-) strand; PAM type: YTN; PAM sequence: TTT
ctgatggctgtttagttttg

SEQ ID NO: 182277 - DNA, 20 bp, Artificial Sequence
  Description of Artificial Sequence: Synthetic oligonucleotide
  Target: ATXN1; (-) strand; PAM type: YTN; PAM sequence: TTA
aaaatgtttctgatggctgt

SEQ ID NO: 182278 - DNA, 20 bp, Artificial Sequence
  Description of Artificial Sequence: Synthetic oligonucleotide
  Target: ATXN1; (-) strand; PAM type: YTN; PAM sequence: TTT
aaaaatgtttctgatggctg

SEQ ID NO: 182279 - DNA, 20 bp, Artificial Sequence
  Description of Artificial Sequence: Synthetic oligonucleotide
  Target: ATXN1; (-) strand; PAM type: YTN; PAM sequence: TTT
taaaaatgtttctgatggct

SEQ ID NO: 182280 - DNA, 20 bp, Artificial Sequence
  Description of Artificial Sequence: Synthetic oligonucleotide
  Target: ATXN1; (-) strand; PAM type: YTN; PAM sequence: TTA
atagcatattttaaaaatgt

SEQ ID NO: 182281 - DNA, 20 bp, Artificial Sequence
  Description of Artificial Sequence: Synthetic oligonucleotide
  Target: ATXN1; (-) strand; PAM type: YTN; PAM sequence: TTT
aatagcatattttaaaaatg

SEQ ID NO: 182282 - DNA, 20 bp, Artificial Sequence
  Description of Artificial Sequence: Synthetic oligonucleotide
  Target: ATXN1; (-) strand; PAM type: YTN; PAM sequence: CTA
taataatttaatagcatatt

SEQ ID NO: 182283 - DNA, 20 bp, Artificial Sequence
  Description of Artificial Sequence: Synthetic oligonucleotide
  Target: ATXN1; (-) strand; PAM type: YTN; PAM sequence: CTA
ctataataatttaatagcat

SEQ ID NO: 182284 - DNA, 20 bp, Artificial Sequence
  Description of Artificial Sequence: Synthetic oligonucleotide
  Target: ATXN1; (-) strand; PAM type: YTN; PAM sequence: CTG
tctactataataatttaata

SEQ ID NO: 182285 - DNA, 20 bp, Artificial Sequence
  Description of Artificial Sequence: Synthetic oligonucleotide
  Target: ATXN1; (-) strand; PAM type: YTN; PAM sequence: TTG
ctgtctactataataattta

SEQ ID NO: 182286 - DNA, 20 bp, Artificial Sequence
  Description of Artificial Sequence: Synthetic oligonucleotide
  Target: ATXN1; (-) strand; PAM type: YTN; PAM sequence: TTT
gctgtctactataataattt

SEQ ID NO: 182287 - DNA, 20 bp, Artificial Sequence
  Description of Artificial Sequence: Synthetic oligonucleotide
  Target: ATXN1; (-) strand; PAM type: YTN; PAM sequence: TTT
tgctgtctactataataatt

SEQ ID NO: 182288 - DNA, 20 bp, Artificial Sequence
  Description of Artificial Sequence: Synthetic oligonucleotide
  Target: ATXN1; (-) strand; PAM type: YTN; PAM sequence: TTG
gttttgctgtctactataat

SEQ ID NO: 182289 - DNA, 20 bp, Artificial Sequence
  Description of Artificial Sequence: Synthetic oligonucleotide
  Target: ATXN1; (-) strand; PAM type: YTN; PAM sequence: CTT
ggttttgctgtctactataa

SEQ ID NO: 182290 - DNA, 20 bp, Artificial Sequence
  Description of Artificial Sequence: Synthetic oligonucleotide
  Target: ATXN1; (-) strand; PAM type: YTN; PAM sequence: TTC
ttggttttgctgtctactat

SEQ ID NO: 182291 - DNA, 20 bp, Artificial Sequence
  Description of Artificial Sequence: Synthetic oligonucleotide
  Target: ATXN1; (-) strand; PAM type: YTN; PAM sequence: TTT
cttggttttgctgtctacta

SEQ ID NO: 182292 - DNA, 20 bp, Artificial Sequence
  Description of Artificial Sequence: Synthetic oligonucleotide
  Target: ATXN1; (-) strand; PAM type: YTN; PAM sequence: TTA
atttcttggttttgctgtct

SEQ ID NO: 182293 - DNA, 20 bp, Artificial Sequence
  Description of Artificial Sequence: Synthetic oligonucleotide
  Target: ATXN1; (-) strand; PAM type: YTN; PAM sequence: TTG
cattaatttcttggttttgc

SEQ ID NO: 182294 - DNA, 20 bp, Artificial Sequence
  Description of Artificial Sequence: Synthetic oligonucleotide
  Target: ATXN1; (-) strand; PAM type: YTN; PAM sequence: TTT
gcattaatttcttggttttg

SEQ ID NO: 182295 - DNA, 20 bp, Artificial Sequence
  Description of Artificial Sequence: Synthetic oligonucleotide
  Target: ATXN1; (-) strand; PAM type: YTN; PAM sequence: TTT
tgcattaatttcttggtttt

SEQ ID NO: 182296 - DNA, 20 bp, Artificial Sequence
  Description of Artificial Sequence: Synthetic oligonucleotide
  Target: ATXN1; (-) strand; PAM type: YTN; PAM sequence: CTT
ttgcattaatttcttggttt

SEQ ID NO: 182297 - DNA, 20 bp, Artificial Sequence
  Description of Artificial Sequence: Synthetic oligonucleotide
  Target: ATXN1; (-) strand; PAM type: YTN; PAM sequence: TTC
ttttgcattaatttcttggt

SEQ ID NO: 182298 - DNA, 20 bp, Artificial Sequence
  Description of Artificial Sequence: Synthetic oligonucleotide
  Target: ATXN1; (-) strand; PAM type: YTN; PAM sequence: TTG
gttcttttgcattaatttct

SEQ ID NO: 182299 - DNA, 20 bp, Artificial Sequence
  Description of Artificial Sequence: Synthetic oligonucleotide
  Target: ATXN1; (-) strand; PAM type: YTN; PAM sequence: CTT
ggttcttttgcattaatttc

SEQ ID NO: 182300 - DNA, 20 bp, Artificial Sequence
  Description of Artificial Sequence: Synthetic oligonucleotide
  Target: ATXN1; (-) strand; PAM type: YTN; PAM sequence: CTC
ttggttcttttgcattaatt

SEQ ID NO: 182301 - DNA, 20 bp, Artificial Sequence
  Description of Artificial Sequence: Synthetic oligonucleotide
  Target: ATXN1; (-) strand; PAM type: YTN; PAM sequence: TTA
agaaatctcttggttctttt

SEQ ID NO: 182302 - DNA, 20 bp, Artificial Sequence
  Description of Artificial Sequence: Synthetic oligonucleotide
  Target: ATXN1; (-) strand; PAM type: YTN; PAM sequence: CTG
gtgataagattaagaaatct

SEQ ID NO: 182303 - DNA, 20 bp, Artificial Sequence
  Description of Artificial Sequence: Synthetic oligonucleotide
  Target: ATXN1; (-) strand; PAM type: YTN; PAM sequence: CTG
aactggtgataagattaaga

SEQ ID NO: 182304 - DNA, 20 bp, Artificial Sequence
  Description of Artificial Sequence: Synthetic oligonucleotide
  Target: ATXN1; (-) strand; PAM type: YTN; PAM sequence: CTG
aatctgaactggtgataaga

SEQ ID NO: 182305 - DNA, 20 bp, Artificial Sequence
  Description of Artificial Sequence: Synthetic oligonucleotide
  Target: ATXN1; (-) strand; PAM type: YTN; PAM sequence: TTC
tgaatctgaactggtgataa

SEQ ID NO: 182306 - DNA, 20 bp, Artificial Sequence
  Description of Artificial Sequence: Synthetic oligonucleotide
  Target: ATXN1; (-) strand; PAM type: YTN; PAM sequence: TTT
ctgaatctgaactggtgata

SEQ ID NO: 182307 - DNA, 20 bp, Artificial Sequence
  Description of Artificial Sequence: Synthetic oligonucleotide
  Target: ATXN1; (-) strand; PAM type: YTN; PAM sequence: TTT
tctgaatctgaactggtgat

SEQ ID NO: 182308 - DNA, 20 bp, Artificial Sequence
  Description of Artificial Sequence: Synthetic oligonucleotide
  Target: ATXN1; (-) strand; PAM type: YTN; PAM sequence: TTT
ttctgaatctgaactggtga

SEQ ID NO: 182309 - DNA, 20 bp, Artificial Sequence
  Description of Artificial Sequence: Synthetic oligonucleotide
  Target: ATXN1; (-) strand; PAM type: YTN; PAM sequence: CTT
tttctgaatctgaactggtg

SEQ ID NO: 182310 - DNA, 20 bp, Artificial Sequence
  Description of Artificial Sequence: Synthetic oligonucleotide
  Target: ATXN1; (-) strand; PAM type: YTN; PAM sequence: TTC
tttttctgaatctgaactgg

SEQ ID NO: 182311 - DNA, 20 bp, Artificial Sequence
  Description of Artificial Sequence: Synthetic oligonucleotide
  Target: ATXN1; (-) strand; PAM type: YTN; PAM sequence: TTA
gttctttttctgaatctgaa

SEQ ID NO: 182312 - DNA, 20 bp, Artificial Sequence
  Description of Artificial Sequence: Synthetic oligonucleotide
  Target: ATXN1; (-) strand; PAM type: YTN; PAM sequence: TTT
agttctttttctgaatctga

SEQ ID NO: 182313 - DNA, 20 bp, Artificial Sequence
  Description of Artificial Sequence: Synthetic oligonucleotide
  Target: ATXN1; (-) strand; PAM type: YTN; PAM sequence: TTT
tagttctttttctgaatctg

SEQ ID NO: 182314 - DNA, 20 bp, Artificial Sequence
  Description of Artificial Sequence: Synthetic oligonucleotide
  Target: ATXN1; (-) strand; PAM type: YTN; PAM sequence: CTT
ttagttctttttctgaatct

SEQ ID NO: 182315 - DNA, 20 bp, Artificial Sequence
  Description of Artificial Sequence: Synthetic oligonucleotide
  Target: ATXN1; (-) strand; PAM type: YTN; PAM sequence: CTC
ccagatcacagcttttagtt

SEQ ID NO: 182316 - DNA, 20 bp, Artificial Sequence
  Description of Artificial Sequence: Synthetic oligonucleotide
  Target: ATXN1; (-) strand; PAM type: YTN; PAM sequence: CTA
taatatccaagctcccagat

SEQ ID NO: 182317 - DNA, 20 bp, Artificial Sequence
  Description of Artificial Sequence: Synthetic oligonucleotide
  Target: ATXN1; (-) strand; PAM type: YTN; PAM sequence: TTG
ctataatatccaagctccca

SEQ ID NO: 182318 - DNA, 20 bp, Artificial Sequence
  Description of Artificial Sequence: Synthetic oligonucleotide
  Target: ATXN1; (-) strand; PAM type: YTN; PAM sequence: TTA
attgctataatatccaagct

SEQ ID NO: 182319 - DNA, 20 bp, Artificial Sequence
  Description of Artificial Sequence: Synthetic oligonucleotide
  Target: ATXN1; (-) strand; PAM type: YTN; PAM sequence: CTT
aattgctataatatccaagc

SEQ ID NO: 182320 - DNA, 20 bp, Artificial Sequence
  Description of Artificial Sequence: Synthetic oligonucleotide
  Target: ATXN1; (-) strand; PAM type: YTN; PAM sequence: CTG
cttaattgctataatatcca

SEQ ID NO: 182321 - DNA, 20 bp, Artificial Sequence
  Description of Artificial Sequence: Synthetic oligonucleotide
  Target: ATXN1; (-) strand; PAM type: YTN; PAM sequence: TTA
tatccaagctgcttaattgc

SEQ ID NO: 182322 - DNA, 20 bp, Artificial Sequence
  Description of Artificial Sequence: Synthetic oligonucleotide
  Target: ATXN1; (-) strand; PAM type: YTN; PAM sequence: TTT
atatccaagctgcttaattg

SEQ ID NO: 182323 - DNA, 20 bp, Artificial Sequence
  Description of Artificial Sequence: Synthetic oligonucleotide
  Target: ATXN1; (-) strand; PAM type: YTN; PAM sequence: TTT
tatatccaagctgcttaatt

SEQ ID NO: 182324 - DNA, 20 bp, Artificial Sequence
  Description of Artificial Sequence: Synthetic oligonucleotide
  Target: ATXN1; (-) strand; PAM type: YTN; PAM sequence: TTT
ttatatccaagctgcttaat

SEQ ID NO: 182325 - DNA, 20 bp, Artificial Sequence
  Description of Artificial Sequence: Synthetic oligonucleotide
  Target: ATXN1; (-) strand; PAM type: YTN; PAM sequence: CTT
tttatatccaagctgcttaa

SEQ ID NO: 182326 - DNA, 20 bp, Artificial Sequence
  Description of Artificial Sequence: Synthetic oligonucleotide
  Target: ATXN1; (-) strand; PAM type: YTN; PAM sequence: CTC
tttttatatccaagctgctt

SEQ ID NO: 182327 - DNA, 20 bp, Artificial Sequence
  Description of Artificial Sequence: Synthetic oligonucleotide
  Target: ATXN1; (-) strand; PAM type: YTN; PAM sequence: CTA
cctctttttatatccaagct

SEQ ID NO: 182328 - DNA, 20 bp, Artificial Sequence
  Description of Artificial Sequence: Synthetic oligonucleotide
  Target: ATXN1; (-) strand; PAM type: YTN; PAM sequence: TTA
tctacctctttttatatcca

SEQ ID NO: 182329 - DNA, 20 bp, Artificial Sequence
  Description of Artificial Sequence: Synthetic oligonucleotide
  Target: ATXN1; (-) strand; PAM type: YTN; PAM sequence: CTT
atctacctctttttatatcc

SEQ ID NO: 182330 - DNA, 20 bp, Artificial Sequence
  Description of Artificial Sequence: Synthetic oligonucleotide
  Target: ATXN1; (-) strand; PAM type: YTN; PAM sequence: CTG
aaggtgagcttatctacctc

SEQ ID NO: 182331 - DNA, 20 bp, Artificial Sequence
  Description of Artificial Sequence: Synthetic oligonucleotide
  Target: ATXN1; (-) strand; PAM type: YTN; PAM sequence: CTG
agtccccctgaaggtgagct

SEQ ID NO: 182332 - DNA, 20 bp, Artificial Sequence
  Description of Artificial Sequence: Synthetic oligonucleotide
  Target: ATXN1; (-) strand; PAM type: YTN; PAM sequence: CTG
ctgagtccccctgaaggtga

SEQ ID NO: 182333 - DNA, 20 bp, Artificial Sequence
  Description of Artificial Sequence: Synthetic oligonucleotide
  Target: ATXN1; (-) strand; PAM type: YTN; PAM sequence: TTC
catacataacagtggtggtc

SEQ ID NO: 182334 - DNA, 20 bp, Artificial Sequence
  Description of Artificial Sequence: Synthetic oligonucleotide
  Target: ATXN1; (-) strand; PAM type: YTN; PAM sequence: TTT
ccatacataacagtggtggt

SEQ ID NO: 182335 - DNA, 20 bp, Artificial Sequence
  Description of Artificial Sequence: Synthetic oligonucleotide
  Target: ATXN1; (-) strand; PAM type: YTN; PAM sequence: CTT
tccatacataacagtggtgg

SEQ ID NO: 182336 - DNA, 20 bp, Artificial Sequence
  Description of Artificial Sequence: Synthetic oligonucleotide
  Target: ATXN1; (-) strand; PAM type: YTN; PAM sequence: CTC
ctttccatacataacagtgg

SEQ ID NO: 182337 - DNA, 20 bp, Artificial Sequence
  Description of Artificial Sequence: Synthetic oligonucleotide
  Target: ATXN1; (-) strand; PAM type: YTN; PAM sequence: TTA
ctcctttccatacataacag

SEQ ID NO: 182338 - DNA, 20 bp, Artificial Sequence
  Description of Artificial Sequence: Synthetic oligonucleotide
  Target: ATXN1; (-) strand; PAM type: YTN; PAM sequence: TTT
actcctttccatacataaca

SEQ ID NO: 182339 - DNA, 20 bp, Artificial Sequence
  Description of Artificial Sequence: Synthetic oligonucleotide
  Target: ATXN1; (-) strand; PAM type: YTN; PAM sequence: CTT
tactcctttccatacataac

SEQ ID NO: 182340 - DNA, 20 bp, Artificial Sequence
  Description of Artificial Sequence: Synthetic oligonucleotide
  Target: ATXN1; (-) strand; PAM type: YTN; PAM sequence: TTC
cctttactcctttccataca

SEQ ID NO: 182341 - DNA, 20 bp, Artificial Sequence
  Description of Artificial Sequence: Synthetic oligonucleotide
  Target: ATXN1; (-) strand; PAM type: YTN; PAM sequence: CTC
gcattccctttactcctttc

SEQ ID NO: 182342 - DNA, 20 bp, Artificial Sequence
  Description of Artificial Sequence: Synthetic oligonucleotide
  Target: ATXN1; (-) strand; PAM type: YTN; PAM sequence: CTC
tcgcattccctttactcctt

SEQ ID NO: 182343 - DNA, 20 bp, Artificial Sequence
  Description of Artificial Sequence: Synthetic oligonucleotide
  Target: ATXN1; (-) strand; PAM type: YTN; PAM sequence: TTC
atatatcctctcgcattccc

SEQ ID NO: 182344 - DNA, 20 bp, Artificial Sequence
  Description of Artificial Sequence: Synthetic oligonucleotide
  Target: ATXN1; (-) strand; PAM type: YTN; PAM sequence: CTC
aagttcatatatcctctcgc

SEQ ID NO: 182345 - DNA, 20 bp, Artificial Sequence
  Description of Artificial Sequence: Synthetic oligonucleotide
  Target: ATXN1; (-) strand; PAM type: YTN; PAM sequence: CTG
acctcaagttcatatatcct

SEQ ID NO: 182346 - DNA, 20 bp, Artificial Sequence
  Description of Artificial Sequence: Synthetic oligonucleotide
  Target: ATXN1; (-) strand; PAM type: YTN; PAM sequence: TTC
ctgacctcaagttcatatat

SEQ ID NO: 182347 - DNA, 20 bp, Artificial Sequence
  Description of Artificial Sequence: Synthetic oligonucleotide
  Target: ATXN1; (-) strand; PAM type: YTN; PAM sequence: TTT
cctgacctcaagttcatata

SEQ ID NO: 182348 - DNA, 20 bp, Artificial Sequence
  Description of Artificial Sequence: Synthetic oligonucleotide
  Target: ATXN1; (-) strand; PAM type: YTN; PAM sequence: CTG
ccacatgtttcctgacctca

SEQ ID NO: 182349 - DNA, 20 bp, Artificial Sequence
  Description of Artificial Sequence: Synthetic oligonucleotide
  Target: ATXN1; (-) strand; PAM type: YTN; PAM sequence: TTC
ccaacccaatgcctgccaca

SEQ ID NO: 182350 - DNA, 20 bp, Artificial Sequence
  Description of Artificial Sequence: Synthetic oligonucleotide
  Target: ATXN1; (-) strand; PAM type: YTN; PAM sequence: CTT
cccaacccaatgcctgccac

SEQ ID NO: 182351 - DNA, 20 bp, Artificial Sequence
  Description of Artificial Sequence: Synthetic oligonucleotide
  Target: ATXN1; (-) strand; PAM type: YTN; PAM sequence: CTC
agtaaatacagtcttcccaa

SEQ ID NO: 182352 - DNA, 20 bp, Artificial Sequence
  Description of Artificial Sequence: Synthetic oligonucleotide
  Target: ATXN1; (-) strand; PAM type: YTN; PAM sequence: TTC
agatcctcagtaaatacagt

SEQ ID NO: 182353 - DNA, 20 bp, Artificial Sequence
  Description of Artificial Sequence: Synthetic oligonucleotide
  Target: ATXN1; (-) strand; PAM type: YTN; PAM sequence: CTT
cagatcctcagtaaatacag

SEQ ID NO: 182354 - DNA, 20 bp, Artificial Sequence
  Description of Artificial Sequence: Synthetic oligonucleotide
  Target: ATXN1; (-) strand; PAM type: YTN; PAM sequence: TTG
ccacacttcagatcctcagt

SEQ ID NO: 182355 - DNA, 20 bp, Artificial Sequence
  Description of Artificial Sequence: Synthetic oligonucleotide
  Target: ATXN1; (-) strand; PAM type: YTN; PAM sequence: TTT
gccacacttcagatcctcag

SEQ ID NO: 182356 - DNA, 20 bp, Artificial Sequence
  Description of Artificial Sequence: Synthetic oligonucleotide
  Target: ATXN1; (-) strand; PAM type: YTN; PAM sequence: CTA
gagcatttgccacacttcag

SEQ ID NO: 182357 - DNA, 20 bp, Artificial Sequence
  Description of Artificial Sequence: Synthetic oligonucleotide
  Target: ATXN1; (-) strand; PAM type: YTN; PAM sequence: CTC
ctagagcatttgccacactt

SEQ ID NO: 182358 - DNA, 20 bp, Artificial Sequence
  Description of Artificial Sequence: Synthetic oligonucleotide
  Target: ATXN1; (-) strand; PAM type: YTN; PAM sequence: CTG
tctcctagagcatttgccac

SEQ ID NO: 182359 - DNA, 20 bp, Artificial Sequence
  Description of Artificial Sequence: Synthetic oligonucleotide
  Target: ATXN1; (-) strand; PAM type: YTN; PAM sequence: TTC
tgtctcctagagcatttgcc

SEQ ID NO: 182360 - DNA, 20 bp, Artificial Sequence
  Description of Artificial Sequence: Synthetic oligonucleotide
  Target: ATXN1; (-) strand; PAM type: YTN; PAM sequence: CTT
ctgtctcctagagcatttgc

SEQ ID NO: 182361 - DNA, 20 bp, Artificial Sequence
  Description of Artificial Sequence: Synthetic oligonucleotide
  Target: ATXN1; (-) strand; PAM type: YTN; PAM sequence: TTC
cttctgtctcctagagcatt

SEQ ID NO: 182362 - DNA, 20 bp, Artificial Sequence
  Description of Artificial Sequence: Synthetic oligonucleotide
  Target: ATXN1; (-) strand; PAM type: YTN; PAM sequence: CTT
ccttctgtctcctagagcat

SEQ ID NO: 182363 - DNA, 20 bp, Artificial Sequence
  Description of Artificial Sequence: Synthetic oligonucleotide
  Target: ATXN1; (-) strand; PAM type: YTN; PAM sequence: TTC
cttccttctgtctcctagag

SEQ ID NO: 182364 - DNA, 20 bp, Artificial Sequence
  Description of Artificial Sequence: Synthetic oligonucleotide
  Target: ATXN1; (-) strand; PAM type: YTN; PAM sequence: CTT
ccttccttctgtctcctaga

SEQ ID NO: 182365 - DNA, 20 bp, Artificial Sequence
  Description of Artificial Sequence: Synthetic oligonucleotide
  Target: ATXN1; (-) strand; PAM type: YTN; PAM sequence: CTC
cttccttccttctgtctcct

SEQ ID NO: 182366 - DNA, 20 bp, Artificial Sequence
  Description of Artificial Sequence: Synthetic oligonucleotide
  Target: ATXN1; (-) strand; PAM type: YTN; PAM sequence: CTC
tccttccttccttctgtctc

SEQ ID NO: 182367 - DNA, 20 bp, Artificial Sequence
  Description of Artificial Sequence: Synthetic oligonucleotide
  Target: ATXN1; (-) strand; PAM type: YTN; PAM sequence: TTG
tagagatgctctccttcctt

SEQ ID NO: 182368 - DNA, 20 bp, Artificial Sequence
  Description of Artificial Sequence: Synthetic oligonucleotide
  Target: ATXN1; (-) strand; PAM type: YTN; PAM sequence: CTT
gtagagatgctctccttcct

SEQ ID NO: 182369 - DNA, 20 bp, Artificial Sequence
  Description of Artificial Sequence: Synthetic oligonucleotide
  Target: ATXN1; (-) strand; PAM type: YTN; PAM sequence: TTA
cttgtagagatgctctcctt

SEQ ID NO: 182370 - DNA, 20 bp, Artificial Sequence
  Description of Artificial Sequence: Synthetic oligonucleotide
  Target: ATXN1; (-) strand; PAM type: YTN; PAM sequence: TTG
ggtgttacttgtagagatgc

SEQ ID NO: 182371 - DNA, 20 bp, Artificial Sequence
  Description of Artificial Sequence: Synthetic oligonucleotide
  Target: ATXN1; (-) strand; PAM type: YTN; PAM sequence: TTA
gattgggtgttacttgtaga

SEQ ID NO: 182372 - DNA, 20 bp, Artificial Sequence
  Description of Artificial Sequence: Synthetic oligonucleotide
  Target: ATXN1; (-) strand; PAM type: YTN; PAM sequence: CTG
gttagattgggtgttacttg

SEQ ID NO: 182373 - DNA, 20 bp, Artificial Sequence
  Description of Artificial Sequence: Synthetic oligonucleotide
  Target: ATXN1; (-) strand; PAM type: YTN; PAM sequence: CTA
cctggttagattgggtgtta

SEQ ID NO: 182374 - DNA, 20 bp, Artificial Sequence
  Description of Artificial Sequence: Synthetic oligonucleotide
  Target: ATXN1; (-) strand; PAM type: YTN; PAM sequence: TTA
ctacctggttagattgggtg

SEQ ID NO: 182375 - DNA, 20 bp, Artificial Sequence
  Description of Artificial Sequence: Synthetic oligonucleotide
  Target: ATXN1; (-) strand; PAM type: YTN; PAM sequence: CTT
actacctggttagattgggt

SEQ ID NO: 182376 - DNA, 20 bp, Artificial Sequence
  Description of Artificial Sequence: Synthetic oligonucleotide
  Target: ATXN1; (-) strand; PAM type: YTN; PAM sequence: TTA
catcaagatgagtcttacta

SEQ ID NO: 182377 - DNA, 20 bp, Artificial Sequence
  Description of Artificial Sequence: Synthetic oligonucleotide
  Target: ATXN1; (-) strand; PAM type: YTN; PAM sequence: TTT
acatcaagatgagtcttact

SEQ ID NO: 182378 - DNA, 20 bp, Artificial Sequence
  Description of Artificial Sequence: Synthetic oligonucleotide
  Target: ATXN1; (-) strand; PAM type: YTN; PAM sequence: TTT
tacatcaagatgagtcttac

SEQ ID NO: 182379 - DNA, 20 bp, Artificial Sequence
  Description of Artificial Sequence: Synthetic oligonucleotide
  Target: ATXN1; (-) strand; PAM type: YTN; PAM sequence: TTT
ttacatcaagatgagtctta

SEQ ID NO: 182380 - DNA, 20 bp, Artificial Sequence
  Description of Artificial Sequence: Synthetic oligonucleotide
  Target: ATXN1; (-) strand; PAM type: YTN; PAM sequence: TTT
tttacatcaagatgagtctt

SEQ ID NO: 182381 - DNA, 20 bp, Artificial Sequence
  Description of Artificial Sequence: Synthetic oligonucleotide
  Target: ATXN1; (-) strand; PAM type: YTN; PAM sequence: CTT
ttttacatcaagatgagtct

SEQ ID NO: 182382 - DNA, 20 bp, Artificial Sequence
  Description of Artificial Sequence: Synthetic oligonucleotide
  Target: ATXN1; (-) strand; PAM type: YTN; PAM sequence: TTC
ttttttacatcaagatgagt

SEQ ID NO: 182383 - DNA, 20 bp, Artificial Sequence
  Description of Artificial Sequence: Synthetic oligonucleotide
  Target: ATXN1; (-) strand; PAM type: YTN; PAM sequence: CTT
cttttttacatcaagatgag

SEQ ID NO: 182384 - DNA, 20 bp, Artificial Sequence
  Description of Artificial Sequence: Synthetic oligonucleotide
  Target: ATXN1; (-) strand; PAM type: YTN; PAM sequence: TTA
cttcttttttacatcaagat

SEQ ID NO: 182385 - DNA, 20 bp, Artificial Sequence
  Description of Artificial Sequence: Synthetic oligonucleotide
  Target: ATXN1; (-) strand; PAM type: YTN; PAM sequence: TTG
tgtggttacttcttttttac

SEQ ID NO: 182386 - DNA, 20 bp, Artificial Sequence
  Description of Artificial Sequence: Synthetic oligonucleotide
  Target: ATXN1; (-) strand; PAM type: YTN; PAM sequence: CTG
ttgtgtggttacttcttttt

SEQ ID NO: 182387 - DNA, 20 bp, Artificial Sequence
  Description of Artificial Sequence: Synthetic oligonucleotide
  Target: ATXN1; (-) strand; PAM type: YTN; PAM sequence: CTC
tgttgtgtggttacttcttt

SEQ ID NO: 182388 - DNA, 20 bp, Artificial Sequence
  Description of Artificial Sequence: Synthetic oligonucleotide
  Target: ATXN1; (-) strand; PAM type: YTN; PAM sequence: CTA
cagctctgttgtgtggttac

SEQ ID NO: 182389 - DNA, 20 bp, Artificial Sequence
  Description of Artificial Sequence: Synthetic oligonucleotide
  Target: ATXN1; (-) strand; PAM type: YTN; PAM sequence: TTC
tacagctctgttgtgtggtt

SEQ ID NO: 182390 - DNA, 20 bp, Artificial Sequence
  Description of Artificial Sequence: Synthetic oligonucleotide
  Target: ATXN1; (-) strand; PAM type: YTN; PAM sequence: TTT
ctacagctctgttgtgtggt

SEQ ID NO: 182391 - DNA, 20 bp, Artificial Sequence
  Description of Artificial Sequence: Synthetic oligonucleotide
  Target: ATXN1; (-) strand; PAM type: YTN; PAM sequence: TTT
tctacagctctgttgtgtgg

SEQ ID NO: 182392 - DNA, 20 bp, Artificial Sequence
  Description of Artificial Sequence: Synthetic oligonucleotide
  Target: ATXN1; (-) strand; PAM type: YTN; PAM sequence: CTA
atagtgaagttttctacagc

SEQ ID NO: 182393 - DNA, 20 bp, Artificial Sequence
  Description of Artificial Sequence: Synthetic oligonucleotide
  Target: ATXN1; (-) strand; PAM type: YTN; PAM sequence: TTC
taatagtgaagttttctaca

SEQ ID NO: 182394 - DNA, 20 bp, Artificial Sequence
  Description of Artificial Sequence: Synthetic oligonucleotide
  Target: ATXN1; (-) strand; PAM type: YTN; PAM sequence: TTT
ctaatagtgaagttttctac

SEQ ID NO: 182395 - DNA, 20 bp, Artificial Sequence
  Description of Artificial Sequence: Synthetic oligonucleotide
  Target: ATXN1; (-) strand; PAM type: YTN; PAM sequence: TTT
tctaatagtgaagttttcta

SEQ ID NO: 182396 - DNA, 20 bp, Artificial Sequence
  Description of Artificial Sequence: Synthetic oligonucleotide
  Target: ATXN1; (-) strand; PAM type: YTN; PAM sequence: TTG
ttttctaatagtgaagtttt

SEQ ID NO: 182397 - DNA, 20 bp, Artificial Sequence
  Description of Artificial Sequence: Synthetic oligonucleotide
  Target: ATXN1; (-) strand; PAM type: YTN; PAM sequence: TTT
gttttctaatagtgaagttt

SEQ ID NO: 182398 - DNA, 20 bp, Artificial Sequence
  Description of Artificial Sequence: Synthetic oligonucleotide
  Target: ATXN1; (-) strand; PAM type: YTN; PAM sequence: TTG
tttgttttctaatagtgaag

SEQ ID NO: 182399 - DNA, 20 bp, Artificial Sequence
  Description of Artificial Sequence: Synthetic oligonucleotide
  Target: ATXN1; (-) strand; PAM type: YTN; PAM sequence: CTG
ggttgtttgttttctaatag

SEQ ID NO: 182400 - DNA, 20 bp, Artificial Sequence
  Description of Artificial Sequence: Synthetic oligonucleotide
  Target: ATXN1; (-) strand; PAM type: YTN; PAM sequence: TTA
aaaactgggttgtttgtttt

SEQ ID NO: 182401 - DNA, 20 bp, Artificial Sequence
  Description of Artificial Sequence: Synthetic oligonucleotide
  Target: ATXN1; (-) strand; PAM type: YTN; PAM sequence: TTT
aaaaactgggttgtttgttt

SEQ ID NO: 182402 - DNA, 20 bp, Artificial Sequence
  Description of Artificial Sequence: Synthetic oligonucleotide
  Target: ATXN1; (-) strand; PAM type: YTN; PAM sequence: TTT
taaaaactgggttgtttgtt

SEQ ID NO: 182403 - DNA, 20 bp, Artificial Sequence
  Description of Artificial Sequence: Synthetic oligonucleotide
  Target: ATXN1; (-) strand; PAM type: YTN; PAM sequence: TTG
tccattttaaaaactgggtt

SEQ ID NO: 182404 - DNA, 20 bp, Artificial Sequence
  Description of Artificial Sequence: Synthetic oligonucleotide
  Target: ATXN1; (-) strand; PAM type: YTN; PAM sequence: TTT
gtccattttaaaaactgggt

SEQ ID NO: 182405 - DNA, 20 bp, Artificial Sequence
  Description of Artificial Sequence: Synthetic oligonucleotide
  Target: ATXN1; (-) strand; PAM type: YTN; PAM sequence: TTT
tgtccattttaaaaactggg

SEQ ID NO: 182406 - DNA, 20 bp, Artificial Sequence
  Description of Artificial Sequence: Synthetic oligonucleotide
  Target: ATXN1; (-) strand; PAM type: YTN; PAM sequence: CTT
ttgtccattttaaaaactgg

SEQ ID NO: 182407 - DNA, 20 bp, Artificial Sequence
  Description of Artificial Sequence: Synthetic oligonucleotide
  Target: ATXN1; (-) strand; PAM type: YTN; PAM sequence: CTG
gtcaggtcttttgtccattt

SEQ ID NO: 182408 - DNA, 20 bp, Artificial Sequence
  Description of Artificial Sequence: Synthetic oligonucleotide
  Target: ATXN1; (-) strand; PAM type: YTN; PAM sequence: TTG
gtaaggtgtctggtcaggtc

SEQ ID NO: 182409 - DNA, 20 bp, Artificial Sequence
  Description of Artificial Sequence: Synthetic oligonucleotide
  Target: ATXN1; (-) strand; PAM type: YTN; PAM sequence: TTT
ggtaaggtgtctggtcaggt

SEQ ID NO: 182410 - DNA, 20 bp, Artificial Sequence
  Description of Artificial Sequence: Synthetic oligonucleotide
  Target: ATXN1; (-) strand; PAM type: YTN; PAM sequence: CTA
atttggtaaggtgtctggtc

SEQ ID NO: 182411 - DNA, 20 bp, Artificial Sequence
  Description of Artificial Sequence: Synthetic oligonucleotide
  Target: ATXN1; (-) strand; PAM type: YTN; PAM sequence: CTA
tgtctaatttggtaaggtgt

SEQ ID NO: 182412 - DNA, 20 bp, Artificial Sequence
  Description of Artificial Sequence: Synthetic oligonucleotide
  Target: ATXN1; (-) strand; PAM type: YTN; PAM sequence: CTC
tatgtctaatttggtaaggt

SEQ ID NO: 182413 - DNA, 20 bp, Artificial Sequence
  Description of Artificial Sequence: Synthetic oligonucleotide
  Target: ATXN1; (-) strand; PAM type: YTN; PAM sequence: TTG
ccatctctatgtctaatttg

SEQ ID NO: 182414 - DNA, 20 bp, Artificial Sequence
  Description of Artificial Sequence: Synthetic oligonucleotide
  Target: ATXN1; (-) strand; PAM type: YTN; PAM sequence: CTT
gccatctctatgtctaattt

SEQ ID NO: 182415 - DNA, 20 bp, Artificial Sequence
  Description of Artificial Sequence: Synthetic oligonucleotide
  Target: ATXN1; (-) strand; PAM type: YTN; PAM sequence: TTA
cttgccatctctatgtctaa

SEQ ID NO: 182416 - DNA, 20 bp, Artificial Sequence
  Description of Artificial Sequence: Synthetic oligonucleotide
  Target: ATXN1; (-) strand; PAM type: YTN; PAM sequence: CTT
acttgccatctctatgtcta

SEQ ID NO: 182417 - DNA, 20 bp, Artificial Sequence
  Description of Artificial Sequence: Synthetic oligonucleotide
  Target: ATXN1; (-) strand; PAM type: YTN; PAM sequence: TTA
tgtgcttacttgccatctct

SEQ ID NO: 182418 - DNA, 20 bp, Artificial Sequence
  Description of Artificial Sequence: Synthetic oligonucleotide
  Target: ATXN1; (-) strand; PAM type: YTN; PAM sequence: TTT
atgtgcttacttgccatctc

SEQ ID NO: 182419 - DNA, 20 bp, Artificial Sequence
  Description of Artificial Sequence: Synthetic oligonucleotide
  Target: ATXN1; (-) strand; PAM type: YTN; PAM sequence: TTT
tatgtgcttacttgccatct

SEQ ID NO: 182420 - DNA, 20 bp, Artificial Sequence
  Description of Artificial Sequence: Synthetic oligonucleotide
  Target: ATXN1; (-) strand; PAM type: YTN; PAM sequence: TTT
ttatgtgcttacttgccatc

SEQ ID NO: 182421 - DNA, 20 bp, Artificial Sequence
  Description of Artificial Sequence: Synthetic oligonucleotide
  Target: ATXN1; (-) strand; PAM type: YTN; PAM sequence: CTT
tttatgtgcttacttgccat

SEQ ID NO: 182422 - DNA, 20 bp, Artificial Sequence
  Description of Artificial Sequence: Synthetic oligonucleotide
  Target: ATXN1; (-) strand; PAM type: YTN; PAM sequence: TTC
ataatgtggagcatcttttt

SEQ ID NO: 182423 - DNA, 20 bp, Artificial Sequence
  Description of Artificial Sequence: Synthetic oligonucleotide
  Target: ATXN1; (-) strand; PAM type: YTN; PAM sequence: CTA
gtgattcataatgtggagca

SEQ ID NO: 182424 - DNA, 20 bp, Artificial Sequence
  Description of Artificial Sequence: Synthetic oligonucleotide
  Target: ATXN1; (-) strand; PAM type: YTN; PAM sequence: TTC
cctagtgattcataatgtgg

SEQ ID NO: 182425 - DNA, 20 bp, Artificial Sequence
  Description of Artificial Sequence: Synthetic oligonucleotide
  Target: ATXN1; (-) strand; PAM type: YTN; PAM sequence: TTC
acagttccctagtgattcat

SEQ ID NO: 182426 - DNA, 20 bp, Artificial Sequence
  Description of Artificial Sequence: Synthetic oligonucleotide
  Target: ATXN1; (-) strand; PAM type: YTN; PAM sequence: TTA
attcacagttccctagtgat

SEQ ID NO: 182427 - DNA, 20 bp, Artificial Sequence
  Description of Artificial Sequence: Synthetic oligonucleotide
  Target: ATXN1; (-) strand; PAM type: YTN; PAM sequence: TTT
aattcacagttccctagtga

SEQ ID NO: 182428 - DNA, 20 bp, Artificial Sequence
  Description of Artificial Sequence: Synthetic oligonucleotide
  Target: ATXN1; (-) strand; PAM type: YTN; PAM sequence: TTT
taattcacagttccctagtg

SEQ ID NO: 182429 - DNA, 20 bp, Artificial Sequence
  Description of Artificial Sequence: Synthetic oligonucleotide
  Target: ATXN1; (-) strand; PAM type: YTN; PAM sequence: TTG
ttttaattcacagttcccta

SEQ ID NO: 182430 - DNA, 20 bp, Artificial Sequence
  Description of Artificial Sequence: Synthetic oligonucleotide
  Target: ATXN1; (-) strand; PAM type: YTN; PAM sequence: TTT
gttttaattcacagttccct

SEQ ID NO: 182431 - DNA, 20 bp, Artificial Sequence
  Description of Artificial Sequence: Synthetic oligonucleotide
  Target: ATXN1; (-) strand; PAM type: YTN; PAM sequence: TTG
tgtttgttttaattcacagt

SEQ ID NO: 182432 - DNA, 20 bp, Artificial Sequence
  Description of Artificial Sequence: Synthetic oligonucleotide
  Target: ATXN1; (-) strand; PAM type: YTN; PAM sequence: CTT
gtgtttgttttaattcacag

SEQ ID NO: 182433 - DNA, 20 bp, Artificial Sequence
  Description of Artificial Sequence: Synthetic oligonucleotide
  Target: ATXN1; (-) strand; PAM type: YTN; PAM sequence: TTC
ataggtggtatcttgtgttt

SEQ ID NO: 182434 - DNA, 20 bp, Artificial Sequence
  Description of Artificial Sequence: Synthetic oligonucleotide
  Target: ATXN1; (-) strand; PAM type: YTN; PAM sequence: TTT
cataggtggtatcttgtgtt

SEQ ID NO: 182435 - DNA, 20 bp, Artificial Sequence
  Description of Artificial Sequence: Synthetic oligonucleotide
  Target: ATXN1; (-) strand; PAM type: YTN; PAM sequence: TTT
tcataggtggtatcttgtgt

SEQ ID NO: 182436 - DNA, 20 bp, Artificial Sequence
  Description of Artificial Sequence: Synthetic oligonucleotide
  Target: ATXN1; (-) strand; PAM type: YTN; PAM sequence: TTG
gccattttcataggtggtat

SEQ ID NO: 182437 - DNA, 20 bp, Artificial Sequence
  Description of Artificial Sequence: Synthetic oligonucleotide
  Target: ATXN1; (-) strand; PAM type: YTN; PAM sequence: TTT
ggccattttcataggtggta

SEQ ID NO: 182438 - DNA, 20 bp, Artificial Sequence
  Description of Artificial Sequence: Synthetic oligonucleotide
  Target: ATXN1; (-) strand; PAM type: YTN; PAM sequence: TTT
tggccattttcataggtggt

SEQ ID NO: 182439 - DNA, 20 bp, Artificial Sequence
  Description of Artificial Sequence: Synthetic oligonucleotide
  Target: ATXN1; (-) strand; PAM type: YTN; PAM sequence: TTG
gattttggccattttcatag

SEQ ID NO: 182440 - DNA, 20 bp, Artificial Sequence
  Description of Artificial Sequence: Synthetic oligonucleotide
  Target: ATXN1; (-) strand; PAM type: YTN; PAM sequence: TTG
gcagtgtgttggattttggc

SEQ ID NO: 182441 - DNA, 20 bp, Artificial Sequence
  Description of Artificial Sequence: Synthetic oligonucleotide
  Target: ATXN1; (-) strand; PAM type: YTN; PAM sequence: CTG
ttggcagtgtgttggatttt

SEQ ID NO: 182442 - DNA, 20 bp, Artificial Sequence
  Description of Artificial Sequence: Synthetic oligonucleotide
  Target: ATXN1; (-) strand; PAM type: YTN; PAM sequence: CTG
ctgttggcagtgtgttggat

SEQ ID NO: 182443 - DNA, 20 bp, Artificial Sequence
  Description of Artificial Sequence: Synthetic oligonucleotide
  Target: ATXN1; (-) strand; PAM type: YTN; PAM sequence: TTG
ccagcatctgctgttggcag

SEQ ID NO: 182444 - DNA, 20 bp, Artificial Sequence
  Description of Artificial Sequence: Synthetic oligonucleotide
  Target: ATXN1; (-) strand; PAM type: YTN; PAM sequence: CTT
gccagcatctgctgttggca

SEQ ID NO: 182445 - DNA, 20 bp, Artificial Sequence
  Description of Artificial Sequence: Synthetic oligonucleotide
  Target: ATXN1; (-) strand; PAM type: YTN; PAM sequence: CTG
catccttgccagcatctgct

SEQ ID NO: 182446 - DNA, 20 bp, Artificial Sequence
  Description of Artificial Sequence: Synthetic oligonucleotide
  Target: ATXN1; (-) strand; PAM type: YTN; PAM sequence: CTC
tgcatccttgccagcatctg

SEQ ID NO: 182447 - DNA, 20 bp, Artificial Sequence
  Description of Artificial Sequence: Synthetic oligonucleotide
  Target: ATXN1; (-) strand; PAM type: YTN; PAM sequence: CTA
tggctctgcatccttgccag

SEQ ID NO: 182448 - DNA, 20 bp, Artificial Sequence
  Description of Artificial Sequence: Synthetic oligonucleotide
  Target: ATXN1; (-) strand; PAM type: YTN; PAM sequence: TTC
ctatggctctgcatccttgc

SEQ ID NO: 182449 - DNA, 20 bp, Artificial Sequence
  Description of Artificial Sequence: Synthetic oligonucleotide
  Target: ATXN1; (-) strand; PAM type: YTN; PAM sequence: TTG
agagttcctatggctctgca

SEQ ID NO: 182450 - DNA, 20 bp, Artificial Sequence
  Description of Artificial Sequence: Synthetic oligonucleotide
  Target: ATXN1; (-) strand; PAM type: YTN; PAM sequence: CTT
gagagttcctatggctctgc

SEQ ID NO: 182451 - DNA, 20 bp, Artificial Sequence
  Description of Artificial Sequence: Synthetic oligonucleotide
  Target: ATXN1; (-) strand; PAM type: YTN; PAM sequence: TTC
ccacccgcaatgacttgaga

SEQ ID NO: 182452 - DNA, 20 bp, Artificial Sequence
  Description of Artificial Sequence: Synthetic oligonucleotide
  Target: ATXN1; (-) strand; PAM type: YTN; PAM sequence: TTG
cattcccacccgcaatgact

SEQ ID NO: 182453 - DNA, 20 bp, Artificial Sequence
  Description of Artificial Sequence: Synthetic oligonucleotide
  Target: ATXN1; (-) strand; PAM type: YTN; PAM sequence: TTT
gcattcccacccgcaatgac

SEQ ID NO: 182454 - DNA, 20 bp, Artificial Sequence
  Description of Artificial Sequence: Synthetic oligonucleotide
  Target: ATXN1; (-) strand; PAM type: YTN; PAM sequence: CTA
tttgcattcccacccgcaat

SEQ ID NO: 182455 - DNA, 20 bp, Artificial Sequence
  Description of Artificial Sequence: Synthetic oligonucleotide
  Target: ATXN1; (-) strand; PAM type: YTN; PAM sequence: TTA
ctatttgcattcccacccgc

SEQ ID NO: 182456 - DNA, 20 bp, Artificial Sequence
  Description of Artificial Sequence: Synthetic oligonucleotide
  Target: ATXN1; (-) strand; PAM type: YTN; PAM sequence: CTT
actatttgcattcccacccg

SEQ ID NO: 182457 - DNA, 20 bp, Artificial Sequence
  Description of Artificial Sequence: Synthetic oligonucleotide
  Target: ATXN1; (-) strand; PAM type: YTN; PAM sequence: TTC
ccaagtagcttactatttgc

SEQ ID NO: 182458 - DNA, 20 bp, Artificial Sequence
  Description of Artificial Sequence: Synthetic oligonucleotide
  Target: ATXN1; (-) strand; PAM type: YTN; PAM sequence: TTT
cccaagtagcttactatttg

SEQ ID NO: 182459 - DNA, 20 bp, Artificial Sequence
  Description of Artificial Sequence: Synthetic oligonucleotide
  Target: ATXN1; (-) strand; PAM type: YTN; PAM sequence: TTT
tcccaagtagcttactattt

SEQ ID NO: 182460 - DNA, 20 bp, Artificial Sequence
  Description of Artificial Sequence: Synthetic oligonucleotide
  Target: ATXN1; (-) strand; PAM type: YTN; PAM sequence: CTG
ttttcccaagtagcttacta

SEQ ID NO: 182461 - DNA, 20 bp, Artificial Sequence
  Description of Artificial Sequence: Synthetic oligonucleotide
  Target: ATXN1; (-) strand; PAM type: YTN; PAM sequence: CTG
ccaaactgttttcccaagta

SEQ ID NO: 182462 - DNA, 20 bp, Artificial Sequence
  Description of Artificial Sequence: Synthetic oligonucleotide
  Target: ATXN1; (-) strand; PAM type: YTN; PAM sequence: TTG
taggaaactgccaaactgtt

SEQ ID NO: 182463 - DNA, 20 bp, Artificial Sequence
  Description of Artificial Sequence: Synthetic oligonucleotide
  Target: ATXN1; (-) strand; PAM type: YTN; PAM sequence: TTT
gtaggaaactgccaaactgt

SEQ ID NO: 182464 - DNA, 20 bp, Artificial Sequence
  Description of Artificial Sequence: Synthetic oligonucleotide
  Target: ATXN1; (-) strand; PAM type: YTN; PAM sequence: CTT
tgtaggaaactgccaaactg

SEQ ID NO: 182465 - DNA, 20 bp, Artificial Sequence
  Description of Artificial Sequence: Synthetic oligonucleotide
  Target: ATXN1; (-) strand; PAM type: YTN; PAM sequence: TTA
gctttgtaggaaactgccaa

SEQ ID NO: 182466 - DNA, 20 bp, Artificial Sequence
  Description of Artificial Sequence: Synthetic oligonucleotide
  Target: ATXN1; (-) strand; PAM type: YTN; PAM sequence: TTT
agctttgtaggaaactgcca

SEQ ID NO: 182467 - DNA, 20 bp, Artificial Sequence
  Description of Artificial Sequence: Synthetic oligonucleotide
  Target: ATXN1; (-) strand; PAM type: YTN; PAM sequence: TTA
agagtatgtttagctttgta

SEQ ID NO: 182468 - DNA, 20 bp, Artificial Sequence
  Description of Artificial Sequence: Synthetic oligonucleotide
  Target: ATXN1; (-) strand; PAM type: YTN; PAM sequence: TTG
catgttaagagtatgtttag

SEQ ID NO: 182469 - DNA, 20 bp, Artificial Sequence
  Description of Artificial Sequence: Synthetic oligonucleotide
  Target: ATXN1; (-) strand; PAM type: YTN; PAM sequence: TTG
ccacattgcatgttaagagt

SEQ ID NO: 182470 - DNA, 20 bp, Artificial Sequence
  Description of Artificial Sequence: Synthetic oligonucleotide
  Target: ATXN1; (-) strand; PAM type: YTN; PAM sequence: CTT
gccacattgcatgttaagag

SEQ ID NO: 182471 - DNA, 20 bp, Artificial Sequence
  Description of Artificial Sequence: Synthetic oligonucleotide
  Target: ATXN1; (-) strand; PAM type: YTN; PAM sequence: TTG
tgtagataccaaggagcatg

SEQ ID NO: 182472 - DNA, 20 bp, Artificial Sequence
  Description of Artificial Sequence: Synthetic oligonucleotide
  Target: ATXN1; (-) strand; PAM type: YTN; PAM sequence: TTT
gtgtagataccaaggagcat

SEQ ID NO: 182473 - DNA, 20 bp, Artificial Sequence
  Description of Artificial Sequence: Synthetic oligonucleotide
  Target: ATXN1; (-) strand; PAM type: YTN; PAM sequence: TTA
tttgtgtagataccaaggag

SEQ ID NO: 182474 - DNA, 20 bp, Artificial Sequence
  Description of Artificial Sequence: Synthetic oligonucleotide
  Target: ATXN1; (-) strand; PAM type: YTN; PAM sequence: TTT
atttgtgtagataccaagga

SEQ ID NO: 182475 - DNA, 20 bp, Artificial Sequence
  Description of Artificial Sequence: Synthetic oligonucleotide
  Target: ATXN1; (-) strand; PAM type: YTN; PAM sequence: TTA
gtttatttgtgtagatacca

SEQ ID NO: 182476 - DNA, 20 bp, Artificial Sequence
  Description of Artificial Sequence: Synthetic oligonucleotide
  Target: ATXN1; (-) strand; PAM type: YTN; PAM sequence: TTT
agtttatttgtgtagatacc

SEQ ID NO: 182477 - DNA, 20 bp, Artificial Sequence
  Description of Artificial Sequence: Synthetic oligonucleotide
  Target: ATXN1; (-) strand; PAM type: YTN; PAM sequence: TTT
tagtttatttgtgtagatac

SEQ ID NO: 182478 - DNA, 20 bp, Artificial Sequence
  Description of Artificial Sequence: Synthetic oligonucleotide
  Target: ATXN1; (-) strand; PAM type: YTN; PAM sequence: TTT
ttagtttatttgtgtagata

SEQ ID NO: 182479 - DNA, 20 bp, Artificial Sequence
  Description of Artificial Sequence: Synthetic oligonucleotide
  Target: ATXN1; (-) strand; PAM type: YTN; PAM sequence: TTA
agtttttagtttatttgtgt

SEQ ID NO: 182480 - DNA, 20 bp, Artificial Sequence
  Description of Artificial Sequence: Synthetic oligonucleotide
  Target: ATXN1; (-) strand; PAM type: YTN; PAM sequence: CTT
aagtttttagtttatttgtg

SEQ ID NO: 182481 - DNA, 20 bp, Artificial Sequence
  Description of Artificial Sequence: Synthetic oligonucleotide
  Target: ATXN1; (-) strand; PAM type: YTN; PAM sequence: TTG
tgtggacttaagtttttagt

SEQ ID NO: 182482 - DNA, 20 bp, Artificial Sequence
  Description of Artificial Sequence: Synthetic oligonucleotide
  Target: ATXN1; (-) strand; PAM type: YTN; PAM sequence: TTT
gtgtggacttaagtttttag

SEQ ID NO: 182483 - DNA, 20 bp, Artificial Sequence
  Description of Artificial Sequence: Synthetic oligonucleotide
  Target: ATXN1; (-) strand; PAM type: YTN; PAM sequence: TTT
tgtgtggacttaagttttta

SEQ ID NO: 182484 - DNA, 20 bp, Artificial Sequence
  Description of Artificial Sequence: Synthetic oligonucleotide
  Target: ATXN1; (-) strand; PAM type: YTN; PAM sequence: TTT
ttgtgtggacttaagttttt

SEQ ID NO: 182485 - DNA, 20 bp, Artificial Sequence
  Description of Artificial Sequence: Synthetic oligonucleotide
  Target: ATXN1; (-) strand; PAM type: YTN; PAM sequence: TTG
agtgcaggtttttgtgtgga

SEQ ID NO: 182486 - DNA, 20 bp, Artificial Sequence
  Description of Artificial Sequence: Synthetic oligonucleotide
  Target: ATXN1; (-) strand; PAM type: YTN; PAM sequence: TTT
gagtgcaggtttttgtgtgg

SEQ ID NO: 182487 - DNA, 20 bp, Artificial Sequence
  Description of Artificial Sequence: Synthetic oligonucleotide
  Target: ATXN1; (-) strand; PAM type: YTN; PAM sequence: CTA
taaacatttgagtgcaggtt

SEQ ID NO: 182488 - DNA, 20 bp, Artificial Sequence
  Description of Artificial Sequence: Synthetic oligonucleotide
  Target: ATXN1; (-) strand; PAM type: YTN; PAM sequence: CTG
ctataaacatttgagtgcag

SEQ ID NO: 182489 - DNA, 20 bp, Artificial Sequence
  Description of Artificial Sequence: Synthetic oligonucleotide
  Target: ATXN1; (-) strand; PAM type: YTN; PAM sequence: TTA
tgaatgaagctgctataaac

SEQ ID NO: 182490 - DNA, 20 bp, Artificial Sequence
  Description of Artificial Sequence: Synthetic oligonucleotide
  Target: ATXN1; (-) strand; PAM type: YTN; PAM sequence: TTC
acgattatgaatgaagctgc

SEQ ID NO: 182491 - DNA, 20 bp, Artificial Sequence
  Description of Artificial Sequence: Synthetic oligonucleotide
  Target: ATXN1; (-) strand; PAM type: YTN; PAM sequence: TTC
atgtacccattcacgattat

SEQ ID NO: 182492 - DNA, 20 bp, Artificial Sequence
  Description of Artificial Sequence: Synthetic oligonucleotide
  Target: ATXN1; (-) strand; PAM type: YTN; PAM sequence: TTG
tatggatgtaccacagttca

SEQ ID NO: 182493 - DNA, 20 bp, Artificial Sequence
  Description of Artificial Sequence: Synthetic oligonucleotide
  Target: ATXN1; (-) strand; PAM type: YTN; PAM sequence: CTA
ttgtatggatgtaccacagt

SEQ ID NO: 182494 - DNA, 20 bp, Artificial Sequence
  Description of Artificial Sequence: Synthetic oligonucleotide
  Target: ATXN1; (-) strand; PAM type: YTN; PAM sequence: TTC
tattgtatggatgtaccaca

SEQ ID NO: 182495 - DNA, 20 bp, Artificial Sequence
  Description of Artificial Sequence: Synthetic oligonucleotide
  Target: ATXN1; (-) strand; PAM type: YTN; PAM sequence: CTG
aataatattctattgtatgg

SEQ ID NO: 182496 - DNA, 20 bp, Artificial Sequence
  Description of Artificial Sequence: Synthetic oligonucleotide
  Target: ATXN1; (-) strand; PAM type: YTN; PAM sequence: TTA
gtgctgaataatattctatt

SEQ ID NO: 182497 - DNA, 20 bp, Artificial Sequence
  Description of Artificial Sequence: Synthetic oligonucleotide
  Target: ATXN1; (-) strand; PAM type: YTN; PAM sequence: TTT
agtgctgaataatattctat

SEQ ID NO: 182498 - DNA, 20 bp, Artificial Sequence
  Description of Artificial Sequence: Synthetic oligonucleotide
  Target: ATXN1; (-) strand; PAM type: YTN; PAM sequence: TTT
tagtgctgaataatattcta

SEQ ID NO: 182499 - DNA, 20 bp, Artificial Sequence
  Description of Artificial Sequence: Synthetic oligonucleotide
  Target: ATXN1; (-) strand; PAM type: YTN; PAM sequence: TTT
ttagtgctgaataatattct

SEQ ID NO: 182500 - DNA, 20 bp, Artificial Sequence
  Description of Artificial Sequence: Synthetic oligonucleotide
  Target: ATXN1; (-) strand; PAM type: YTN; PAM sequence: TTG
tttttagtgctgaataatat

SEQ ID NO: 182501 - DNA, 20 bp, Artificial Sequence
  Description of Artificial Sequence: Synthetic oligonucleotide
  Target: ATXN1; (-) strand; PAM type: YTN; PAM sequence: TTT
gtttttagtgctgaataata

SEQ ID NO: 182502 - DNA, 20 bp, Artificial Sequence
  Description of Artificial Sequence: Synthetic oligonucleotide
  Target: ATXN1; (-) strand; PAM type: YTN; PAM sequence: TTA
tttgtttttagtgctgaata

SEQ ID NO: 182503 - DNA, 20 bp, Artificial Sequence
  Description of Artificial Sequence: Synthetic oligonucleotide
  Target: ATXN1; (-) strand; PAM type: YTN; PAM sequence: CTT
atttgtttttagtgctgaat

SEQ ID NO: 182504 - DNA, 20 bp, Artificial Sequence
  Description of Artificial Sequence: Synthetic oligonucleotide
  Target: ATXN1; (-) strand; PAM type: YTN; PAM sequence: CTG
aaagcttatttgtttttagt

SEQ ID NO: 182505 - DNA, 20 bp, Artificial Sequence
  Description of Artificial Sequence: Synthetic oligonucleotide
  Target: ATXN1; (-) strand; PAM type: YTN; PAM sequence: TTA
tggcctgaaagcttatttgt

SEQ ID NO: 182506 - DNA, 20 bp, Artificial Sequence
  Description of Artificial Sequence: Synthetic oligonucleotide
  Target: ATXN1; (-) strand; PAM type: YTN; PAM sequence: TTT
atggcctgaaagcttatttg

SEQ ID NO: 182507 - DNA, 20 bp, Artificial Sequence
  Description of Artificial Sequence: Synthetic oligonucleotide
  Target: ATXN1; (-) strand; PAM type: YTN; PAM sequence: TTT
tatggcctgaaagcttattt

SEQ ID NO: 182508 - DNA, 20 bp, Artificial Sequence
  Description of Artificial Sequence: Synthetic oligonucleotide
  Target: ATXN1; (-) strand; PAM type: YTN; PAM sequence: TTT
ttatggcctgaaagcttatt

SEQ ID NO: 182509 - DNA, 20 bp, Artificial Sequence
  Description of Artificial Sequence: Synthetic oligonucleotide
  Target: ATXN1; (-) strand; PAM type: YTN; PAM sequence: CTC
atttttatggcctgaaagct

SEQ ID NO: 182510 - DNA, 20 bp, Artificial Sequence
  Description of Artificial Sequence: Synthetic oligonucleotide
  Target: ATXN1; (-) strand; PAM type: YTN; PAM sequence: CTC
tcatttttatggcctgaaag

SEQ ID NO: 182511 - DNA, 20 bp, Artificial Sequence
  Description of Artificial Sequence: Synthetic oligonucleotide
  Target: ATXN1; (-) strand; PAM type: YTN; PAM sequence: TTC
acctctcatttttatggcct

SEQ ID NO: 182512 - DNA, 20 bp, Artificial Sequence
  Description of Artificial Sequence: Synthetic oligonucleotide
  Target: ATXN1; (-) strand; PAM type: YTN; PAM sequence: CTT
cacctctcatttttatggcc

SEQ ID NO: 182513 - DNA, 20 bp, Artificial Sequence
  Description of Artificial Sequence: Synthetic oligonucleotide
  Target: ATXN1; (-) strand; PAM type: YTN; PAM sequence: CTG
gcttcacctctcatttttat

SEQ ID NO: 182514 - DNA, 20 bp, Artificial Sequence
  Description of Artificial Sequence: Synthetic oligonucleotide
  Target: ATXN1; (-) strand; PAM type: YTN; PAM sequence: CTC
aacccaggaagtccagctgg

SEQ ID NO: 182515 - DNA, 20 bp, Artificial Sequence
  Description of Artificial Sequence: Synthetic oligonucleotide
  Target: ATXN1; (-) strand; PAM type: YTN; PAM sequence: TTC
cccaagtccccactcaaccc

SEQ ID NO: 182516 - DNA, 20 bp, Artificial Sequence
  Description of Artificial Sequence: Synthetic oligonucleotide
  Target: ATXN1; (-) strand; PAM type: YTN; PAM sequence: TTT
ccccaagtccccactcaacc

SEQ ID NO: 182517 - DNA, 20 bp, Artificial Sequence
  Description of Artificial Sequence: Synthetic oligonucleotide
  Target: ATXN1; (-) strand; PAM type: YTN; PAM sequence: TTG
taggacgggaaatttcccca

SEQ ID NO: 182518 - DNA, 20 bp, Artificial Sequence
  Description of Artificial Sequence: Synthetic oligonucleotide
  Target: ATXN1; (-) strand; PAM type: YTN; PAM sequence: TTT
gtaggacgggaaatttcccc

SEQ ID NO: 182519 - DNA, 20 bp, Artificial Sequence
  Description of Artificial Sequence: Synthetic oligonucleotide
  Target: ATXN1; (-) strand; PAM type: YTN; PAM sequence: TTT
tgtaggacgggaaatttccc

SEQ ID NO: 182520 - DNA, 20 bp, Artificial Sequence
  Description of Artificial Sequence: Synthetic oligonucleotide
  Target: ATXN1; (-) strand; PAM type: YTN; PAM sequence: CTT
ttgtaggacgggaaatttcc

SEQ ID NO: 182521 - DNA, 20 bp, Artificial Sequence
  Description of Artificial Sequence: Synthetic oligonucleotide
  Target: ATXN1; (-) strand; PAM type: YTN; PAM sequence: TTA
caatccttttgtaggacggg

SEQ ID NO: 182522 - DNA, 20 bp, Artificial Sequence
  Description of Artificial Sequence: Synthetic oligonucleotide
  Target: ATXN1; (-) strand; PAM type: YTN; PAM sequence: TTT
acaatccttttgtaggacgg

SEQ ID NO: 182523 - DNA, 20 bp, Artificial Sequence
  Description of Artificial Sequence: Synthetic oligonucleotide
  Target: ATXN1; (-) strand; PAM type: YTN; PAM sequence: TTT
tacaatccttttgtaggacg

SEQ ID NO: 182524 - DNA, 20 bp, Artificial Sequence
  Description of Artificial Sequence: Synthetic oligonucleotide
  Target: ATXN1; (-) strand; PAM type: YTN; PAM sequence: TTG
gtgtgttttacaatcctttt

SEQ ID NO: 182525 - DNA, 20 bp, Artificial Sequence
  Description of Artificial Sequence: Synthetic oligonucleotide
  Target: ATXN1; (-) strand; PAM type: YTN; PAM sequence: CTG
attggtgtgttttacaatcc

SEQ ID NO: 182526 - DNA, 20 bp, Artificial Sequence
  Description of Artificial Sequence: Synthetic oligonucleotide
  Target: ATXN1; (-) strand; PAM type: YTN; PAM sequence: TTC
ctgattggtgtgttttacaa

SEQ ID NO: 182527 - DNA, 20 bp, Artificial Sequence
  Description of Artificial Sequence: Synthetic oligonucleotide
  Target: ATXN1; (-) strand; PAM type: YTN; PAM sequence: TTA
taagacaggaaagttcctga

SEQ ID NO: 182528 - DNA, 20 bp, Artificial Sequence
  Description of Artificial Sequence: Synthetic oligonucleotide
  Target: ATXN1; (-) strand; PAM type: YTN; PAM sequence: CTT
ataagacaggaaagttcctg

SEQ ID NO: 182529 - DNA, 20 bp, Artificial Sequence
  Description of Artificial Sequence: Synthetic oligonucleotide
  Target: ATXN1; (-) strand; PAM type: YTN; PAM sequence: CTC
ttataagacaggaaagttcc

SEQ ID NO: 182530 - DNA, 20 bp, Artificial Sequence
  Description of Artificial Sequence: Synthetic oligonucleotide
  Target: ATXN1; (-) strand; PAM type: YTN; PAM sequence: TTA
caaacctcttataagacagg

SEQ ID NO: 182531 - DNA, 20 bp, Artificial Sequence
  Description of Artificial Sequence: Synthetic oligonucleotide
  Target: ATXN1; (-) strand; PAM type: YTN; PAM sequence: TTT
acaaacctcttataagacag

SEQ ID NO: 182532 - DNA, 20 bp, Artificial Sequence
  Description of Artificial Sequence: Synthetic oligonucleotide
  Target: ATXN1; (-) strand; PAM type: YTN; PAM sequence: CTT
tacaaacctcttataagaca

SEQ ID NO: 182533 - DNA, 20 bp, Artificial Sequence
  Description of Artificial Sequence: Synthetic oligonucleotide
  Target: ATXN1; (-) strand; PAM type: YTN; PAM sequence: TTG
gtgcgctttacaaacctctt

SEQ ID NO: 182534 - DNA, 20 bp, Artificial Sequence
  Description of Artificial Sequence: Synthetic oligonucleotide
  Target: ATXN1; (-) strand; PAM type: YTN; PAM sequence: CTG
attggtgcgctttacaaacc

SEQ ID NO: 182535 - DNA, 20 bp, Artificial Sequence
  Description of Artificial Sequence: Synthetic oligonucleotide
  Target: ATXN1; (-) strand; PAM type: YTN; PAM sequence: TTA
ccaagtgctgattggtgcgc

SEQ ID NO: 182536 - DNA, 20 bp, Artificial Sequence
  Description of Artificial Sequence: Synthetic oligonucleotide
  Target: ATXN1; (-) strand; PAM type: YTN; PAM sequence: TTT
accaagtgctgattggtgcg

SEQ ID NO: 182537 - DNA, 20 bp, Artificial Sequence
  Description of Artificial Sequence: Synthetic oligonucleotide
  Target: ATXN1; (-) strand; PAM type: YTN; PAM sequence: TTT
taccaagtgctgattggtgc

SEQ ID NO: 182538 - DNA, 20 bp, Artificial Sequence
  Description of Artificial Sequence: Synthetic oligonucleotide
  Target: ATXN1; (-) strand; PAM type: YTN; PAM sequence: TTG
gtgcattttaccaagtgctg

SEQ ID NO: 182539 - DNA, 20 bp, Artificial Sequence
  Description of Artificial Sequence: Synthetic oligonucleotide
  Target: ATXN1; (-) strand; PAM type: YTN; PAM sequence: TTG
attggtgcattttaccaagt

SEQ ID NO: 182540 - DNA, 20 bp, Artificial Sequence
  Description of Artificial Sequence: Synthetic oligonucleotide
  Target: ATXN1; (-) strand; PAM type: YTN; PAM sequence: TTA
cagagcgttgattggtgcat

SEQ ID NO: 182541 - DNA, 20 bp, Artificial Sequence
  Description of Artificial Sequence: Synthetic oligonucleotide
  Target: ATXN1; (-) strand; PAM type: YTN; PAM sequence: TTT
acagagcgttgattggtgca

SEQ ID NO: 182542 - DNA, 20 bp, Artificial Sequence
  Description of Artificial Sequence: Synthetic oligonucleotide
  Target: ATXN1; (-) strand; PAM type: YTN; PAM sequence: TTT
tacagagcgttgattggtgc

SEQ ID NO: 182543 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacagagcgttg

SEQ ID NO: 182544 - DNA, 20 bp, Artificial Sequence
  Description of Artificial Sequence: Synthetic oligonucleotide
  Target: ATXN1; (-) strand; PAM type: YTN; PAM sequence: TTG
attggtgcattttacagagc

SEQ ID NO: 182545 - DNA, 20 bp, Artificial Sequence
  Description of Artificial Sequence: Synthetic oligonucleotide
  Target: ATXN1; (-) strand; PAM type: YTN; PAM sequence: TTA
cagagcgttgattggtgcat

SEQ ID NO: 182546 - DNA, 20 bp, Artificial Sequence
  Description of Artificial Sequence: Synthetic oligonucleotide
  Target: ATXN1; (-) strand; PAM type: YTN; PAM sequence: TTT
acagagcgttgattggtgca

SEQ ID NO: 182547 - DNA, 20 bp, Artificial Sequence
  Description of Artificial Sequence: Synthetic oligonucleotide
  Target: ATXN1; (-) strand; PAM type: YTN; PAM sequence: TTT
tacagagcgttgattggtgc

SEQ ID NO: 182548 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacagagcgttg

SEQ ID NO: 182549 - DNA, 20 bp, Artificial Sequence
  Description of Artificial Sequence: Synthetic oligonucleotide
  Target: ATXN1; (-) strand; PAM type: YTN; PAM sequence: CTG
attggtgcattttacagagc

SEQ ID NO: 182550 - DNA, 20 bp, Artificial Sequence
  Description of Artificial Sequence: Synthetic oligonucleotide
  Target: ATXN1; (-) strand; PAM type: YTN; PAM sequence: CTG
ctgattggtgcattttacag

SEQ ID NO: 182551 - DNA, 20 bp, Artificial Sequence
  Description of Artificial Sequence: Synthetic oligonucleotide
  Target: ATXN1; (-) strand; PAM type: YTN; PAM sequence: CTC
ctgctgattggtgcatttta

SEQ ID NO: 182552 - DNA, 20 bp, Artificial Sequence
  Description of Artificial Sequence: Synthetic oligonucleotide
  Target: ATXN1; (-) strand; PAM type: YTN; PAM sequence: TTA
tactcctgctgattggtgca

SEQ ID NO: 182553 - DNA, 20 bp, Artificial Sequence
  Description of Artificial Sequence: Synthetic oligonucleotide
  Target: ATXN1; (-) strand; PAM type: YTN; PAM sequence: TTT
atactcctgctgattggtgc

SEQ ID NO: 182554 - DNA, 20 bp, Artificial Sequence
  Description of Artificial Sequence: Synthetic oligonucleotide
  Target: ATXN1; (-) strand; PAM type: YTN; PAM sequence: TTT
tatactcctgctgattggtg

SEQ ID NO: 182555 - DNA, 20 bp, Artificial Sequence
  Description of Artificial Sequence: Synthetic oligonucleotide
  Target: ATXN1; (-) strand; PAM type: YTN; PAM sequence: CTT
ttatactcctgctgattggt

SEQ ID NO: 182556 - DNA, 20 bp, Artificial Sequence
  Description of Artificial Sequence: Synthetic oligonucleotide
  Target: ATXN1; (-) strand; PAM type: YTN; PAM sequence: CTA
cttttatactcctgctgatt

SEQ ID NO: 182557 - DNA, 20 bp, Artificial Sequence
  Description of Artificial Sequence: Synthetic oligonucleotide
  Target: ATXN1; (-) strand; PAM type: YTN; PAM sequence: TTG
gctacttttatactcctgct

SEQ ID NO: 182558 - DNA, 20 bp, Artificial Sequence
  Description of Artificial Sequence: Synthetic oligonucleotide
  Target: ATXN1; (-) strand; PAM type: YTN; PAM sequence: CTG
cgattggctacttttatact

SEQ ID NO: 182559 - DNA, 20 bp, Artificial Sequence
  Description of Artificial Sequence: Synthetic oligonucleotide
  Target: ATXN1; (-) strand; PAM type: YTN; PAM sequence: CTC
cctgcgattggctactttta

SEQ ID NO: 182560 - DNA, 20 bp, Artificial Sequence
  Description of Artificial Sequence: Synthetic oligonucleotide
  Target: ATXN1; (-) strand; PAM type: YTN; PAM sequence: TTC
aatcctccctgcgattggct

SEQ ID NO: 182561 - DNA, 20 bp, Artificial Sequence
  Description of Artificial Sequence: Synthetic oligonucleotide
  Target: ATXN1; (-) strand; PAM type: YTN; PAM sequence: TTT
caatcctccctgcgattggc

SEQ ID NO: 182562 - DNA, 20 bp, Artificial Sequence
  Description of Artificial Sequence: Synthetic oligonucleotide
  Target: ATXN1; (-) strand; PAM type: YTN; PAM sequence: TTT
tcaatcctccctgcgattgg

SEQ ID NO: 182563 - DNA, 20 bp, Artificial Sequence
  Description of Artificial Sequence: Synthetic oligonucleotide
  Target: ATXN1; (-) strand; PAM type: YTN; PAM sequence: TTT
ttcaatcctccctgcgattg

SEQ ID NO: 182564 - DNA, 20 bp, Artificial Sequence
  Description of Artificial Sequence: Synthetic oligonucleotide
  Target: ATXN1; (-) strand; PAM type: YTN; PAM sequence: TTT
tttcaatcctccctgcgatt

SEQ ID NO: 182565 - DNA, 20 bp, Artificial Sequence
  Description of Artificial Sequence: Synthetic oligonucleotide
  Target: ATXN1; (-) strand; PAM type: YTN; PAM sequence: TTT
ttttcaatcctccctgcgat

SEQ ID NO: 182566 - DNA, 20 bp, Artificial Sequence
  Description of Artificial Sequence: Synthetic oligonucleotide
  Target: ATXN1; (-) strand; PAM type: YTN; PAM sequence: CTA
tcagagtgccatttttttca

SEQ ID NO: 182567 - DNA, 20 bp, Artificial Sequence
  Description of Artificial Sequence: Synthetic oligonucleotide
  Target: ATXN1; (-) strand; PAM type: YTN; PAM sequence: CTG
tcctatcagagtgccatttt

SEQ ID NO: 182568 - DNA, 20 bp, Artificial Sequence
  Description of Artificial Sequence: Synthetic oligonucleotide
  Target: ATXN1; (-) strand; PAM type: YTN; PAM sequence: TTC
tgtcctatcagagtgccatt

SEQ ID NO: 182569 - DNA, 20 bp, Artificial Sequence
  Description of Artificial Sequence: Synthetic oligonucleotide
  Target: ATXN1; (-) strand; PAM type: YTN; PAM sequence: TTT
ctgtcctatcagagtgccat

SEQ ID NO: 182570 - DNA, 20 bp, Artificial Sequence
  Description of Artificial Sequence: Synthetic oligonucleotide
  Target: ATXN1; (-) strand; PAM type: YTN; PAM sequence: CTG
tttctgtcctatcagagtgc

SEQ ID NO: 182571 - DNA, 20 bp, Artificial Sequence
  Description of Artificial Sequence: Synthetic oligonucleotide
  Target: ATXN1; (-) strand; PAM type: YTN; PAM sequence: TTC
tgtttctgtcctatcagagt

SEQ ID NO: 182572 - DNA, 20 bp, Artificial Sequence
  Description of Artificial Sequence: Synthetic oligonucleotide
  Target: ATXN1; (-) strand; PAM type: YTN; PAM sequence: CTC
ccatattctgtttctgtcct

SEQ ID NO: 182573 - DNA, 20 bp, Artificial Sequence
  Description of Artificial Sequence: Synthetic oligonucleotide
  Target: ATXN1; (-) strand; PAM type: YTN; PAM sequence: TTG
tcccctcccatattctgttt

SEQ ID NO: 182574 - DNA, 20 bp, Artificial Sequence
  Description of Artificial Sequence: Synthetic oligonucleotide
  Target: ATXN1; (-) strand; PAM type: YTN; PAM sequence: TTT
gtcccctcccatattctgtt

SEQ ID NO: 182575 - DNA, 20 bp, Artificial Sequence
  Description of Artificial Sequence: Synthetic oligonucleotide
  Target: ATXN1; (-) strand; PAM type: YTN; PAM sequence: TTA
tttgtcccctcccatattct

SEQ ID NO: 182576 - DNA, 20 bp, Artificial Sequence
  Description of Artificial Sequence: Synthetic oligonucleotide
  Target: ATXN1; (-) strand; PAM type: YTN; PAM sequence: CTT
atttgtcccctcccatattc

SEQ ID NO: 182577 - DNA, 20 bp, Artificial Sequence
  Description of Artificial Sequence: Synthetic oligonucleotide
  Target: ATXN1; (-) strand; PAM type: YTN; PAM sequence: TTC
ccttatttgtcccctcccat

SEQ ID NO: 182578 - DNA, 20 bp, Artificial Sequence
  Description of Artificial Sequence: Synthetic oligonucleotide
  Target: ATXN1; (-) strand; PAM type: YTN; PAM sequence: TTA
ttcccttatttgtcccctcc

SEQ ID NO: 182579 - DNA, 20 bp, Artificial Sequence
  Description of Artificial Sequence: Synthetic oligonucleotide
  Target: ATXN1; (-) strand; PAM type: YTN; PAM sequence: TTT
attcccttatttgtcccctc

SEQ ID NO: 182580 - DNA, 20 bp, Artificial Sequence
  Description of Artificial Sequence: Synthetic oligonucleotide
  Target: ATXN1; (-) strand; PAM type: YTN; PAM sequence: TTT
tattcccttatttgtcccct

SEQ ID NO: 182581 - DNA, 20 bp, Artificial Sequence
  Description of Artificial Sequence: Synthetic oligonucleotide
  Target: ATXN1; (-) strand; PAM type: YTN; PAM sequence: CTT
ttattcccttatttgtcccc

SEQ ID NO: 182582 - DNA, 20 bp, Artificial Sequence
  Description of Artificial Sequence: Synthetic oligonucleotide
  Target: ATXN1; (-) strand; PAM type: YTN; PAM sequence: CTG
gggtggcccgcttttattcc

SEQ ID NO: 182583 - DNA, 20 bp, Artificial Sequence
  Description of Artificial Sequence: Synthetic oligonucleotide
  Target: ATXN1; (-) strand; PAM type: YTN; PAM sequence: CTG
gctggggtggcccgctttta

SEQ ID NO: 182584 - DNA, 20 bp, Artificial Sequence
  Description of Artificial Sequence: Synthetic oligonucleotide
  Target: ATXN1; (-) strand; PAM type: YTN; PAM sequence: CTG
ctggctggggtggcccgctt

SEQ ID NO: 182585 - DNA, 20 bp, Artificial Sequence
  Description of Artificial Sequence: Synthetic oligonucleotide
  Target: ATXN1; (-) strand; PAM type: YTN; PAM sequence: TTG
ccactgctggctggggtggc

SEQ ID NO: 182586 - DNA, 20 bp, Artificial Sequence
  Description of Artificial Sequence: Synthetic oligonucleotide
  Target: ATXN1; (-) strand; PAM type: YTN; PAM sequence: TTC
cccagcgtggaaggggaccc

SEQ ID NO: 182587 - DNA, 20 bp, Artificial Sequence
  Description of Artificial Sequence: Synthetic oligonucleotide
  Target: ATXN1; (-) strand; PAM type: YTN; PAM sequence: CTT
ccccagcgtggaaggggacc

SEQ ID NO: 182588 - DNA, 20 bp, Artificial Sequence
  Description of Artificial Sequence: Synthetic oligonucleotide
  Target: ATXN1; (-) strand; PAM type: YTN; PAM sequence: CTG
tgaagagcgacaggacaaag

SEQ ID NO: 182589 - DNA, 20 bp, Artificial Sequence
  Description of Artificial Sequence: Synthetic oligonucleotide
  Target: ATXN1; (-) strand; PAM type: YTN; PAM sequence: TTA
actgtgaagagcgacaggac

SEQ ID NO: 182590 - DNA, 20 bp, Artificial Sequence
  Description of Artificial Sequence: Synthetic oligonucleotide
  Target: ATXN1; (-) strand; PAM type: YTN; PAM sequence: TTA
aagatggcacagacccaaag

SEQ ID NO: 182591 - DNA, 20 bp, Artificial Sequence
  Description of Artificial Sequence: Synthetic oligonucleotide
  Target: ATXN1; (-) strand; PAM type: YTN; PAM sequence: CTT
aaagatggcacagacccaaa

SEQ ID NO: 182592 - DNA, 20 bp, Artificial Sequence
  Description of Artificial Sequence: Synthetic oligonucleotide
  Target: ATXN1; (-) strand; PAM type: YTN; PAM sequence: CTC
ttaaagatggcacagaccca

SEQ ID NO: 182593 - DNA, 20 bp, Artificial Sequence
  Description of Artificial Sequence: Synthetic oligonucleotide
  Target: ATXN1; (-) strand; PAM type: YTN; PAM sequence: TTA
cagctcttaaagatggcaca

SEQ ID NO: 182594 - DNA, 20 bp, Artificial Sequence
  Description of Artificial Sequence: Synthetic oligonucleotide
  Target: ATXN1; (-) strand; PAM type: YTN; PAM sequence: TTC
acggtgagtgttacagctct

SEQ ID NO: 182595 - DNA, 20 bp, Artificial Sequence
  Description of Artificial Sequence: Synthetic oligonucleotide
  Target: ATXN1; (-) strand; PAM type: YTN; PAM sequence: CTT
cacggtgagtgttacagctc

SEQ ID NO: 182596 - DNA, 20 bp, Artificial Sequence
  Description of Artificial Sequence: Synthetic oligonucleotide
  Target: ATXN1; (-) strand; PAM type: YTN; PAM sequence: TTC
aagaatggaggcacggacct

SEQ ID NO: 182597 - DNA, 20 bp, Artificial Sequence
  Description of Artificial Sequence: Synthetic oligonucleotide
  Target: ATXN1; (-) strand; PAM type: YTN; PAM sequence: CTT
caagaatggaggcacggacc

SEQ ID NO: 182598 - DNA, 20 bp, Artificial Sequence
  Description of Artificial Sequence: Synthetic oligonucleotide
  Target: ATXN1; (-) strand; PAM type: YTN; PAM sequence: CTG
acttcaagaatggaggcacg

SEQ ID NO: 182599 - DNA, 20 bp, Artificial Sequence
  Description of Artificial Sequence: Synthetic oligonucleotide
  Target: ATXN1; (-) strand; PAM type: YTN; PAM sequence: CTC
gctgacttcaagaatggagg

SEQ ID NO: 182600 - DNA, 20 bp, Artificial Sequence
  Description of Artificial Sequence: Synthetic oligonucleotide
  Target: ATXN1; (-) strand; PAM type: YTN; PAM sequence: TTC
atggtctcgctgacttcaag

SEQ ID NO: 182601 - DNA, 20 bp, Artificial Sequence
  Description of Artificial Sequence: Synthetic oligonucleotide
  Target: ATXN1; (-) strand; PAM type: YTN; PAM sequence: TTC
cagccggtggattcatggtc

SEQ ID NO: 182602 - DNA, 20 bp, Artificial Sequence
  Description of Artificial Sequence: Synthetic oligonucleotide
  Target: ATXN1; (-) strand; PAM type: YTN; PAM sequence: TTG
gttccagccggtggattcat

SEQ ID NO: 182603 - DNA, 20 bp, Artificial Sequence
  Description of Artificial Sequence: Synthetic oligonucleotide
  Target: ATXN1; (-) strand; PAM type: YTN; PAM sequence: CTG
ggaggatcccccaagatgtg

SEQ ID NO: 182604 - DNA, 20 bp, Artificial Sequence
  Description of Artificial Sequence: Synthetic oligonucleotide
  Target: ATXN1; (-) strand; PAM type: YTN; PAM sequence: TTG
caatatctgggaggatcccc

SEQ ID NO: 182605 - DNA, 20 bp, Artificial Sequence
  Description of Artificial Sequence: Synthetic oligonucleotide
  Target: ATXN1; (-) strand; PAM type: YTN; PAM sequence: CTC
accacgttgcaatatctggg

SEQ ID NO: 182606 - DNA, 20 bp, Artificial Sequence
  Description of Artificial Sequence: Synthetic oligonucleotide
  Target: ATXN1; (-) strand; PAM type: YTN; PAM sequence: CTG
atggtactcaccacgttgca

SEQ ID NO: 182607 - DNA, 20 bp, Artificial Sequence
  Description of Artificial Sequence: Synthetic oligonucleotide
  Target: ATXN1; (-) strand; PAM type: YTN; PAM sequence: CTA
aggaaaaataggacagaata

SEQ ID NO: 182608 - DNA, 20 bp, Artificial Sequence
  Description of Artificial Sequence: Synthetic oligonucleotide
  Target: ATXN1; (-) strand; PAM type: YTN; PAM sequence: TTC
taaggaaaaataggacagaa

SEQ ID NO: 182609 - DNA, 20 bp, Artificial Sequence
  Description of Artificial Sequence: Synthetic oligonucleotide
  Target: ATXN1; (-) strand; PAM type: YTN; PAM sequence: CTG
aattctaaggaaaaatagga

SEQ ID NO: 182610 - DNA, 20 bp, Artificial Sequence
  Description of Artificial Sequence: Synthetic oligonucleotide
  Target: ATXN1; (-) strand; PAM type: YTN; PAM sequence: TTA
gcccctgaattctaaggaaa

SEQ ID NO: 182611 - DNA, 20 bp, Artificial Sequence
  Description of Artificial Sequence: Synthetic oligonucleotide
  Target: ATXN1; (-) strand; PAM type: YTN; PAM sequence: TTT
agcccctgaattctaaggaa

SEQ ID NO: 182612 - DNA, 20 bp, Artificial Sequence
  Description of Artificial Sequence: Synthetic oligonucleotide
  Target: ATXN1; (-) strand; PAM type: YTN; PAM sequence: TTT
tagcccctgaattctaagga

SEQ ID NO: 182613 - DNA, 20 bp, Artificial Sequence
  Description of Artificial Sequence: Synthetic oligonucleotide
  Target: ATXN1; (-) strand; PAM type: YTN; PAM sequence: CTA
gttttagcccctgaattcta

SEQ ID NO: 182614 - DNA, 20 bp, Artificial Sequence
  Description of Artificial Sequence: Synthetic oligonucleotide
  Target: ATXN1; (-) strand; PAM type: YTN; PAM sequence: CTG
acaggtgcctagttttagcc

SEQ ID NO: 182615 - DNA, 20 bp, Artificial Sequence
  Description of Artificial Sequence: Synthetic oligonucleotide
  Target: ATXN1; (-) strand; PAM type: YTN; PAM sequence: CTG
gctgacaggtgcctagtttt

SEQ ID NO: 182616 - DNA, 20 bp, Artificial Sequence
  Description of Artificial Sequence: Synthetic oligonucleotide
  Target: ATXN1; (-) strand; PAM type: YTN; PAM sequence: TTA
actggctgacaggtgcctag

SEQ ID NO: 182617 - DNA, 20 bp, Artificial Sequence
  Description of Artificial Sequence: Synthetic oligonucleotide
  Target: ATXN1; (-) strand; PAM type: YTN; PAM sequence: TTT
aactggctgacaggtgccta

SEQ ID NO: 182618 - DNA, 20 bp, Artificial Sequence
  Description of Artificial Sequence: Synthetic oligonucleotide
  Target: ATXN1; (-) strand; PAM type: YTN; PAM sequence: TTT
taactggctgacaggtgcct

SEQ ID NO: 182619 - DNA, 20 bp, Artificial Sequence
  Description of Artificial Sequence: Synthetic oligonucleotide
  Target: ATXN1; (-) strand; PAM type: YTN; PAM sequence: CTT
ttaactggctgacaggtgcc

SEQ ID NO: 182620 - DNA, 20 bp, Artificial Sequence
  Description of Artificial Sequence: Synthetic oligonucleotide
  Target: ATXN1; (-) strand; PAM type: YTN; PAM sequence: TTG
cttttaactggctgacaggt

SEQ ID NO: 182621 - DNA, 20 bp, Artificial Sequence
  Description of Artificial Sequence: Synthetic oligonucleotide
  Target: ATXN1; (-) strand; PAM type: YTN; PAM sequence: CTA
gttgcttttaactggctgac

SEQ ID NO: 182622 - DNA, 20 bp, Artificial Sequence
  Description of Artificial Sequence: Synthetic oligonucleotide
  Target: ATXN1; (-) strand; PAM type: YTN; PAM sequence: CTG
tggccatgctagttgctttt

SEQ ID NO: 182623 - DNA, 20 bp, Artificial Sequence
  Description of Artificial Sequence: Synthetic oligonucleotide
  Target: ATXN1; (-) strand; PAM type: YTN; PAM sequence: TTA
gtcctgtggccatgctagtt

SEQ ID NO: 182624 - DNA, 20 bp, Artificial Sequence
  Description of Artificial Sequence: Synthetic oligonucleotide
  Target: ATXN1; (-) strand; PAM type: YTN; PAM sequence: CTT
agtcctgtggccatgctagt

SEQ ID NO: 182625 - DNA, 20 bp, Artificial Sequence
  Description of Artificial Sequence: Synthetic oligonucleotide
  Target: ATXN1; (-) strand; PAM type: YTN; PAM sequence: CTG
acatccatgtccttagtcct

SEQ ID NO: 182626 - DNA, 20 bp, Artificial Sequence
  Description of Artificial Sequence: Synthetic oligonucleotide
  Target: ATXN1; (-) strand; PAM type: YTN; PAM sequence: TTC
ccagagagcctgacatccat

SEQ ID NO: 182627 - DNA, 20 bp, Artificial Sequence
  Description of Artificial Sequence: Synthetic oligonucleotide
  Target: ATXN1; (-) strand; PAM type: YTN; PAM sequence: TTT
cccagagagcctgacatcca

SEQ ID NO: 182628 - DNA, 20 bp, Artificial Sequence
  Description of Artificial Sequence: Synthetic oligonucleotide
  Target: ATXN1; (-) strand; PAM type: YTN; PAM sequence: CTT
tcccagagagcctgacatcc

SEQ ID NO: 182629 - DNA, 20 bp, Artificial Sequence
  Description of Artificial Sequence: Synthetic oligonucleotide
  Target: ATXN1; (-) strand; PAM type: YTN; PAM sequence: TTA
gtgagccctttcccagagag

SEQ ID NO: 182630 - DNA, 20 bp, Artificial Sequence
  Description of Artificial Sequence: Synthetic oligonucleotide
  Target: ATXN1; (-) strand; PAM type: YTN; PAM sequence: TTG
ttagtgagccctttcccaga

SEQ ID NO: 182631 - DNA, 20 bp, Artificial Sequence
  Description of Artificial Sequence: Synthetic oligonucleotide
  Target: ATXN1; (-) strand; PAM type: YTN; PAM sequence: CTC
caaacagtcgggggttgtta

SEQ ID NO: 182632 - DNA, 20 bp, Artificial Sequence
  Description of Artificial Sequence: Synthetic oligonucleotide
  Target: ATXN1; (-) strand; PAM type: YTN; PAM sequence: CTG
actccaaacagtcgggggtt

SEQ ID NO: 182633 - DNA, 20 bp, Artificial Sequence
  Description of Artificial Sequence: Synthetic oligonucleotide
  Target: ATXN1; (-) strand; PAM type: YTN; PAM sequence: CTC
ctgactccaaacagtcgggg

SEQ ID NO: 182634 - DNA, 20 bp, Artificial Sequence
  Description of Artificial Sequence: Synthetic oligonucleotide
  Target: ATXN1; (-) strand; PAM type: YTN; PAM sequence: TTC
caggcaaaccaatgctcctg

SEQ ID NO: 182635 - DNA, 20 bp, Artificial Sequence
  Description of Artificial Sequence: Synthetic oligonucleotide
  Target: ATXN1; (-) strand; PAM type: YTN; PAM sequence: CTG
gttccaggcaaaccaatgct

SEQ ID NO: 182636 - DNA, 20 bp, Artificial Sequence
  Description of Artificial Sequence: Synthetic oligonucleotide
  Target: ATXN1; (-) strand; PAM type: YTN; PAM sequence: TTA
gcccggaagtgcaggaaaag

SEQ ID NO: 182637 - DNA, 20 bp, Artificial Sequence
  Description of Artificial Sequence: Synthetic oligonucleotide
  Target: ATXN1; (-) strand; PAM type: YTN; PAM sequence: CTT
agcccggaagtgcaggaaaa

SEQ ID NO: 182638 - DNA, 20 bp, Artificial Sequence
  Description of Artificial Sequence: Synthetic oligonucleotide
  Target: ATXN1; (-) strand; PAM type: YTN; PAM sequence: CTA
ggcttagcccggaagtgcag

SEQ ID NO: 182639 - DNA, 20 bp, Artificial Sequence
  Description of Artificial Sequence: Synthetic oligonucleotide
  Target: ATXN1; (-) strand; PAM type: YTN; PAM sequence: CTG
tcgaccctaggcttagcccg

SEQ ID NO: 182640 - DNA, 20 bp, Artificial Sequence
  Description of Artificial Sequence: Synthetic oligonucleotide
  Target: ATXN1; (-) strand; PAM type: YTN; PAM sequence: CTC
tgtcgaccctaggcttagcc

SEQ ID NO: 182641 - DNA, 20 bp, Artificial Sequence
  Description of Artificial Sequence: Synthetic oligonucleotide
  Target: ATXN1; (-) strand; PAM type: YTN; PAM sequence: CTC
tctgtcgaccctaggcttag

SEQ ID NO: 182642 - DNA, 20 bp, Artificial Sequence
  Description of Artificial Sequence: Synthetic oligonucleotide
  Target: ATXN1; (-) strand; PAM type: YTN; PAM sequence: TTC
ctctctgtcgaccctaggct

SEQ ID NO: 182643 - DNA, 20 bp, Artificial Sequence
  Description of Artificial Sequence: Synthetic oligonucleotide
  Target: ATXN1; (-) strand; PAM type: YTN; PAM sequence: TTT
cctctctgtcgaccctaggc

SEQ ID NO: 182644 - DNA, 20 bp, Artificial Sequence
  Description of Artificial Sequence: Synthetic oligonucleotide
  Target: ATXN1; (-) strand; PAM type: YTN; PAM sequence: CTT
tcctctctgtcgaccctagg

SEQ ID NO: 182645 - DNA, 20 bp, Artificial Sequence
  Description of Artificial Sequence: Synthetic oligonucleotide
  Target: ATXN1; (-) strand; PAM type: YTN; PAM sequence: CTG
aatggctttcctctctgtcg

SEQ ID NO: 182646 - DNA, 20 bp, Artificial Sequence
  Description of Artificial Sequence: Synthetic oligonucleotide
  Target: ATXN1; (-) strand; PAM type: YTN; PAM sequence: TTG
agaccccggagctgaatggc

SEQ ID NO: 182647 - DNA, 20 bp, Artificial Sequence
  Description of Artificial Sequence: Synthetic oligonucleotide
  Target: ATXN1; (-) strand; PAM type: YTN; PAM sequence: TTG
ttgagaccccggagctgaat

SEQ ID NO: 182648 - DNA, 20 bp, Artificial Sequence
  Description of Artificial Sequence: Synthetic oligonucleotide
  Target: ATXN1; (-) strand; PAM type: YTN; PAM sequence: TTT
gttgagaccccggagctgaa

SEQ ID NO: 182649 - DNA, 20 bp, Artificial Sequence
  Description of Artificial Sequence: Synthetic oligonucleotide
  Target: ATXN1; (-) strand; PAM type: YTN; PAM sequence: TTT
tgttgagaccccggagctga

SEQ ID NO: 182650 - DNA, 20 bp, Artificial Sequence
  Description of Artificial Sequence: Synthetic oligonucleotide
  Target: ATXN1; (-) strand; PAM type: YTN; PAM sequence: TTT
ttgttgagaccccggagctg

SEQ ID NO: 182651 - DNA, 20 bp, Artificial Sequence
  Description of Artificial Sequence: Synthetic oligonucleotide
  Target: ATXN1; (-) strand; PAM type: YTN; PAM sequence: CTT
tttgttgagaccccggagct

SEQ ID NO: 182652 - DNA, 20 bp, Artificial Sequence
  Description of Artificial Sequence: Synthetic oligonucleotide
  Target: ATXN1; (-) strand; PAM type: YTN; PAM sequence: CTG
cagggccaaccaactttttg

SEQ ID NO: 182653 - DNA, 20 bp, Artificial Sequence
  Description of Artificial Sequence: Synthetic oligonucleotide
  Target: ATXN1; (-) strand; PAM type: YTN; PAM sequence: CTC
atggctgcagggccaaccaa

SEQ ID NO: 182654 - DNA, 20 bp, Artificial Sequence
  Description of Artificial Sequence: Synthetic oligonucleotide
  Target: ATXN1; (-) strand; PAM type: YTN; PAM sequence: CTG
ctcatggctgcagggccaac

SEQ ID NO: 182655 - DNA, 20 bp, Artificial Sequence
  Description of Artificial Sequence: Synthetic oligonucleotide
  Target: ATXN1; (-) strand; PAM type: YTN; PAM sequence: TTC
tgctcatggctgcagggcca

SEQ ID NO: 182656 - DNA, 20 bp, Artificial Sequence
  Description of Artificial Sequence: Synthetic oligonucleotide
  Target: ATXN1; (-) strand; PAM type: YTN; PAM sequence: TTG
agagttctgctcatggctgc

SEQ ID NO: 182657 - DNA, 20 bp, Artificial Sequence
  Description of Artificial Sequence: Synthetic oligonucleotide
  Target: ATXN1; (-) strand; PAM type: YTN; PAM sequence: TTT
gagagttctgctcatggctg

SEQ ID NO: 182658 - DNA, 20 bp, Artificial Sequence
  Description of Artificial Sequence: Synthetic oligonucleotide
  Target: ATXN1; (-) strand; PAM type: YTN; PAM sequence: CTT
tgagagttctgctcatggct

SEQ ID NO: 182659 - DNA, 20 bp, Artificial Sequence
  Description of Artificial Sequence: Synthetic oligonucleotide
  Target: ATXN1; (-) strand; PAM type: YTN; PAM sequence: CTA
tgtaactttgagagttctgc

SEQ ID NO: 182660 - DNA, 20 bp, Artificial Sequence
  Description of Artificial Sequence: Synthetic oligonucleotide
  Target: ATXN1; (-) strand; PAM type: YTN; PAM sequence: TTG
ggctatgtaactttgagagt

SEQ ID NO: 182661 - DNA, 20 bp, Artificial Sequence
  Description of Artificial Sequence: Synthetic oligonucleotide
  Target: ATXN1; (-) strand; PAM type: YTN; PAM sequence: TTT
gggctatgtaactttgagag

SEQ ID NO: 182662 - DNA, 20 bp, Artificial Sequence
  Description of Artificial Sequence: Synthetic oligonucleotide
  Target: ATXN1; (-) strand; PAM type: YTN; PAM sequence: TTG
tttgggctatgtaactttga

SEQ ID NO: 182663 - DNA, 20 bp, Artificial Sequence
  Description of Artificial Sequence: Synthetic oligonucleotide
  Target: ATXN1; (-) strand; PAM type: YTN; PAM sequence: CTT
gtttgggctatgtaactttg

SEQ ID NO: 182664 - DNA, 20 bp, Artificial Sequence
  Description of Artificial Sequence: Synthetic oligonucleotide
  Target: ATXN1; (-) strand; PAM type: YTN; PAM sequence: TTA
ggacccaggaggcaagggtc

SEQ ID NO: 182665 - DNA, 20 bp, Artificial Sequence
  Description of Artificial Sequence: Synthetic oligonucleotide
  Target: ATXN1; (-) strand; PAM type: YTN; PAM sequence: CTG
acaggtgttaggacccagga

SEQ ID NO: 182666 - DNA, 20 bp, Artificial Sequence
  Description of Artificial Sequence: Synthetic oligonucleotide
  Target: ATXN1; (-) strand; PAM type: YTN; PAM sequence: TTG
tctgacaggtgttaggaccc

SEQ ID NO: 182667 - DNA, 20 bp, Artificial Sequence
  Description of Artificial Sequence: Synthetic oligonucleotide
  Target: ATXN1; (-) strand; PAM type: YTN; PAM sequence: TTT
gtctgacaggtgttaggacc

SEQ ID NO: 182668 - DNA, 20 bp, Artificial Sequence
  Description of Artificial Sequence: Synthetic oligonucleotide
  Target: ATXN1; (-) strand; PAM type: YTN; PAM sequence: TTG
gagaagagaggcgggagaaa

SEQ ID NO: 182669 - DNA, 20 bp, Artificial Sequence
  Description of Artificial Sequence: Synthetic oligonucleotide
  Target: ATXN1; (-) strand; PAM type: YTN; PAM sequence: CTT
ggagaagagaggcgggagaa

SEQ ID NO: 182670 - DNA, 20 bp, Artificial Sequence
  Description of Artificial Sequence: Synthetic oligonucleotide
  Target: ATXN1; (-) strand; PAM type: YTN; PAM sequence: CTA
accttggagaagagaggcgg

SEQ ID NO: 182671 - DNA, 20 bp, Artificial Sequence
  Description of Artificial Sequence: Synthetic oligonucleotide
  Target: ATXN1; (-) strand; PAM type: YTN; PAM sequence: TTA
gaagcaagactaaccttgga

SEQ ID NO: 182672 - DNA, 20 bp, Artificial Sequence
  Description of Artificial Sequence: Synthetic oligonucleotide
  Target: ATXN1; (-) strand; PAM type: YTN; PAM sequence: TTT
agaagcaagactaaccttgg

SEQ ID NO: 182673 - DNA, 20 bp, Artificial Sequence
  Description of Artificial Sequence: Synthetic oligonucleotide
  Target: ATXN1; (-) strand; PAM type: YTN; PAM sequence: TTT
tagaagcaagactaaccttg

SEQ ID NO: 182674 - DNA, 20 bp, Artificial Sequence
  Description of Artificial Sequence: Synthetic oligonucleotide
  Target: ATXN1; (-) strand; PAM type: YTN; PAM sequence: TTT
ttagaagcaagactaacctt

SEQ ID NO: 182675 - DNA, 20 bp, Artificial Sequence
  Description of Artificial Sequence: Synthetic oligonucleotide
  Target: ATXN1; (-) strand; PAM type: YTN; PAM sequence: CTG
gaagagcaccagggacaggg

SEQ ID NO: 182676 - DNA, 20 bp, Artificial Sequence
  Description of Artificial Sequence: Synthetic oligonucleotide
  Target: ATXN1; (-) strand; PAM type: YTN; PAM sequence: TTA
taggagaaactggaagagca

SEQ ID NO: 182677 - DNA, 20 bp, Artificial Sequence
  Description of Artificial Sequence: Synthetic oligonucleotide
  Target: ATXN1; (-) strand; PAM type: YTN; PAM sequence: CTT
ataggagaaactggaagagc

SEQ ID NO: 182678 - DNA, 20 bp, Artificial Sequence
  Description of Artificial Sequence: Synthetic oligonucleotide
  Target: ATXN1; (-) strand; PAM type: YTN; PAM sequence: TTA
gaaatcatccttataggaga

SEQ ID NO: 182679 - DNA, 20 bp, Artificial Sequence
  Description of Artificial Sequence: Synthetic oligonucleotide
  Target: ATXN1; (-) strand; PAM type: YTN; PAM sequence: TTA
tattagaaatcatccttata

SEQ ID NO: 182680 - DNA, 20 bp, Artificial Sequence
  Description of Artificial Sequence: Synthetic oligonucleotide
  Target: ATXN1; (-) strand; PAM type: YTN; PAM sequence: TTT
atattagaaatcatccttat

SEQ ID NO: 182681 - DNA, 20 bp, Artificial Sequence
  Description of Artificial Sequence: Synthetic oligonucleotide
  Target: ATXN1; (-) strand; PAM type: YTN; PAM sequence: CTG
aaatttatattagaaatcat

SEQ ID NO: 182682 - DNA, 20 bp, Artificial Sequence
  Description of Artificial Sequence: Synthetic oligonucleotide
  Target: ATXN1; (-) strand; PAM type: YTN; PAM sequence: CTA
aagaagggagcagagtcctg

SEQ ID NO: 182683 - DNA, 20 bp, Artificial Sequence
  Description of Artificial Sequence: Synthetic oligonucleotide
  Target: ATXN1; (-) strand; PAM type: YTN; PAM sequence: CTG
ggtgcctaaagaagggagca

SEQ ID NO: 182684 - DNA, 20 bp, Artificial Sequence
  Description of Artificial Sequence: Synthetic oligonucleotide
  Target: ATXN1; (-) strand; PAM type: YTN; PAM sequence: TTG
gtgagcctgggtgcctaaag

SEQ ID NO: 182685 - DNA, 20 bp, Artificial Sequence
  Description of Artificial Sequence: Synthetic oligonucleotide
  Target: ATXN1; (-) strand; PAM type: YTN; PAM sequence: CTG
attggtgagcctgggtgcct

SEQ ID NO: 182686 - DNA, 20 bp, Artificial Sequence
  Description of Artificial Sequence: Synthetic oligonucleotide
  Target: ATXN1; (-) strand; PAM type: YTN; PAM sequence: TTC
tgattggtgagcctgggtgc

SEQ ID NO: 182687 - DNA, 20 bp, Artificial Sequence
  Description of Artificial Sequence: Synthetic oligonucleotide
  Target: ATXN1; (-) strand; PAM type: YTN; PAM sequence: TTT
ctgattggtgagcctgggtg

SEQ ID NO: 182688 - DNA, 20 bp, Artificial Sequence
  Description of Artificial Sequence: Synthetic oligonucleotide
  Target: ATXN1; (-) strand; PAM type: YTN; PAM sequence: CTT
tctgattggtgagcctgggt

SEQ ID NO: 182689 - DNA, 20 bp, Artificial Sequence
  Description of Artificial Sequence: Synthetic oligonucleotide
  Target: ATXN1; (-) strand; PAM type: YTN; PAM sequence: TTA
tgtctttctgattggtgagc

SEQ ID NO: 182690 - DNA, 20 bp, Artificial Sequence
  Description of Artificial Sequence: Synthetic oligonucleotide
  Target: ATXN1; (-) strand; PAM type: YTN; PAM sequence: TTG
gacaaaaattatgtctttct

SEQ ID NO: 182691 - DNA, 20 bp, Artificial Sequence
  Description of Artificial Sequence: Synthetic oligonucleotide
  Target: ATXN1; (-) strand; PAM type: YTN; PAM sequence: TTT
ggacaaaaattatgtctttc

SEQ ID NO: 182692 - DNA, 20 bp, Artificial Sequence
  Description of Artificial Sequence: Synthetic oligonucleotide
  Target: ATXN1; (-) strand; PAM type: YTN; PAM sequence: CTT
tggacaaaaattatgtcttt

SEQ ID NO: 182693 - DNA, 20 bp, Artificial Sequence
  Description of Artificial Sequence: Synthetic oligonucleotide
  Target: ATXN1; (-) strand; PAM type: YTN; PAM sequence: TTC
cagatagtcccccacaacag

SEQ ID NO: 182694 - DNA, 20 bp, Artificial Sequence
  Description of Artificial Sequence: Synthetic oligonucleotide
  Target: ATXN1; (-) strand; PAM type: YTN; PAM sequence: CTA
aaattccagatagtccccca

SEQ ID NO: 182695 - DNA, 20 bp, Artificial Sequence
  Description of Artificial Sequence: Synthetic oligonucleotide
  Target: ATXN1; (-) strand; PAM type: YTN; PAM sequence: CTG
aggagggatcctaaaattcc

SEQ ID NO: 182696 - DNA, 20 bp, Artificial Sequence
  Description of Artificial Sequence: Synthetic oligonucleotide
  Target: ATXN1; (-) strand; PAM type: YTN; PAM sequence: CTA
gtctgaggagggatcctaaa

SEQ ID NO: 182697 - DNA, 20 bp, Artificial Sequence
  Description of Artificial Sequence: Synthetic oligonucleotide
  Target: ATXN1; (-) strand; PAM type: YTN; PAM sequence: CTG
ctagtctgaggagggatcct

SEQ ID NO: 182698 - DNA, 20 bp, Artificial Sequence
  Description of Artificial Sequence: Synthetic oligonucleotide
  Target: ATXN1; (-) strand; PAM type: YTN; PAM sequence: TTA
ggtctgctagtctgaggagg

SEQ ID NO: 182699 - DNA, 20 bp, Artificial Sequence
  Description of Artificial Sequence: Synthetic oligonucleotide
  Target: ATXN1; (-) strand; PAM type: YTN; PAM sequence: TTG
ttaggtctgctagtctgagg

SEQ ID NO: 182700 - DNA, 20 bp, Artificial Sequence
  Description of Artificial Sequence: Synthetic oligonucleotide
  Target: ATXN1; (-) strand; PAM type: YTN; PAM sequence: TTT
gttaggtctgctagtctgag

SEQ ID NO: 182701 - DNA, 20 bp, Artificial Sequence
  Description of Artificial Sequence: Synthetic oligonucleotide
  Target: ATXN1; (-) strand; PAM type: YTN; PAM sequence: CTT
tgttaggtctgctagtctga

SEQ ID NO: 182702 - DNA, 20 bp, Artificial Sequence
  Description of Artificial Sequence: Synthetic oligonucleotide
  Target: ATXN1; (-) strand; PAM type: YTN; PAM sequence: TTG
ggaatagcctttgttaggtc

SEQ ID NO: 182703 - DNA, 20 bp, Artificial Sequence
  Description of Artificial Sequence: Synthetic oligonucleotide
  Target: ATXN1; (-) strand; PAM type: YTN; PAM sequence: TTT
gggaatagcctttgttaggt

SEQ ID NO: 182704 - DNA, 20 bp, Artificial Sequence
  Description of Artificial Sequence: Synthetic oligonucleotide
  Target: ATXN1; (-) strand; PAM type: YTN; PAM sequence: CTT
tgggaatagcctttgttagg

SEQ ID NO: 182705 - DNA, 20 bp, Artificial Sequence
  Description of Artificial Sequence: Synthetic oligonucleotide
  Target: ATXN1; (-) strand; PAM type: YTN; PAM sequence: CTA
gctttgggaatagcctttgt

SEQ ID NO: 182706 - DNA, 20 bp, Artificial Sequence
  Description of Artificial Sequence: Synthetic oligonucleotide
  Target: ATXN1; (-) strand; PAM type: YTN; PAM sequence: CTA
tcctagctttgggaatagcc

SEQ ID NO: 182707 - DNA, 20 bp, Artificial Sequence
  Description of Artificial Sequence: Synthetic oligonucleotide
  Target: ATXN1; (-) strand; PAM type: YTN; PAM sequence: CTC
ctatcctagctttgggaata

SEQ ID NO: 182708 - DNA, 20 bp, Artificial Sequence
  Description of Artificial Sequence: Synthetic oligonucleotide
  Target: ATXN1; (-) strand; PAM type: YTN; PAM sequence: CTC
ctcctatcctagctttggga

SEQ ID NO: 182709 - DNA, 20 bp, Artificial Sequence
  Description of Artificial Sequence: Synthetic oligonucleotide
  Target: ATXN1; (-) strand; PAM type: YTN; PAM sequence: CTG
agtctcctcctatcctagct

SEQ ID NO: 182710 - DNA, 20 bp, Artificial Sequence
  Description of Artificial Sequence: Synthetic oligonucleotide
  Target: ATXN1; (-) strand; PAM type: YTN; PAM sequence: TTC
tgagtctcctcctatcctag

SEQ ID NO: 182711 - DNA, 20 bp, Artificial Sequence
  Description of Artificial Sequence: Synthetic oligonucleotide
  Target: ATXN1; (-) strand; PAM type: YTN; PAM sequence: TTT
ctgagtctcctcctatccta

SEQ ID NO: 182712 - DNA, 20 bp, Artificial Sequence
  Description of Artificial Sequence: Synthetic oligonucleotide
  Target: ATXN1; (-) strand; PAM type: YTN; PAM sequence: TTA
tcatatgaataggaaggata

SEQ ID NO: 182713 - DNA, 20 bp, Artificial Sequence
  Description of Artificial Sequence: Synthetic oligonucleotide
  Target: ATXN1; (-) strand; PAM type: YTN; PAM sequence: CTT
atcatatgaataggaaggat

SEQ ID NO: 182714 - DNA, 20 bp, Artificial Sequence
  Description of Artificial Sequence: Synthetic oligonucleotide
  Target: ATXN1; (-) strand; PAM type: YTN; PAM sequence: CTC
acttatcatatgaataggaa

SEQ ID NO: 182715 - DNA, 20 bp, Artificial Sequence
  Description of Artificial Sequence: Synthetic oligonucleotide
  Target: ATXN1; (-) strand; PAM type: YTN; PAM sequence: TTG
tcctcacttatcatatgaat

SEQ ID NO: 182716 - DNA, 20 bp, Artificial Sequence
  Description of Artificial Sequence: Synthetic oligonucleotide
  Target: ATXN1; (-) strand; PAM type: YTN; PAM sequence: TTT
gtcctcacttatcatatgaa

SEQ ID NO: 182717 - DNA, 20 bp, Artificial Sequence
  Description of Artificial Sequence: Synthetic oligonucleotide
  Target: ATXN1; (-) strand; PAM type: YTN; PAM sequence: TTT
tgtcctcacttatcatatga

SEQ ID NO: 182718 - DNA, 20 bp, Artificial Sequence
  Description of Artificial Sequence: Synthetic oligonucleotide
  Target: ATXN1; (-) strand; PAM type: YTN; PAM sequence: TTG
gaagagtgatgcgttttgtc

SEQ ID NO: 182719 - DNA, 20 bp, Artificial Sequence
  Description of Artificial Sequence: Synthetic oligonucleotide
  Target: ATXN1; (-) strand; PAM type: YTN; PAM sequence: CTC
cagggttggaagagtgatgc

SEQ ID NO: 182720 - DNA, 20 bp, Artificial Sequence
  Description of Artificial Sequence: Synthetic oligonucleotide
  Target: ATXN1; (-) strand; PAM type: YTN; PAM sequence: CTG
agggaaggaagggatctcca

SEQ ID NO: 182721 - DNA, 20 bp, Artificial Sequence
  Description of Artificial Sequence: Synthetic oligonucleotide
  Target: ATXN1; (-) strand; PAM type: YTN; PAM sequence: CTC
aaaatggagtggagggccat

SEQ ID NO: 182722 - DNA, 20 bp, Artificial Sequence
  Description of Artificial Sequence: Synthetic oligonucleotide
  Target: ATXN1; (-) strand; PAM type: YTN; PAM sequence: CTA
taaagataatatgcctcaaa

SEQ ID NO: 182723 - DNA, 20 bp, Artificial Sequence
  Description of Artificial Sequence: Synthetic oligonucleotide
  Target: ATXN1; (-) strand; PAM type: YTN; PAM sequence: TTG
tactataaagataatatgcc

SEQ ID NO: 182724 - DNA, 20 bp, Artificial Sequence
  Description of Artificial Sequence: Synthetic oligonucleotide
  Target: ATXN1; (-) strand; PAM type: YTN; PAM sequence: CTT
gtactataaagataatatgc

SEQ ID NO: 182725 - DNA, 20 bp, Artificial Sequence
  Description of Artificial Sequence: Synthetic oligonucleotide
  Target: ATXN1; (-) strand; PAM type: YTN; PAM sequence: TTA
cccttgtactataaagataa

SEQ ID NO: 182726 - DNA, 20 bp, Artificial Sequence
  Description of Artificial Sequence: Synthetic oligonucleotide
  Target: ATXN1; (-) strand; PAM type: YTN; PAM sequence: CTT
acccttgtactataaagata

SEQ ID NO: 182727 - DNA, 20 bp, Artificial Sequence
  Description of Artificial Sequence: Synthetic oligonucleotide
  Target: ATXN1; (-) strand; PAM type: YTN; PAM sequence: TTA
ggaccttacccttgtactat

SEQ ID NO: 182728 - DNA, 20 bp, Artificial Sequence
  Description of Artificial Sequence: Synthetic oligonucleotide
  Target: ATXN1; (-) strand; PAM type: YTN; PAM sequence: TTA
ttaggaccttacccttgtac

SEQ ID NO: 182729 - DNA, 20 bp, Artificial Sequence
  Description of Artificial Sequence: Synthetic oligonucleotide
  Target: ATXN1; (-) strand; PAM type: YTN; PAM sequence: TTG
ttattaggaccttacccttg

SEQ ID NO: 182730 - DNA, 20 bp, Artificial Sequence
  Description of Artificial Sequence: Synthetic oligonucleotide
  Target: ATXN1; (-) strand; PAM type: YTN; PAM sequence: CTG
ttgttattaggaccttaccc

SEQ ID NO: 182731 - DNA, 20 bp, Artificial Sequence
  Description of Artificial Sequence: Synthetic oligonucleotide
  Target: ATXN1; (-) strand; PAM type: YTN; PAM sequence: CTC
ctgttgttattaggacctta

SEQ ID NO: 182732 - DNA, 20 bp, Artificial Sequence
  Description of Artificial Sequence: Synthetic oligonucleotide
  Target: ATXN1; (-) strand; PAM type: YTN; PAM sequence: TTC
tcctgttgttattaggacct

SEQ ID NO: 182733 - DNA, 20 bp, Artificial Sequence
  Description of Artificial Sequence: Synthetic oligonucleotide
  Target: ATXN1; (-) strand; PAM type: YTN; PAM sequence: TTT
ctcctgttgttattaggacc

SEQ ID NO: 182734 - DNA, 20 bp, Artificial Sequence
  Description of Artificial Sequence: Synthetic oligonucleotide
  Target: ATXN1; (-) strand; PAM type: YTN; PAM sequence: TTT
tctcctgttgttattaggac

SEQ ID NO: 182735 - DNA, 20 bp, Artificial Sequence
  Description of Artificial Sequence: Synthetic oligonucleotide
  Target: ATXN1; (-) strand; PAM type: YTN; PAM sequence: CTA
agtgttttctcctgttgtta

SEQ ID NO: 182736 - DNA, 20 bp, Artificial Sequence
  Description of Artificial Sequence: Synthetic oligonucleotide
  Target: ATXN1; (-) strand; PAM type: YTN; PAM sequence: TTA
gagtcctaagtgttttctcc

SEQ ID NO: 182737 - DNA, 20 bp, Artificial Sequence
  Description of Artificial Sequence: Synthetic oligonucleotide
  Target: ATXN1; (-) strand; PAM type: YTN; PAM sequence: CTG
ttagagtcctaagtgttttc

SEQ ID NO: 182738 - DNA, 20 bp, Artificial Sequence
  Description of Artificial Sequence: Synthetic oligonucleotide
  Target: ATXN1; (-) strand; PAM type: YTN; PAM sequence: TTG
aaaacctgttagagtcctaa

SEQ ID NO: 182739 - DNA, 20 bp, Artificial Sequence
  Description of Artificial Sequence: Synthetic oligonucleotide
  Target: ATXN1; (-) strand; PAM type: YTN; PAM sequence: CTT
gaaaacctgttagagtccta

SEQ ID NO: 182740 - DNA, 20 bp, Artificial Sequence
  Description of Artificial Sequence: Synthetic oligonucleotide
  Target: ATXN1; (-) strand; PAM type: YTN; PAM sequence: TTC
ttgaaaacctgttagagtcc

SEQ ID NO: 182741 - DNA, 20 bp, Artificial Sequence
  Description of Artificial Sequence: Synthetic oligonucleotide
  Target: ATXN1; (-) strand; PAM type: YTN; PAM sequence: TTA
ccaatgcattcttgaaaacc

SEQ ID NO: 182742 - DNA, 20 bp, Artificial Sequence
  Description of Artificial Sequence: Synthetic oligonucleotide
  Target: ATXN1; (-) strand; PAM type: YTN; PAM sequence: CTT
accaatgcattcttgaaaac

SEQ ID NO: 182743 - DNA, 20 bp, Artificial Sequence
  Description of Artificial Sequence: Synthetic oligonucleotide
  Target: ATXN1; (-) strand; PAM type: YTN; PAM sequence: TTA
gtggcccttaccaatgcatt

SEQ ID NO: 182744 - DNA, 20 bp, Artificial Sequence
  Description of Artificial Sequence: Synthetic oligonucleotide
  Target: ATXN1; (-) strand; PAM type: YTN; PAM sequence: TTT
agtggcccttaccaatgcat

SEQ ID NO: 182745 - DNA, 20 bp, Artificial Sequence
  Description of Artificial Sequence: Synthetic oligonucleotide
  Target: ATXN1; (-) strand; PAM type: YTN; PAM sequence: CTG
agaaaagtcagatttagtgg

SEQ ID NO: 182746 - DNA, 20 bp, Artificial Sequence
  Description of Artificial Sequence: Synthetic oligonucleotide
  Target: ATXN1; (-) strand; PAM type: YTN; PAM sequence: TTA
gaccacaaagaggactgaga

SEQ ID NO: 182747 - DNA, 20 bp, Artificial Sequence
  Description of Artificial Sequence: Synthetic oligonucleotide
  Target: ATXN1; (-) strand; PAM type: YTN; PAM sequence: TTT
agaccacaaagaggactgag

SEQ ID NO: 182748 - DNA, 20 bp, Artificial Sequence
  Description of Artificial Sequence: Synthetic oligonucleotide
  Target: ATXN1; (-) strand; PAM type: YTN; PAM sequence: CTT
tagaccacaaagaggactga

SEQ ID NO: 182749 - DNA, 20 bp, Artificial Sequence
  Description of Artificial Sequence: Synthetic oligonucleotide
  Target: ATXN1; (-) strand; PAM type: YTN; PAM sequence: TTC
gtctttagaccacaaagagg

SEQ ID NO: 182750 - DNA, 20 bp, Artificial Sequence
  Description of Artificial Sequence: Synthetic oligonucleotide
  Target: ATXN1; (-) strand; PAM type: YTN; PAM sequence: TTT
cgtctttagaccacaaagag

SEQ ID NO: 182751 - DNA, 20 bp, Artificial Sequence
  Description of Artificial Sequence: Synthetic oligonucleotide
  Target: ATXN1; (-) strand; PAM type: YTN; PAM sequence: CTT
tcgtctttagaccacaaaga

SEQ ID NO: 182752 - DNA, 20 bp, Artificial Sequence
  Description of Artificial Sequence: Synthetic oligonucleotide
  Target: ATXN1; (-) strand; PAM type: YTN; PAM sequence: TTG
cctttcgtctttagaccaca

SEQ ID NO: 182753 - DNA, 20 bp, Artificial Sequence
  Description of Artificial Sequence: Synthetic oligonucleotide
  Target: ATXN1; (-) strand; PAM type: YTN; PAM sequence: CTT
gcctttcgtctttagaccac

SEQ ID NO: 182754 - DNA, 20 bp, Artificial Sequence
  Description of Artificial Sequence: Synthetic oligonucleotide
  Target: ATXN1; (-) strand; PAM type: YTN; PAM sequence: CTG
cacccttgcctttcgtcttt

SEQ ID NO: 182755 - DNA, 20 bp, Artificial Sequence
  Description of Artificial Sequence: Synthetic oligonucleotide
  Target: ATXN1; (-) strand; PAM type: YTN; PAM sequence: CTC
aaaaacctgcacccttgcct

SEQ ID NO: 182756 - DNA, 20 bp, Artificial Sequence
  Description of Artificial Sequence: Synthetic oligonucleotide
  Target: ATXN1; (-) strand; PAM type: YTN; PAM sequence: TTC
tcaaaaacctgcacccttgc

SEQ ID NO: 182757 - DNA, 20 bp, Artificial Sequence
  Description of Artificial Sequence: Synthetic oligonucleotide
  Target: ATXN1; (-) strand; PAM type: YTN; PAM sequence: TTA
ccaatggattctcaaaaacc

SEQ ID NO: 182758 - DNA, 20 bp, Artificial Sequence
  Description of Artificial Sequence: Synthetic oligonucleotide
  Target: ATXN1; (-) strand; PAM type: YTN; PAM sequence: CTT
accaatggattctcaaaaac

SEQ ID NO: 182759 - DNA, 20 bp, Artificial Sequence
  Description of Artificial Sequence: Synthetic oligonucleotide
  Target: ATXN1; (-) strand; PAM type: YTN; PAM sequence: TTA
gtggcccttaccaatggatt

SEQ ID NO: 182760 - DNA, 20 bp, Artificial Sequence
  Description of Artificial Sequence: Synthetic oligonucleotide
  Target: ATXN1; (-) strand; PAM type: YTN; PAM sequence: TTT
agtggcccttaccaatggat

SEQ ID NO: 182761 - DNA, 20 bp, Artificial Sequence
  Description of Artificial Sequence: Synthetic oligonucleotide
  Target: ATXN1; (-) strand; PAM type: YTN; PAM sequence: CTG
aggaaggtcagatttagtgg

SEQ ID NO: 182762 - DNA, 20 bp, Artificial Sequence
  Description of Artificial Sequence: Synthetic oligonucleotide
  Target: ATXN1; (-) strand; PAM type: YTN; PAM sequence: CTA
gaccacaaaaaggactgagg

SEQ ID NO: 182763 - DNA, 20 bp, Artificial Sequence
  Description of Artificial Sequence: Synthetic oligonucleotide
  Target: ATXN1; (-) strand; PAM type: YTN; PAM sequence: CTC
ctagaccacaaaaaggactg

SEQ ID NO: 182764 - DNA, 20 bp, Artificial Sequence
  Description of Artificial Sequence: Synthetic oligonucleotide
  Target: ATXN1; (-) strand; PAM type: YTN; PAM sequence: TTC
ctcctagaccacaaaaagga

SEQ ID NO: 182765 - DNA, 20 bp, Artificial Sequence
  Description of Artificial Sequence: Synthetic oligonucleotide
  Target: ATXN1; (-) strand; PAM type: YTN; PAM sequence: TTT
cctcctagaccacaaaaagg

SEQ ID NO: 182766 - DNA, 20 bp, Artificial Sequence
  Description of Artificial Sequence: Synthetic oligonucleotide
  Target: ATXN1; (-) strand; PAM type: YTN; PAM sequence: TTT
tcctcctagaccacaaaaag

SEQ ID NO: 182767 - DNA, 20 bp, Artificial Sequence
  Description of Artificial Sequence: Synthetic oligonucleotide
  Target: ATXN1; (-) strand; PAM type: YTN; PAM sequence: CTA
gttttcctcctagaccacaa

SEQ ID NO: 182768 - DNA, 20 bp, Artificial Sequence
  Description of Artificial Sequence: Synthetic oligonucleotide
  Target: ATXN1; (-) strand; PAM type: YTN; PAM sequence: CTC
accaaagcagcagcggaaac

SEQ ID NO: 182769 - DNA, 20 bp, Artificial Sequence
  Description of Artificial Sequence: Synthetic oligonucleotide
  Target: ATXN1; (-) strand; PAM type: YTN; PAM sequence: CTG
tgctcaccaaagcagcagcg

SEQ ID NO: 182770 - DNA, 20 bp, Artificial Sequence
  Description of Artificial Sequence: Synthetic oligonucleotide
  Target: ATXN1; (-) strand; PAM type: YTN; PAM sequence: TTC
ggaatagctgtgctcaccaa

SEQ ID NO: 182771 - DNA, 20 bp, Artificial Sequence
  Description of Artificial Sequence: Synthetic oligonucleotide
  Target: ATXN1; (-) strand; PAM type: YTN; PAM sequence: CTG
ttcggaatagctgtgctcac

SEQ ID NO: 182772 - DNA, 20 bp, Artificial Sequence
  Description of Artificial Sequence: Synthetic oligonucleotide
  Target: ATXN1; (-) strand; PAM type: YTN; PAM sequence: CTG
ctgttcggaatagctgtgct

SEQ ID NO: 182773 - DNA, 20 bp, Artificial Sequence
  Description of Artificial Sequence: Synthetic oligonucleotide
  Target: ATXN1; (-) strand; PAM type: YTN; PAM sequence: CTG
gatcctgctgttcggaatag

SEQ ID NO: 182774 - DNA, 20 bp, Artificial Sequence
  Description of Artificial Sequence: Synthetic oligonucleotide
  Target: ATXN1; (-) strand; PAM type: YTN; PAM sequence: CTG
cccaagaacccacaacagtc

SEQ ID NO: 182775 - DNA, 20 bp, Artificial Sequence
  Description of Artificial Sequence: Synthetic oligonucleotide
  Target: ATXN1; (-) strand; PAM type: YTN; PAM sequence: CTC
cctgcccaagaacccacaac

SEQ ID NO: 182776 - DNA, 20 bp, Artificial Sequence
  Description of Artificial Sequence: Synthetic oligonucleotide
  Target: ATXN1; (-) strand; PAM type: YTN; PAM sequence: TTC
tccctgcccaagaacccaca

SEQ ID NO: 182777 - DNA, 20 bp, Artificial Sequence
  Description of Artificial Sequence: Synthetic oligonucleotide
  Target: ATXN1; (-) strand; PAM type: YTN; PAM sequence: CTT
ctccctgcccaagaacccac

SEQ ID NO: 182778 - DNA, 20 bp, Artificial Sequence
  Description of Artificial Sequence: Synthetic oligonucleotide
  Target: ATXN1; (-) strand; PAM type: YTN; PAM sequence: CTC
ttctccctgcccaagaaccc

SEQ ID NO: 182779 - DNA, 20 bp, Artificial Sequence
  Description of Artificial Sequence: Synthetic oligonucleotide
  Target: ATXN1; (-) strand; PAM type: YTN; PAM sequence: TTC
tcttctccctgcccaagaac

SEQ ID NO: 182780 - DNA, 20 bp, Artificial Sequence
  Description of Artificial Sequence: Synthetic oligonucleotide
  Target: ATXN1; (-) strand; PAM type: YTN; PAM sequence: TTT
ctcttctccctgcccaagaa

SEQ ID NO: 182781 - DNA, 20 bp, Artificial Sequence
  Description of Artificial Sequence: Synthetic oligonucleotide
  Target: ATXN1; (-) strand; PAM type: YTN; PAM sequence: TTT
tctcttctccctgcccaaga

SEQ ID NO: 182782 - DNA, 20 bp, Artificial Sequence
  Description of Artificial Sequence: Synthetic oligonucleotide
  Target: ATXN1; (-) strand; PAM type: YTN; PAM sequence: TTT
ttctcttctccctgcccaag

SEQ ID NO: 182783 - DNA, 20 bp, Artificial Sequence
  Description of Artificial Sequence: Synthetic oligonucleotide
  Target: ATXN1; (-) strand; PAM type: YTN; PAM sequence: TTT
tttctcttctccctgcccaa

SEQ ID NO: 182784 - DNA, 20 bp, Artificial Sequence
  Description of Artificial Sequence: Synthetic oligonucleotide
  Target: ATXN1; (-) strand; PAM type: YTN; PAM sequence: TTT
ttttctcttctccctgccca

SEQ ID NO: 182785 - DNA, 20 bp, Artificial Sequence
  Description of Artificial Sequence: Synthetic oligonucleotide
  Target: ATXN1; (-) strand; PAM type: YTN; PAM sequence: TTT
tttttctcttctccctgccc

SEQ ID NO: 182786 - DNA, 20 bp, Artificial Sequence
  Description of Artificial Sequence: Synthetic oligonucleotide
  Target: ATXN1; (-) strand; PAM type: YTN; PAM sequence: TTT
ttttttctcttctccctgcc

SEQ ID NO: 182787 - DNA, 20 bp, Artificial Sequence
  Description of Artificial Sequence: Synthetic oligonucleotide
  Target: ATXN1; (-) strand; PAM type: YTN; PAM sequence: TTT
tttttttctcttctccctgc

SEQ ID NO: 182788 - DNA, 20 bp, Artificial Sequence
  Description of Artificial Sequence: Synthetic oligonucleotide
  Target: ATXN1; (-) strand; PAM type: YTN; PAM sequence: TTT
ttttttttctcttctccctg

SEQ ID NO: 182789 - DNA, 20 bp, Artificial Sequence
  Description of Artificial Sequence: Synthetic oligonucleotide
  Target: ATXN1; (-) strand; PAM type: YTN; PAM sequence: TTT
tttttttttctcttctccct

SEQ ID NO: 182790 - DNA, 20 bp, Artificial Sequence
  Description of Artificial Sequence: Synthetic oligonucleotide
  Target: ATXN1; (-) strand; PAM type: YTN; PAM sequence: TTT
ttttttttttctcttctccc

SEQ ID NO: 182791 - DNA, 20 bp, Artificial Sequence
  Description of Artificial Sequence: Synthetic oligonucleotide
  Target: ATXN1; (-) strand; PAM type: YTN; PAM sequence: TTT
tttttttttttctcttctcc

SEQ ID NO: 182792 - DNA, 20 bp, Artificial Sequence
  Description of Artificial Sequence: Synthetic oligonucleotide
  Target: ATXN1; (-) strand; PAM type: YTN; PAM sequence: CTG
cagttttttttttttttctc

SEQ ID NO: 182793 - DNA, 20 bp, Artificial Sequence
  Description of Artificial Sequence: Synthetic oligonucleotide
  Target: ATXN1; (-) strand; PAM type: YTN; PAM sequence: CTG
aaagaaaaaaccgcctgcag

SEQ ID NO: 182794 - DNA, 20 bp, Artificial Sequence
  Description of Artificial Sequence: Synthetic oligonucleotide
  Target: ATXN1; (-) strand; PAM type: YTN; PAM sequence: TTC
ccatctgaaagaaaaaaccg

SEQ ID NO: 182795 - DNA, 20 bp, Artificial Sequence
  Description of Artificial Sequence: Synthetic oligonucleotide
  Target: ATXN1; (-) strand; PAM type: YTN; PAM sequence: TTT
cccatctgaaagaaaaaacc

SEQ ID NO: 182796 - DNA, 20 bp, Artificial Sequence
  Description of Artificial Sequence: Synthetic oligonucleotide
  Target: ATXN1; (-) strand; PAM type: YTN; PAM sequence: CTG
ggtgtttcccatctgaaaga

SEQ ID NO: 182797 - DNA, 20 bp, Artificial Sequence
  Description of Artificial Sequence: Synthetic oligonucleotide
  Target: ATXN1; (-) strand; PAM type: YTN; PAM sequence: TTG
atgcctgggtgtttcccatc

SEQ ID NO: 182798 - DNA, 20 bp, Artificial Sequence
  Description of Artificial Sequence: Synthetic oligonucleotide
  Target: ATXN1; (-) strand; PAM type: YTN; PAM sequence: TTG
ttgatgcctgggtgtttccc

SEQ ID NO: 182799 - DNA, 20 bp, Artificial Sequence
  Description of Artificial Sequence: Synthetic oligonucleotide
  Target: ATXN1; (-) strand; PAM type: YTN; PAM sequence: CTT
gttgatgcctgggtgtttcc

SEQ ID NO: 182800 - DNA, 20 bp, Artificial Sequence
  Description of Artificial Sequence: Synthetic oligonucleotide
  Target: ATXN1; (-) strand; PAM type: YTN; PAM sequence: TTC
aagggtgagcttgttgatgc

SEQ ID NO: 182801 - DNA, 20 bp, Artificial Sequence
  Description of Artificial Sequence: Synthetic oligonucleotide
  Target: ATXN1; (-) strand; PAM type: YTN; PAM sequence: TTT
caagggtgagcttgttgatg

SEQ ID NO: 182802 - DNA, 20 bp, Artificial Sequence
  Description of Artificial Sequence: Synthetic oligonucleotide
  Target: ATXN1; (-) strand; PAM type: YTN; PAM sequence: TTA
ggatgcgtttcaagggtgag

SEQ ID NO: 182803 - DNA, 20 bp, Artificial Sequence
  Description of Artificial Sequence: Synthetic oligonucleotide
  Target: ATXN1; (-) strand; PAM type: YTN; PAM sequence: CTT
aggatgcgtttcaagggtga

SEQ ID NO: 182804 - DNA, 20 bp, Artificial Sequence
  Description of Artificial Sequence: Synthetic oligonucleotide
  Target: ATXN1; (-) strand; PAM type: YTN; PAM sequence: TTG
gtcccaatggcttaggatgc

SEQ ID NO: 182805 - DNA, 20 bp, Artificial Sequence
  Description of Artificial Sequence: Synthetic oligonucleotide
  Target: ATXN1; (-) strand; PAM type: YTN; PAM sequence: TTG
cgggacaaattggtcccaat

SEQ ID NO: 182806 - DNA, 20 bp, Artificial Sequence
  Description of Artificial Sequence: Synthetic oligonucleotide
  Target: ATXN1; (-) strand; PAM type: YTN; PAM sequence: TTT
gcgggacaaattggtcccaa

SEQ ID NO: 182807 - DNA, 20 bp, Artificial Sequence
  Description of Artificial Sequence: Synthetic oligonucleotide
  Target: ATXN1; (-) strand; PAM type: YTN; PAM sequence: TTC
agggtttgcgggacaaattg

SEQ ID NO: 182808 - DNA, 20 bp, Artificial Sequence
  Description of Artificial Sequence: Synthetic oligonucleotide
  Target: ATXN1; (-) strand; PAM type: YTN; PAM sequence: TTT
cagggtttgcgggacaaatt

SEQ ID NO: 182809 - DNA, 20 bp, Artificial Sequence
  Description of Artificial Sequence: Synthetic oligonucleotide
  Target: ATXN1; (-) strand; PAM type: YTN; PAM sequence: TTT
tcagggtttgcgggacaaat

SEQ ID NO: 182810 - DNA, 20 bp, Artificial Sequence
  Description of Artificial Sequence: Synthetic oligonucleotide
  Target: ATXN1; (-) strand; PAM type: YTN; PAM sequence: TTT
ttcagggtttgcgggacaaa

SEQ ID NO: 182811 - DNA, 20 bp, Artificial Sequence
  Description of Artificial Sequence: Synthetic oligonucleotide
  Target: ATXN1; (-) strand; PAM type: YTN; PAM sequence: CTT
tttcagggtttgcgggacaa

SEQ ID NO: 182812 - DNA, 20 bp, Artificial Sequence
  Description of Artificial Sequence: Synthetic oligonucleotide
  Target: ATXN1; (-) strand; PAM type: YTN; PAM sequence: TTC
tttttcagggtttgcgggac

SEQ ID NO: 182813 - DNA, 20 bp, Artificial Sequence
  Description of Artificial Sequence: Synthetic oligonucleotide
  Target: ATXN1; (-) strand; PAM type: YTN; PAM sequence: CTT
ctttttcagggtttgcggga

SEQ ID NO: 182814 - DNA, 20 bp, Artificial Sequence
  Description of Artificial Sequence: Synthetic oligonucleotide
  Target: ATXN1; (-) strand; PAM type: YTN; PAM sequence: TTA
aggccagaccgtagtgcaga

SEQ ID NO: 182815 - DNA, 20 bp, Artificial Sequence
  Description of Artificial Sequence: Synthetic oligonucleotide
  Target: ATXN1; (-) strand; PAM type: YTN; PAM sequence: TTA
gagagataatattaaggcca

SEQ ID NO: 182816 - DNA, 20 bp, Artificial Sequence
  Description of Artificial Sequence: Synthetic oligonucleotide
  Target: ATXN1; (-) strand; PAM type: YTN; PAM sequence: CTA
ttagagagataatattaagg

SEQ ID NO: 182817 - DNA, 20 bp, Artificial Sequence
  Description of Artificial Sequence: Synthetic oligonucleotide
  Target: ATXN1; (-) strand; PAM type: YTN; PAM sequence: TTC
cctattagagagataatatt

SEQ ID NO: 182818 - DNA, 20 bp, Artificial Sequence
  Description of Artificial Sequence: Synthetic oligonucleotide
  Target: ATXN1; (-) strand; PAM type: YTN; PAM sequence: TTT
ccctattagagagataatat

SEQ ID NO: 182819 - DNA, 20 bp, Artificial Sequence
  Description of Artificial Sequence: Synthetic oligonucleotide
  Target: ATXN1; (-) strand; PAM type: YTN; PAM sequence: TTT
tccctattagagagataata

SEQ ID NO: 182820 - DNA, 20 bp, Artificial Sequence
  Description of Artificial Sequence: Synthetic oligonucleotide
  Target: ATXN1; (-) strand; PAM type: YTN; PAM sequence: TTT
ttccctattagagagataat

SEQ ID NO: 182821 - DNA, 20 bp, Artificial Sequence
  Description of Artificial Sequence: Synthetic oligonucleotide
  Target: ATXN1; (-) strand; PAM type: YTN; PAM sequence: CTC
aggtgaccatttttccctat

SEQ ID NO: 182822 - DNA, 20 bp, Artificial Sequence
  Description of Artificial Sequence: Synthetic oligonucleotide
  Target: ATXN1; (-) strand; PAM type: YTN; PAM sequence: TTC
cctcaggtgaccatttttcc

SEQ ID NO: 182823 - DNA, 20 bp, Artificial Sequence
  Description of Artificial Sequence: Synthetic oligonucleotide
  Target: ATXN1; (-) strand; PAM type: YTN; PAM sequence: CTT
ccctcaggtgaccatttttc

SEQ ID NO: 182824 - DNA, 20 bp, Artificial Sequence
  Description of Artificial Sequence: Synthetic oligonucleotide
  Target: ATXN1; (-) strand; PAM type: YTN; PAM sequence: TTA
tacttccctcaggtgaccat

SEQ ID NO: 182825 - DNA, 20 bp, Artificial Sequence
  Description of Artificial Sequence: Synthetic oligonucleotide
  Target: ATXN1; (-) strand; PAM type: YTN; PAM sequence: TTT
atacttccctcaggtgacca

SEQ ID NO: 182826 - DNA, 20 bp, Artificial Sequence
  Description of Artificial Sequence: Synthetic oligonucleotide
  Target: ATXN1; (-) strand; PAM type: YTN; PAM sequence: TTG
taatttatacttccctcagg

SEQ ID NO: 182827 - DNA, 20 bp, Artificial Sequence
  Description of Artificial Sequence: Synthetic oligonucleotide
  Target: ATXN1; (-) strand; PAM type: YTN; PAM sequence: CTG
cagaatagtgttgtaattta

SEQ ID NO: 182828 - DNA, 20 bp, Artificial Sequence
  Description of Artificial Sequence: Synthetic oligonucleotide
  Target: ATXN1; (-) strand; PAM type: YTN; PAM sequence: TTA
cagaaaaggtcaacctgcag

SEQ ID NO: 182829 - DNA, 20 bp, Artificial Sequence
  Description of Artificial Sequence: Synthetic oligonucleotide
  Target: ATXN1; (-) strand; PAM type: YTN; PAM sequence: CTT
acagaaaaggtcaacctgca

SEQ ID NO: 182830 - DNA, 20 bp, Artificial Sequence
  Description of Artificial Sequence: Synthetic oligonucleotide
  Target: ATXN1; (-) strand; PAM type: YTN; PAM sequence: CTC
ttacagaaaaggtcaacctg

SEQ ID NO: 182831 - DNA, 20 bp, Artificial Sequence
  Description of Artificial Sequence: Synthetic oligonucleotide
  Target: ATXN1; (-) strand; PAM type: YTN; PAM sequence: TTC
cctcttacagaaaaggtcaa

SEQ ID NO: 182832 - DNA, 20 bp, Artificial Sequence
  Description of Artificial Sequence: Synthetic oligonucleotide
  Target: ATXN1; (-) strand; PAM type: YTN; PAM sequence: CTT
ccctcttacagaaaaggtca

SEQ ID NO: 182833 - DNA, 20 bp, Artificial Sequence
  Description of Artificial Sequence: Synthetic oligonucleotide
  Target: ATXN1; (-) strand; PAM type: YTN; PAM sequence: TTC
ccttccctcttacagaaaag

SEQ ID NO: 182834 - DNA, 20 bp, Artificial Sequence
  Description of Artificial Sequence: Synthetic oligonucleotide
  Target: ATXN1; (-) strand; PAM type: YTN; PAM sequence: TTT
cccttccctcttacagaaaa

SEQ ID NO: 182835 - DNA, 20 bp, Artificial Sequence
  Description of Artificial Sequence: Synthetic oligonucleotide
  Target: ATXN1; (-) strand; PAM type: YTN; PAM sequence: CTC
catttcccttccctcttaca

SEQ ID NO: 182836 - DNA, 20 bp, Artificial Sequence
  Description of Artificial Sequence: Synthetic oligonucleotide
  Target: ATXN1; (-) strand; PAM type: YTN; PAM sequence: TTC
actccatttcccttccctct

SEQ ID NO: 182837 - DNA, 20 bp, Artificial Sequence
  Description of Artificial Sequence: Synthetic oligonucleotide
  Target: ATXN1; (-) strand; PAM type: YTN; PAM sequence: TTT
cactccatttcccttccctc

SEQ ID NO: 182838 - DNA, 20 bp, Artificial Sequence
  Description of Artificial Sequence: Synthetic oligonucleotide
  Target: ATXN1; (-) strand; PAM type: YTN; PAM sequence: TTG
gacataaggtatttcactcc

SEQ ID NO: 182839 - DNA, 20 bp, Artificial Sequence
  Description of Artificial Sequence: Synthetic oligonucleotide
  Target: ATXN1; (-) strand; PAM type: YTN; PAM sequence: CTT
ggacataaggtatttcactc

SEQ ID NO: 182840 - DNA, 20 bp, Artificial Sequence
  Description of Artificial Sequence: Synthetic oligonucleotide
  Target: ATXN1; (-) strand; PAM type: YTN; PAM sequence: TTC
agtaaaaagaaagcttggac

SEQ ID NO: 182841 - DNA, 20 bp, Artificial Sequence
  Description of Artificial Sequence: Synthetic oligonucleotide
  Target: ATXN1; (-) strand; PAM type: YTN; PAM sequence: CTT
cagtaaaaagaaagcttgga

SEQ ID NO: 182842 - DNA, 20 bp, Artificial Sequence
  Description of Artificial Sequence: Synthetic oligonucleotide
  Target: ATXN1; (-) strand; PAM type: YTN; PAM sequence: TTA
tccttcagtaaaaagaaagc

SEQ ID NO: 182843 - DNA, 20 bp, Artificial Sequence
  Description of Artificial Sequence: Synthetic oligonucleotide
  Target: ATXN1; (-) strand; PAM type: YTN; PAM sequence: TTG
tggattatccttcagtaaaa

SEQ ID NO: 182844 - DNA, 20 bp, Artificial Sequence
  Description of Artificial Sequence: Synthetic oligonucleotide
  Target: ATXN1; (-) strand; PAM type: YTN; PAM sequence: TTG
catagttgtggattatcctt

SEQ ID NO: 182845 - DNA, 20 bp, Artificial Sequence
  Description of Artificial Sequence: Synthetic oligonucleotide
  Target: ATXN1; (-) strand; PAM type: YTN; PAM sequence: TTT
gcatagttgtggattatcct

SEQ ID NO: 182846 - DNA, 20 bp, Artificial Sequence
  Description of Artificial Sequence: Synthetic oligonucleotide
  Target: ATXN1; (-) strand; PAM type: YTN; PAM sequence: CTT
tgcatagttgtggattatcc

SEQ ID NO: 182847 - DNA, 20 bp, Artificial Sequence
  Description of Artificial Sequence: Synthetic oligonucleotide
  Target: ATXN1; (-) strand; PAM type: YTN; PAM sequence: CTG
tggaatgtaaatcgccagct

SEQ ID NO: 182848 - DNA, 20 bp, Artificial Sequence
  Description of Artificial Sequence: Synthetic oligonucleotide
  Target: ATXN1; (-) strand; PAM type: YTN; PAM sequence: CTC
ctgtggaatgtaaatcgcca

SEQ ID NO: 182849 - DNA, 20 bp, Artificial Sequence
  Description of Artificial Sequence: Synthetic oligonucleotide
  Target: ATXN1; (-) strand; PAM type: YTN; PAM sequence: CTG
agaggtcctcctgtggaatg

SEQ ID NO: 182850 - DNA, 20 bp, Artificial Sequence
  Description of Artificial Sequence: Synthetic oligonucleotide
  Target: ATXN1; (-) strand; PAM type: YTN; PAM sequence: CTA
ggatatggaggtaatctgag

SEQ ID NO: 182851 - DNA, 20 bp, Artificial Sequence
  Description of Artificial Sequence: Synthetic oligonucleotide
  Target: ATXN1; (-) strand; PAM type: YTN; PAM sequence: CTG
tagggaggctaggatatgga

SEQ ID NO: 182852 - DNA, 20 bp, Artificial Sequence
  Description of Artificial Sequence: Synthetic oligonucleotide
  Target: ATXN1; (-) strand; PAM type: YTN; PAM sequence: TTA
ataggaaggggagctgtagg

SEQ ID NO: 182853 - DNA, 20 bp, Artificial Sequence
  Description of Artificial Sequence: Synthetic oligonucleotide
  Target: ATXN1; (-) strand; PAM type: YTN; PAM sequence: CTC
atcattaataggaaggggag

SEQ ID NO: 182854 - DNA, 20 bp, Artificial Sequence
  Description of Artificial Sequence: Synthetic oligonucleotide
  Target: ATXN1; (-) strand; PAM type: YTN; PAM sequence: TTA
gaggaggctcatcattaata

SEQ ID NO: 182855 - DNA, 20 bp, Artificial Sequence
  Description of Artificial Sequence: Synthetic oligonucleotide
  Target: ATXN1; (-) strand; PAM type: YTN; PAM sequence: CTG
gatggaggagattagaggag

SEQ ID NO: 182856 - DNA, 20 bp, Artificial Sequence
  Description of Artificial Sequence: Synthetic oligonucleotide
  Target: ATXN1; (-) strand; PAM type: YTN; PAM sequence: TTC
tggatggaggagattagagg

SEQ ID NO: 182857 - DNA, 20 bp, Artificial Sequence
  Description of Artificial Sequence: Synthetic oligonucleotide
  Target: ATXN1; (-) strand; PAM type: YTN; PAM sequence: CTT
ctggatggaggagattagag

SEQ ID NO: 182858 - DNA, 20 bp, Artificial Sequence
  Description of Artificial Sequence: Synthetic oligonucleotide
  Target: ATXN1; (-) strand; PAM type: YTN; PAM sequence: TTC
cttctggatggaggagatta

SEQ ID NO: 182859 - DNA, 20 bp, Artificial Sequence
  Description of Artificial Sequence: Synthetic oligonucleotide
  Target: ATXN1; (-) strand; PAM type: YTN; PAM sequence: TTT
ccttctggatggaggagatt

SEQ ID NO: 182860 - DNA, 20 bp, Artificial Sequence
  Description of Artificial Sequence: Synthetic oligonucleotide
  Target: ATXN1; (-) strand; PAM type: YTN; PAM sequence: TTG
tttccttctggatggaggag

SEQ ID NO: 182861 - DNA, 20 bp, Artificial Sequence
  Description of Artificial Sequence: Synthetic oligonucleotide
  Target: ATXN1; (-) strand; PAM type: YTN; PAM sequence: CTT
gtttccttctggatggagga

SEQ ID NO: 182862 - DNA, 20 bp, Artificial Sequence
  Description of Artificial Sequence: Synthetic oligonucleotide
  Target: ATXN1; (-) strand; PAM type: YTN; PAM sequence: TTG
cttgtttccttctggatgga

SEQ ID NO: 182863 - DNA, 20 bp, Artificial Sequence
  Description of Artificial Sequence: Synthetic oligonucleotide
  Target: ATXN1; (-) strand; PAM type: YTN; PAM sequence: TTT
gcttgtttccttctggatgg

SEQ ID NO: 182864 - DNA, 20 bp, Artificial Sequence
  Description of Artificial Sequence: Synthetic oligonucleotide
  Target: ATXN1; (-) strand; PAM type: YTN; PAM sequence: CTT
tgcttgtttccttctggatg

SEQ ID NO: 182865 - DNA, 20 bp, Artificial Sequence
  Description of Artificial Sequence: Synthetic oligonucleotide
  Target: ATXN1; (-) strand; PAM type: YTN; PAM sequence: TTC
tttgcttgtttccttctgga

SEQ ID NO: 182866 - DNA, 20 bp, Artificial Sequence
  Description of Artificial Sequence: Synthetic oligonucleotide
  Target: ATXN1; (-) strand; PAM type: YTN; PAM sequence: TTT
ctttgcttgtttccttctgg

SEQ ID NO: 182867 - DNA, 20 bp, Artificial Sequence
  Description of Artificial Sequence: Synthetic oligonucleotide
  Target: ATXN1; (-) strand; PAM type: YTN; PAM sequence: TTG
gaaatttctttgcttgtttc

SEQ ID NO: 182868 - DNA, 20 bp, Artificial Sequence
  Description of Artificial Sequence: Synthetic oligonucleotide
  Target: ATXN1; (-) strand; PAM type: YTN; PAM sequence: TTT
ggaaatttctttgcttgttt

SEQ ID NO: 182869 - DNA, 20 bp, Artificial Sequence
  Description of Artificial Sequence: Synthetic oligonucleotide
  Target: ATXN1; (-) strand; PAM type: YTN; PAM sequence: CTT
tggaaatttctttgcttgtt

SEQ ID NO: 182870 - DNA, 20 bp, Artificial Sequence
  Description of Artificial Sequence: Synthetic oligonucleotide
  Target: ATXN1; (-) strand; PAM type: YTN; PAM sequence: TTG
gtggtcctttggaaatttct

SEQ ID NO: 182871 - DNA, 20 bp, Artificial Sequence
  Description of Artificial Sequence: Synthetic oligonucleotide
  Target: ATXN1; (-) strand; PAM type: YTN; PAM sequence: TTT
ggtggtcctttggaaatttc

SEQ ID NO: 182872 - DNA, 20 bp, Artificial Sequence
  Description of Artificial Sequence: Synthetic oligonucleotide
  Target: ATXN1; (-) strand; PAM type: YTN; PAM sequence: CTG
aggggtttggtggtcctttg

SEQ ID NO: 182873 - DNA, 20 bp, Artificial Sequence
  Description of Artificial Sequence: Synthetic oligonucleotide
  Target: ATXN1; (-) strand; PAM type: YTN; PAM sequence: CTG
atagcctgaggggtttggtg

SEQ ID NO: 182874 - DNA, 20 bp, Artificial Sequence
  Description of Artificial Sequence: Synthetic oligonucleotide
  Target: ATXN1; (-) strand; PAM type: YTN; PAM sequence: TTA
aaggagacataactgatagc

SEQ ID NO: 182875 - DNA, 20 bp, Artificial Sequence
  Description of Artificial Sequence: Synthetic oligonucleotide
  Target: ATXN1; (-) strand; PAM type: YTN; PAM sequence: CTT
aaaggagacataactgatag

SEQ ID NO: 182876 - DNA, 20 bp, Artificial Sequence
  Description of Artificial Sequence: Synthetic oligonucleotide
  Target: ATXN1; (-) strand; PAM type: YTN; PAM sequence: CTA
cagcttaaaggagacataac

SEQ ID NO: 182877 - DNA, 20 bp, Artificial Sequence
  Description of Artificial Sequence: Synthetic oligonucleotide
  Target: ATXN1; (-) strand; PAM type: YTN; PAM sequence: CTC
cccctacagcttaaaggaga

SEQ ID NO: 182878 - DNA, 20 bp, Artificial Sequence
  Description of Artificial Sequence: Synthetic oligonucleotide
  Target: ATXN1; (-) strand; PAM type: YTN; PAM sequence: TTC
ccctccccctacagcttaaa

SEQ ID NO: 182879 - DNA, 20 bp, Artificial Sequence
  Description of Artificial Sequence: Synthetic oligonucleotide
  Target: ATXN1; (-) strand; PAM type: YTN; PAM sequence: TTG
ggccaaattcccctccccct

SEQ ID NO: 182880 - DNA, 20 bp, Artificial Sequence
  Description of Artificial Sequence: Synthetic oligonucleotide
  Target: ATXN1; (-) strand; PAM type: YTN; PAM sequence: TTC
agagagagagaaggtcccat

SEQ ID NO: 182881 - DNA, 20 bp, Artificial Sequence
  Description of Artificial Sequence: Synthetic oligonucleotide
  Target: ATXN1; (-) strand; PAM type: YTN; PAM sequence: TTA
attcagagagagagaaggtc

SEQ ID NO: 182882 - DNA, 20 bp, Artificial Sequence
  Description of Artificial Sequence: Synthetic oligonucleotide
  Target: ATXN1; (-) strand; PAM type: YTN; PAM sequence: TTT
aattcagagagagagaaggt

SEQ ID NO: 182883 - DNA, 20 bp, Artificial Sequence
  Description of Artificial Sequence: Synthetic oligonucleotide
  Target: ATXN1; (-) strand; PAM type: YTN; PAM sequence: CTT
taattcagagagagagaagg

SEQ ID NO: 182884 - DNA, 20 bp, Artificial Sequence
  Description of Artificial Sequence: Synthetic oligonucleotide
  Target: ATXN1; (-) strand; PAM type: YTN; PAM sequence: CTG
ctttaattcagagagagaga

SEQ ID NO: 182885 - DNA, 20 bp, Artificial Sequence
  Description of Artificial Sequence: Synthetic oligonucleotide
  Target: ATXN1; (-) strand; PAM type: YTN; PAM sequence: TTG
atctgctttaattcagagag

SEQ ID NO: 182886 - DNA, 20 bp, Artificial Sequence
  Description of Artificial Sequence: Synthetic oligonucleotide
  Target: ATXN1; (-) strand; PAM type: YTN; PAM sequence: CTT
gatctgctttaattcagaga

SEQ ID NO: 182887 - DNA, 20 bp, Artificial Sequence
  Description of Artificial Sequence: Synthetic oligonucleotide
  Target: ATXN1; (-) strand; PAM type: YTN; PAM sequence: CTA
ccttgatctgctttaattca

SEQ ID NO: 182888 - DNA, 20 bp, Artificial Sequence
  Description of Artificial Sequence: Synthetic oligonucleotide
  Target: ATXN1; (-) strand; PAM type: YTN; PAM sequence: TTC
ccaggtctaccttgatctgc

SEQ ID NO: 182889 - DNA, 20 bp, Artificial Sequence
  Description of Artificial Sequence: Synthetic oligonucleotide
  Target: ATXN1; (-) strand; PAM type: YTN; PAM sequence: TTT
cccaggtctaccttgatctg

SEQ ID NO: 182890 - DNA, 20 bp, Artificial Sequence
  Description of Artificial Sequence: Synthetic oligonucleotide
  Target: ATXN1; (-) strand; PAM type: YTN; PAM sequence: CTT
tcccaggtctaccttgatct

SEQ ID NO: 182891 - DNA, 20 bp, Artificial Sequence
  Description of Artificial Sequence: Synthetic oligonucleotide
  Target: ATXN1; (-) strand; PAM type: YTN; PAM sequence: CTG
aaaactttcccaggtctacc

SEQ ID NO: 182892 - DNA, 20 bp, Artificial Sequence
  Description of Artificial Sequence: Synthetic oligonucleotide
  Target: ATXN1; (-) strand; PAM type: YTN; PAM sequence: CTA
ccaggatcatctgaaaactt

SEQ ID NO: 182893 - DNA, 20 bp, Artificial Sequence
  Description of Artificial Sequence: Synthetic oligonucleotide
  Target: ATXN1; (-) strand; PAM type: YTN; PAM sequence: CTA
tatacctaccaggatcatct

SEQ ID NO: 182894 - DNA, 20 bp, Artificial Sequence
  Description of Artificial Sequence: Synthetic oligonucleotide
  Target: ATXN1; (-) strand; PAM type: YTN; PAM sequence: CTG
taggacatctatatacctac

SEQ ID NO: 182895 - DNA, 20 bp, Artificial Sequence
  Description of Artificial Sequence: Synthetic oligonucleotide
  Target: ATXN1; (-) strand; PAM type: YTN; PAM sequence: CTG
gaccctgtaggacatctata

SEQ ID NO: 182896 - DNA, 20 bp, Artificial Sequence
  Description of Artificial Sequence: Synthetic oligonucleotide
  Target: ATXN1; (-) strand; PAM type: YTN; PAM sequence: TTG
ccctggaccctgtaggacat

SEQ ID NO: 182897 - DNA, 20 bp, Artificial Sequence
  Description of Artificial Sequence: Synthetic oligonucleotide
  Target: ATXN1; (-) strand; PAM type: YTN; PAM sequence: TTT
gccctggaccctgtaggaca

SEQ ID NO: 182898 - DNA, 20 bp, Artificial Sequence
  Description of Artificial Sequence: Synthetic oligonucleotide
  Target: ATXN1; (-) strand; PAM type: YTN; PAM sequence: CTC
caagtgaggtcgaaggtttg

SEQ ID NO: 182899 - DNA, 20 bp, Artificial Sequence
  Description of Artificial Sequence: Synthetic oligonucleotide
  Target: ATXN1; (-) strand; PAM type: YTN; PAM sequence: CTC
tccaagtgaggtcgaaggtt

SEQ ID NO: 182900 - DNA, 20 bp, Artificial Sequence
  Description of Artificial Sequence: Synthetic oligonucleotide
  Target: ATXN1; (-) strand; PAM type: YTN; PAM sequence: CTA
acaatagcatgacatctctc

SEQ ID NO: 182901 - DNA, 20 bp, Artificial Sequence
  Description of Artificial Sequence: Synthetic oligonucleotide
  Target: ATXN1; (-) strand; PAM type: YTN; PAM sequence: TTG
atctaacaatagcatgacat

SEQ ID NO: 182902 - DNA, 20 bp, Artificial Sequence
  Description of Artificial Sequence: Synthetic oligonucleotide
  Target: ATXN1; (-) strand; PAM type: YTN; PAM sequence: TTT
gatctaacaatagcatgaca

SEQ ID NO: 182903 - DNA, 20 bp, Artificial Sequence
  Description of Artificial Sequence: Synthetic oligonucleotide
  Target: ATXN1; (-) strand; PAM type: YTN; PAM sequence: TTA
aaggccagggtttgatctaa

SEQ ID NO: 182904 - DNA, 20 bp, Artificial Sequence
  Description of Artificial Sequence: Synthetic oligonucleotide
  Target: ATXN1; (-) strand; PAM type: YTN; PAM sequence: TTC
attaaaggccagggtttgat

SEQ ID NO: 182905 - DNA, 20 bp, Artificial Sequence
  Description of Artificial Sequence: Synthetic oligonucleotide
  Target: ATXN1; (-) strand; PAM type: YTN; PAM sequence: TTT
cattaaaggccagggtttga

SEQ ID NO: 182906 - DNA, 20 bp, Artificial Sequence
  Description of Artificial Sequence: Synthetic oligonucleotide
  Target: ATXN1; (-) strand; PAM type: YTN; PAM sequence: TTT
tcattaaaggccagggtttg

SEQ ID NO: 182907 - DNA, 20 bp, Artificial Sequence
  Description of Artificial Sequence: Synthetic oligonucleotide
  Target: ATXN1; (-) strand; PAM type: YTN; PAM sequence: CTT
ttcattaaaggccagggttt

SEQ ID NO: 182908 - DNA, 20 bp, Artificial Sequence
  Description of Artificial Sequence: Synthetic oligonucleotide
  Target: ATXN1; (-) strand; PAM type: YTN; PAM sequence: TTC
ttttcattaaaggccagggt

SEQ ID NO: 182909 - DNA, 20 bp, Artificial Sequence
  Description of Artificial Sequence: Synthetic oligonucleotide
  Target: ATXN1; (-) strand; PAM type: YTN; PAM sequence: CTG
cattcttttcattaaaggcc

SEQ ID NO: 182910 - DNA, 20 bp, Artificial Sequence
  Description of Artificial Sequence: Synthetic oligonucleotide
  Target: ATXN1; (-) strand; PAM type: YTN; PAM sequence: CTA
aagctgcattcttttcatta

SEQ ID NO: 182911 - DNA, 20 bp, Artificial Sequence
  Description of Artificial Sequence: Synthetic oligonucleotide
  Target: ATXN1; (-) strand; PAM type: YTN; PAM sequence: CTG
cagctaaagctgcattcttt

SEQ ID NO: 182912 - DNA, 20 bp, Artificial Sequence
  Description of Artificial Sequence: Synthetic oligonucleotide
  Target: ATXN1; (-) strand; PAM type: YTN; PAM sequence: CTC
gggctgcagctaaagctgca

SEQ ID NO: 182913 - DNA, 20 bp, Artificial Sequence
  Description of Artificial Sequence: Synthetic oligonucleotide
  Target: ATXN1; (-) strand; PAM type: YTN; PAM sequence: TTC
tcgggctgcagctaaagctg

SEQ ID NO: 182914 - DNA, 20 bp, Artificial Sequence
  Description of Artificial Sequence: Synthetic oligonucleotide
  Target: ATXN1; (-) strand; PAM type: YTN; PAM sequence: CTC
caaattctcgggctgcagct

SEQ ID NO: 182915 - DNA, 20 bp, Artificial Sequence
  Description of Artificial Sequence: Synthetic oligonucleotide
  Target: ATXN1; (-) strand; PAM type: YTN; PAM sequence: CTA
agataccaggtatctccaaa

SEQ ID NO: 182916 - DNA, 20 bp, Artificial Sequence
  Description of Artificial Sequence: Synthetic oligonucleotide
  Target: ATXN1; (-) strand; PAM type: YTN; PAM sequence: TTG
actaagataccaggtatctc

SEQ ID NO: 182917 - DNA, 20 bp, Artificial Sequence
  Description of Artificial Sequence: Synthetic oligonucleotide
  Target: ATXN1; (-) strand; PAM type: YTN; PAM sequence: CTT
gactaagataccaggtatct

SEQ ID NO: 182918 - DNA, 20 bp, Artificial Sequence
  Description of Artificial Sequence: Synthetic oligonucleotide
  Target: ATXN1; (-) strand; PAM type: YTN; PAM sequence: TTA
cttgactaagataccaggta

SEQ ID NO: 182919 - DNA, 20 bp, Artificial Sequence
  Description of Artificial Sequence: Synthetic oligonucleotide
  Target: ATXN1; (-) strand; PAM type: YTN; PAM sequence: TTT
acttgactaagataccaggt

SEQ ID NO: 182920 - DNA, 20 bp, Artificial Sequence
  Description of Artificial Sequence: Synthetic oligonucleotide
  Target: ATXN1; (-) strand; PAM type: YTN; PAM sequence: TTG
tcatttacttgactaagata

SEQ ID NO: 182921 - DNA, 20 bp, Artificial Sequence
  Description of Artificial Sequence: Synthetic oligonucleotide
  Target: ATXN1; (-) strand; PAM type: YTN; PAM sequence: TTT
gtcatttacttgactaagat

SEQ ID NO: 182922 - DNA, 20 bp, Artificial Sequence
  Description of Artificial Sequence: Synthetic oligonucleotide
  Target: ATXN1; (-) strand; PAM type: YTN; PAM sequence: TTT
tgtcatttacttgactaaga

SEQ ID NO: 182923 - DNA, 20 bp, Artificial Sequence
  Description of Artificial Sequence: Synthetic oligonucleotide
  Target: ATXN1; (-) strand; PAM type: YTN; PAM sequence: CTG
tcattttgtcatttacttga

SEQ ID NO: 182924 - DNA, 20 bp, Artificial Sequence
  Description of Artificial Sequence: Synthetic oligonucleotide
  Target: ATXN1; (-) strand; PAM type: YTN; PAM sequence: TTC
ggctgtcattttgtcattta

SEQ ID NO: 182925 - DNA, 20 bp, Artificial Sequence
  Description of Artificial Sequence: Synthetic oligonucleotide
  Target: ATXN1; (-) strand; PAM type: YTN; PAM sequence: CTT
cggctgtcattttgtcattt

SEQ ID NO: 182926 - DNA, 20 bp, Artificial Sequence
  Description of Artificial Sequence: Synthetic oligonucleotide
  Target: ATXN1; (-) strand; PAM type: YTN; PAM sequence: TTC
ttcggctgtcattttgtcat

SEQ ID NO: 182927 - DNA, 20 bp, Artificial Sequence
  Description of Artificial Sequence: Synthetic oligonucleotide
  Target: ATXN1; (-) strand; PAM type: YTN; PAM sequence: TTT
cttcggctgtcattttgtca

SEQ ID NO: 182928 - DNA, 20 bp, Artificial Sequence
  Description of Artificial Sequence: Synthetic oligonucleotide
  Target: ATXN1; (-) strand; PAM type: YTN; PAM sequence: CTT
tcttcggctgtcattttgtc

SEQ ID NO: 182929 - DNA, 20 bp, Artificial Sequence
  Description of Artificial Sequence: Synthetic oligonucleotide
  Target: ATXN1; (-) strand; PAM type: YTN; PAM sequence: TTG
tccctttcttcggctgtcat

SEQ ID NO: 182930 - DNA, 20 bp, Artificial Sequence
  Description of Artificial Sequence: Synthetic oligonucleotide
  Target: ATXN1; (-) strand; PAM type: YTN; PAM sequence: TTT
gtccctttcttcggctgtca

SEQ ID NO: 182931 - DNA, 20 bp, Artificial Sequence
  Description of Artificial Sequence: Synthetic oligonucleotide
  Target: ATXN1; (-) strand; PAM type: YTN; PAM sequence: TTA
gggaatttgtccctttcttc

SEQ ID NO: 182932 - DNA, 20 bp, Artificial Sequence
  Description of Artificial Sequence: Synthetic oligonucleotide
  Target: ATXN1; (-) strand; PAM type: YTN; PAM sequence: CTG
cccattagggaatttgtccc

SEQ ID NO: 182933 - DNA, 20 bp, Artificial Sequence
  Description of Artificial Sequence: Synthetic oligonucleotide
  Target: ATXN1; (-) strand; PAM type: YTN; PAM sequence: TTG
ctgcccattagggaatttgt

SEQ ID NO: 182934 - DNA, 20 bp, Artificial Sequence
  Description of Artificial Sequence: Synthetic oligonucleotide
  Target: ATXN1; (-) strand; PAM type: YTN; PAM sequence: CTT
gctgcccattagggaatttg

SEQ ID NO: 182935 - DNA, 20 bp, Artificial Sequence
  Description of Artificial Sequence: Synthetic oligonucleotide
  Target: ATXN1; (-) strand; PAM type: YTN; PAM sequence: CTA
ggtcccagtggggatccata

SEQ ID NO: 182936 - DNA, 20 bp, Artificial Sequence
  Description of Artificial Sequence: Synthetic oligonucleotide
  Target: ATXN1; (-) strand; PAM type: YTN; PAM sequence: CTG
agtctaggtcccagtgggga

SEQ ID NO: 182937 - DNA, 20 bp, Artificial Sequence
  Description of Artificial Sequence: Synthetic oligonucleotide
  Target: ATXN1; (-) strand; PAM type: YTN; PAM sequence: TTC
ccatgatctgagtctaggtc

SEQ ID NO: 182938 - DNA, 20 bp, Artificial Sequence
  Description of Artificial Sequence: Synthetic oligonucleotide
  Target: ATXN1; (-) strand; PAM type: YTN; PAM sequence: CTC
cagttcccatgatctgagtc

SEQ ID NO: 182939 - DNA, 20 bp, Artificial Sequence
  Description of Artificial Sequence: Synthetic oligonucleotide
  Target: ATXN1; (-) strand; PAM type: YTN; PAM sequence: TTG
cgactccagttcccatgatc

SEQ ID NO: 182940 - DNA, 20 bp, Artificial Sequence
  Description of Artificial Sequence: Synthetic oligonucleotide
  Target: ATXN1; (-) strand; PAM type: YTN; PAM sequence: TTT
gcgactccagttcccatgat

SEQ ID NO: 182941 - DNA, 20 bp, Artificial Sequence
  Description of Artificial Sequence: Synthetic oligonucleotide
  Target: ATXN1; (-) strand; PAM type: YTN; PAM sequence: CTG
gaatacaggtcaacagatgt

SEQ ID NO: 182942 - DNA, 20 bp, Artificial Sequence
  Description of Artificial Sequence: Synthetic oligonucleotide
  Target: ATXN1; (-) strand; PAM type: YTN; PAM sequence: TTC
tggaatacaggtcaacagat

SEQ ID NO: 182943 - DNA, 20 bp, Artificial Sequence
  Description of Artificial Sequence: Synthetic oligonucleotide
  Target: ATXN1; (-) strand; PAM type: YTN; PAM sequence: CTT
ctggaatacaggtcaacaga

SEQ ID NO: 182944 - DNA, 20 bp, Artificial Sequence
  Description of Artificial Sequence: Synthetic oligonucleotide
  Target: ATXN1; (-) strand; PAM type: YTN; PAM sequence: TTA
gtccttctggaatacaggtc

SEQ ID NO: 182945 - DNA, 20 bp, Artificial Sequence
  Description of Artificial Sequence: Synthetic oligonucleotide
  Target: ATXN1; (-) strand; PAM type: YTN; PAM sequence: CTT
agtccttctggaatacaggt

SEQ ID NO: 182946 - DNA, 20 bp, Artificial Sequence
  Description of Artificial Sequence: Synthetic oligonucleotide
  Target: ATXN1; (-) strand; PAM type: YTN; PAM sequence: CTC
cttagtccttctggaataca

SEQ ID NO: 182947 - DNA, 20 bp, Artificial Sequence
  Description of Artificial Sequence: Synthetic oligonucleotide
  Target: ATXN1; (-) strand; PAM type: YTN; PAM sequence: TTC
tccttagtccttctggaata

SEQ ID NO: 182948 - DNA, 20 bp, Artificial Sequence
  Description of Artificial Sequence: Synthetic oligonucleotide
  Target: ATXN1; (-) strand; PAM type: YTN; PAM sequence: CTA
attctccttagtccttctgg

SEQ ID NO: 182949 - DNA, 20 bp, Artificial Sequence
  Description of Artificial Sequence: Synthetic oligonucleotide
  Target: ATXN1; (-) strand; PAM type: YTN; PAM sequence: TTC
ctaattctccttagtccttc

SEQ ID NO: 182950 - DNA, 20 bp, Artificial Sequence
  Description of Artificial Sequence: Synthetic oligonucleotide
  Target: ATXN1; (-) strand; PAM type: YTN; PAM sequence: TTT
cctaattctccttagtcctt

SEQ ID NO: 182951 - DNA, 20 bp, Artificial Sequence
  Description of Artificial Sequence: Synthetic oligonucleotide
  Target: ATXN1; (-) strand; PAM type: YTN; PAM sequence: TTT
tcctaattctccttagtcct

SEQ ID NO: 182952 - DNA, 20 bp, Artificial Sequence
  Description of Artificial Sequence: Synthetic oligonucleotide
  Target: ATXN1; (-) strand; PAM type: YTN; PAM sequence: TTT
ttcctaattctccttagtcc

SEQ ID NO: 182953 - DNA, 20 bp, Artificial Sequence
  Description of Artificial Sequence: Synthetic oligonucleotide
  Target: ATXN1; (-) strand; PAM type: YTN; PAM sequence: CTT
tttcctaattctccttagtc

SEQ ID NO: 182954 - DNA, 20 bp, Artificial Sequence
  Description of Artificial Sequence: Synthetic oligonucleotide
  Target: ATXN1; (-) strand; PAM type: YTN; PAM sequence: TTC
atgggctttttcctaattct

SEQ ID NO: 182955 - DNA, 20 bp, Artificial Sequence
  Description of Artificial Sequence: Synthetic oligonucleotide
  Target: ATXN1; (-) strand; PAM type: YTN; PAM sequence: TTG
aataattcatgggctttttc

SEQ ID NO: 182956 - DNA, 20 bp, Artificial Sequence
  Description of Artificial Sequence: Synthetic oligonucleotide
  Target: ATXN1; (-) strand; PAM type: YTN; PAM sequence: TTA
tggtggacatcattgaataa

SEQ ID NO: 182957 - DNA, 20 bp, Artificial Sequence
  Description of Artificial Sequence: Synthetic oligonucleotide
  Target: ATXN1; (-) strand; PAM type: YTN; PAM sequence: CTG
agttatggtggacatcattg

SEQ ID NO: 182958 - DNA, 20 bp, Artificial Sequence
  Description of Artificial Sequence: Synthetic oligonucleotide
  Target: ATXN1; (-) strand; PAM type: YTN; PAM sequence: TTC
cctgagttatggtggacatc

SEQ ID NO: 182959 - DNA, 20 bp, Artificial Sequence
  Description of Artificial Sequence: Synthetic oligonucleotide
  Target: ATXN1; (-) strand; PAM type: YTN; PAM sequence: TTT
ccctgagttatggtggacat

SEQ ID NO: 182960 - DNA, 20 bp, Artificial Sequence
  Description of Artificial Sequence: Synthetic oligonucleotide
  Target: ATXN1; (-) strand; PAM type: YTN; PAM sequence: CTT
tccctgagttatggtggaca

SEQ ID NO: 182961 - DNA, 20 bp, Artificial Sequence
  Description of Artificial Sequence: Synthetic oligonucleotide
  Target: ATXN1; (-) strand; PAM type: YTN; PAM sequence: TTC
ctttccctgagttatggtgg

SEQ ID NO: 182962 - DNA, 20 bp, Artificial Sequence
  Description of Artificial Sequence: Synthetic oligonucleotide
  Target: ATXN1; (-) strand; PAM type: YTN; PAM sequence: CTT
cctttccctgagttatggtg

SEQ ID NO: 182963 - DNA, 20 bp, Artificial Sequence
  Description of Artificial Sequence: Synthetic oligonucleotide
  Target: ATXN1; (-) strand; PAM type: YTN; PAM sequence: TTC
ttcctttccctgagttatgg

SEQ ID NO: 182964 - DNA, 20 bp, Artificial Sequence
  Description of Artificial Sequence: Synthetic oligonucleotide
  Target: ATXN1; (-) strand; PAM type: YTN; PAM sequence: TTT
cttcctttccctgagttatg

SEQ ID NO: 182965 - DNA, 20 bp, Artificial Sequence
  Description of Artificial Sequence: Synthetic oligonucleotide
  Target: ATXN1; (-) strand; PAM type: YTN; PAM sequence: TTT
tcttcctttccctgagttat

SEQ ID NO: 182966 - DNA, 20 bp, Artificial Sequence
  Description of Artificial Sequence: Synthetic oligonucleotide
  Target: ATXN1; (-) strand; PAM type: YTN; PAM sequence: TTG
aggaaggcagtaggattttc

SEQ ID NO: 182967 - DNA, 20 bp, Artificial Sequence
  Description of Artificial Sequence: Synthetic oligonucleotide
  Target: ATXN1; (-) strand; PAM type: YTN; PAM sequence: CTT
gaggaaggcagtaggatttt

SEQ ID NO: 182968 - DNA, 20 bp, Artificial Sequence
  Description of Artificial Sequence: Synthetic oligonucleotide
  Target: ATXN1; (-) strand; PAM type: YTN; PAM sequence: CTG
cttgaggaaggcagtaggat

SEQ ID NO: 182969 - DNA, 20 bp, Artificial Sequence
  Description of Artificial Sequence: Synthetic oligonucleotide
  Target: ATXN1; (-) strand; PAM type: YTN; PAM sequence: CTC
ccatagctgcttgaggaagg

SEQ ID NO: 182970 - DNA, 20 bp, Artificial Sequence
  Description of Artificial Sequence: Synthetic oligonucleotide
  Target: ATXN1; (-) strand; PAM type: YTN; PAM sequence: TTA
aggcctcccatagctgcttg

SEQ ID NO: 182971 - DNA, 20 bp, Artificial Sequence
  Description of Artificial Sequence: Synthetic oligonucleotide
  Target: ATXN1; (-) strand; PAM type: YTN; PAM sequence: CTT
aaggcctcccatagctgctt

SEQ ID NO: 182972 - DNA, 20 bp, Artificial Sequence
  Description of Artificial Sequence: Synthetic oligonucleotide
  Target: ATXN1; (-) strand; PAM type: YTN; PAM sequence: TTC
ttaaggcctcccatagctgc

SEQ ID NO: 182973 - DNA, 20 bp, Artificial Sequence
  Description of Artificial Sequence: Synthetic oligonucleotide
  Target: ATXN1; (-) strand; PAM type: YTN; PAM sequence: TTT
cttaaggcctcccatagctg

SEQ ID NO: 182974 - DNA, 20 bp, Artificial Sequence
  Description of Artificial Sequence: Synthetic oligonucleotide
  Target: ATXN1; (-) strand; PAM type: YTN; PAM sequence: TTT
tcttaaggcctcccatagct

SEQ ID NO: 182975 - DNA, 20 bp, Artificial Sequence
  Description of Artificial Sequence: Synthetic oligonucleotide
  Target: ATXN1; (-) strand; PAM type: YTN; PAM sequence: TTG
ggtgacaggggagtatattt

SEQ ID NO: 182976 - DNA, 20 bp, Artificial Sequence
  Description of Artificial Sequence: Synthetic oligonucleotide
  Target: ATXN1; (-) strand; PAM type: YTN; PAM sequence: CTC
gagggagttgggtgacaggg

SEQ ID NO: 182977 - DNA, 20 bp, Artificial Sequence
  Description of Artificial Sequence: Synthetic oligonucleotide
  Target: ATXN1; (-) strand; PAM type: YTN; PAM sequence: TTG
accctcgagggagttgggtg

SEQ ID NO: 182978 - DNA, 20 bp, Artificial Sequence
  Description of Artificial Sequence: Synthetic oligonucleotide
  Target: ATXN1; (-) strand; PAM type: YTN; PAM sequence: TTA
ggatcaattgaccctcgagg

SEQ ID NO: 182979 - DNA, 20 bp, Artificial Sequence
  Description of Artificial Sequence: Synthetic oligonucleotide
  Target: ATXN1; (-) strand; PAM type: YTN; PAM sequence: TTT
aggatcaattgaccctcgag

SEQ ID NO: 182980 - DNA, 20 bp, Artificial Sequence
  Description of Artificial Sequence: Synthetic oligonucleotide
  Target: ATXN1; (-) strand; PAM type: YTN; PAM sequence: TTT
taggatcaattgaccctcga

SEQ ID NO: 182981 - DNA, 20 bp, Artificial Sequence
  Description of Artificial Sequence: Synthetic oligonucleotide
  Target: ATXN1; (-) strand; PAM type: YTN; PAM sequence: CTT
ttaggatcaattgaccctcg

SEQ ID NO: 182982 - DNA, 20 bp, Artificial Sequence
  Description of Artificial Sequence: Synthetic oligonucleotide
  Target: ATXN1; (-) strand; PAM type: YTN; PAM sequence: TTG
ggtaataaacatcttttagg

SEQ ID NO: 182983 - DNA, 20 bp, Artificial Sequence
  Description of Artificial Sequence: Synthetic oligonucleotide
  Target: ATXN1; (-) strand; PAM type: YTN; PAM sequence: CTG
attgggtaataaacatcttt

SEQ ID NO: 182984 - DNA, 20 bp, Artificial Sequence
  Description of Artificial Sequence: Synthetic oligonucleotide
  Target: ATXN1; (-) strand; PAM type: YTN; PAM sequence: CTC
agctgattgggtaataaaca

SEQ ID NO: 182985 - DNA, 20 bp, Artificial Sequence
  Description of Artificial Sequence: Synthetic oligonucleotide
  Target: ATXN1; (-) strand; PAM type: YTN; PAM sequence: CTG
atatctcagctgattgggta

SEQ ID NO: 182986 - DNA, 20 bp, Artificial Sequence
  Description of Artificial Sequence: Synthetic oligonucleotide
  Target: ATXN1; (-) strand; PAM type: YTN; PAM sequence: CTC
ctgatatctcagctgattgg

SEQ ID NO: 182987 - DNA, 20 bp, Artificial Sequence
  Description of Artificial Sequence: Synthetic oligonucleotide
  Target: ATXN1; (-) strand; PAM type: YTN; PAM sequence: TTC
tcctgatatctcagctgatt

SEQ ID NO: 182988 - DNA, 20 bp, Artificial Sequence
  Description of Artificial Sequence: Synthetic oligonucleotide
  Target: ATXN1; (-) strand; PAM type: YTN; PAM sequence: TTT
ctcctgatatctcagctgat

SEQ ID NO: 182989 - DNA, 20 bp, Artificial Sequence
  Description of Artificial Sequence: Synthetic oligonucleotide
  Target: ATXN1; (-) strand; PAM type: YTN; PAM sequence: CTT
tctcctgatatctcagctga

SEQ ID NO: 182990 - DNA, 20 bp, Artificial Sequence
  Description of Artificial Sequence: Synthetic oligonucleotide
  Target: ATXN1; (-) strand; PAM type: YTN; PAM sequence: TTG
gagctttctcctgatatctc

SEQ ID NO: 182991 - DNA, 20 bp, Artificial Sequence
  Description of Artificial Sequence: Synthetic oligonucleotide
  Target: ATXN1; (-) strand; PAM type: YTN; PAM sequence: TTT
ggagctttctcctgatatct

SEQ ID NO: 182992 - DNA, 20 bp, Artificial Sequence
  Description of Artificial Sequence: Synthetic oligonucleotide
  Target: ATXN1; (-) strand; PAM type: YTN; PAM sequence: TTT
tggagctttctcctgatatc

SEQ ID NO: 182993 - DNA, 20 bp, Artificial Sequence
  Description of Artificial Sequence: Synthetic oligonucleotide
  Target: ATXN1; (-) strand; PAM type: YTN; PAM sequence: CTT
ttggagctttctcctgatat

SEQ ID NO: 182994 - DNA, 20 bp, Artificial Sequence
  Description of Artificial Sequence: Synthetic oligonucleotide
  Target: ATXN1; (-) strand; PAM type: YTN; PAM sequence: CTC
gcttttggagctttctcctg

SEQ ID NO: 182995 - DNA, 20 bp, Artificial Sequence
  Description of Artificial Sequence: Synthetic oligonucleotide
  Target: ATXN1; (-) strand; PAM type: YTN; PAM sequence: TTC
agggccaagggctcgctttt

SEQ ID NO: 182996 - DNA, 20 bp, Artificial Sequence
  Description of Artificial Sequence: Synthetic oligonucleotide
  Target: ATXN1; (-) strand; PAM type: YTN; PAM sequence: TTG
ttcagggccaagggctcgct

SEQ ID NO: 182997 - DNA, 20 bp, Artificial Sequence
  Description of Artificial Sequence: Synthetic oligonucleotide
  Target: ATXN1; (-) strand; PAM type: YTN; PAM sequence: TTT
gttcagggccaagggctcgc

SEQ ID NO: 182998 - DNA, 20 bp, Artificial Sequence
  Description of Artificial Sequence: Synthetic oligonucleotide
  Target: ATXN1; (-) strand; PAM type: YTN; PAM sequence: TTT
tgttcagggccaagggctcg

SEQ ID NO: 182999 - DNA, 20 bp, Artificial Sequence
  Description of Artificial Sequence: Synthetic oligonucleotide
  Target: ATXN1; (-) strand; PAM type: YTN; PAM sequence: CTC
cagattttgttcagggccaa

SEQ ID NO: 183000 - DNA, 20 bp, Artificial Sequence
  Description of Artificial Sequence: Synthetic oligonucleotide
  Target: ATXN1; (-) strand; PAM type: YTN; PAM sequence: TTA
ataatgcctccagattttgt

SEQ ID NO: 183001 - DNA, 20 bp, Artificial Sequence
  Description of Artificial Sequence: Synthetic oligonucleotide
  Target: ATXN1; (-) strand; PAM type: YTN; PAM sequence: TTT
aataatgcctccagattttg

SEQ ID NO: 183002 - DNA, 20 bp, Artificial Sequence
  Description of Artificial Sequence: Synthetic oligonucleotide
  Target: ATXN1; (-) strand; PAM type: YTN; PAM sequence: TTG
ccaggtttaataatgcctcc

SEQ ID NO: 183003 - DNA, 20 bp, Artificial Sequence
  Description of Artificial Sequence: Synthetic oligonucleotide
  Target: ATXN1; (-) strand; PAM type: YTN; PAM sequence: TTA
gagaacaccgcggttgccag

SEQ ID NO: 183004 - DNA, 20 bp, Artificial Sequence
  Description of Artificial Sequence: Synthetic oligonucleotide
  Target: ATXN1; (-) strand; PAM type: YTN; PAM sequence: CTA
ttagagaacaccgcggttgc

SEQ ID NO: 183005 - DNA, 20 bp, Artificial Sequence
  Description of Artificial Sequence: Synthetic oligonucleotide
  Target: ATXN1; (-) strand; PAM type: YTN; PAM sequence: TTC
ctattagagaacaccgcggt

SEQ ID NO: 183006 - DNA, 20 bp, Artificial Sequence
  Description of Artificial Sequence: Synthetic oligonucleotide
  Target: ATXN1; (-) strand; PAM type: YTN; PAM sequence: TTG
gttcctattagagaacaccg

SEQ ID NO: 183007 - DNA, 20 bp, Artificial Sequence
  Description of Artificial Sequence: Synthetic oligonucleotide
  Target: ATXN1; (-) strand; PAM type: YTN; PAM sequence: CTT
ggttcctattagagaacacc

SEQ ID NO: 183008 - DNA, 20 bp, Artificial Sequence
  Description of Artificial Sequence: Synthetic oligonucleotide
  Target: ATXN1; (-) strand; PAM type: YTN; PAM sequence: CTC
ttggttcctattagagaaca

SEQ ID NO: 183009 - DNA, 20 bp, Artificial Sequence
  Description of Artificial Sequence: Synthetic oligonucleotide
  Target: ATXN1; (-) strand; PAM type: YTN; PAM sequence: TTC
ctcttggttcctattagaga

SEQ ID NO: 183010 - DNA, 20 bp, Artificial Sequence
  Description of Artificial Sequence: Synthetic oligonucleotide
  Target: ATXN1; (-) strand; PAM type: YTN; PAM sequence: CTG
ttcctcttggttcctattag

SEQ ID NO: 183011 - DNA, 20 bp, Artificial Sequence
  Description of Artificial Sequence: Synthetic oligonucleotide
  Target: ATXN1; (-) strand; PAM type: YTN; PAM sequence: CTG
cctgttcctcttggttccta

SEQ ID NO: 183012 - DNA, 20 bp, Artificial Sequence
  Description of Artificial Sequence: Synthetic oligonucleotide
  Target: ATXN1; (-) strand; PAM type: YTN; PAM sequence: TTC
tgcctgttcctcttggttcc

SEQ ID NO: 183013 - DNA, 20 bp, Artificial Sequence
  Description of Artificial Sequence: Synthetic oligonucleotide
  Target: ATXN1; (-) strand; PAM type: YTN; PAM sequence: TTT
ctgcctgttcctcttggttc

SEQ ID NO: 183014 - DNA, 20 bp, Artificial Sequence
  Description of Artificial Sequence: Synthetic oligonucleotide
  Target: ATXN1; (-) strand; PAM type: YTN; PAM sequence: TTT
tctgcctgttcctcttggtt

SEQ ID NO: 183015 - DNA, 20 bp, Artificial Sequence
  Description of Artificial Sequence: Synthetic oligonucleotide
  Target: ATXN1; (-) strand; PAM type: YTN; PAM sequence: CTT
ttctgcctgttcctcttggt

SEQ ID NO: 183016 - DNA, 20 bp, Artificial Sequence
  Description of Artificial Sequence: Synthetic oligonucleotide
  Target: ATXN1; (-) strand; PAM type: YTN; PAM sequence: TTC
cttttctgcctgttcctctt

SEQ ID NO: 183017 - DNA, 20 bp, Artificial Sequence
  Description of Artificial Sequence: Synthetic oligonucleotide
  Target: ATXN1; (-) strand; PAM type: YTN; PAM sequence: TTT
ccttttctgcctgttcctct

SEQ ID NO: 183018 - DNA, 20 bp, Artificial Sequence
  Description of Artificial Sequence: Synthetic oligonucleotide
  Target: ATXN1; (-) strand; PAM type: YTN; PAM sequence: TTT
tccttttctgcctgttcctc

SEQ ID NO: 183019 - DNA, 20 bp, Artificial Sequence
  Description of Artificial Sequence: Synthetic oligonucleotide
  Target: ATXN1; (-) strand; PAM type: YTN; PAM sequence: CTT
ttccttttctgcctgttcct

SEQ ID NO: 183020 - DNA, 20 bp, Artificial Sequence
  Description of Artificial Sequence: Synthetic oligonucleotide
  Target: ATXN1; (-) strand; PAM type: YTN; PAM sequence: CTC
gcttttccttttctgcctgt

SEQ ID NO: 183021 - DNA, 20 bp, Artificial Sequence
  Description of Artificial Sequence: Synthetic oligonucleotide
  Target: ATXN1; (-) strand; PAM type: YTN; PAM sequence: TTA
tctcgcttttccttttctgc

SEQ ID NO: 183022 - DNA, 20 bp, Artificial Sequence
  Description of Artificial Sequence: Synthetic oligonucleotide
  Target: ATXN1; (-) strand; PAM type: YTN; PAM sequence: CTT
atctcgcttttccttttctg

SEQ ID NO: 183023 - DNA, 20 bp, Artificial Sequence
  Description of Artificial Sequence: Synthetic oligonucleotide
  Target: ATXN1; (-) strand; PAM type: YTN; PAM sequence: CTC
ttatctcgcttttccttttc

SEQ ID NO: 183024 - DNA, 20 bp, Artificial Sequence
  Description of Artificial Sequence: Synthetic oligonucleotide
  Target: ATXN1; (-) strand; PAM type: YTN; PAM sequence: TTC
tcttatctcgcttttccttt

SEQ ID NO: 183025 - DNA, 20 bp, Artificial Sequence
  Description of Artificial Sequence: Synthetic oligonucleotide
  Target: ATXN1; (-) strand; PAM type: YTN; PAM sequence: TTT
ctcttatctcgcttttcctt

SEQ ID NO: 183026 - DNA, 20 bp, Artificial Sequence
  Description of Artificial Sequence: Synthetic oligonucleotide
  Target: ATXN1; (-) strand; PAM type: YTN; PAM sequence: CTT
tctcttatctcgcttttcct

SEQ ID NO: 183027 - DNA, 20 bp, Artificial Sequence
  Description of Artificial Sequence: Synthetic oligonucleotide
  Target: ATXN1; (-) strand; PAM type: YTN; PAM sequence: CTG
cggcctttctcttatctcgc

SEQ ID NO: 183028 - DNA, 20 bp, Artificial Sequence
  Description of Artificial Sequence: Synthetic oligonucleotide
  Target: ATXN1; (-) strand; PAM type: YTN; PAM sequence: CTG
aggctgcggcctttctctta

SEQ ID NO: 183029 - DNA, 20 bp, Artificial Sequence
  Description of Artificial Sequence: Synthetic oligonucleotide
  Target: ATXN1; (-) strand; PAM type: YTN; PAM sequence: CTG
agggccatgactgaggctgc

SEQ ID NO: 183030 - DNA, 20 bp, Artificial Sequence
  Description of Artificial Sequence: Synthetic oligonucleotide
  Target: ATXN1; (-) strand; PAM type: YTN; PAM sequence: TTG
tctgagggccatgactgagg

SEQ ID NO: 183031 - DNA, 20 bp, Artificial Sequence
  Description of Artificial Sequence: Synthetic oligonucleotide
  Target: ATXN1; (-) strand; PAM type: YTN; PAM sequence: TTT
gtctgagggccatgactgag

SEQ ID NO: 183032 - DNA, 20 bp, Artificial Sequence
  Description of Artificial Sequence: Synthetic oligonucleotide
  Target: ATXN1; (-) strand; PAM type: YTN; PAM sequence: TTG
tttgtctgagggccatgact

SEQ ID NO: 183033 - DNA, 20 bp, Artificial Sequence
  Description of Artificial Sequence: Synthetic oligonucleotide
  Target: ATXN1; (-) strand; PAM type: YTN; PAM sequence: TTT
gtttgtctgagggccatgac

SEQ ID NO: 183034 - DNA, 20 bp, Artificial Sequence
  Description of Artificial Sequence: Synthetic oligonucleotide
  Target: ATXN1; (-) strand; PAM type: YTN; PAM sequence: CTG
aaccaccaaggtttgtttgt

SEQ ID NO: 183035 - DNA, 20 bp, Artificial Sequence
  Description of Artificial Sequence: Synthetic oligonucleotide
  Target: ATXN1; (-) strand; PAM type: YTN; PAM sequence: CTC
tgaaccaccaaggtttgttt

SEQ ID NO: 183036 - DNA, 20 bp, Artificial Sequence
  Description of Artificial Sequence: Synthetic oligonucleotide
  Target: ATXN1; (-) strand; PAM type: YTN; PAM sequence: CTC
tctgaaccaccaaggtttgt

SEQ ID NO: 183037 - DNA, 20 bp, Artificial Sequence
  Description of Artificial Sequence: Synthetic oligonucleotide
  Target: ATXN1; (-) strand; PAM type: YTN; PAM sequence: CTG
tcctctctgaaccaccaagg

SEQ ID NO: 183038 - DNA, 20 bp, Artificial Sequence
  Description of Artificial Sequence: Synthetic oligonucleotide
  Target: ATXN1; (-) strand; PAM type: YTN; PAM sequence: TTC
tgtcctctctgaaccaccaa

SEQ ID NO: 183039 - DNA, 20 bp, Artificial Sequence
  Description of Artificial Sequence: Synthetic oligonucleotide
  Target: ATXN1; (-) strand; PAM type: YTN; PAM sequence: TTT
ctgtcctctctgaaccacca

SEQ ID NO: 183040 - DNA, 20 bp, Artificial Sequence
  Description of Artificial Sequence: Synthetic oligonucleotide
  Target: ATXN1; (-) strand; PAM type: YTN; PAM sequence: TTT
tctgtcctctctgaaccacc

SEQ ID NO: 183041 - DNA, 20 bp, Artificial Sequence
  Description of Artificial Sequence: Synthetic oligonucleotide
  Target: ATXN1; (-) strand; PAM type: YTN; PAM sequence: CTC
cattttctgtcctctctgaa

SEQ ID NO: 183042 - DNA, 20 bp, Artificial Sequence
  Description of Artificial Sequence: Synthetic oligonucleotide
  Target: ATXN1; (-) strand; PAM type: YTN; PAM sequence: CTG
ctccattttctgtcctctct

SEQ ID NO: 183043 - DNA, 20 bp, Artificial Sequence
  Description of Artificial Sequence: Synthetic oligonucleotide
  Target: ATXN1; (-) strand; PAM type: YTN; PAM sequence: TTG
gcctgctccattttctgtcc

SEQ ID NO: 183044 - DNA, 20 bp, Artificial Sequence
  Description of Artificial Sequence: Synthetic oligonucleotide
  Target: ATXN1; (-) strand; PAM type: YTN; PAM sequence: CTG
ggtgattggcctgctccatt

SEQ ID NO: 183045 - DNA, 20 bp, Artificial Sequence
  Description of Artificial Sequence: Synthetic oligonucleotide
  Target: ATXN1; (-) strand; PAM type: YTN; PAM sequence: CTA
ctgggtgattggcctgctcc

SEQ ID NO: 183046 - DNA, 20 bp, Artificial Sequence
  Description of Artificial Sequence: Synthetic oligonucleotide
  Target: ATXN1; (-) strand; PAM type: YTN; PAM sequence: CTG
ataacaagccctactgggtg

SEQ ID NO: 183047 - DNA, 20 bp, Artificial Sequence
  Description of Artificial Sequence: Synthetic oligonucleotide
  Target: ATXN1; (-) strand; PAM type: YTN; PAM sequence: TTG
caaaccacactgataacaag

SEQ ID NO: 183048 - DNA, 20 bp, Artificial Sequence
  Description of Artificial Sequence: Synthetic oligonucleotide
  Target: ATXN1; (-) strand; PAM type: YTN; PAM sequence: CTT
gcaaaccacactgataacaa

SEQ ID NO: 183049 - DNA, 20 bp, Artificial Sequence
  Description of Artificial Sequence: Synthetic oligonucleotide
  Target: ATXN1; (-) strand; PAM type: YTN; PAM sequence: TTA
aggtgtccttgcaaaccaca

SEQ ID NO: 183050 - DNA, 20 bp, Artificial Sequence
  Description of Artificial Sequence: Synthetic oligonucleotide
  Target: ATXN1; (-) strand; PAM type: YTN; PAM sequence: TTT
aaggtgtccttgcaaaccac

SEQ ID NO: 183051 - DNA, 20 bp, Artificial Sequence
  Description of Artificial Sequence: Synthetic oligonucleotide
  Target: ATXN1; (-) strand; PAM type: YTN; PAM sequence: TTT
taaggtgtccttgcaaacca

SEQ ID NO: 183052 - DNA, 20 bp, Artificial Sequence
  Description of Artificial Sequence: Synthetic oligonucleotide
  Target: ATXN1; (-) strand; PAM type: YTN; PAM sequence: TTT
ttaaggtgtccttgcaaacc

SEQ ID NO: 183053 - DNA, 20 bp, Artificial Sequence
  Description of Artificial Sequence: Synthetic oligonucleotide
  Target: ATXN1; (-) strand; PAM type: YTN; PAM sequence: TTT
tttaaggtgtccttgcaaac

SEQ ID NO: 183054 - DNA, 20 bp, Artificial Sequence
  Description of Artificial Sequence: Synthetic oligonucleotide
  Target: ATXN1; (-) strand; PAM type: YTN; PAM sequence: CTT
ttttaaggtgtccttgcaaa

SEQ ID NO: 183055 - DNA, 20 bp, Artificial Sequence
  Description of Artificial Sequence: Synthetic oligonucleotide
  Target: ATXN1; (-) strand; PAM type: YTN; PAM sequence: TTG
gacagtcttttttaaggtgt

SEQ ID NO: 183056 - DNA, 20 bp, Artificial Sequence
  Description of Artificial Sequence: Synthetic oligonucleotide
  Target: ATXN1; (-) strand; PAM type: YTN; PAM sequence: TTG
ttggacagtcttttttaagg

SEQ ID NO: 183057 - DNA, 20 bp, Artificial Sequence
  Description of Artificial Sequence: Synthetic oligonucleotide
  Target: ATXN1; (-) strand; PAM type: YTN; PAM sequence: CTT
gttggacagtcttttttaag

SEQ ID NO: 183058 - DNA, 20 bp, Artificial Sequence
  Description of Artificial Sequence: Synthetic oligonucleotide
  Target: ATXN1; (-) strand; PAM type: YTN; PAM sequence: TTC
ttgttggacagtctttttta

SEQ ID NO: 183059 - DNA, 20 bp, Artificial Sequence
  Description of Artificial Sequence: Synthetic oligonucleotide
  Target: ATXN1; (-) strand; PAM type: YTN; PAM sequence: TTT
cttgttggacagtctttttt

SEQ ID NO: 183060 - DNA, 20 bp, Artificial Sequence
  Description of Artificial Sequence: Synthetic oligonucleotide
  Target: ATXN1; (-) strand; PAM type: YTN; PAM sequence: TTG
tttcttgttggacagtcttt

SEQ ID NO: 183061 - DNA, 20 bp, Artificial Sequence
  Description of Artificial Sequence: Synthetic oligonucleotide
  Target: ATXN1; (-) strand; PAM type: YTN; PAM sequence: CTT
gtttcttgttggacagtctt

SEQ ID NO: 183062 - DNA, 20 bp, Artificial Sequence
  Description of Artificial Sequence: Synthetic oligonucleotide
  Target: ATXN1; (-) strand; PAM type: YTN; PAM sequence: TTG
gcatagtggacatgggtgag

SEQ ID NO: 183063 - DNA, 20 bp, Artificial Sequence
  Description of Artificial Sequence: Synthetic oligonucleotide
  Target: ATXN1; (-) strand; PAM type: YTN; PAM sequence: CTT
ggcatagtggacatgggtga

SEQ ID NO: 183064 - DNA, 20 bp, Artificial Sequence
  Description of Artificial Sequence: Synthetic oligonucleotide
  Target: ATXN1; (-) strand; PAM type: YTN; PAM sequence: TTG
ccttggcatagtggacatgg

SEQ ID NO: 183065 - DNA, 20 bp, Artificial Sequence
  Description of Artificial Sequence: Synthetic oligonucleotide
  Target: ATXN1; (-) strand; PAM type: YTN; PAM sequence: CTA
gtgattgccttggcatagtg

SEQ ID NO: 183066 - DNA, 20 bp, Artificial Sequence
  Description of Artificial Sequence: Synthetic oligonucleotide
  Target: ATXN1; (-) strand; PAM type: YTN; PAM sequence: CTG
gggcagtaccccgtctagtg

SEQ ID NO: 183067 - DNA, 20 bp, Artificial Sequence
  Description of Artificial Sequence: Synthetic oligonucleotide
  Target: ATXN1; (-) strand; PAM type: YTN; PAM sequence: CTC
tggggcagtaccccgtctag

SEQ ID NO: 183068 - DNA, 20 bp, Artificial Sequence
  Description of Artificial Sequence: Synthetic oligonucleotide
  Target: ATXN1; (-) strand; PAM type: YTN; PAM sequence: TTG
tcctctggggcagtaccccg

SEQ ID NO: 183069 - DNA, 20 bp, Artificial Sequence
  Description of Artificial Sequence: Synthetic oligonucleotide
  Target: ATXN1; (-) strand; PAM type: YTN; PAM sequence: TTT
gtcctctggggcagtacccc

SEQ ID NO: 183070 - DNA, 20 bp, Artificial Sequence
  Description of Artificial Sequence: Synthetic oligonucleotide
  Target: ATXN1; (-) strand; PAM type: YTN; PAM sequence: CTT
tgtcctctggggcagtaccc

SEQ ID NO: 183071 - DNA, 20 bp, Artificial Sequence
  Description of Artificial Sequence: Synthetic oligonucleotide
  Target: ATXN1; (-) strand; PAM type: YTN; PAM sequence: CTG
gcccggagaacctttgtcct

SEQ ID NO: 183072 - DNA, 20 bp, Artificial Sequence
  Description of Artificial Sequence: Synthetic oligonucleotide
  Target: ATXN1; (-) strand; PAM type: YTN; PAM sequence: TTC
tggcccggagaacctttgtc

SEQ ID NO: 183073 - DNA, 20 bp, Artificial Sequence
  Description of Artificial Sequence: Synthetic oligonucleotide
  Target: ATXN1; (-) strand; PAM type: YTN; PAM sequence: CTT
ctggcccggagaacctttgt

SEQ ID NO: 183074 - DNA, 20 bp, Artificial Sequence
  Description of Artificial Sequence: Synthetic oligonucleotide
  Target: ATXN1; (-) strand; PAM type: YTN; PAM sequence: TTG
ggggcttctggcccggagaa

SEQ ID NO: 183075 - DNA, 20 bp, Artificial Sequence
  Description of Artificial Sequence: Synthetic oligonucleotide
  Target: ATXN1; (-) strand; PAM type: YTN; PAM sequence: CTG
gttgggggcttctggcccgg

SEQ ID NO: 183076 - DNA, 20 bp, Artificial Sequence
  Description of Artificial Sequence: Synthetic oligonucleotide
  Target: ATXN1; (-) strand; PAM type: YTN; PAM sequence: TTG
gatcatctggttgggggctt

SEQ ID NO: 183077 - DNA, 20 bp, Artificial Sequence
  Description of Artificial Sequence: Synthetic oligonucleotide
  Target: ATXN1; (-) strand; PAM type: YTN; PAM sequence: TTG
ttggatcatctggttggggg

SEQ ID NO: 183078 - DNA, 20 bp, Artificial Sequence
  Description of Artificial Sequence: Synthetic oligonucleotide
  Target: ATXN1; (-) strand; PAM type: YTN; PAM sequence: CTG
ttgttggatcatctggttgg

SEQ ID NO: 183079 - DNA, 20 bp, Artificial Sequence
  Description of Artificial Sequence: Synthetic oligonucleotide
  Target: ATXN1; (-) strand; PAM type: YTN; PAM sequence: CTC
agtcctgttgttggatcatc

SEQ ID NO: 183080 - DNA, 20 bp, Artificial Sequence
  Description of Artificial Sequence: Synthetic oligonucleotide
  Target: ATXN1; (-) strand; PAM type: YTN; PAM sequence: TTG
caccaggcaccctcagtcct

SEQ ID NO: 183081 - DNA, 20 bp, Artificial Sequence
  Description of Artificial Sequence: Synthetic oligonucleotide
  Target: ATXN1; (-) strand; PAM type: YTN; PAM sequence: CTT
gcaccaggcaccctcagtcc

SEQ ID NO: 183082 - DNA, 20 bp, Artificial Sequence
  Description of Artificial Sequence: Synthetic oligonucleotide
  Target: ATXN1; (-) strand; PAM type: YTN; PAM sequence: CTG
gtgcttgcaccaggcaccct

SEQ ID NO: 183083 - DNA, 20 bp, Artificial Sequence
  Description of Artificial Sequence: Synthetic oligonucleotide
  Target: ATXN1; (-) strand; PAM type: YTN; PAM sequence: CTC
agtgagggtgatgacatgag

SEQ ID NO: 183084 - DNA, 20 bp, Artificial Sequence
  Description of Artificial Sequence: Synthetic oligonucleotide
  Target: ATXN1; (-) strand; PAM type: YTN; PAM sequence: TTG
cccagggctcagtgagggtg

SEQ ID NO: 183085 - DNA, 20 bp, Artificial Sequence
  Description of Artificial Sequence: Synthetic oligonucleotide
  Target: ATXN1; (-) strand; PAM type: YTN; PAM sequence: CTT
gcccagggctcagtgagggt

SEQ ID NO: 183086 - DNA, 20 bp, Artificial Sequence
  Description of Artificial Sequence: Synthetic oligonucleotide
  Target: ATXN1; (-) strand; PAM type: YTN; PAM sequence: CTA
aacttgcccagggctcagtg

SEQ ID NO: 183087 - DNA, 20 bp, Artificial Sequence
  Description of Artificial Sequence: Synthetic oligonucleotide
  Target: ATXN1; (-) strand; PAM type: YTN; PAM sequence: CTC
aatggctaaacttgcccagg

SEQ ID NO: 183088 - DNA, 20 bp, Artificial Sequence
  Description of Artificial Sequence: Synthetic oligonucleotide
  Target: ATXN1; (-) strand; PAM type: YTN; PAM sequence: CTG
gccctcaatggctaaacttg

SEQ ID NO: 183089 - DNA, 20 bp, Artificial Sequence
  Description of Artificial Sequence: Synthetic oligonucleotide
  Target: ATXN1; (-) strand; PAM type: YTN; PAM sequence: TTC
ctggccctcaatggctaaac

SEQ ID NO: 183090 - DNA, 20 bp, Artificial Sequence
  Description of Artificial Sequence: Synthetic oligonucleotide
  Target: ATXN1; (-) strand; PAM type: YTN; PAM sequence: TTT
cctggccctcaatggctaaa

SEQ ID NO: 183091 - DNA, 20 bp, Artificial Sequence
  Description of Artificial Sequence: Synthetic oligonucleotide
  Target: ATXN1; (-) strand; PAM type: YTN; PAM sequence: CTG
agaaggccatgccagtgtcc

SEQ ID NO: 183092 - DNA, 20 bp, Artificial Sequence
  Description of Artificial Sequence: Synthetic oligonucleotide
  Target: ATXN1; (-) strand; PAM type: YTN; PAM sequence: TTA
acactgagaaggccatgcca

SEQ ID NO: 183093 - DNA, 20 bp, Artificial Sequence
  Description of Artificial Sequence: Synthetic oligonucleotide
  Target: ATXN1; (-) strand; PAM type: YTN; PAM sequence: CTG
gggcaggagattaacactga

SEQ ID NO: 183094 - DNA, 20 bp, Artificial Sequence
  Description of Artificial Sequence: Synthetic oligonucleotide
  Target: ATXN1; (-) strand; PAM type: YTN; PAM sequence: CTG
tctggggcaggagattaaca

SEQ ID NO: 183095 - DNA, 20 bp, Artificial Sequence
  Description of Artificial Sequence: Synthetic oligonucleotide
  Target: ATXN1; (-) strand; PAM type: YTN; PAM sequence: TTG
aggacagctgtctggggcag

SEQ ID NO: 183096 - DNA, 20 bp, Artificial Sequence
  Description of Artificial Sequence: Synthetic oligonucleotide
  Target: ATXN1; (-) strand; PAM type: YTN; PAM sequence: CTT
gaggacagctgtctggggca

SEQ ID NO: 183097 - DNA, 20 bp, Artificial Sequence
  Description of Artificial Sequence: Synthetic oligonucleotide
  Target: ATXN1; (-) strand; PAM type: YTN; PAM sequence: TTG
gatggtaatggatcttgagg

SEQ ID NO: 183098 - DNA, 20 bp, Artificial Sequence
  Description of Artificial Sequence: Synthetic oligonucleotide
  Target: ATXN1; (-) strand; PAM type: YTN; PAM sequence: CTT
ggatggtaatggatcttgag

SEQ ID NO: 183099 - DNA, 20 bp, Artificial Sequence
  Description of Artificial Sequence: Synthetic oligonucleotide
  Target: ATXN1; (-) strand; PAM type: YTN; PAM sequence: TTC
cttggatggtaatggatctt

SEQ ID NO: 183100 - DNA, 20 bp, Artificial Sequence
  Description of Artificial Sequence: Synthetic oligonucleotide
  Target: ATXN1; (-) strand; PAM type: YTN; PAM sequence: CTG
tcccaggattccttggatgg

SEQ ID NO: 183101 - DNA, 20 bp, Artificial Sequence
  Description of Artificial Sequence: Synthetic oligonucleotide
  Target: ATXN1; (-) strand; PAM type: YTN; PAM sequence: TTA
caggctgtcccaggattcct

SEQ ID NO: 183102 - DNA, 20 bp, Artificial Sequence
  Description of Artificial Sequence: Synthetic oligonucleotide
  Target: ATXN1; (-) strand; PAM type: YTN; PAM sequence: CTG
gttacaggctgtcccaggat

SEQ ID NO: 183103 - DNA, 20 bp, Artificial Sequence
  Description of Artificial Sequence: Synthetic oligonucleotide
  Target: ATXN1; (-) strand; PAM type: YTN; PAM sequence: CTG
aggaggtgggagaaatacct

SEQ ID NO: 183104 - DNA, 20 bp, Artificial Sequence
  Description of Artificial Sequence: Synthetic oligonucleotide
  Target: ATXN1; (-) strand; PAM type: YTN; PAM sequence: TTA
caactgaggaggtgggagaa

SEQ ID NO: 183105 - DNA, 20 bp, Artificial Sequence
  Description of Artificial Sequence: Synthetic oligonucleotide
  Target: ATXN1; (-) strand; PAM type: YTN; PAM sequence: CTC
ccaattacaactgaggaggt

SEQ ID NO: 183106 - DNA, 20 bp, Artificial Sequence
  Description of Artificial Sequence: Synthetic oligonucleotide
  Target: ATXN1; (-) strand; PAM type: YTN; PAM sequence: TTC
aggcataagaaaagcatgtg

SEQ ID NO: 183107 - DNA, 20 bp, Artificial Sequence
  Description of Artificial Sequence: Synthetic oligonucleotide
  Target: ATXN1; (-) strand; PAM type: YTN; PAM sequence: TTT
caggcataagaaaagcatgt

SEQ ID NO: 183108 - DNA, 20 bp, Artificial Sequence
  Description of Artificial Sequence: Synthetic oligonucleotide
  Target: ATXN1; (-) strand; PAM type: YTN; PAM sequence: CTT
tcaggcataagaaaagcatg

SEQ ID NO: 183109 - DNA, 20 bp, Artificial Sequence
  Description of Artificial Sequence: Synthetic oligonucleotide
  Target: ATXN1; (-) strand; PAM type: YTN; PAM sequence: CTA
ataagggtgtggggctttca

SEQ ID NO: 183110 - DNA, 20 bp, Artificial Sequence
  Description of Artificial Sequence: Synthetic oligonucleotide
  Target: ATXN1; (-) strand; PAM type: YTN; PAM sequence: CTC
cctaataagggtgtggggct

SEQ ID NO: 183111 - DNA, 20 bp, Artificial Sequence
  Description of Artificial Sequence: Synthetic oligonucleotide
  Target: ATXN1; (-) strand; PAM type: YTN; PAM sequence: CTA
atatgtccctccctaataag

SEQ ID NO: 183112 - DNA, 20 bp, Artificial Sequence
  Description of Artificial Sequence: Synthetic oligonucleotide
  Target: ATXN1; (-) strand; PAM type: YTN; PAM sequence: TTG
gctaatatgtccctccctaa

SEQ ID NO: 183113 - DNA, 20 bp, Artificial Sequence
  Description of Artificial Sequence: Synthetic oligonucleotide
  Target: ATXN1; (-) strand; PAM type: YTN; PAM sequence: TTT
ggctaatatgtccctcccta

SEQ ID NO: 183114 - DNA, 20 bp, Artificial Sequence
  Description of Artificial Sequence: Synthetic oligonucleotide
  Target: ATXN1; (-) strand; PAM type: YTN; PAM sequence: CTT
tggctaatatgtccctccct

SEQ ID NO: 183115 - DNA, 20 bp, Artificial Sequence
  Description of Artificial Sequence: Synthetic oligonucleotide
  Target: ATXN1; (-) strand; PAM type: YTN; PAM sequence: CTC
cagctttggctaatatgtcc

SEQ ID NO: 183116 - DNA, 20 bp, Artificial Sequence
  Description of Artificial Sequence: Synthetic oligonucleotide
  Target: ATXN1; (-) strand; PAM type: YTN; PAM sequence: TTA
atggctccagctttggctaa

SEQ ID NO: 183117 - DNA, 20 bp, Artificial Sequence
  Description of Artificial Sequence: Synthetic oligonucleotide
  Target: ATXN1; (-) strand; PAM type: YTN; PAM sequence: TTC
atatagttaatggctccagc

SEQ ID NO: 183118 - DNA, 20 bp, Artificial Sequence
  Description of Artificial Sequence: Synthetic oligonucleotide
  Target: ATXN1; (-) strand; PAM type: YTN; PAM sequence: TTC
cccatattcatatagttaat

SEQ ID NO: 183119 - DNA, 20 bp, Artificial Sequence
  Description of Artificial Sequence: Synthetic oligonucleotide
  Target: ATXN1; (-) strand; PAM type: YTN; PAM sequence: TTG
ttccccatattcatatagtt

SEQ ID NO: 183120 - DNA, 20 bp, Artificial Sequence
  Description of Artificial Sequence: Synthetic oligonucleotide
  Target: ATXN1; (-) strand; PAM type: YTN; PAM sequence: CTT
gttccccatattcatatagt

SEQ ID NO: 183121 - DNA, 20 bp, Artificial Sequence
  Description of Artificial Sequence: Synthetic oligonucleotide
  Target: ATXN1; (-) strand; PAM type: YTN; PAM sequence: CTC
aagtaggggacaacaaatgg

SEQ ID NO: 183122 - DNA, 20 bp, Artificial Sequence
  Description of Artificial Sequence: Synthetic oligonucleotide
  Target: ATXN1; (-) strand; PAM type: YTN; PAM sequence: CTC
ctcaagtaggggacaacaaa

SEQ ID NO: 183123 - DNA, 20 bp, Artificial Sequence
  Description of Artificial Sequence: Synthetic oligonucleotide
  Target: ATXN1; (-) strand; PAM type: YTN; PAM sequence: TTC
cctcctcaagtaggggacaa

SEQ ID NO: 183124 - DNA, 20 bp, Artificial Sequence
  Description of Artificial Sequence: Synthetic oligonucleotide
  Target: ATXN1; (-) strand; PAM type: YTN; PAM sequence: TTG
attccctcctcaagtagggg

SEQ ID NO: 183125 - DNA, 20 bp, Artificial Sequence
  Description of Artificial Sequence: Synthetic oligonucleotide
  Target: ATXN1; (-) strand; PAM type: YTN; PAM sequence: TTC
agggttgattccctcctcaa

SEQ ID NO: 183126 - DNA, 20 bp, Artificial Sequence
  Description of Artificial Sequence: Synthetic oligonucleotide
  Target: ATXN1; (-) strand; PAM type: YTN; PAM sequence: CTT
cagggttgattccctcctca

SEQ ID NO: 183127 - DNA, 20 bp, Artificial Sequence
  Description of Artificial Sequence: Synthetic oligonucleotide
  Target: ATXN1; (-) strand; PAM type: YTN; PAM sequence: TTC
caatgcccagacttcagggt

SEQ ID NO: 183128 - DNA, 20 bp, Artificial Sequence
  Description of Artificial Sequence: Synthetic oligonucleotide
  Target: ATXN1; (-) strand; PAM type: YTN; PAM sequence: CTT
ccaatgcccagacttcaggg

SEQ ID NO: 183129 - DNA, 20 bp, Artificial Sequence
  Description of Artificial Sequence: Synthetic oligonucleotide
  Target: ATXN1; (-) strand; PAM type: YTN; PAM sequence: TTG
tccttccaatgcccagactt

SEQ ID NO: 183130 - DNA, 20 bp, Artificial Sequence
  Description of Artificial Sequence: Synthetic oligonucleotide
  Target: ATXN1; (-) strand; PAM type: YTN; PAM sequence: TTC
cgaattgtccttccaatgcc

SEQ ID NO: 183131 - DNA, 20 bp, Artificial Sequence
  Description of Artificial Sequence: Synthetic oligonucleotide
  Target: ATXN1; (-) strand; PAM type: YTN; PAM sequence: TTT
ccgaattgtccttccaatgc

SEQ ID NO: 183132 - DNA, 20 bp, Artificial Sequence
  Description of Artificial Sequence: Synthetic oligonucleotide
  Target: ATXN1; (-) strand; PAM type: YTN; PAM sequence: CTT
tccgaattgtccttccaatg

SEQ ID NO: 183133 - DNA, 20 bp, Artificial Sequence
  Description of Artificial Sequence: Synthetic oligonucleotide
  Target: ATXN1; (-) strand; PAM type: YTN; PAM sequence: TTG
cctttccgaattgtccttcc

SEQ ID NO: 183134 - DNA, 20 bp, Artificial Sequence
  Description of Artificial Sequence: Synthetic oligonucleotide
  Target: ATXN1; (-) strand; PAM type: YTN; PAM sequence: TTT
gcctttccgaattgtccttc

SEQ ID NO: 183135 - DNA, 20 bp, Artificial Sequence
  Description of Artificial Sequence: Synthetic oligonucleotide
  Target: ATXN1; (-) strand; PAM type: YTN; PAM sequence: TTT
tgcctttccgaattgtcctt

SEQ ID NO: 183136 - DNA, 20 bp, Artificial Sequence
  Description of Artificial Sequence: Synthetic oligonucleotide
  Target: ATXN1; (-) strand; PAM type: YTN; PAM sequence: TTT
ttgcctttccgaattgtcct

SEQ ID NO: 183137 - DNA, 20 bp, Artificial Sequence
  Description of Artificial Sequence: Synthetic oligonucleotide
  Target: ATXN1; (-) strand; PAM type: YTN; PAM sequence: TTT
tttgcctttccgaattgtcc

SEQ ID NO: 183138 - DNA, 20 bp, Artificial Sequence
  Description of Artificial Sequence: Synthetic oligonucleotide
  Target: ATXN1; (-) strand; PAM type: YTN; PAM sequence: CTG
ggtgggcattttttgccttt

SEQ ID NO: 183139 - DNA, 20 bp, Artificial Sequence
  Description of Artificial Sequence: Synthetic oligonucleotide
  Target: ATXN1; (-) strand; PAM type: YTN; PAM sequence: TTG
gactgggtgggcattttttg

SEQ ID NO: 183140 - DNA, 20 bp, Artificial Sequence
  Description of Artificial Sequence: Synthetic oligonucleotide
  Target: ATXN1; (-) strand; PAM type: YTN; PAM sequence: TTT
ggactgggtgggcatttttt

SEQ ID NO: 183141 - DNA, 20 bp, Artificial Sequence
  Description of Artificial Sequence: Synthetic oligonucleotide
  Target: ATXN1; (-) strand; PAM type: YTN; PAM sequence: CTG
atttggactgggtgggcatt

SEQ ID NO: 183142 - DNA, 20 bp, Artificial Sequence
  Description of Artificial Sequence: Synthetic oligonucleotide
  Target: ATXN1; (-) strand; PAM type: YTN; PAM sequence: TTA
tagcctgatttggactgggt

SEQ ID NO: 183143 - DNA, 20 bp, Artificial Sequence
  Description of Artificial Sequence: Synthetic oligonucleotide
  Target: ATXN1; (-) strand; PAM type: YTN; PAM sequence: CTT
atagcctgatttggactggg

SEQ ID NO: 183144 - DNA, 20 bp, Artificial Sequence
  Description of Artificial Sequence: Synthetic oligonucleotide
  Target: ATXN1; (-) strand; PAM type: YTN; PAM sequence: TTG
ataaggaaaagtggtggggt

SEQ ID NO: 183145 - DNA, 20 bp, Artificial Sequence
  Description of Artificial Sequence: Synthetic oligonucleotide
  Target: ATXN1; (-) strand; PAM type: YTN; PAM sequence: TTT
gataaggaaaagtggtgggg

SEQ ID NO: 183146 - DNA, 20 bp, Artificial Sequence
  Description of Artificial Sequence: Synthetic oligonucleotide
  Target: ATXN1; (-) strand; PAM type: YTN; PAM sequence: CTT
tgataaggaaaagtggtggg

SEQ ID NO: 183147 - DNA, 20 bp, Artificial Sequence
  Description of Artificial Sequence: Synthetic oligonucleotide
  Target: ATXN1; (-) strand; PAM type: YTN; PAM sequence: TTG
cctttgataaggaaaagtgg

SEQ ID NO: 183148 - DNA, 20 bp, Artificial Sequence
  Description of Artificial Sequence: Synthetic oligonucleotide
  Target: ATXN1; (-) strand; PAM type: YTN; PAM sequence: TTA
agagatattgcctttgataa

SEQ ID NO: 183149 - DNA, 20 bp, Artificial Sequence
  Description of Artificial Sequence: Synthetic oligonucleotide
  Target: ATXN1; (-) strand; PAM type: YTN; PAM sequence: CTT
aagagatattgcctttgata

SEQ ID NO: 183150 - DNA, 20 bp, Artificial Sequence
  Description of Artificial Sequence: Synthetic oligonucleotide
  Target: ATXN1; (-) strand; PAM type: YTN; PAM sequence: TTC
aggccttaagagatattgcc

SEQ ID NO: 183151 - DNA, 20 bp, Artificial Sequence
  Description of Artificial Sequence: Synthetic oligonucleotide
  Target: ATXN1; (-) strand; PAM type: YTN; PAM sequence: CTT
caggccttaagagatattgc

SEQ ID NO: 183152 - DNA, 20 bp, Artificial Sequence
  Description of Artificial Sequence: Synthetic oligonucleotide
  Target: ATXN1; (-) strand; PAM type: YTN; PAM sequence: TTA
tgagcttcaggccttaagag

SEQ ID NO: 183153 - DNA, 20 bp, Artificial Sequence
  Description of Artificial Sequence: Synthetic oligonucleotide
  Target: ATXN1; (-) strand; PAM type: YTN; PAM sequence: TTT
atgagcttcaggccttaaga

SEQ ID NO: 183154 - DNA, 20 bp, Artificial Sequence
  Description of Artificial Sequence: Synthetic oligonucleotide
  Target: ATXN1; (-) strand; PAM type: YTN; PAM sequence: CTT
tatgagcttcaggccttaag

SEQ ID NO: 183155 - DNA, 20 bp, Artificial Sequence
  Description of Artificial Sequence: Synthetic oligonucleotide
  Target: ATXN1; (-) strand; PAM type: YTN; PAM sequence: CTG
taatcctttatgagcttcag

SEQ ID NO: 183156 - DNA, 20 bp, Artificial Sequence
  Description of Artificial Sequence: Synthetic oligonucleotide
  Target: ATXN1; (-) strand; PAM type: YTN; PAM sequence: TTA
aatgtataacaatatcctgt

SEQ ID NO: 183157 - DNA, 20 bp, Artificial Sequence
  Description of Artificial Sequence: Synthetic oligonucleotide
  Target: ATXN1; (-) strand; PAM type: YTN; PAM sequence: TTT
aaatgtataacaatatcctg

SEQ ID NO: 183158 - DNA, 20 bp, Artificial Sequence
  Description of Artificial Sequence: Synthetic oligonucleotide
  Target: ATXN1; (-) strand; PAM type: YTN; PAM sequence: TTT
taaatgtataacaatatcct

SEQ ID NO: 183159 - DNA, 20 bp, Artificial Sequence
  Description of Artificial Sequence: Synthetic oligonucleotide
  Target: ATXN1; (-) strand; PAM type: YTN; PAM sequence: CTT
ttaaatgtataacaatatcc

SEQ ID NO: 183160 - DNA, 20 bp, Artificial Sequence
  Description of Artificial Sequence: Synthetic oligonucleotide
  Target: ATXN1; (-) strand; PAM type: YTN; PAM sequence: CTC
gaacttttaaatgtataaca

SEQ ID NO: 183161 - DNA, 20 bp, Artificial Sequence
  Description of Artificial Sequence: Synthetic oligonucleotide
  Target: ATXN1; (-) strand; PAM type: YTN; PAM sequence: CTA
agcctcgaacttttaaatgt

SEQ ID NO: 183162 - DNA, 20 bp, Artificial Sequence
  Description of Artificial Sequence: Synthetic oligonucleotide
  Target: ATXN1; (-) strand; PAM type: YTN; PAM sequence: TTA
ctaagcctcgaacttttaaa

SEQ ID NO: 183163 - DNA, 20 bp, Artificial Sequence
  Description of Artificial Sequence: Synthetic oligonucleotide
  Target: ATXN1; (-) strand; PAM type: YTN; PAM sequence: CTT
actaagcctcgaacttttaa

SEQ ID NO: 183164 - DNA, 20 bp, Artificial Sequence
  Description of Artificial Sequence: Synthetic oligonucleotide
  Target: ATXN1; (-) strand; PAM type: YTN; PAM sequence: TTC
ttactaagcctcgaactttt

SEQ ID NO: 183165 - DNA, 20 bp, Artificial Sequence
  Description of Artificial Sequence: Synthetic oligonucleotide
  Target: ATXN1; (-) strand; PAM type: YTN; PAM sequence: TTT
cttactaagcctcgaacttt

SEQ ID NO: 183166 - DNA, 20 bp, Artificial Sequence
  Description of Artificial Sequence: Synthetic oligonucleotide
  Target: ATXN1; (-) strand; PAM type: YTN; PAM sequence: TTT
tcttactaagcctcgaactt

SEQ ID NO: 183167 - DNA, 20 bp, Artificial Sequence
  Description of Artificial Sequence: Synthetic oligonucleotide
  Target: ATXN1; (-) strand; PAM type: YTN; PAM sequence: CTG
cattttcttactaagcctcg

SEQ ID NO: 183168 - DNA, 20 bp, Artificial Sequence
  Description of Artificial Sequence: Synthetic oligonucleotide
  Target: ATXN1; (-) strand; PAM type: YTN; PAM sequence: CTA
ctgcattttcttactaagcc

SEQ ID NO: 183169 - DNA, 20 bp, Artificial Sequence
  Description of Artificial Sequence: Synthetic oligonucleotide
  Target: ATXN1; (-) strand; PAM type: YTN; PAM sequence: TTG
caggggctactgcattttct

SEQ ID NO: 183170 - DNA, 20 bp, Artificial Sequence
  Description of Artificial Sequence: Synthetic oligonucleotide
  Target: ATXN1; (-) strand; PAM type: YTN; PAM sequence: TTG
gggtgttgcaggggctactg

SEQ ID NO: 183171 - DNA, 20 bp, Artificial Sequence
  Description of Artificial Sequence: Synthetic oligonucleotide
  Target: ATXN1; (-) strand; PAM type: YTN; PAM sequence: CTA
gaattggggtgttgcagggg

SEQ ID NO: 183172 - DNA, 20 bp, Artificial Sequence
  Description of Artificial Sequence: Synthetic oligonucleotide
  Target: ATXN1; (-) strand; PAM type: YTN; PAM sequence: CTC
ctagaattggggtgttgcag

SEQ ID NO: 183173 - DNA, 20 bp, Artificial Sequence
  Description of Artificial Sequence: Synthetic oligonucleotide
  Target: ATXN1; (-) strand; PAM type: YTN; PAM sequence: TTG
tactcctagaattggggtgt

SEQ ID NO: 183174 - DNA, 20 bp, Artificial Sequence
  Description of Artificial Sequence: Synthetic oligonucleotide
  Target: ATXN1; (-) strand; PAM type: YTN; PAM sequence: TTT
gtactcctagaattggggtg

SEQ ID NO: 183175 - DNA, 20 bp, Artificial Sequence
  Description of Artificial Sequence: Synthetic oligonucleotide
  Target: ATXN1; (-) strand; PAM type: YTN; PAM sequence: TTT
tgtactcctagaattggggt

SEQ ID NO: 183176 - DNA, 20 bp, Artificial Sequence
  Description of Artificial Sequence: Synthetic oligonucleotide
  Target: ATXN1; (-) strand; PAM type: YTN; PAM sequence: TTT
ttgtactcctagaattgggg

SEQ ID NO: 183177 - DNA, 20 bp, Artificial Sequence
  Description of Artificial Sequence: Synthetic oligonucleotide
  Target: ATXN1; (-) strand; PAM type: YTN; PAM sequence: TTC
agtttttgtactcctagaat

SEQ ID NO: 183178 - DNA, 20 bp, Artificial Sequence
  Description of Artificial Sequence: Synthetic oligonucleotide
  Target: ATXN1; (-) strand; PAM type: YTN; PAM sequence: CTG
acgattcagtttttgtactc

SEQ ID NO: 183179 - DNA, 20 bp, Artificial Sequence
  Description of Artificial Sequence: Synthetic oligonucleotide
  Target: ATXN1; (-) strand; PAM type: YTN; PAM sequence: CTC
cactgacgattcagtttttg

SEQ ID NO: 183180 - DNA, 20 bp, Artificial Sequence
  Description of Artificial Sequence: Synthetic oligonucleotide
  Target: ATXN1; (-) strand; PAM type: YTN; PAM sequence: CTA
gtctccactgacgattcagt

SEQ ID NO: 183181 - DNA, 20 bp, Artificial Sequence
  Description of Artificial Sequence: Synthetic oligonucleotide
  Target: ATXN1; (-) strand; PAM type: YTN; PAM sequence: TTG
cactagtctccactgacgat

SEQ ID NO: 183182 - DNA, 20 bp, Artificial Sequence
  Description of Artificial Sequence: Synthetic oligonucleotide
  Target: ATXN1; (-) strand; PAM type: YTN; PAM sequence: CTT
gcactagtctccactgacga

SEQ ID NO: 183183 - DNA, 20 bp, Artificial Sequence
  Description of Artificial Sequence: Synthetic oligonucleotide
  Target: ATXN1; (-) strand; PAM type: YTN; PAM sequence: CTA
ggatcttgcactagtctcca

SEQ ID NO: 183184 - DNA, 20 bp, Artificial Sequence
  Description of Artificial Sequence: Synthetic oligonucleotide
  Target: ATXN1; (-) strand; PAM type: YTN; PAM sequence: CTG
atgagtctaggatcttgcac

SEQ ID NO: 183185 - DNA, 20 bp, Artificial Sequence
  Description of Artificial Sequence: Synthetic oligonucleotide
  Target: ATXN1; (-) strand; PAM type: YTN; PAM sequence: CTC
actgatgagtctaggatctt

SEQ ID NO: 183186 - DNA, 20 bp, Artificial Sequence
  Description of Artificial Sequence: Synthetic oligonucleotide
  Target: ATXN1; (-) strand; PAM type: YTN; PAM sequence: TTC
ctcactgatgagtctaggat

SEQ ID NO: 183187 - DNA, 20 bp, Artificial Sequence
  Description of Artificial Sequence: Synthetic oligonucleotide
  Target: ATXN1; (-) strand; PAM type: YTN; PAM sequence: CTT
cctcactgatgagtctagga

SEQ ID NO: 183188 - DNA, 20 bp, Artificial Sequence
  Description of Artificial Sequence: Synthetic oligonucleotide
  Target: ATXN1; (-) strand; PAM type: YTN; PAM sequence: TTA
cttcctcactgatgagtcta

SEQ ID NO: 183189 - DNA, 20 bp, Artificial Sequence
  Description of Artificial Sequence: Synthetic oligonucleotide
  Target: ATXN1; (-) strand; PAM type: YTN; PAM sequence: TTG
ggtacaaccggatatagagg

SEQ ID NO: 183190 - DNA, 20 bp, Artificial Sequence
  Description of Artificial Sequence: Synthetic oligonucleotide
  Target: ATXN1; (-) strand; PAM type: YTN; PAM sequence: TTG
agagagcagggtataggggt

SEQ ID NO: 183191 - DNA, 20 bp, Artificial Sequence
  Description of Artificial Sequence: Synthetic oligonucleotide
  Target: ATXN1; (-) strand; PAM type: YTN; PAM sequence: TTT
gagagagcagggtatagggg

SEQ ID NO: 183192 - DNA, 20 bp, Artificial Sequence
  Description of Artificial Sequence: Synthetic oligonucleotide
  Target: ATXN1; (-) strand; PAM type: YTN; PAM sequence: TTG
gtatttgagagagcagggta

SEQ ID NO: 183193 - DNA, 20 bp, Artificial Sequence
  Description of Artificial Sequence: Synthetic oligonucleotide
  Target: ATXN1; (-) strand; PAM type: YTN; PAM sequence: TTT
ggtatttgagagagcagggt

SEQ ID NO: 183194 - DNA, 20 bp, Artificial Sequence
  Description of Artificial Sequence: Synthetic oligonucleotide
  Target: ATXN1; (-) strand; PAM type: YTN; PAM sequence: CTT
tggtatttgagagagcaggg

SEQ ID NO: 183195 - DNA, 20 bp, Artificial Sequence
  Description of Artificial Sequence: Synthetic oligonucleotide
  Target: ATXN1; (-) strand; PAM type: YTN; PAM sequence: TTC
ctttggtatttgagagagca

SEQ ID NO: 183196 - DNA, 20 bp, Artificial Sequence
  Description of Artificial Sequence: Synthetic oligonucleotide
  Target: ATXN1; (-) strand; PAM type: YTN; PAM sequence: CTT
cctttggtatttgagagagc

SEQ ID NO: 183197 - DNA, 20 bp, Artificial Sequence
  Description of Artificial Sequence: Synthetic oligonucleotide
  Target: ATXN1; (-) strand; PAM type: YTN; PAM sequence: CTG
cttcctttggtatttgagag

SEQ ID NO: 183198 - DNA, 20 bp, Artificial Sequence
  Description of Artificial Sequence: Synthetic oligonucleotide
  Target: ATXN1; (-) strand; PAM type: YTN; PAM sequence: TTC
tgcttcctttggtatttgag

SEQ ID NO: 183199 - DNA, 20 bp, Artificial Sequence
  Description of Artificial Sequence: Synthetic oligonucleotide
  Target: ATXN1; (-) strand; PAM type: YTN; PAM sequence: TTG
aggtccagaacagtgaaacc

SEQ ID NO: 183200 - DNA, 20 bp, Artificial Sequence
  Description of Artificial Sequence: Synthetic oligonucleotide
  Target: ATXN1; (-) strand; PAM type: YTN; PAM sequence: CTT
gaggtccagaacagtgaaac

SEQ ID NO: 183201 - DNA, 20 bp, Artificial Sequence
  Description of Artificial Sequence: Synthetic oligonucleotide
  Target: ATXN1; (-) strand; PAM type: YTN; PAM sequence: CTG
ggagtccaagtgcagaggaa

SEQ ID NO: 183202 - DNA, 20 bp, Artificial Sequence
  Description of Artificial Sequence: Synthetic oligonucleotide
  Target: ATXN1; (-) strand; PAM type: YTN; PAM sequence: CTC
aaaggcaaagagaaactggg

SEQ ID NO: 183203 - DNA, 20 bp, Artificial Sequence
  Description of Artificial Sequence: Synthetic oligonucleotide
  Target: ATXN1; (-) strand; PAM type: YTN; PAM sequence: CTG
tgggatcctcaaaggcaaag

SEQ ID NO: 183204 - DNA, 20 bp, Artificial Sequence
  Description of Artificial Sequence: Synthetic oligonucleotide
  Target: ATXN1; (-) strand; PAM type: YTN; PAM sequence: TTG
tggtctgtgggatcctcaaa

SEQ ID NO: 183205 - DNA, 20 bp, Artificial Sequence
  Description of Artificial Sequence: Synthetic oligonucleotide
  Target: ATXN1; (-) strand; PAM type: YTN; PAM sequence: TTT
gtggtctgtgggatcctcaa

SEQ ID NO: 183206 - DNA, 20 bp, Artificial Sequence
  Description of Artificial Sequence: Synthetic oligonucleotide
  Target: ATXN1; (-) strand; PAM type: YTN; PAM sequence: TTT
tgtggtctgtgggatcctca

SEQ ID NO: 183207 - DNA, 20 bp, Artificial Sequence
  Description of Artificial Sequence: Synthetic oligonucleotide
  Target: ATXN1; (-) strand; PAM type: YTN; PAM sequence: TTG
ggttttgtggtctgtgggat

SEQ ID NO: 183208 - DNA, 20 bp, Artificial Sequence
  Description of Artificial Sequence: Synthetic oligonucleotide
  Target: ATXN1; (-) strand; PAM type: YTN; PAM sequence: TTG
aggcaagaccgtccatgtaa

SEQ ID NO: 183209 - DNA, 20 bp, Artificial Sequence
  Description of Artificial Sequence: Synthetic oligonucleotide
  Target: ATXN1; (-) strand; PAM type: YTN; PAM sequence: CTT
gaggcaagaccgtccatgta

SEQ ID NO: 183210 - DNA, 20 bp, Artificial Sequence
  Description of Artificial Sequence: Synthetic oligonucleotide
  Target: ATXN1; (-) strand; PAM type: YTN; PAM sequence: CTA
aacccttgaggcaagaccgt

SEQ ID NO: 183211 - DNA, 20 bp, Artificial Sequence
  Description of Artificial Sequence: Synthetic oligonucleotide
  Target: ATXN1; (-) strand; PAM type: YTN; PAM sequence: CTA
tccctaaacccttgaggcaa

SEQ ID NO: 183212 - DNA, 20 bp, Artificial Sequence
  Description of Artificial Sequence: Synthetic oligonucleotide
  Target: ATXN1; (-) strand; PAM type: YTN; PAM sequence: CTG
accaaacagatgagggctat

SEQ ID NO: 183213 - DNA, 20 bp, Artificial Sequence
  Description of Artificial Sequence: Synthetic oligonucleotide
  Target: ATXN1; (-) strand; PAM type: YTN; PAM sequence: TTG
ggacagtgcctgaccaaaca

SEQ ID NO: 183214 - DNA, 20 bp, Artificial Sequence
  Description of Artificial Sequence: Synthetic oligonucleotide
  Target: ATXN1; (-) strand; PAM type: YTN; PAM sequence: CTT
gggacagtgcctgaccaaac

SEQ ID NO: 183215 - DNA, 20 bp, Artificial Sequence
  Description of Artificial Sequence: Synthetic oligonucleotide
  Target: ATXN1; (-) strand; PAM type: YTN; PAM sequence: CTA
gatcttgggacagtgcctga

SEQ ID NO: 183216 - DNA, 20 bp, Artificial Sequence
  Description of Artificial Sequence: Synthetic oligonucleotide
  Target: ATXN1; (-) strand; PAM type: YTN; PAM sequence: TTG
agaagtggcctagatcttgg

SEQ ID NO: 183217 - DNA, 20 bp, Artificial Sequence
  Description of Artificial Sequence: Synthetic oligonucleotide
  Target: ATXN1; (-) strand; PAM type: YTN; PAM sequence: CTT
gagaagtggcctagatcttg

SEQ ID NO: 183218 - DNA, 20 bp, Artificial Sequence
  Description of Artificial Sequence: Synthetic oligonucleotide
  Target: ATXN1; (-) strand; PAM type: YTN; PAM sequence: CTG
gacttgagaagtggcctaga

SEQ ID NO: 183219 - DNA, 20 bp, Artificial Sequence
  Description of Artificial Sequence: Synthetic oligonucleotide
  Target: ATXN1; (-) strand; PAM type: YTN; PAM sequence: CTG
aaggaccagcatgcctggac

SEQ ID NO: 183220 - DNA, 20 bp, Artificial Sequence
  Description of Artificial Sequence: Synthetic oligonucleotide
  Target: ATXN1; (-) strand; PAM type: YTN; PAM sequence: CTG
gtagccaaaagtaaatcatc

SEQ ID NO: 183221 - DNA, 20 bp, Artificial Sequence
  Description of Artificial Sequence: Synthetic oligonucleotide
  Target: ATXN1; (-) strand; PAM type: YTN; PAM sequence: TTC
cgaactggtagccaaaagta

SEQ ID NO: 183222 - DNA, 20 bp, Artificial Sequence
  Description of Artificial Sequence: Synthetic oligonucleotide
  Target: ATXN1; (-) strand; PAM type: YTN; PAM sequence: CTT
ccgaactggtagccaaaagt

SEQ ID NO: 183223 - DNA, 20 bp, Artificial Sequence
  Description of Artificial Sequence: Synthetic oligonucleotide
  Target: ATXN1; (-) strand; PAM type: YTN; PAM sequence: CTG
gcatgaagcttccgaactgg

SEQ ID NO: 183224 - DNA, 20 bp, Artificial Sequence
  Description of Artificial Sequence: Synthetic oligonucleotide
  Target: ATXN1; (-) strand; PAM type: YTN; PAM sequence: CTG
ctggcatgaagcttccgaac

SEQ ID NO: 183225 - DNA, 20 bp, Artificial Sequence
  Description of Artificial Sequence: Synthetic oligonucleotide
  Target: ATXN1; (-) strand; PAM type: YTN; PAM sequence: CTA
gagtagcctgctggcatgaa

SEQ ID NO: 183226 - DNA, 20 bp, Artificial Sequence
  Description of Artificial Sequence: Synthetic oligonucleotide
  Target: ATXN1; (-) strand; PAM type: YTN; PAM sequence: TTC
aagagatctagagtagcctg

SEQ ID NO: 183227 - DNA, 20 bp, Artificial Sequence
  Description of Artificial Sequence: Synthetic oligonucleotide
  Target: ATXN1; (-) strand; PAM type: YTN; PAM sequence: CTA
gaaagttcaagagatctaga

SEQ ID NO: 183228 - DNA, 20 bp, Artificial Sequence
  Description of Artificial Sequence: Synthetic oligonucleotide
  Target: ATXN1; (-) strand; PAM type: YTN; PAM sequence: TTA
gctagaaagttcaagagatc

SEQ ID NO: 183229 - DNA, 20 bp, Artificial Sequence
  Description of Artificial Sequence: Synthetic oligonucleotide
  Target: ATXN1; (-) strand; PAM type: YTN; PAM sequence: TTG
attagctagaaagttcaaga

SEQ ID NO: 183230 - DNA, 20 bp, Artificial Sequence
  Description of Artificial Sequence: Synthetic oligonucleotide
  Target: ATXN1; (-) strand; PAM type: YTN; PAM sequence: CTT
gattagctagaaagttcaag

SEQ ID NO: 183231 - DNA, 20 bp, Artificial Sequence
  Description of Artificial Sequence: Synthetic oligonucleotide
  Target: ATXN1; (-) strand; PAM type: YTN; PAM sequence: TTG
tacccttgattagctagaaa

SEQ ID NO: 183232 - DNA, 20 bp, Artificial Sequence
  Description of Artificial Sequence: Synthetic oligonucleotide
  Target: ATXN1; (-) strand; PAM type: YTN; PAM sequence: CTT
gtacccttgattagctagaa

SEQ ID NO: 183233 - DNA, 20 bp, Artificial Sequence
  Description of Artificial Sequence: Synthetic oligonucleotide
  Target: ATXN1; (-) strand; PAM type: YTN; PAM sequence: TTA
gatgccttgtacccttgatt

SEQ ID NO: 183234 - DNA, 20 bp, Artificial Sequence
  Description of Artificial Sequence: Synthetic oligonucleotide
  Target: ATXN1; (-) strand; PAM type: YTN; PAM sequence: TTT
agatgccttgtacccttgat

SEQ ID NO: 183235 - DNA, 20 bp, Artificial Sequence
  Description of Artificial Sequence: Synthetic oligonucleotide
  Target: ATXN1; (-) strand; PAM type: YTN; PAM sequence: TTC
gatttagatgccttgtaccc

SEQ ID NO: 183236 - DNA, 20 bp, Artificial Sequence
  Description of Artificial Sequence: Synthetic oligonucleotide
  Target: ATXN1; (-) strand; PAM type: YTN; PAM sequence: CTT
cgatttagatgccttgtacc

SEQ ID NO: 183237 - DNA, 20 bp, Artificial Sequence
  Description of Artificial Sequence: Synthetic oligonucleotide
  Target: ATXN1; (-) strand; PAM type: YTN; PAM sequence: CTG
ggccttcgatttagatgcct

SEQ ID NO: 183238 - DNA, 20 bp, Artificial Sequence
  Description of Artificial Sequence: Synthetic oligonucleotide
  Target: ATXN1; (-) strand; PAM type: YTN; PAM sequence: TTG
taggcagagctgggccttcg

SEQ ID NO: 183239 - DNA, 20 bp, Artificial Sequence
  Description of Artificial Sequence: Synthetic oligonucleotide
  Target: ATXN1; (-) strand; PAM type: YTN; PAM sequence: TTG
ttgtaggcagagctgggcct

SEQ ID NO: 183240 - DNA, 20 bp, Artificial Sequence
  Description of Artificial Sequence: Synthetic oligonucleotide
  Target: ATXN1; (-) strand; PAM type: YTN; PAM sequence: CTT
gttgtaggcagagctgggcc

SEQ ID NO: 183241 - DNA, 20 bp, Artificial Sequence
  Description of Artificial Sequence: Synthetic oligonucleotide
  Target: ATXN1; (-) strand; PAM type: YTN; PAM sequence: TTG
acttgttgtaggcagagctg

SEQ ID NO: 183242 - DNA, 20 bp, Artificial Sequence
  Description of Artificial Sequence: Synthetic oligonucleotide
  Target: ATXN1; (-) strand; PAM type: YTN; PAM sequence: TTT
gacttgttgtaggcagagct

SEQ ID NO: 183243 - DNA, 20 bp, Artificial Sequence
  Description of Artificial Sequence: Synthetic oligonucleotide
  Target: ATXN1; (-) strand; PAM type: YTN; PAM sequence: TTA
gatatttgacttgttgtagg

SEQ ID NO: 183244 - DNA, 20 bp, Artificial Sequence
  Description of Artificial Sequence: Synthetic oligonucleotide
  Target: ATXN1; (-) strand; PAM type: YTN; PAM sequence: CTT
agatatttgacttgttgtag

SEQ ID NO: 183245 - DNA, 20 bp, Artificial Sequence
  Description of Artificial Sequence: Synthetic oligonucleotide
  Target: ATXN1; (-) strand; PAM type: YTN; PAM sequence: TTA
ggcttagatatttgacttgt

SEQ ID NO: 183246 - DNA, 20 bp, Artificial Sequence
  Description of Artificial Sequence: Synthetic oligonucleotide
  Target: ATXN1; (-) strand; PAM type: YTN; PAM sequence: CTA
ggattaggcttagatatttg

SEQ ID NO: 183247 - DNA, 20 bp, Artificial Sequence
  Description of Artificial Sequence: Synthetic oligonucleotide
  Target: ATXN1; (-) strand; PAM type: YTN; PAM sequence: CTG
gctaggattaggcttagata

SEQ ID NO: 183248 - DNA, 20 bp, Artificial Sequence
  Description of Artificial Sequence: Synthetic oligonucleotide
  Target: ATXN1; (-) strand; PAM type: YTN; PAM sequence: CTC
tggctaggattaggcttaga

SEQ ID NO: 183249 - DNA, 20 bp, Artificial Sequence
  Description of Artificial Sequence: Synthetic oligonucleotide
  Target: ATXN1; (-) strand; PAM type: YTN; PAM sequence: TTC
ctctggctaggattaggctt

SEQ ID NO: 183250 - DNA, 20 bp, Artificial Sequence
  Description of Artificial Sequence: Synthetic oligonucleotide
  Target: ATXN1; (-) strand; PAM type: YTN; PAM sequence: CTG
gttcctctggctaggattag

SEQ ID NO: 183251 - DNA, 20 bp, Artificial Sequence
  Description of Artificial Sequence: Synthetic oligonucleotide
  Target: ATXN1; (-) strand; PAM type: YTN; PAM sequence: CTG
agggccctggttcctctggc

SEQ ID NO: 183252 - DNA, 20 bp, Artificial Sequence
  Description of Artificial Sequence: Synthetic oligonucleotide
  Target: ATXN1; (-) strand; PAM type: YTN; PAM sequence: TTG
ctgagggccctggttcctct

SEQ ID NO: 183253 - DNA, 20 bp, Artificial Sequence
  Description of Artificial Sequence: Synthetic oligonucleotide
  Target: ATXN1; (-) strand; PAM type: YTN; PAM sequence: TTT
gctgagggccctggttcctc

SEQ ID NO: 183254 - DNA, 20 bp, Artificial Sequence
  Description of Artificial Sequence: Synthetic oligonucleotide
  Target: ATXN1; (-) strand; PAM type: YTN; PAM sequence: CTT
tgctgagggccctggttcct

SEQ ID NO: 183255 - DNA, 20 bp, Artificial Sequence
  Description of Artificial Sequence: Synthetic oligonucleotide
  Target: ATXN1; (-) strand; PAM type: YTN; PAM sequence: TTC
tttgctgagggccctggttc

SEQ ID NO: 183256 - DNA, 20 bp, Artificial Sequence
  Description of Artificial Sequence: Synthetic oligonucleotide
  Target: ATXN1; (-) strand; PAM type: YTN; PAM sequence: TTG
ttctttgctgagggccctgg

SEQ ID NO: 183257 - DNA, 20 bp, Artificial Sequence
  Description of Artificial Sequence: Synthetic oligonucleotide
  Target: ATXN1; (-) strand; PAM type: YTN; PAM sequence: TTT
gttctttgctgagggccctg

SEQ ID NO: 183258 - DNA, 20 bp, Artificial Sequence
  Description of Artificial Sequence: Synthetic oligonucleotide
  Target: ATXN1; (-) strand; PAM type: YTN; PAM sequence: CTG
tatttgttctttgctgaggg

SEQ ID NO: 183259 - DNA, 20 bp, Artificial Sequence
  Description of Artificial Sequence: Synthetic oligonucleotide
  Target: ATXN1; (-) strand; PAM type: YTN; PAM sequence: TTA
gggcaaggacaagccagtat

SEQ ID NO: 183260 - DNA, 20 bp, Artificial Sequence
  Description of Artificial Sequence: Synthetic oligonucleotide
  Target: ATXN1; (-) strand; PAM type: YTN; PAM sequence: TTA
atgtgttagggcaaggacaa

SEQ ID NO: 183261 - DNA, 20 bp, Artificial Sequence
  Description of Artificial Sequence: Synthetic oligonucleotide
  Target: ATXN1; (-) strand; PAM type: YTN; PAM sequence: TTT
aatgtgttagggcaaggaca

SEQ ID NO: 183262 - DNA, 20 bp, Artificial Sequence
  Description of Artificial Sequence: Synthetic oligonucleotide
  Target: ATXN1; (-) strand; PAM type: YTN; PAM sequence: TTT
taatgtgttagggcaaggac

SEQ ID NO: 183263 - DNA, 20 bp, Artificial Sequence
  Description of Artificial Sequence: Synthetic oligonucleotide
  Target: ATXN1; (-) strand; PAM type: YTN; PAM sequence: CTG
ttttaatgtgttagggcaag

SEQ ID NO: 183264 - DNA, 20 bp, Artificial Sequence
  Description of Artificial Sequence: Synthetic oligonucleotide
  Target: ATXN1; (-) strand; PAM type: YTN; PAM sequence: CTG
tatccggggatccatagtcg

SEQ ID NO: 183265 - DNA, 20 bp, Artificial Sequence
  Description of Artificial Sequence: Synthetic oligonucleotide
  Target: ATXN1; (-) strand; PAM type: YTN; PAM sequence: CTC
gctgtatccggggatccata

SEQ ID NO: 183266 - DNA, 20 bp, Artificial Sequence
  Description of Artificial Sequence: Synthetic oligonucleotide
  Target: ATXN1; (-) strand; PAM type: YTN; PAM sequence: CTG
gccatctcgctgtatccggg

SEQ ID NO: 183267 - DNA, 20 bp, Artificial Sequence
  Description of Artificial Sequence: Synthetic oligonucleotide
  Target: ATXN1; (-) strand; PAM type: YTN; PAM sequence: TTA
gagtatagagtggcctggcc

SEQ ID NO: 183268 - DNA, 20 bp, Artificial Sequence
  Description of Artificial Sequence: Synthetic oligonucleotide
  Target: ATXN1; (-) strand; PAM type: YTN; PAM sequence: TTG
attagagtatagagtggcct

SEQ ID NO: 183269 - DNA, 20 bp, Artificial Sequence
  Description of Artificial Sequence: Synthetic oligonucleotide
  Target: ATXN1; (-) strand; PAM type: YTN; PAM sequence: CTT
gattagagtatagagtggcc

SEQ ID NO: 183270 - DNA, 20 bp, Artificial Sequence
  Description of Artificial Sequence: Synthetic oligonucleotide
  Target: ATXN1; (-) strand; PAM type: YTN; PAM sequence: CTC
cttgattagagtatagagtg

SEQ ID NO: 183271 - DNA, 20 bp, Artificial Sequence
  Description of Artificial Sequence: Synthetic oligonucleotide
  Target: ATXN1; (-) strand; PAM type: YTN; PAM sequence: CTC
ggtctccttgattagagtat

SEQ ID NO: 183272 - DNA, 20 bp, Artificial Sequence
  Description of Artificial Sequence: Synthetic oligonucleotide
  Target: ATXN1; (-) strand; PAM type: YTN; PAM sequence: CTC
tcggtctccttgattagagt

SEQ ID NO: 183273 - DNA, 20 bp, Artificial Sequence
  Description of Artificial Sequence: Synthetic oligonucleotide
  Target: ATXN1; (-) strand; PAM type: YTN; PAM sequence: TTG
ccctctcggtctccttgatt

SEQ ID NO: 183274 - DNA, 20 bp, Artificial Sequence
  Description of Artificial Sequence: Synthetic oligonucleotide
  Target: ATXN1; (-) strand; PAM type: YTN; PAM sequence: TTT
gccctctcggtctccttgat

SEQ ID NO: 183275 - DNA, 20 bp, Artificial Sequence
  Description of Artificial Sequence: Synthetic oligonucleotide
  Target: ATXN1; (-) strand; PAM type: YTN; PAM sequence: CTA
gatgaatatttgccctctcg

SEQ ID NO: 183276 - DNA, 20 bp, Artificial Sequence
  Description of Artificial Sequence: Synthetic oligonucleotide
  Target: ATXN1; (-) strand; PAM type: YTN; PAM sequence: CTA
ctagatgaatatttgccctc

SEQ ID NO: 183277 - DNA, 20 bp, Artificial Sequence
  Description of Artificial Sequence: Synthetic oligonucleotide
  Target: ATXN1; (-) strand; PAM type: YTN; PAM sequence: TTC
tactagatgaatatttgccc

SEQ ID NO: 183278 - DNA, 20 bp, Artificial Sequence
  Description of Artificial Sequence: Synthetic oligonucleotide
  Target: ATXN1; (-) strand; PAM type: YTN; PAM sequence: TTC
ccattctactagatgaatat

SEQ ID NO: 183279 - DNA, 20 bp, Artificial Sequence
  Description of Artificial Sequence: Synthetic oligonucleotide
  Target: ATXN1; (-) strand; PAM type: YTN; PAM sequence: CTG
gttcccattctactagatga

SEQ ID NO: 183280 - DNA, 20 bp, Artificial Sequence
  Description of Artificial Sequence: Synthetic oligonucleotide
  Target: ATXN1; (-) strand; PAM type: YTN; PAM sequence: CTC
tggttcccattctactagat

SEQ ID NO: 183281 - DNA, 20 bp, Artificial Sequence
  Description of Artificial Sequence: Synthetic oligonucleotide
  Target: ATXN1; (-) strand; PAM type: YTN; PAM sequence: CTG
cctctggttcccattctact

SEQ ID NO: 183282 - DNA, 20 bp, Artificial Sequence
  Description of Artificial Sequence: Synthetic oligonucleotide
  Target: ATXN1; (-) strand; PAM type: YTN; PAM sequence: TTC
tgcctctggttcccattcta

SEQ ID NO: 183283 - DNA, 20 bp, Artificial Sequence
  Description of Artificial Sequence: Synthetic oligonucleotide
  Target: ATXN1; (-) strand; PAM type: YTN; PAM sequence: TTT
ctgcctctggttcccattct

SEQ ID NO: 183284 - DNA, 20 bp, Artificial Sequence
  Description of Artificial Sequence: Synthetic oligonucleotide
  Target: ATXN1; (-) strand; PAM type: YTN; PAM sequence: CTG
tttctgcctctggttcccat

SEQ ID NO: 183285 - DNA, 20 bp, Artificial Sequence
  Description of Artificial Sequence: Synthetic oligonucleotide
  Target: ATXN1; (-) strand; PAM type: YTN; PAM sequence: TTG
aaggctgtttctgcctctgg

SEQ ID NO: 183286 - DNA, 20 bp, Artificial Sequence
  Description of Artificial Sequence: Synthetic oligonucleotide
  Target: ATXN1; (-) strand; PAM type: YTN; PAM sequence: TTT
gaaggctgtttctgcctctg

SEQ ID NO: 183287 - DNA, 20 bp, Artificial Sequence
  Description of Artificial Sequence: Synthetic oligonucleotide
  Target: ATXN1; (-) strand; PAM type: YTN; PAM sequence: TTT
tgaaggctgtttctgcctct

SEQ ID NO: 183288 - DNA, 20 bp, Artificial Sequence
  Description of Artificial Sequence: Synthetic oligonucleotide
  Target: ATXN1; (-) strand; PAM type: YTN; PAM sequence: TTA
aggttttgaaggctgtttct

SEQ ID NO: 183289 - DNA, 20 bp, Artificial Sequence
  Description of Artificial Sequence: Synthetic oligonucleotide
  Target: ATXN1; (-) strand; PAM type: YTN; PAM sequence: TTT
aaggttttgaaggctgtttc

SEQ ID NO: 183290 - DNA, 20 bp, Artificial Sequence
  Description of Artificial Sequence: Synthetic oligonucleotide
  Target: ATXN1; (-) strand; PAM type: YTN; PAM sequence: CTT
taaggttttgaaggctgttt

SEQ ID NO: 183291 - DNA, 20 bp, Artificial Sequence
  Description of Artificial Sequence: Synthetic oligonucleotide
  Target: ATXN1; (-) strand; PAM type: YTN; PAM sequence: CTG
ctttaaggttttgaaggctg

SEQ ID NO: 183292 - DNA, 20 bp, Artificial Sequence
  Description of Artificial Sequence: Synthetic oligonucleotide
  Target: ATXN1; (-) strand; PAM type: YTN; PAM sequence: CTA
gggcctgctttaaggttttg

SEQ ID NO: 183293 - DNA, 20 bp, Artificial Sequence
  Description of Artificial Sequence: Synthetic oligonucleotide
  Target: ATXN1; (-) strand; PAM type: YTN; PAM sequence: TTG
tactagggcctgctttaagg

SEQ ID NO: 183294 - DNA, 20 bp, Artificial Sequence
  Description of Artificial Sequence: Synthetic oligonucleotide
  Target: ATXN1; (-) strand; PAM type: YTN; PAM sequence: TTT
gtactagggcctgctttaag

SEQ ID NO: 183295 - DNA, 20 bp, Artificial Sequence
  Description of Artificial Sequence: Synthetic oligonucleotide
  Target: ATXN1; (-) strand; PAM type: YTN; PAM sequence: TTG
agtttgtactagggcctgct

SEQ ID NO: 183296 - DNA, 20 bp, Artificial Sequence
  Description of Artificial Sequence: Synthetic oligonucleotide
  Target: ATXN1; (-) strand; PAM type: YTN; PAM sequence: CTT
gagtttgtactagggcctgc

SEQ ID NO: 183297 - DNA, 20 bp, Artificial Sequence
  Description of Artificial Sequence: Synthetic oligonucleotide
  Target: ATXN1; (-) strand; PAM type: YTN; PAM sequence: TTA
agtcttgagtttgtactagg

SEQ ID NO: 183298 - DNA, 20 bp, Artificial Sequence
  Description of Artificial Sequence: Synthetic oligonucleotide
  Target: ATXN1; (-) strand; PAM type: YTN; PAM sequence: CTT
aagtcttgagtttgtactag

SEQ ID NO: 183299 - DNA, 20 bp, Artificial Sequence
  Description of Artificial Sequence: Synthetic oligonucleotide
  Target: ATXN1; (-) strand; PAM type: YTN; PAM sequence: CTG
gggaaggcttaagtcttgag

SEQ ID NO: 183300 - DNA, 20 bp, Artificial Sequence
  Description of Artificial Sequence: Synthetic oligonucleotide
  Target: ATXN1; (-) strand; PAM type: YTN; PAM sequence: TTG
tcctggggaaggcttaagtc

SEQ ID NO: 183301 - DNA, 20 bp, Artificial Sequence
  Description of Artificial Sequence: Synthetic oligonucleotide
  Target: ATXN1; (-) strand; PAM type: YTN; PAM sequence: TTT
gtcctggggaaggcttaagt

SEQ ID NO: 183302 - DNA, 20 bp, Artificial Sequence
  Description of Artificial Sequence: Synthetic oligonucleotide
  Target: ATXN1; (-) strand; PAM type: YTN; PAM sequence: TTT
tgtcctggggaaggcttaag

SEQ ID NO: 183303 - DNA, 20 bp, Artificial Sequence
  Description of Artificial Sequence: Synthetic oligonucleotide
  Target: ATXN1; (-) strand; PAM type: YTN; PAM sequence: CTG
tgaggtataaagagaagttt

SEQ ID NO: 183304 - DNA, 20 bp, Artificial Sequence
  Description of Artificial Sequence: Synthetic oligonucleotide
  Target: ATXN1; (-) strand; PAM type: YTN; PAM sequence: CTC
tgtgaggtataaagagaagt

SEQ ID NO: 183305 - DNA, 20 bp, Artificial Sequence
  Description of Artificial Sequence: Synthetic oligonucleotide
  Target: ATXN1; (-) strand; PAM type: YTN; PAM sequence: CTC
tctgtgaggtataaagagaa

SEQ ID NO: 183306 - DNA, 20 bp, Artificial Sequence
  Description of Artificial Sequence: Synthetic oligonucleotide
  Target: ATXN1; (-) strand; PAM type: YTN; PAM sequence: CTC
tctctgtgaggtataaagag

SEQ ID NO: 183307 - DNA, 20 bp, Artificial Sequence
  Description of Artificial Sequence: Synthetic oligonucleotide
  Target: ATXN1; (-) strand; PAM type: YTN; PAM sequence: TTC
ccgctctctctgtgaggtat

SEQ ID NO: 183308 - DNA, 20 bp, Artificial Sequence
  Description of Artificial Sequence: Synthetic oligonucleotide
  Target: ATXN1; (-) strand; PAM type: YTN; PAM sequence: CTA
ttcccgctctctctgtgagg

SEQ ID NO: 183309 - DNA, 20 bp, Artificial Sequence
  Description of Artificial Sequence: Synthetic oligonucleotide
  Target: ATXN1; (-) strand; PAM type: YTN; PAM sequence: CTC
caagagctattcccgctctc

SEQ ID NO: 183310 - DNA, 20 bp, Artificial Sequence
  Description of Artificial Sequence: Synthetic oligonucleotide
  Target: ATXN1; (-) strand; PAM type: YTN; PAM sequence: CTG
agtaaggactccaagagcta

SEQ ID NO: 183311 - DNA, 20 bp, Artificial Sequence
  Description of Artificial Sequence: Synthetic oligonucleotide
  Target: ATXN1; (-) strand; PAM type: YTN; PAM sequence: CTA
caagtctgagtaaggactcc

SEQ ID NO: 183312 - DNA, 20 bp, Artificial Sequence
  Description of Artificial Sequence: Synthetic oligonucleotide
  Target: ATXN1; (-) strand; PAM type: YTN; PAM sequence: TTG
tcctacaagtctgagtaagg

SEQ ID NO: 183313 - DNA, 20 bp, Artificial Sequence
  Description of Artificial Sequence: Synthetic oligonucleotide
  Target: ATXN1; (-) strand; PAM type: YTN; PAM sequence: TTG
tggggttgtcctacaagtct

SEQ ID NO: 183314 - DNA, 20 bp, Artificial Sequence
  Description of Artificial Sequence: Synthetic oligonucleotide
  Target: ATXN1; (-) strand; PAM type: YTN; PAM sequence: CTG
gttgtggggttgtcctacaa

SEQ ID NO: 183315 - DNA, 20 bp, Artificial Sequence
  Description of Artificial Sequence: Synthetic oligonucleotide
  Target: ATXN1; (-) strand; PAM type: YTN; PAM sequence: TTA
ctggttgtggggttgtccta

SEQ ID NO: 183316 - DNA, 20 bp, Artificial Sequence
  Description of Artificial Sequence: Synthetic oligonucleotide
  Target: ATXN1; (-) strand; PAM type: YTN; PAM sequence: CTT
actggttgtggggttgtcct

SEQ ID NO: 183317 - DNA, 20 bp, Artificial Sequence
  Description of Artificial Sequence: Synthetic oligonucleotide
  Target: ATXN1; (-) strand; PAM type: YTN; PAM sequence: TTC
cttactggttgtggggttgt

SEQ ID NO: 183318 - DNA, 20 bp, Artificial Sequence
  Description of Artificial Sequence: Synthetic oligonucleotide
  Target: ATXN1; (-) strand; PAM type: YTN; PAM sequence: CTT
ccttactggttgtggggttg

SEQ ID NO: 183319 - DNA, 20 bp, Artificial Sequence
  Description of Artificial Sequence: Synthetic oligonucleotide
  Target: ATXN1; (-) strand; PAM type: YTN; PAM sequence: TTC
cttccttactggttgtgggg

SEQ ID NO: 183320 - DNA, 20 bp, Artificial Sequence
  Description of Artificial Sequence: Synthetic oligonucleotide
  Target: ATXN1; (-) strand; PAM type: YTN; PAM sequence: TTG
tggggttccttccttactgg

SEQ ID NO: 183321 - DNA, 20 bp, Artificial Sequence
  Description of Artificial Sequence: Synthetic oligonucleotide
  Target: ATXN1; (-) strand; PAM type: YTN; PAM sequence: TTA
ggttgtggggttccttcctt

SEQ ID NO: 183322 - DNA, 20 bp, Artificial Sequence
  Description of Artificial Sequence: Synthetic oligonucleotide
  Target: ATXN1; (-) strand; PAM type: YTN; PAM sequence: CTT
aggttgtggggttccttcct

SEQ ID NO: 183323 - DNA, 20 bp, Artificial Sequence
  Description of Artificial Sequence: Synthetic oligonucleotide
  Target: ATXN1; (-) strand; PAM type: YTN; PAM sequence: TTA
cttaggttgtggggttcctt

SEQ ID NO: 183324 - DNA, 20 bp, Artificial Sequence
  Description of Artificial Sequence: Synthetic oligonucleotide
  Target: ATXN1; (-) strand; PAM type: YTN; PAM sequence: CTT
acttaggttgtggggttcct

SEQ ID NO: 183325 - DNA, 20 bp, Artificial Sequence
  Description of Artificial Sequence: Synthetic oligonucleotide
  Target: ATXN1; (-) strand; PAM type: YTN; PAM sequence: TTC
cttacttaggttgtggggtt

SEQ ID NO: 183326 - DNA, 20 bp, Artificial Sequence
  Description of Artificial Sequence: Synthetic oligonucleotide
  Target: ATXN1; (-) strand; PAM type: YTN; PAM sequence: TTT
ccttacttaggttgtggggt

SEQ ID NO: 183327 - DNA, 20 bp, Artificial Sequence
  Description of Artificial Sequence: Synthetic oligonucleotide
  Target: ATXN1; (-) strand; PAM type: YTN; PAM sequence: CTA
catcaatttccttacttagg

SEQ ID NO: 183328 - DNA, 20 bp, Artificial Sequence
  Description of Artificial Sequence: Synthetic oligonucleotide
  Target: ATXN1; (-) strand; PAM type: YTN; PAM sequence: CTA
ctacatcaatttccttactt

SEQ ID NO: 183329 - DNA, 20 bp, Artificial Sequence
  Description of Artificial Sequence: Synthetic oligonucleotide
  Target: ATXN1; (-) strand; PAM type: YTN; PAM sequence: TTG
ctactacatcaatttcctta

SEQ ID NO: 183330 - DNA, 20 bp, Artificial Sequence
  Description of Artificial Sequence: Synthetic oligonucleotide
  Target: ATXN1; (-) strand; PAM type: YTN; PAM sequence: TTT
gctactacatcaatttcctt

SEQ ID NO: 183331 - DNA, 20 bp, Artificial Sequence
  Description of Artificial Sequence: Synthetic oligonucleotide
  Target: ATXN1; (-) strand; PAM type: YTN; PAM sequence: TTT
tgctactacatcaatttcct

SEQ ID NO: 183332 - DNA, 20 bp, Artificial Sequence
  Description of Artificial Sequence: Synthetic oligonucleotide
  Target: ATXN1; (-) strand; PAM type: YTN; PAM sequence: CTT
ttgctactacatcaatttcc

SEQ ID NO: 183333 - DNA, 20 bp, Artificial Sequence
  Description of Artificial Sequence: Synthetic oligonucleotide
  Target: ATXN1; (-) strand; PAM type: YTN; PAM sequence: CTA
cccgtaaacagtgaggccag

SEQ ID NO: 183334 - DNA, 20 bp, Artificial Sequence
  Description of Artificial Sequence: Synthetic oligonucleotide
  Target: ATXN1; (-) strand; PAM type: YTN; PAM sequence: CTG
ccacaactacccgtaaacag

SEQ ID NO: 183335 - DNA, 20 bp, Artificial Sequence
  Description of Artificial Sequence: Synthetic oligonucleotide
  Target: ATXN1; (-) strand; PAM type: YTN; PAM sequence: CTA
agatagccactgccacaact

SEQ ID NO: 183336 - DNA, 20 bp, Artificial Sequence
  Description of Artificial Sequence: Synthetic oligonucleotide
  Target: ATXN1; (-) strand; PAM type: YTN; PAM sequence: CTG
acactaagatagccactgcc

SEQ ID NO: 183337 - DNA, 20 bp, Artificial Sequence
  Description of Artificial Sequence: Synthetic oligonucleotide
  Target: ATXN1; (-) strand; PAM type: YTN; PAM sequence: CTC
tgacactaagatagccactg

SEQ ID NO: 183338 - DNA, 20 bp, Artificial Sequence
  Description of Artificial Sequence: Synthetic oligonucleotide
  Target: ATXN1; (-) strand; PAM type: YTN; PAM sequence: TTG
atagcctctgacactaagat

SEQ ID NO: 183339 - DNA, 20 bp, Artificial Sequence
  Description of Artificial Sequence: Synthetic oligonucleotide
  Target: ATXN1; (-) strand; PAM type: YTN; PAM sequence: TTT
gatagcctctgacactaaga

SEQ ID NO: 183340 - DNA, 20 bp, Artificial Sequence
  Description of Artificial Sequence: Synthetic oligonucleotide
  Target: ATXN1; (-) strand; PAM type: YTN; PAM sequence: TTT
tgatagcctctgacactaag

SEQ ID NO: 183341 - DNA, 20 bp, Artificial Sequence
  Description of Artificial Sequence: Synthetic oligonucleotide
  Target: ATXN1; (-) strand; PAM type: YTN; PAM sequence: TTA
ttttgatagcctctgacact

SEQ ID NO: 183342 - DNA, 20 bp, Artificial Sequence
  Description of Artificial Sequence: Synthetic oligonucleotide
  Target: ATXN1; (-) strand; PAM type: YTN; PAM sequence: TTG
tattattttgatagcctctg

SEQ ID NO: 183343 - DNA, 20 bp, Artificial Sequence
  Description of Artificial Sequence: Synthetic oligonucleotide
  Target: ATXN1; (-) strand; PAM type: YTN; PAM sequence: CTT
gtattattttgatagcctct

SEQ ID NO: 183344 - DNA, 20 bp, Artificial Sequence
  Description of Artificial Sequence: Synthetic oligonucleotide
  Target: ATXN1; (-) strand; PAM type: YTN; PAM sequence: TTC
cttgtattattttgatagcc

SEQ ID NO: 183345 - DNA, 20 bp, Artificial Sequence
  Description of Artificial Sequence: Synthetic oligonucleotide
  Target: ATXN1; (-) strand; PAM type: YTN; PAM sequence: TTT
ccttgtattattttgatagc

SEQ ID NO: 183346 - DNA, 20 bp, Artificial Sequence
  Description of Artificial Sequence: Synthetic oligonucleotide
  Target: ATXN1; (-) strand; PAM type: YTN; PAM sequence: CTT
tccttgtattattttgatag

SEQ ID NO: 183347 - DNA, 20 bp, Artificial Sequence
  Description of Artificial Sequence: Synthetic oligonucleotide
  Target: ATXN1; (-) strand; PAM type: YTN; PAM sequence: CTA
gatggtgagatcctttcctt

SEQ ID NO: 183348 - DNA, 20 bp, Artificial Sequence
  Description of Artificial Sequence: Synthetic oligonucleotide
  Target: ATXN1; (-) strand; PAM type: YTN; PAM sequence: TTA
catcatgagtagtctagatg

SEQ ID NO: 183349 - DNA, 20 bp, Artificial Sequence
  Description of Artificial Sequence: Synthetic oligonucleotide
  Target: ATXN1; (-) strand; PAM type: YTN; PAM sequence: TTT
acatcatgagtagtctagat

SEQ ID NO: 183350 - DNA, 20 bp, Artificial Sequence
  Description of Artificial Sequence: Synthetic oligonucleotide
  Target: ATXN1; (-) strand; PAM type: YTN; PAM sequence: CTG
gtatgccatttacatcatga

SEQ ID NO: 183351 - DNA, 20 bp, Artificial Sequence
  Description of Artificial Sequence: Synthetic oligonucleotide
  Target: ATXN1; (-) strand; PAM type: YTN; PAM sequence: TTG
gcacctggtatgccatttac

SEQ ID NO: 183352 - DNA, 20 bp, Artificial Sequence
  Description of Artificial Sequence: Synthetic oligonucleotide
  Target: ATXN1; (-) strand; PAM type: YTN; PAM sequence: TTT
ggcacctggtatgccattta

SEQ ID NO: 183353 - DNA, 20 bp, Artificial Sequence
  Description of Artificial Sequence: Synthetic oligonucleotide
  Target: ATXN1; (-) strand; PAM type: YTN; PAM sequence: CTT
tggcacctggtatgccattt

SEQ ID NO: 183354 - DNA, 20 bp, Artificial Sequence
  Description of Artificial Sequence: Synthetic oligonucleotide
  Target: ATXN1; (-) strand; PAM type: YTN; PAM sequence: TTC
ctttggcacctggtatgcca

SEQ ID NO: 183355 - DNA, 20 bp, Artificial Sequence
  Description of Artificial Sequence: Synthetic oligonucleotide
  Target: ATXN1; (-) strand; PAM type: YTN; PAM sequence: TTT
cctttggcacctggtatgcc

SEQ ID NO: 183356 - DNA, 20 bp, Artificial Sequence
  Description of Artificial Sequence: Synthetic oligonucleotide
  Target: ATXN1; (-) strand; PAM type: YTN; PAM sequence: CTG
atagccataaatttcctttg

SEQ ID NO: 183357 - DNA, 20 bp, Artificial Sequence
  Description of Artificial Sequence: Synthetic oligonucleotide
  Target: ATXN1; (-) strand; PAM type: YTN; PAM sequence: TTC
tgatagccataaatttcctt

SEQ ID NO: 183358 - DNA, 20 bp, Artificial Sequence
  Description of Artificial Sequence: Synthetic oligonucleotide
  Target: ATXN1; (-) strand; PAM type: YTN; PAM sequence: TTT
ctgatagccataaatttcct

SEQ ID NO: 183359 - DNA, 20 bp, Artificial Sequence
  Description of Artificial Sequence: Synthetic oligonucleotide
  Target: ATXN1; (-) strand; PAM type: YTN; PAM sequence: TTT
tctgatagccataaatttcc

SEQ ID NO: 183360 - DNA, 20 bp, Artificial Sequence
  Description of Artificial Sequence: Synthetic oligonucleotide
  Target: ATXN1; (-) strand; PAM type: YTN; PAM sequence: CTG
agtaggtggttttctgatag

SEQ ID NO: 183361 - DNA, 20 bp, Artificial Sequence
  Description of Artificial Sequence: Synthetic oligonucleotide
  Target: ATXN1; (-) strand; PAM type: YTN; PAM sequence: CTG
gtacctgagtaggtggtttt

SEQ ID NO: 183362 - DNA, 20 bp, Artificial Sequence
  Description of Artificial Sequence: Synthetic oligonucleotide
  Target: ATXN1; (-) strand; PAM type: YTN; PAM sequence: CTG
aatgagtagcgcctggtacc

SEQ ID NO: 183363 - DNA, 20 bp, Artificial Sequence
  Description of Artificial Sequence: Synthetic oligonucleotide
  Target: ATXN1; (-) strand; PAM type: YTN; PAM sequence: TTC
aagcaccagtccctgaatga

SEQ ID NO: 183364 - DNA, 20 bp, Artificial Sequence
  Description of Artificial Sequence: Synthetic oligonucleotide
  Target: ATXN1; (-) strand; PAM type: YTN; PAM sequence: TTT
caagcaccagtccctgaatg

SEQ ID NO: 183365 - DNA, 20 bp, Artificial Sequence
  Description of Artificial Sequence: Synthetic oligonucleotide
  Target: ATXN1; (-) strand; PAM type: YTN; PAM sequence: CTG
cacacgtgtgtatttcaagc

SEQ ID NO: 183366 - DNA, 20 bp, Artificial Sequence
  Description of Artificial Sequence: Synthetic oligonucleotide
  Target: ATXN1; (-) strand; PAM type: YTN; PAM sequence: TTG
agggctgcacacgtgtgtat

SEQ ID NO: 183367 - DNA, 20 bp, Artificial Sequence
  Description of Artificial Sequence: Synthetic oligonucleotide
  Target: ATXN1; (-) strand; PAM type: YTN; PAM sequence: CTG
ggagaaaagtagcagggttg

SEQ ID NO: 183368 - DNA, 20 bp, Artificial Sequence
  Description of Artificial Sequence: Synthetic oligonucleotide
  Target: ATXN1; (-) strand; PAM type: YTN; PAM sequence: CTC
tgggagaaaagtagcagggt

SEQ ID NO: 183369 - DNA, 20 bp, Artificial Sequence
  Description of Artificial Sequence: Synthetic oligonucleotide
  Target: ATXN1; (-) strand; PAM type: YTN; PAM sequence: CTC
catcctctgggagaaaagta

SEQ ID NO: 183370 - DNA, 20 bp, Artificial Sequence
  Description of Artificial Sequence: Synthetic oligonucleotide
  Target: ATXN1; (-) strand; PAM type: YTN; PAM sequence: TTC
tccatcctctgggagaaaag

SEQ ID NO: 183371 - DNA, 20 bp, Artificial Sequence
  Description of Artificial Sequence: Synthetic oligonucleotide
  Target: ATXN1; (-) strand; PAM type: YTN; PAM sequence: TTG
gttctccatcctctgggaga

SEQ ID NO: 183372 - DNA, 20 bp, Artificial Sequence
  Description of Artificial Sequence: Synthetic oligonucleotide
  Target: ATXN1; (-) strand; PAM type: YTN; PAM sequence: CTC
gattggttctccatcctctg

SEQ ID NO: 183373 - DNA, 20 bp, Artificial Sequence
  Description of Artificial Sequence: Synthetic oligonucleotide
  Target: ATXN1; (-) strand; PAM type: YTN; PAM sequence: TTG
gcagtcatactcgattggtt

SEQ ID NO: 183374 - DNA, 20 bp, Artificial Sequence
  Description of Artificial Sequence: Synthetic oligonucleotide
  Target: ATXN1; (-) strand; PAM type: YTN; PAM sequence: TTG
ttggcagtcatactcgattg

SEQ ID NO: 183375 - DNA, 20 bp, Artificial Sequence
  Description of Artificial Sequence: Synthetic oligonucleotide
  Target: ATXN1; (-) strand; PAM type: YTN; PAM sequence: TTT
gttggcagtcatactcgatt

SEQ ID NO: 183376 - DNA, 20 bp, Artificial Sequence
  Description of Artificial Sequence: Synthetic oligonucleotide
  Target: ATXN1; (-) strand; PAM type: YTN; PAM sequence: CTA
caatttgttggcagtcatac

SEQ ID NO: 183377 - DNA, 20 bp, Artificial Sequence
  Description of Artificial Sequence: Synthetic oligonucleotide
  Target: ATXN1; (-) strand; PAM type: YTN; PAM sequence: CTG
ggctacaatttgttggcagt

SEQ ID NO: 183378 - DNA, 20 bp, Artificial Sequence
  Description of Artificial Sequence: Synthetic oligonucleotide
  Target: ATXN1; (-) strand; PAM type: YTN; PAM sequence: TTG
ggaagcataagtctgggcta

SEQ ID NO: 183379 - DNA, 20 bp, Artificial Sequence
  Description of Artificial Sequence: Synthetic oligonucleotide
  Target: ATXN1; (-) strand; PAM type: YTN; PAM sequence: CTG
ttgggaagcataagtctggg

SEQ ID NO: 183380 - DNA, 20 bp, Artificial Sequence
  Description of Artificial Sequence: Synthetic oligonucleotide
  Target: ATXN1; (-) strand; PAM type: YTN; PAM sequence: CTA
agagatcctgttgggaagca

SEQ ID NO: 183381 - DNA, 20 bp, Artificial Sequence
  Description of Artificial Sequence: Synthetic oligonucleotide
  Target: ATXN1; (-) strand; PAM type: YTN; PAM sequence: TTC
taagagatcctgttgggaag

SEQ ID NO: 183382 - DNA, 20 bp, Artificial Sequence
  Description of Artificial Sequence: Synthetic oligonucleotide
  Target: ATXN1; (-) strand; PAM type: YTN; PAM sequence: CTT
ctaagagatcctgttgggaa

SEQ ID NO: 183383 - DNA, 20 bp, Artificial Sequence
  Description of Artificial Sequence: Synthetic oligonucleotide
  Target: ATXN1; (-) strand; PAM type: YTN; PAM sequence: CTA
agggtacttctaagagatcc

SEQ ID NO: 183384 - DNA, 20 bp, Artificial Sequence
  Description of Artificial Sequence: Synthetic oligonucleotide
  Target: ATXN1; (-) strand; PAM type: YTN; PAM sequence: TTA
gctaagggtacttctaagag

SEQ ID NO: 183385 - DNA, 20 bp, Artificial Sequence
  Description of Artificial Sequence: Synthetic oligonucleotide
  Target: ATXN1; (-) strand; PAM type: YTN; PAM sequence: TTA
aggtcaggattagctaaggg

SEQ ID NO: 183386 - DNA, 20 bp, Artificial Sequence
  Description of Artificial Sequence: Synthetic oligonucleotide
  Target: ATXN1; (-) strand; PAM type: YTN; PAM sequence: TTC
catcggtatataggttaagg

SEQ ID NO: 183387 - DNA, 20 bp, Artificial Sequence
  Description of Artificial Sequence: Synthetic oligonucleotide
  Target: ATXN1; (-) strand; PAM type: YTN; PAM sequence: CTT
ccatcggtatataggttaag

SEQ ID NO: 183388 - DNA, 20 bp, Artificial Sequence
  Description of Artificial Sequence: Synthetic oligonucleotide
  Target: ATXN1; (-) strand; PAM type: YTN; PAM sequence: CTC
cacaaatgaacttccatcgg

SEQ ID NO: 183389 - DNA, 20 bp, Artificial Sequence
  Description of Artificial Sequence: Synthetic oligonucleotide
  Target: ATXN1; (-) strand; PAM type: YTN; PAM sequence: TTC
tccacaaatgaacttccatc

SEQ ID NO: 183390 - DNA, 20 bp, Artificial Sequence
  Description of Artificial Sequence: Synthetic oligonucleotide
  Target: ATXN1; (-) strand; PAM type: YTN; PAM sequence: TTC
atatcccattctccacaaat

SEQ ID NO: 183391 - DNA, 20 bp, Artificial Sequence
  Description of Artificial Sequence: Synthetic oligonucleotide
  Target: ATXN1; (-) strand; PAM type: YTN; PAM sequence: CTT
catatcccattctccacaaa

SEQ ID NO: 183392 - DNA, 20 bp, Artificial Sequence
  Description of Artificial Sequence: Synthetic oligonucleotide
  Target: ATXN1; (-) strand; PAM type: YTN; PAM sequence: CTG
cccttcatatcccattctcc

SEQ ID NO: 183393 - DNA, 20 bp, Artificial Sequence
  Description of Artificial Sequence: Synthetic oligonucleotide
  Target: ATXN1; (-) strand; PAM type: YTN; PAM sequence: CTA
tggcataacctgcccttcat

SEQ ID NO: 183394 - DNA, 20 bp, Artificial Sequence
  Description of Artificial Sequence: Synthetic oligonucleotide
  Target: ATXN1; (-) strand; PAM type: YTN; PAM sequence: CTA
actatggcataacctgccct

SEQ ID NO: 183395 - DNA, 20 bp, Artificial Sequence
  Description of Artificial Sequence: Synthetic oligonucleotide
  Target: ATXN1; (-) strand; PAM type: YTN; PAM sequence: TTA
catcactaactatggcataa

SEQ ID NO: 183396 - DNA, 20 bp, Artificial Sequence
  Description of Artificial Sequence: Synthetic oligonucleotide
  Target: ATXN1; (-) strand; PAM type: YTN; PAM sequence: CTG
ttacatcactaactatggca

SEQ ID NO: 183397 - DNA, 20 bp, Artificial Sequence
  Description of Artificial Sequence: Synthetic oligonucleotide
  Target: ATXN1; (-) strand; PAM type: YTN; PAM sequence: TTC
aagtactgttacatcactaa

SEQ ID NO: 183398 - DNA, 20 bp, Artificial Sequence
  Description of Artificial Sequence: Synthetic oligonucleotide
  Target: ATXN1; (-) strand; PAM type: YTN; PAM sequence: TTT
caagtactgttacatcacta

SEQ ID NO: 183399 - DNA, 20 bp, Artificial Sequence
  Description of Artificial Sequence: Synthetic oligonucleotide
  Target: ATXN1; (-) strand; PAM type: YTN; PAM sequence: CTT
tcaagtactgttacatcact

SEQ ID NO: 183400 - DNA, 20 bp, Artificial Sequence
  Description of Artificial Sequence: Synthetic oligonucleotide
  Target: ATXN1; (-) strand; PAM type: YTN; PAM sequence: TTA
ctttcaagtactgttacatc

SEQ ID NO: 183401 - DNA, 20 bp, Artificial Sequence
  Description of Artificial Sequence: Synthetic oligonucleotide
  Target: ATXN1; (-) strand; PAM type: YTN; PAM sequence: CTT
actttcaagtactgttacat

SEQ ID NO: 183402 - DNA, 20 bp, Artificial Sequence
  Description of Artificial Sequence: Synthetic oligonucleotide
  Target: ATXN1; (-) strand; PAM type: YTN; PAM sequence: CTG
gtccgtggggggaagagact

SEQ ID NO: 183403 - DNA, 20 bp, Artificial Sequence
  Description of Artificial Sequence: Synthetic oligonucleotide
  Target: ATXN1; (-) strand; PAM type: YTN; PAM sequence: CTA
ggcgctggtccgtgggggga

SEQ ID NO: 183404 - DNA, 20 bp, Artificial Sequence
  Description of Artificial Sequence: Synthetic oligonucleotide
  Target: ATXN1; (-) strand; PAM type: YTN; PAM sequence: CTA
actaggcgctggtccgtggg

SEQ ID NO: 183405 - DNA, 20 bp, Artificial Sequence
  Description of Artificial Sequence: Synthetic oligonucleotide
  Target: ATXN1; (-) strand; PAM type: YTN; PAM sequence: CTG
ctaactaggcgctggtccgt

SEQ ID NO: 183406 - DNA, 20 bp, Artificial Sequence
  Description of Artificial Sequence: Synthetic oligonucleotide
  Target: ATXN1; (-) strand; PAM type: YTN; PAM sequence: TTC
tgctaactaggcgctggtcc

SEQ ID NO: 183407 - DNA, 20 bp, Artificial Sequence
  Description of Artificial Sequence: Synthetic oligonucleotide
  Target: ATXN1; (-) strand; PAM type: YTN; PAM sequence: TTG
ggtaagttctgctaactagg

SEQ ID NO: 183408 - DNA, 20 bp, Artificial Sequence
  Description of Artificial Sequence: Synthetic oligonucleotide
  Target: ATXN1; (-) strand; PAM type: YTN; PAM sequence: CTT
gggtaagttctgctaactag

SEQ ID NO: 183409 - DNA, 20 bp, Artificial Sequence
  Description of Artificial Sequence: Synthetic oligonucleotide
  Target: ATXN1; (-) strand; PAM type: YTN; PAM sequence: CTA
aggcttgggtaagttctgct

SEQ ID NO: 183410 - DNA, 20 bp, Artificial Sequence
  Description of Artificial Sequence: Synthetic oligonucleotide
  Target: ATXN1; (-) strand; PAM type: YTN; PAM sequence: TTC
taaggcttgggtaagttctg

SEQ ID NO: 183411 - DNA, 20 bp, Artificial Sequence
  Description of Artificial Sequence: Synthetic oligonucleotide
  Target: ATXN1; (-) strand; PAM type: YTN; PAM sequence: TTC
ccggttctaaggcttgggta

SEQ ID NO: 183412 - DNA, 20 bp, Artificial Sequence
  Description of Artificial Sequence: Synthetic oligonucleotide
  Target: ATXN1; (-) strand; PAM type: YTN; PAM sequence: TTT
cccggttctaaggcttgggt

SEQ ID NO: 183413 - DNA, 20 bp, Artificial Sequence
  Description of Artificial Sequence: Synthetic oligonucleotide
  Target: ATXN1; (-) strand; PAM type: YTN; PAM sequence: CTT
tcccggttctaaggcttggg

SEQ ID NO: 183414 - DNA, 20 bp, Artificial Sequence
  Description of Artificial Sequence: Synthetic oligonucleotide
  Target: ATXN1; (-) strand; PAM type: YTN; PAM sequence: TTC
ctttcccggttctaaggctt

SEQ ID NO: 183415 - DNA, 20 bp, Artificial Sequence
  Description of Artificial Sequence: Synthetic oligonucleotide
  Target: ATXN1; (-) strand; PAM type: YTN; PAM sequence: TTT
cctttcccggttctaaggct

SEQ ID NO: 183416 - DNA, 20 bp, Artificial Sequence
  Description of Artificial Sequence: Synthetic oligonucleotide
  Target: ATXN1; (-) strand; PAM type: YTN; PAM sequence: TTT
tcctttcccggttctaaggc

SEQ ID NO: 183417 - DNA, 20 bp, Artificial Sequence
  Description of Artificial Sequence: Synthetic oligonucleotide
  Target: ATXN1; (-) strand; PAM type: YTN; PAM sequence: TTT
ttcctttcccggttctaagg

SEQ ID NO: 183418 - DNA, 20 bp, Artificial Sequence
  Description of Artificial Sequence: Synthetic oligonucleotide
  Target: ATXN1; (-) strand; PAM type: YTN; PAM sequence: TTT
tttcctttcccggttctaag

SEQ ID NO: 183419 - DNA, 20 bp, Artificial Sequence
  Description of Artificial Sequence: Synthetic oligonucleotide
  Target: ATXN1; (-) strand; PAM type: YTN; PAM sequence: CTT
ttttcctttcccggttctaa

SEQ ID NO: 183420 - DNA, 20 bp, Artificial Sequence
  Description of Artificial Sequence: Synthetic oligonucleotide
  Target: ATXN1; (-) strand; PAM type: YTN; PAM sequence: TTC
ttttttcctttcccggttct

SEQ ID NO: 183421 - DNA, 20 bp, Artificial Sequence
  Description of Artificial Sequence: Synthetic oligonucleotide
  Target: ATXN1; (-) strand; PAM type: YTN; PAM sequence: TTA
ttcttttttcctttcccggt

SEQ ID NO: 183422 - DNA, 20 bp, Artificial Sequence
  Description of Artificial Sequence: Synthetic oligonucleotide
  Target: ATXN1; (-) strand; PAM type: YTN; PAM sequence: TTT
attcttttttcctttcccgg

SEQ ID NO: 183423 - DNA, 20 bp, Artificial Sequence
  Description of Artificial Sequence: Synthetic oligonucleotide
  Target: ATXN1; (-) strand; PAM type: YTN; PAM sequence: CTG
tatacacatttattcttttt

SEQ ID NO: 183424 - DNA, 20 bp, Artificial Sequence
  Description of Artificial Sequence: Synthetic oligonucleotide
  Target: ATXN1; (-) strand; PAM type: YTN; PAM sequence: CTA
tctgtatacacatttattct

SEQ ID NO: 183425 - DNA, 20 bp, Artificial Sequence
  Description of Artificial Sequence: Synthetic oligonucleotide
  Target: ATXN1; (-) strand; PAM type: YTN; PAM sequence: TTG
ctatctgtatacacatttat

SEQ ID NO: 183426 - DNA, 20 bp, Artificial Sequence
  Description of Artificial Sequence: Synthetic oligonucleotide
  Target: ATXN1; (-) strand; PAM type: YTN; PAM sequence: CTT
gctatctgtatacacattta

SEQ ID NO: 183427 - DNA, 20 bp, Artificial Sequence
  Description of Artificial Sequence: Synthetic oligonucleotide
  Target: ATXN1; (-) strand; PAM type: YTN; PAM sequence: TTA
gataagcatacttgctatct

SEQ ID NO: 183428 - DNA, 20 bp, Artificial Sequence
  Description of Artificial Sequence: Synthetic oligonucleotide
  Target: ATXN1; (-) strand; PAM type: YTN; PAM sequence: TTG
cagcatgggcatgtaggatt

SEQ ID NO: 183429 - DNA, 20 bp, Artificial Sequence
  Description of Artificial Sequence: Synthetic oligonucleotide
  Target: ATXN1; (-) strand; PAM type: YTN; PAM sequence: TTC
catattgcagcatgggcatg

SEQ ID NO: 183430 - DNA, 20 bp, Artificial Sequence
  Description of Artificial Sequence: Synthetic oligonucleotide
  Target: ATXN1; (-) strand; PAM type: YTN; PAM sequence: TTT
ccatattgcagcatgggcat

SEQ ID NO: 183431 - DNA, 20 bp, Artificial Sequence
  Description of Artificial Sequence: Synthetic oligonucleotide
  Target: ATXN1; (-) strand; PAM type: YTN; PAM sequence: CTT
tccatattgcagcatgggca

SEQ ID NO: 183432 - DNA, 20 bp, Artificial Sequence
  Description of Artificial Sequence: Synthetic oligonucleotide
  Target: ATXN1; (-) strand; PAM type: YTN; PAM sequence: TTC
tttccatattgcagcatggg

SEQ ID NO: 183433 - DNA, 20 bp, Artificial Sequence
  Description of Artificial Sequence: Synthetic oligonucleotide
  Target: ATXN1; (-) strand; PAM type: YTN; PAM sequence: TTT
ctttccatattgcagcatgg

SEQ ID NO: 183434 - DNA, 20 bp, Artificial Sequence
  Description of Artificial Sequence: Synthetic oligonucleotide
  Target: ATXN1; (-) strand; PAM type: YTN; PAM sequence: CTT
tctttccatattgcagcatg

SEQ ID NO: 183435 - DNA, 20 bp, Artificial Sequence
  Description of Artificial Sequence: Synthetic oligonucleotide
  Target: ATXN1; (-) strand; PAM type: YTN; PAM sequence: CTC
cctttctttccatattgcag

SEQ ID NO: 183436 - DNA, 20 bp, Artificial Sequence
  Description of Artificial Sequence: Synthetic oligonucleotide
  Target: ATXN1; (-) strand; PAM type: YTN; PAM sequence: TTA
ggaactccctttctttccat

SEQ ID NO: 183437 - DNA, 20 bp, Artificial Sequence
  Description of Artificial Sequence: Synthetic oligonucleotide
  Target: ATXN1; (-) strand; PAM type: YTN; PAM sequence: TTC
ccccagaggttaggaactcc

SEQ ID NO: 183438 - DNA, 20 bp, Artificial Sequence
  Description of Artificial Sequence: Synthetic oligonucleotide
  Target: ATXN1; (-) strand; PAM type: YTN; PAM sequence: TTA
atgggggttcccccagaggt

SEQ ID NO: 183439 - DNA, 20 bp, Artificial Sequence
  Description of Artificial Sequence: Synthetic oligonucleotide
  Target: ATXN1; (-) strand; PAM type: YTN; PAM sequence: TTT
aatgggggttcccccagagg

SEQ ID NO: 183440 - DNA, 20 bp, Artificial Sequence
  Description of Artificial Sequence: Synthetic oligonucleotide
  Target: ATXN1; (-) strand; PAM type: YTN; PAM sequence: TTG
tggtatttaatgggggttcc

SEQ ID NO: 183441 - DNA, 20 bp, Artificial Sequence
  Description of Artificial Sequence: Synthetic oligonucleotide
  Target: ATXN1; (-) strand; PAM type: YTN; PAM sequence: CTT
gtggtatttaatgggggttc

SEQ ID NO: 183442 - DNA, 20 bp, Artificial Sequence
  Description of Artificial Sequence: Synthetic oligonucleotide
  Target: ATXN1; (-) strand; PAM type: YTN; PAM sequence: TTC
cttgtggtatttaatggggg

SEQ ID NO: 183443 - DNA, 20 bp, Artificial Sequence
  Description of Artificial Sequence: Synthetic oligonucleotide
  Target: ATXN1; (-) strand; PAM type: YTN; PAM sequence: TTT
ccttgtggtatttaatgggg

SEQ ID NO: 183444 - DNA, 20 bp, Artificial Sequence
  Description of Artificial Sequence: Synthetic oligonucleotide
  Target: ATXN1; (-) strand; PAM type: YTN; PAM sequence: CTC
cataatttccttgtggtatt

SEQ ID NO: 183445 - DNA, 20 bp, Artificial Sequence
  Description of Artificial Sequence: Synthetic oligonucleotide
  Target: ATXN1; (-) strand; PAM type: YTN; PAM sequence: CTG
tgtgcaataactccataatt

SEQ ID NO: 183446 - DNA, 20 bp, Artificial Sequence
  Description of Artificial Sequence: Synthetic oligonucleotide
  Target: ATXN1; (-) strand; PAM type: YTN; PAM sequence: TTG
cactgtgtgcaataactcca

SEQ ID NO: 183447 - DNA, 20 bp, Artificial Sequence
  Description of Artificial Sequence: Synthetic oligonucleotide
  Target: ATXN1; (-) strand; PAM type: YTN; PAM sequence: TTT
gcactgtgtgcaataactcc

SEQ ID NO: 183448 - DNA, 20 bp, Artificial Sequence
  Description of Artificial Sequence: Synthetic oligonucleotide
  Target: ATXN1; (-) strand; PAM type: YTN; PAM sequence: TTT
tgcactgtgtgcaataactc

SEQ ID NO: 183449 - DNA, 20 bp, Artificial Sequence
  Description of Artificial Sequence: Synthetic oligonucleotide
  Target: ATXN1; (-) strand; PAM type: YTN; PAM sequence: TTT
ttgcactgtgtgcaataact

SEQ ID NO: 183450 - DNA, 20 bp, Artificial Sequence
  Description of Artificial Sequence: Synthetic oligonucleotide
  Target: ATXN1; (-) strand; PAM type: YTN; PAM sequence: TTG
ggtttttgcactgtgtgcaa

SEQ ID NO: 183451 - DNA, 20 bp, Artificial Sequence
  Description of Artificial Sequence: Synthetic oligonucleotide
  Target: ATXN1; (-) strand; PAM type: YTN; PAM sequence: CTT
gggtttttgcactgtgtgca

SEQ ID NO: 183452 - DNA, 20 bp, Artificial Sequence
  Description of Artificial Sequence: Synthetic oligonucleotide
  Target: ATXN1; (-) strand; PAM type: YTN; PAM sequence: CTC
cttgggtttttgcactgtgt

SEQ ID NO: 183453 - DNA, 20 bp, Artificial Sequence
  Description of Artificial Sequence: Synthetic oligonucleotide
  Target: ATXN1; (-) strand; PAM type: YTN; PAM sequence: CTG
ccacctccttgggtttttgc

SEQ ID NO: 183454 - DNA, 20 bp, Artificial Sequence
  Description of Artificial Sequence: Synthetic oligonucleotide
  Target: ATXN1; (-) strand; PAM type: YTN; PAM sequence: TTC
agcagtgtaacactgccacc

SEQ ID NO: 183455 - DNA, 20 bp, Artificial Sequence
  Description of Artificial Sequence: Synthetic oligonucleotide
  Target: ATXN1; (-) strand; PAM type: YTN; PAM sequence: CTT
cagcagtgtaacactgccac

SEQ ID NO: 183456 - DNA, 20 bp, Artificial Sequence
  Description of Artificial Sequence: Synthetic oligonucleotide
  Target: ATXN1; (-) strand; PAM type: YTN; PAM sequence: TTG
atggcttcagcagtgtaaca

SEQ ID NO: 183457 - DNA, 20 bp, Artificial Sequence
  Description of Artificial Sequence: Synthetic oligonucleotide
  Target: ATXN1; (-) strand; PAM type: YTN; PAM sequence: TTT
gatggcttcagcagtgtaac

SEQ ID NO: 183458 - DNA, 20 bp, Artificial Sequence
  Description of Artificial Sequence: Synthetic oligonucleotide
  Target: ATXN1; (-) strand; PAM type: YTN; PAM sequence: TTT
tgatggcttcagcagtgtaa

SEQ ID NO: 183459 - DNA, 20 bp, Artificial Sequence
  Description of Artificial Sequence: Synthetic oligonucleotide
  Target: ATXN1; (-) strand; PAM type: YTN; PAM sequence: TTT
ttgatggcttcagcagtgta

SEQ ID NO: 183460 - DNA, 20 bp, Artificial Sequence
  Description of Artificial Sequence: Synthetic oligonucleotide
  Target: ATXN1; (-) strand; PAM type: YTN; PAM sequence: CTT
tttgatggcttcagcagtgt

SEQ ID NO: 183461 - DNA, 20 bp, Artificial Sequence
  Description of Artificial Sequence: Synthetic oligonucleotide
  Target: ATXN1; (-) strand; PAM type: YTN; PAM sequence: TTC
acctttttgatggcttcagc

SEQ ID NO: 183462 - DNA, 20 bp, Artificial Sequence
  Description of Artificial Sequence: Synthetic oligonucleotide
  Target: ATXN1; (-) strand; PAM type: YTN; PAM sequence: CTT
cacctttttgatggcttcag

SEQ ID NO: 183463 - DNA, 20 bp, Artificial Sequence
  Description of Artificial Sequence: Synthetic oligonucleotide
  Target: ATXN1; (-) strand; PAM type: YTN; PAM sequence: CTC
cttcacctttttgatggctt

SEQ ID NO: 183464 - DNA, 20 bp, Artificial Sequence
  Description of Artificial Sequence: Synthetic oligonucleotide
  Target: ATXN1; (-) strand; PAM type: YTN; PAM sequence: TTC
tccttcacctttttgatggc

SEQ ID NO: 183465 - DNA, 20 bp, Artificial Sequence
  Description of Artificial Sequence: Synthetic oligonucleotide
  Target: ATXN1; (-) strand; PAM type: YTN; PAM sequence: TTT
ctccttcacctttttgatgg

SEQ ID NO: 183466 - DNA, 20 bp, Artificial Sequence
  Description of Artificial Sequence: Synthetic oligonucleotide
  Target: ATXN1; (-) strand; PAM type: YTN; PAM sequence: TTT
tctccttcacctttttgatg

SEQ ID NO: 183467 - DNA, 20 bp, Artificial Sequence
  Description of Artificial Sequence: Synthetic oligonucleotide
  Target: ATXN1; (-) strand; PAM type: YTN; PAM sequence: CTT
ttctccttcacctttttgat

SEQ ID NO: 183468 - DNA, 20 bp, Artificial Sequence
  Description of Artificial Sequence: Synthetic oligonucleotide
  Target: ATXN1; (-) strand; PAM type: YTN; PAM sequence: CTG
ccttttctccttcacctttt

SEQ ID NO: 183469 - DNA, 20 bp, Artificial Sequence
  Description of Artificial Sequence: Synthetic oligonucleotide
  Target: ATXN1; (-) strand; PAM type: YTN; PAM sequence: TTC
tgccttttctccttcacctt

SEQ ID NO: 183470 - DNA, 20 bp, Artificial Sequence
  Description of Artificial Sequence: Synthetic oligonucleotide
  Target: ATXN1; (-) strand; PAM type: YTN; PAM sequence: CTT
ctgccttttctccttcacct

SEQ ID NO: 183471 - DNA, 20 bp, Artificial Sequence
  Description of Artificial Sequence: Synthetic oligonucleotide
  Target: ATXN1; (-) strand; PAM type: YTN; PAM sequence: TTC
cttctgccttttctccttca

SEQ ID NO: 183472 - DNA, 20 bp, Artificial Sequence
  Description of Artificial Sequence: Synthetic oligonucleotide
  Target: ATXN1; (-) strand; PAM type: YTN; PAM sequence: TTT
ccttctgccttttctccttc

SEQ ID NO: 183473 - DNA, 20 bp, Artificial Sequence
  Description of Artificial Sequence: Synthetic oligonucleotide
  Target: ATXN1; (-) strand; PAM type: YTN; PAM sequence: CTG
cccagtggtttccttctgcc

SEQ ID NO: 183474 - DNA, 20 bp, Artificial Sequence
  Description of Artificial Sequence: Synthetic oligonucleotide
  Target: ATXN1; (-) strand; PAM type: YTN; PAM sequence: CTC
agcatctgcccagtggtttc

SEQ ID NO: 183475 - DNA, 20 bp, Artificial Sequence
  Description of Artificial Sequence: Synthetic oligonucleotide
  Target: ATXN1; (-) strand; PAM type: YTN; PAM sequence: TTG
gcctcagcatctgcccagtg

SEQ ID NO: 183476 - DNA, 20 bp, Artificial Sequence
  Description of Artificial Sequence: Synthetic oligonucleotide
  Target: ATXN1; (-) strand; PAM type: YTN; PAM sequence: TTT
ggcctcagcatctgcccagt

SEQ ID NO: 183477 - DNA, 20 bp, Artificial Sequence
  Description of Artificial Sequence: Synthetic oligonucleotide
  Target: ATXN1; (-) strand; PAM type: YTN; PAM sequence: TTT
tggcctcagcatctgcccag

SEQ ID NO: 183478 - DNA, 20 bp, Artificial Sequence
  Description of Artificial Sequence: Synthetic oligonucleotide
  Target: ATXN1; (-) strand; PAM type: YTN; PAM sequence: CTG
gcagcaattttggcctcagc

SEQ ID NO: 183479 - DNA, 20 bp, Artificial Sequence
  Description of Artificial Sequence: Synthetic oligonucleotide
  Target: ATXN1; (-) strand; PAM type: YTN; PAM sequence: CTG
cctggcagcaattttggcct

SEQ ID NO: 183480 - DNA, 20 bp, Artificial Sequence
  Description of Artificial Sequence: Synthetic oligonucleotide
  Target: ATXN1; (-) strand; PAM type: YTN; PAM sequence: TTC
tgcctggcagcaattttggc

SEQ ID NO: 183481 - DNA, 20 bp, Artificial Sequence
  Description of Artificial Sequence: Synthetic oligonucleotide
  Target: ATXN1; (-) strand; PAM type: YTN; PAM sequence: CTA
atgggaggttctgcctggca

SEQ ID NO: 183482 - DNA, 20 bp, Artificial Sequence
  Description of Artificial Sequence: Synthetic oligonucleotide
  Target: ATXN1; (-) strand; PAM type: YTN; PAM sequence: TTC
taatgggaggttctgcctgg

SEQ ID NO: 183483 - DNA, 20 bp, Artificial Sequence
  Description of Artificial Sequence: Synthetic oligonucleotide
  Target: ATXN1; (-) strand; PAM type: YTN; PAM sequence: TTT
ctaatgggaggttctgcctg

SEQ ID NO: 183484 - DNA, 20 bp, Artificial Sequence
  Description of Artificial Sequence: Synthetic oligonucleotide
  Target: ATXN1; (-) strand; PAM type: YTN; PAM sequence: TTC
cataggtatttctaatggga

SEQ ID NO: 183485 - DNA, 20 bp, Artificial Sequence
  Description of Artificial Sequence: Synthetic oligonucleotide
  Target: ATXN1; (-) strand; PAM type: YTN; PAM sequence: CTT
ccataggtatttctaatggg

SEQ ID NO: 183486 - DNA, 20 bp, Artificial Sequence
  Description of Artificial Sequence: Synthetic oligonucleotide
  Target: ATXN1; (-) strand; PAM type: YTN; PAM sequence: TTC
cataccatgggtccttccat

SEQ ID NO: 183487 - DNA, 20 bp, Artificial Sequence
  Description of Artificial Sequence: Synthetic oligonucleotide
  Target: ATXN1; (-) strand; PAM type: YTN; PAM sequence: TTG
ttccataccatgggtccttc

SEQ ID NO: 183488 - DNA, 20 bp, Artificial Sequence
  Description of Artificial Sequence: Synthetic oligonucleotide
  Target: ATXN1; (-) strand; PAM type: YTN; PAM sequence: TTG
gagggggttgttccatacca

SEQ ID NO: 183489 - DNA, 20 bp, Artificial Sequence
  Description of Artificial Sequence: Synthetic oligonucleotide
  Target: ATXN1; (-) strand; PAM type: YTN; PAM sequence: CTT
ggagggggttgttccatacc

SEQ ID NO: 183490 - DNA, 20 bp, Artificial Sequence
  Description of Artificial Sequence: Synthetic oligonucleotide
  Target: ATXN1; (-) strand; PAM type: YTN; PAM sequence: CTC
ttggagggggttgttccata

SEQ ID NO: 183491 - DNA, 20 bp, Artificial Sequence
  Description of Artificial Sequence: Synthetic oligonucleotide
  Target: ATXN1; (-) strand; PAM type: YTN; PAM sequence: TTA
atctcttggagggggttgtt

SEQ ID NO: 183492 - DNA, 20 bp, Artificial Sequence
  Description of Artificial Sequence: Synthetic oligonucleotide
  Target: ATXN1; (-) strand; PAM type: YTN; PAM sequence: CTT
aatctcttggagggggttgt

SEQ ID NO: 183493 - DNA, 20 bp, Artificial Sequence
  Description of Artificial Sequence: Synthetic oligonucleotide
  Target: ATXN1; (-) strand; PAM type: YTN; PAM sequence: CTG
gggcttaatctcttggaggg

SEQ ID NO: 183494 - DNA, 20 bp, Artificial Sequence
  Description of Artificial Sequence: Synthetic oligonucleotide
  Target: ATXN1; (-) strand; PAM type: YTN; PAM sequence: TTC
gatcagggagtactggggct

SEQ ID NO: 183495 - DNA, 20 bp, Artificial Sequence
  Description of Artificial Sequence: Synthetic oligonucleotide
  Target: ATXN1; (-) strand; PAM type: YTN; PAM sequence: TTT
cgatcagggagtactggggc

SEQ ID NO: 183496 - DNA, 20 bp, Artificial Sequence
  Description of Artificial Sequence: Synthetic oligonucleotide
  Target: ATXN1; (-) strand; PAM type: YTN; PAM sequence: CTG
tttcgatcagggagtactgg

SEQ ID NO: 183497 - DNA, 20 bp, Artificial Sequence
  Description of Artificial Sequence: Synthetic oligonucleotide
  Target: ATXN1; (-) strand; PAM type: YTN; PAM sequence: TTC
tgtttcgatcagggagtact

SEQ ID NO: 183498 - DNA, 20 bp, Artificial Sequence
  Description of Artificial Sequence: Synthetic oligonucleotide
  Target: ATXN1; (-) strand; PAM type: YTN; PAM sequence: CTA
tgcccccgtgaaagtcccca

SEQ ID NO: 183499 - DNA, 20 bp, Artificial Sequence
  Description of Artificial Sequence: Synthetic oligonucleotide
  Target: ATXN1; (-) strand; PAM type: YTN; PAM sequence: TTA
accaccccaaggggagaaaa

SEQ ID NO: 183500 - DNA, 20 bp, Artificial Sequence
  Description of Artificial Sequence: Synthetic oligonucleotide
  Target: ATXN1; (-) strand; PAM type: YTN; PAM sequence: CTG
ccgttaaccaccccaagggg

SEQ ID NO: 183501 - DNA, 20 bp, Artificial Sequence
  Description of Artificial Sequence: Synthetic oligonucleotide
  Target: ATXN1; (-) strand; PAM type: YTN; PAM sequence: TTC
tgccgttaaccaccccaagg

SEQ ID NO: 183502 - DNA, 20 bp, Artificial Sequence
  Description of Artificial Sequence: Synthetic oligonucleotide
  Target: ATXN1; (-) strand; PAM type: YTN; PAM sequence: CTT
ctgccgttaaccaccccaag

SEQ ID NO: 183503 - DNA, 20 bp, Artificial Sequence
  Description of Artificial Sequence: Synthetic oligonucleotide
  Target: ATXN1; (-) strand; PAM type: YTN; PAM sequence: CTC
ttctgccgttaaccacccca

SEQ ID NO: 183504 - DNA, 20 bp, Artificial Sequence
  Description of Artificial Sequence: Synthetic oligonucleotide
  Target: ATXN1; (-) strand; PAM type: YTN; PAM sequence: TTC
cctcttctgccgttaaccac

SEQ ID NO: 183505 - DNA, 20 bp, Artificial Sequence
  Description of Artificial Sequence: Synthetic oligonucleotide
  Target: ATXN1; (-) strand; PAM type: YTN; PAM sequence: TTT
ccctcttctgccgttaacca

SEQ ID NO: 183506 - DNA, 20 bp, Artificial Sequence
  Description of Artificial Sequence: Synthetic oligonucleotide
  Target: ATXN1; (-) strand; PAM type: YTN; PAM sequence: CTT
tccctcttctgccgttaacc

SEQ ID NO: 183507 - DNA, 20 bp, Artificial Sequence
  Description of Artificial Sequence: Synthetic oligonucleotide
  Target: ATXN1; (-) strand; PAM type: YTN; PAM sequence: TTC
ggatatgagtacctttccct

SEQ ID NO: 183508 - DNA, 20 bp, Artificial Sequence
  Description of Artificial Sequence: Synthetic oligonucleotide
  Target: ATXN1; (-) strand; PAM type: YTN; PAM sequence: CTT
cggatatgagtacctttccc

SEQ ID NO: 183509 - DNA, 20 bp, Artificial Sequence
  Description of Artificial Sequence: Synthetic oligonucleotide
  Target: ATXN1; (-) strand; PAM type: YTN; PAM sequence: CTG
gcttcggatatgagtacctt

SEQ ID NO: 183510 - DNA, 20 bp, Artificial Sequence
  Description of Artificial Sequence: Synthetic oligonucleotide
  Target: ATXN1; (-) strand; PAM type: YTN; PAM sequence: CTG
gctggcttcggatatgagta

SEQ ID NO: 183511 - DNA, 20 bp, Artificial Sequence
  Description of Artificial Sequence: Synthetic oligonucleotide
  Target: ATXN1; (-) strand; PAM type: YTN; PAM sequence: TTC
cactggctggcttcggatat

SEQ ID NO: 183512 - DNA, 20 bp, Artificial Sequence
  Description of Artificial Sequence: Synthetic oligonucleotide
  Target: ATXN1; (-) strand; PAM type: YTN; PAM sequence: TTT
ccactggctggcttcggata

SEQ ID NO: 183513 - DNA, 20 bp, Artificial Sequence
  Description of Artificial Sequence: Synthetic oligonucleotide
  Target: ATXN1; (-) strand; PAM type: YTN; PAM sequence: TTT
tccactggctggcttcggat

SEQ ID NO: 183514 - DNA, 20 bp, Artificial Sequence
  Description of Artificial Sequence: Synthetic oligonucleotide
  Target: ATXN1; (-) strand; PAM type: YTN; PAM sequence: TTA
agtattttccactggctggc

SEQ ID NO: 183515 - DNA, 20 bp, Artificial Sequence
  Description of Artificial Sequence: Synthetic oligonucleotide
  Target: ATXN1; (-) strand; PAM type: YTN; PAM sequence: CTT
aagtattttccactggctgg

SEQ ID NO: 183516 - DNA, 20 bp, Artificial Sequence
  Description of Artificial Sequence: Synthetic oligonucleotide
  Target: ATXN1; (-) strand; PAM type: YTN; PAM sequence: TTG
gcagggggtcttaagtattt

SEQ ID NO: 183517 - DNA, 20 bp, Artificial Sequence
  Description of Artificial Sequence: Synthetic oligonucleotide
  Target: ATXN1; (-) strand; PAM type: YTN; PAM sequence: TTT
ggcagggggtcttaagtatt

SEQ ID NO: 183518 - DNA, 20 bp, Artificial Sequence
  Description of Artificial Sequence: Synthetic oligonucleotide
  Target: ATXN1; (-) strand; PAM type: YTN; PAM sequence: CTC
aaacccatgtgaaaagtttg

SEQ ID NO: 183519 - DNA, 20 bp, Artificial Sequence
  Description of Artificial Sequence: Synthetic oligonucleotide
  Target: ATXN1; (-) strand; PAM type: YTN; PAM sequence: TTC
tcaaacccatgtgaaaagtt

SEQ ID NO: 183520 - DNA, 20 bp, Artificial Sequence
  Description of Artificial Sequence: Synthetic oligonucleotide
  Target: ATXN1; (-) strand; PAM type: YTN; PAM sequence: TTG
atgagtgttctcaaacccat

SEQ ID NO: 183521 - DNA, 20 bp, Artificial Sequence
  Description of Artificial Sequence: Synthetic oligonucleotide
  Target: ATXN1; (-) strand; PAM type: YTN; PAM sequence: TTT
gatgagtgttctcaaaccca

SEQ ID NO: 183522 - DNA, 20 bp, Artificial Sequence
  Description of Artificial Sequence: Synthetic oligonucleotide
  Target: ATXN1; (-) strand; PAM type: YTN; PAM sequence: TTG
gccatttgatgagtgttctc

SEQ ID NO: 183523 - DNA, 20 bp, Artificial Sequence
  Description of Artificial Sequence: Synthetic oligonucleotide
  Target: ATXN1; (-) strand; PAM type: YTN; PAM sequence: TTT
ggccatttgatgagtgttct

SEQ ID NO: 183524 - DNA, 20 bp, Artificial Sequence
  Description of Artificial Sequence: Synthetic oligonucleotide
  Target: ATXN1; (-) strand; PAM type: YTN; PAM sequence: CTG
gaggagatatggccccataa

SEQ ID NO: 183525 - DNA, 20 bp, Artificial Sequence
  Description of Artificial Sequence: Synthetic oligonucleotide
  Target: ATXN1; (-) strand; PAM type: YTN; PAM sequence: TTG
gatggtctggaggagatatg

SEQ ID NO: 183526 - DNA, 20 bp, Artificial Sequence
  Description of Artificial Sequence: Synthetic oligonucleotide
  Target: ATXN1; (-) strand; PAM type: YTN; PAM sequence: TTG
ttggatggtctggaggagat

SEQ ID NO: 183527 - DNA, 20 bp, Artificial Sequence
  Description of Artificial Sequence: Synthetic oligonucleotide
  Target: ATXN1; (-) strand; PAM type: YTN; PAM sequence: CTT
gttggatggtctggaggaga

SEQ ID NO: 183528 - DNA, 20 bp, Artificial Sequence
  Description of Artificial Sequence: Synthetic oligonucleotide
  Target: ATXN1; (-) strand; PAM type: YTN; PAM sequence: CTA
cttgttggatggtctggagg

SEQ ID NO: 183529 - DNA, 20 bp, Artificial Sequence
  Description of Artificial Sequence: Synthetic oligonucleotide
  Target: ATXN1; (-) strand; PAM type: YTN; PAM sequence: TTG
actacttgttggatggtctg

SEQ ID NO: 183530 - DNA, 20 bp, Artificial Sequence
  Description of Artificial Sequence: Synthetic oligonucleotide
  Target: ATXN1; (-) strand; PAM type: YTN; PAM sequence: TTT
gactacttgttggatggtct

SEQ ID NO: 183531 - DNA, 20 bp, Artificial Sequence
  Description of Artificial Sequence: Synthetic oligonucleotide
  Target: ATXN1; (-) strand; PAM type: YTN; PAM sequence: CTT
tgactacttgttggatggtc

SEQ ID NO: 183532 - DNA, 20 bp, Artificial Sequence
  Description of Artificial Sequence: Synthetic oligonucleotide
  Target: ATXN1; (-) strand; PAM type: YTN; PAM sequence: CTC
acaggctttgactacttgtt

SEQ ID NO: 183533 - DNA, 20 bp, Artificial Sequence
  Description of Artificial Sequence: Synthetic oligonucleotide
  Target: ATXN1; (-) strand; PAM type: YTN; PAM sequence: TTG
gcacacctcacaggctttga

SEQ ID NO: 183534 - DNA, 20 bp, Artificial Sequence
  Description of Artificial Sequence: Synthetic oligonucleotide
  Target: ATXN1; (-) strand; PAM type: YTN; PAM sequence: TTT
ggcacacctcacaggctttg

SEQ ID NO: 183535 - DNA, 20 bp, Artificial Sequence
  Description of Artificial Sequence: Synthetic oligonucleotide
  Target: ATXN1; (-) strand; PAM type: YTN; PAM sequence: CTT
tggcacacctcacaggcttt

SEQ ID NO: 183536 - DNA, 20 bp, Artificial Sequence
  Description of Artificial Sequence: Synthetic oligonucleotide
  Target: ATXN1; (-) strand; PAM type: YTN; PAM sequence: TTC
ctttggcacacctcacaggc

SEQ ID NO: 183537 - DNA, 20 bp, Artificial Sequence
  Description of Artificial Sequence: Synthetic oligonucleotide
  Target: ATXN1; (-) strand; PAM type: YTN; PAM sequence: TTT
cctttggcacacctcacagg

SEQ ID NO: 183538 - DNA, 20 bp, Artificial Sequence
  Description of Artificial Sequence: Synthetic oligonucleotide
  Target: ATXN1; (-) strand; PAM type: YTN; PAM sequence: TTT
tcctttggcacacctcacag

SEQ ID NO: 183539 - DNA, 20 bp, Artificial Sequence
  Description of Artificial Sequence: Synthetic oligonucleotide
  Target: ATXN1; (-) strand; PAM type: YTN; PAM sequence: TTT
ttcctttggcacacctcaca

SEQ ID NO: 183540 - DNA, 20 bp, Artificial Sequence
  Description of Artificial Sequence: Synthetic oligonucleotide
  Target: ATXN1; (-) strand; PAM type: YTN; PAM sequence: TTA
cgatggaccaagagattttt

SEQ ID NO: 183541 - DNA, 20 bp, Artificial Sequence
  Description of Artificial Sequence: Synthetic oligonucleotide
  Target: ATXN1; (-) strand; PAM type: YTN; PAM sequence: CTT
acgatggaccaagagatttt

SEQ ID NO: 183542 - DNA, 20 bp, Artificial Sequence
  Description of Artificial Sequence: Synthetic oligonucleotide
  Target: ATXN1; (-) strand; PAM type: YTN; PAM sequence: TTC
cccaaaaggggccttacgat

SEQ ID NO: 183543 - DNA, 20 bp, Artificial Sequence
  Description of Artificial Sequence: Synthetic oligonucleotide
  Target: ATXN1; (-) strand; PAM type: YTN; PAM sequence: TTG
ttccccaaaaggggccttac

SEQ ID NO: 183544 - DNA, 20 bp, Artificial Sequence
  Description of Artificial Sequence: Synthetic oligonucleotide
  Target: ATXN1; (-) strand; PAM type: YTN; PAM sequence: TTT
gttccccaaaaggggcctta

SEQ ID NO: 183545 - DNA, 20 bp, Artificial Sequence
  Description of Artificial Sequence: Synthetic oligonucleotide
  Target: ATXN1; (-) strand; PAM type: YTN; PAM sequence: CTT
tgttccccaaaaggggcctt

SEQ ID NO: 183546 - DNA, 20 bp, Artificial Sequence
  Description of Artificial Sequence: Synthetic oligonucleotide
  Target: ATXN1; (-) strand; PAM type: YTN; PAM sequence: TTC
tttgttccccaaaaggggcc

SEQ ID NO: 183547 - DNA, 20 bp, Artificial Sequence
  Description of Artificial Sequence: Synthetic oligonucleotide
  Target: ATXN1; (-) strand; PAM type: YTN; PAM sequence: CTA
ttctttgttccccaaaaggg

SEQ ID NO: 183548 - DNA, 20 bp, Artificial Sequence
  Description of Artificial Sequence: Synthetic oligonucleotide
  Target: ATXN1; (-) strand; PAM type: YTN; PAM sequence: CTC
caggatagtgacctattctt

SEQ ID NO: 183549 - DNA, 20 bp, Artificial Sequence
  Description of Artificial Sequence: Synthetic oligonucleotide
  Target: ATXN1; (-) strand; PAM type: YTN; PAM sequence: CTC
tccaggatagtgacctattc

SEQ ID NO: 183550 - DNA, 20 bp, Artificial Sequence
  Description of Artificial Sequence: Synthetic oligonucleotide
  Target: ATXN1; (-) strand; PAM type: YTN; PAM sequence: CTG
ccagtcctctccaggatagt

SEQ ID NO: 183551 - DNA, 20 bp, Artificial Sequence
  Description of Artificial Sequence: Synthetic oligonucleotide
  Target: ATXN1; (-) strand; PAM type: YTN; PAM sequence: CTA
actgccagtcctctccagga

SEQ ID NO: 183552 - DNA, 20 bp, Artificial Sequence
  Description of Artificial Sequence: Synthetic oligonucleotide
  Target: ATXN1; (-) strand; PAM type: YTN; PAM sequence: TTA
ggcatatgggtgaagtctaa

SEQ ID NO: 183553 - DNA, 20 bp, Artificial Sequence
  Description of Artificial Sequence: Synthetic oligonucleotide
  Target: ATXN1; (-) strand; PAM type: YTN; PAM sequence: CTT
aggcatatgggtgaagtcta

SEQ ID NO: 183554 - DNA, 20 bp, Artificial Sequence
  Description of Artificial Sequence: Synthetic oligonucleotide
  Target: ATXN1; (-) strand; PAM type: YTN; PAM sequence: TTG
acttaggcatatgggtgaag

SEQ ID NO: 183555 - DNA, 20 bp, Artificial Sequence
  Description of Artificial Sequence: Synthetic oligonucleotide
  Target: ATXN1; (-) strand; PAM type: YTN; PAM sequence: CTT
gacttaggcatatgggtgaa

SEQ ID NO: 183556 - DNA, 20 bp, Artificial Sequence
  Description of Artificial Sequence: Synthetic oligonucleotide
  Target: ATXN1; (-) strand; PAM type: YTN; PAM sequence: TTG
aaatccccttgacttaggca

SEQ ID NO: 183557 - DNA, 20 bp, Artificial Sequence
  Description of Artificial Sequence: Synthetic oligonucleotide
  Target: ATXN1; (-) strand; PAM type: YTN; PAM sequence: TTG
gtcaacacagaccaacaagt

SEQ ID NO: 183558 - DNA, 20 bp, Artificial Sequence
  Description of Artificial Sequence: Synthetic oligonucleotide
  Target: ATXN1; (-) strand; PAM type: YTN; PAM sequence: TTG
gttggtcaacacagaccaac

SEQ ID NO: 183559 - DNA, 20 bp, Artificial Sequence
  Description of Artificial Sequence: Synthetic oligonucleotide
  Target: ATXN1; (-) strand; PAM type: YTN; PAM sequence: TTT
ggttggtcaacacagaccaa

SEQ ID NO: 183560 - DNA, 20 bp, Artificial Sequence
  Description of Artificial Sequence: Synthetic oligonucleotide
  Target: ATXN1; (-) strand; PAM type: YTN; PAM sequence: CTA
tccaatttggttggtcaaca

SEQ ID NO: 183561 - DNA, 20 bp, Artificial Sequence
  Description of Artificial Sequence: Synthetic oligonucleotide
  Target: ATXN1; (-) strand; PAM type: YTN; PAM sequence: TTC
tatccaatttggttggtcaa

SEQ ID NO: 183562 - DNA, 20 bp, Artificial Sequence
  Description of Artificial Sequence: Synthetic oligonucleotide
  Target: ATXN1; (-) strand; PAM type: YTN; PAM sequence: CTT
ctatccaatttggttggtca

SEQ ID NO: 183563 - DNA, 20 bp, Artificial Sequence
  Description of Artificial Sequence: Synthetic oligonucleotide
  Target: ATXN1; (-) strand; PAM type: YTN; PAM sequence: TTG
caggggaaggcttctatcca

SEQ ID NO: 183564 - DNA, 20 bp, Artificial Sequence
  Description of Artificial Sequence: Synthetic oligonucleotide
  Target: ATXN1; (-) strand; PAM type: YTN; PAM sequence: CTT
gcaggggaaggcttctatcc

SEQ ID NO: 183565 - DNA, 20 bp, Artificial Sequence
  Description of Artificial Sequence: Synthetic oligonucleotide
  Target: ATXN1; (-) strand; PAM type: YTN; PAM sequence: CTC
cgtcttgcaggggaaggctt

SEQ ID NO: 183566 - DNA, 20 bp, Artificial Sequence
  Description of Artificial Sequence: Synthetic oligonucleotide
  Target: ATXN1; (-) strand; PAM type: YTN; PAM sequence: TTC
tccgtcttgcaggggaaggc

SEQ ID NO: 183567 - DNA, 20 bp, Artificial Sequence
  Description of Artificial Sequence: Synthetic oligonucleotide
  Target: ATXN1; (-) strand; PAM type: YTN; PAM sequence: CTT
ctccgtcttgcaggggaagg

SEQ ID NO: 183568 - DNA, 20 bp, Artificial Sequence
  Description of Artificial Sequence: Synthetic oligonucleotide
  Target: ATXN1; (-) strand; PAM type: YTN; PAM sequence: CTG
agccttctccgtcttgcagg

SEQ ID NO: 183569 - DNA, 20 bp, Artificial Sequence
  Description of Artificial Sequence: Synthetic oligonucleotide
  Target: ATXN1; (-) strand; PAM type: YTN; PAM sequence: TTC
ctgagccttctccgtcttgc

SEQ ID NO: 183570 - DNA, 20 bp, Artificial Sequence
  Description of Artificial Sequence: Synthetic oligonucleotide
  Target: ATXN1; (-) strand; PAM type: YTN; PAM sequence: CTT
cctgagccttctccgtcttg

SEQ ID NO: 183571 - DNA, 20 bp, Artificial Sequence
  Description of Artificial Sequence: Synthetic oligonucleotide
  Target: ATXN1; (-) strand; PAM type: YTN; PAM sequence: TTA
accacttcctgagccttctc

SEQ ID NO: 183572 - DNA, 20 bp, Artificial Sequence
  Description of Artificial Sequence: Synthetic oligonucleotide
  Target: ATXN1; (-) strand; PAM type: YTN; PAM sequence: TTT
aaccacttcctgagccttct

SEQ ID NO: 183573 - DNA, 20 bp, Artificial Sequence
  Description of Artificial Sequence: Synthetic oligonucleotide
  Target: ATXN1; (-) strand; PAM type: YTN; PAM sequence: CTT
taaccacttcctgagccttc

SEQ ID NO: 183574 - DNA, 20 bp, Artificial Sequence
  Description of Artificial Sequence: Synthetic oligonucleotide
  Target: ATXN1; (-) strand; PAM type: YTN; PAM sequence: TTA
gtactttaaccacttcctga

SEQ ID NO: 183575 - DNA, 20 bp, Artificial Sequence
  Description of Artificial Sequence: Synthetic oligonucleotide
  Target: ATXN1; (-) strand; PAM type: YTN; PAM sequence: TTC
atgagttagtactttaacca

SEQ ID NO: 183576 - DNA, 20 bp, Artificial Sequence
  Description of Artificial Sequence: Synthetic oligonucleotide
  Target: ATXN1; (-) strand; PAM type: YTN; PAM sequence: TTT
catgagttagtactttaacc

SEQ ID NO: 183577 - DNA, 20 bp, Artificial Sequence
  Description of Artificial Sequence: Synthetic oligonucleotide
  Target: ATXN1; (-) strand; PAM type: YTN; PAM sequence: TTA
tttcatgagttagtacttta

SEQ ID NO: 183578 - DNA, 20 bp, Artificial Sequence
  Description of Artificial Sequence: Synthetic oligonucleotide
  Target: ATXN1; (-) strand; PAM type: YTN; PAM sequence: CTG
ggaattatttcatgagttag

SEQ ID NO: 183579 - DNA, 20 bp, Artificial Sequence
  Description of Artificial Sequence: Synthetic oligonucleotide
  Target: ATXN1; (-) strand; PAM type: YTN; PAM sequence: TTG
gggaagcccaaatctgggaa

SEQ ID NO: 183580 - DNA, 20 bp, Artificial Sequence
  Description of Artificial Sequence: Synthetic oligonucleotide
  Target: ATXN1; (-) strand; PAM type: YTN; PAM sequence: TTT
ggggaagcccaaatctggga

SEQ ID NO: 183581 - DNA, 20 bp, Artificial Sequence
  Description of Artificial Sequence: Synthetic oligonucleotide
  Target: ATXN1; (-) strand; PAM type: YTN; PAM sequence: CTT
tggggaagcccaaatctggg

SEQ ID NO: 183582 - DNA, 20 bp, Artificial Sequence
  Description of Artificial Sequence: Synthetic oligonucleotide
  Target: ATXN1; (-) strand; PAM type: YTN; PAM sequence: TTG
taagctttggggaagcccaa

SEQ ID NO: 183583 - DNA, 20 bp, Artificial Sequence
  Description of Artificial Sequence: Synthetic oligonucleotide
  Target: ATXN1; (-) strand; PAM type: YTN; PAM sequence: TTT
gtaagctttggggaagccca

SEQ ID NO: 183584 - DNA, 20 bp, Artificial Sequence
  Description of Artificial Sequence: Synthetic oligonucleotide
  Target: ATXN1; (-) strand; PAM type: YTN; PAM sequence: TTT
tgtaagctttggggaagccc

SEQ ID NO: 183585 - DNA, 20 bp, Artificial Sequence
  Description of Artificial Sequence: Synthetic oligonucleotide
  Target: ATXN1; (-) strand; PAM type: YTN; PAM sequence: TTG
tcgttttgtaagctttgggg

SEQ ID NO: 183586 - DNA, 20 bp, Artificial Sequence
  Description of Artificial Sequence: Synthetic oligonucleotide
  Target: ATXN1; (-) strand; PAM type: YTN; PAM sequence: TTA
agagccggaccattgtcgtt

SEQ ID NO: 183587 - DNA, 20 bp, Artificial Sequence
  Description of Artificial Sequence: Synthetic oligonucleotide
  Target: ATXN1; (-) strand; PAM type: YTN; PAM sequence: TTT
aagagccggaccattgtcgt

SEQ ID NO: 183588 - DNA, 20 bp, Artificial Sequence
  Description of Artificial Sequence: Synthetic oligonucleotide
  Target: ATXN1; (-) strand; PAM type: YTN; PAM sequence: CTT
taagagccggaccattgtcg

SEQ ID NO: 183589 - DNA, 20 bp, Artificial Sequence
  Description of Artificial Sequence: Synthetic oligonucleotide
  Target: ATXN1; (-) strand; PAM type: YTN; PAM sequence: TTA
ccgtggctttaagagccgga

SEQ ID NO: 183590 - DNA, 20 bp, Artificial Sequence
  Description of Artificial Sequence: Synthetic oligonucleotide
  Target: ATXN1; (-) strand; PAM type: YTN; PAM sequence: CTG
agttaccgtggctttaagag

SEQ ID NO: 183591 - DNA, 20 bp, Artificial Sequence
  Description of Artificial Sequence: Synthetic oligonucleotide
  Target: ATXN1; (-) strand; PAM type: YTN; PAM sequence: TTC
cctgagttaccgtggcttta

SEQ ID NO: 183592 - DNA, 20 bp, Artificial Sequence
  Description of Artificial Sequence: Synthetic oligonucleotide
  Target: ATXN1; (-) strand; PAM type: YTN; PAM sequence: CTG
gaaattccctgagttaccgt

SEQ ID NO: 183593 - DNA, 20 bp, Artificial Sequence
  Description of Artificial Sequence: Synthetic oligonucleotide
  Target: ATXN1; (-) strand; PAM type: YTN; PAM sequence: CTA
gtgccctggaaattccctga

SEQ ID NO: 183594 - DNA, 20 bp, Artificial Sequence
  Description of Artificial Sequence: Synthetic oligonucleotide
  Target: ATXN1; (-) strand; PAM type: YTN; PAM sequence: TTG
tatccctagtgccctggaaa

SEQ ID NO: 183595 - DNA, 20 bp, Artificial Sequence
  Description of Artificial Sequence: Synthetic oligonucleotide
  Target: ATXN1; (-) strand; PAM type: YTN; PAM sequence: CTC
caggcacagtgaaagtgata

SEQ ID NO: 183596 - DNA, 20 bp, Artificial Sequence
  Description of Artificial Sequence: Synthetic oligonucleotide
  Target: ATXN1; (-) strand; PAM type: YTN; PAM sequence: TTG
tggcctccaggcacagtgaa

SEQ ID NO: 183597 - DNA, 20 bp, Artificial Sequence
  Description of Artificial Sequence: Synthetic oligonucleotide
  Target: ATXN1; (-) strand; PAM type: YTN; PAM sequence: CTG
aggattgtggcctccaggca

SEQ ID NO: 183598 - DNA, 20 bp, Artificial Sequence
  Description of Artificial Sequence: Synthetic oligonucleotide
  Target: ATXN1; (-) strand; PAM type: YTN; PAM sequence: TTC
cctgaggattgtggcctcca

SEQ ID NO: 183599 - DNA, 20 bp, Artificial Sequence
  Description of Artificial Sequence: Synthetic oligonucleotide
  Target: ATXN1; (-) strand; PAM type: YTN; PAM sequence: CTT
ccctgaggattgtggcctcc

SEQ ID NO: 183600 - DNA, 20 bp, Artificial Sequence
  Description of Artificial Sequence: Synthetic oligonucleotide
  Target: ATXN1; (-) strand; PAM type: YTN; PAM sequence: CTC
agccttccctgaggattgtg

SEQ ID NO: 183601 - DNA, 20 bp, Artificial Sequence
  Description of Artificial Sequence: Synthetic oligonucleotide
  Target: ATXN1; (-) strand; PAM type: YTN; PAM sequence: TTC
tcagccttccctgaggattg

SEQ ID NO: 183602 - DNA, 20 bp, Artificial Sequence
  Description of Artificial Sequence: Synthetic oligonucleotide
  Target: ATXN1; (-) strand; PAM type: YTN; PAM sequence: CTT
ctcagccttccctgaggatt

SEQ ID NO: 183603 - DNA, 20 bp, Artificial Sequence
  Description of Artificial Sequence: Synthetic oligonucleotide
  Target: ATXN1; (-) strand; PAM type: YTN; PAM sequence: TTG
ccttctcagccttccctgag

SEQ ID NO: 183604 - DNA, 20 bp, Artificial Sequence
  Description of Artificial Sequence: Synthetic oligonucleotide
  Target: ATXN1; (-) strand; PAM type: YTN; PAM sequence: TTT
gccttctcagccttccctga

SEQ ID NO: 183605 - DNA, 20 bp, Artificial Sequence
  Description of Artificial Sequence: Synthetic oligonucleotide
  Target: ATXN1; (-) strand; PAM type: YTN; PAM sequence: TTC
gtttgccttctcagccttcc

SEQ ID NO: 183606 - DNA, 20 bp, Artificial Sequence
  Description of Artificial Sequence: Synthetic oligonucleotide
  Target: ATXN1; (-) strand; PAM type: YTN; PAM sequence: TTT
cgtttgccttctcagccttc

SEQ ID NO: 183607 - DNA, 20 bp, Artificial Sequence
  Description of Artificial Sequence: Synthetic oligonucleotide
  Target: ATXN1; (-) strand; PAM type: YTN; PAM sequence: TTG
agtgtttcgtttgccttctc

SEQ ID NO: 183608 - DNA, 20 bp, Artificial Sequence
  Description of Artificial Sequence: Synthetic oligonucleotide
  Target: ATXN1; (-) strand; PAM type: YTN; PAM sequence: CTT
gagtgtttcgtttgccttct

SEQ ID NO: 183609 - DNA, 20 bp, Artificial Sequence
  Description of Artificial Sequence: Synthetic oligonucleotide
  Target: ATXN1; (-) strand; PAM type: YTN; PAM sequence: CTC
ttgagtgtttcgtttgcctt

SEQ ID NO: 183610 - DNA, 20 bp, Artificial Sequence
  Description of Artificial Sequence: Synthetic oligonucleotide
  Target: ATXN1; (-) strand; PAM type: YTN; PAM sequence: TTA
agtgcctcttgagtgtttcg

SEQ ID NO: 183611 - DNA, 20 bp, Artificial Sequence
  Description of Artificial Sequence: Synthetic oligonucleotide
  Target: ATXN1; (-) strand; PAM type: YTN; PAM sequence: CTT
aagtgcctcttgagtgtttc

SEQ ID NO: 183612 - DNA, 20 bp, Artificial Sequence
  Description of Artificial Sequence: Synthetic oligonucleotide
  Target: ATXN1; (-) strand; PAM type: YTN; PAM sequence: TTC
cttaagtgcctcttgagtgt

SEQ ID NO: 183613 - DNA, 20 bp, Artificial Sequence
  Description of Artificial Sequence: Synthetic oligonucleotide
  Target: ATXN1; (-) strand; PAM type: YTN; PAM sequence: TTT
ccttaagtgcctcttgagtg

SEQ ID NO: 183614 - DNA, 20 bp, Artificial Sequence
  Description of Artificial Sequence: Synthetic oligonucleotide
  Target: ATXN1; (-) strand; PAM type: YTN; PAM sequence: TTC
gtttccttaagtgcctcttg

SEQ ID NO: 183615 - DNA, 20 bp, Artificial Sequence
  Description of Artificial Sequence: Synthetic oligonucleotide
  Target: ATXN1; (-) strand; PAM type: YTN; PAM sequence: TTG
tgttcgtttccttaagtgcc

SEQ ID NO: 183616 - DNA, 20 bp, Artificial Sequence
  Description of Artificial Sequence: Synthetic oligonucleotide
  Target: ATXN1; (-) strand; PAM type: YTN; PAM sequence: CTT
gtgttcgtttccttaagtgc

SEQ ID NO: 183617 - DNA, 20 bp, Artificial Sequence
  Description of Artificial Sequence: Synthetic oligonucleotide
  Target: ATXN1; (-) strand; PAM type: YTN; PAM sequence: TTC
ttgtgttcgtttccttaagt

SEQ ID NO: 183618 - DNA, 20 bp, Artificial Sequence
  Description of Artificial Sequence: Synthetic oligonucleotide
  Target: ATXN1; (-) strand; PAM type: YTN; PAM sequence: TTT
cttgtgttcgtttccttaag

SEQ ID NO: 183619 - DNA, 20 bp, Artificial Sequence
  Description of Artificial Sequence: Synthetic oligonucleotide
  Target: ATXN1; (-) strand; PAM type: YTN; PAM sequence: CTC
aacaaggccatgggcaagag

SEQ ID NO: 183620 - DNA, 20 bp, Artificial Sequence
  Description of Artificial Sequence: Synthetic oligonucleotide
  Target: ATXN1; (-) strand; PAM type: YTN; PAM sequence: TTC
tcaacaaggccatgggcaag

SEQ ID NO: 183621 - DNA, 20 bp, Artificial Sequence
  Description of Artificial Sequence: Synthetic oligonucleotide
  Target: ATXN1; (-) strand; PAM type: YTN; PAM sequence: TTG
gattctcaacaaggccatgg

SEQ ID NO: 183622 - DNA, 20 bp, Artificial Sequence
  Description of Artificial Sequence: Synthetic oligonucleotide
  Target: ATXN1; (-) strand; PAM type: YTN; PAM sequence: TTT
ggattctcaacaaggccatg

SEQ ID NO: 183623 - DNA, 20 bp, Artificial Sequence
  Description of Artificial Sequence: Synthetic oligonucleotide
  Target: ATXN1; (-) strand; PAM type: YTN; PAM sequence: TTT
tggattctcaacaaggccat

SEQ ID NO: 183624 - DNA, 20 bp, Artificial Sequence
  Description of Artificial Sequence: Synthetic oligonucleotide
  Target: ATXN1; (-) strand; PAM type: YTN; PAM sequence: TTG
tgaggagaattttggattct

SEQ ID NO: 183625 - DNA, 20 bp, Artificial Sequence
  Description of Artificial Sequence: Synthetic oligonucleotide
  Target: ATXN1; (-) strand; PAM type: YTN; PAM sequence: TTT
gtgaggagaattttggattc

SEQ ID NO: 183626 - DNA, 20 bp, Artificial Sequence
  Description of Artificial Sequence: Synthetic oligonucleotide
  Target: ATXN1; (-) strand; PAM type: YTN; PAM sequence: TTT
tgtgaggagaattttggatt

SEQ ID NO: 183627 - DNA, 20 bp, Artificial Sequence
  Description of Artificial Sequence: Synthetic oligonucleotide
  Target: ATXN1; (-) strand; PAM type: YTN; PAM sequence: CTG
agccccattttgtgaggaga

SEQ ID NO: 183628 - DNA, 20 bp, Artificial Sequence
  Description of Artificial Sequence: Synthetic oligonucleotide
  Target: ATXN1; (-) strand; PAM type: YTN; PAM sequence: TTC
atatggactgagccccattt

SEQ ID NO: 183629 - DNA, 20 bp, Artificial Sequence
  Description of Artificial Sequence: Synthetic oligonucleotide
  Target: ATXN1; (-) strand; PAM type: YTN; PAM sequence: CTT
catatggactgagccccatt

SEQ ID NO: 183630 - DNA, 20 bp, Artificial Sequence
  Description of Artificial Sequence: Synthetic oligonucleotide
  Target: ATXN1; (-) strand; PAM type: YTN; PAM sequence: TTG
tgagaaaaggtcatccatac

SEQ ID NO: 183631 - DNA, 20 bp, Artificial Sequence
  Description of Artificial Sequence: Synthetic oligonucleotide
  Target: ATXN1; (-) strand; PAM type: YTN; PAM sequence: TTT
gtgagaaaaggtcatccata

SEQ ID NO: 183632 - DNA, 20 bp, Artificial Sequence
  Description of Artificial Sequence: Synthetic oligonucleotide
  Target: ATXN1; (-) strand; PAM type: YTN; PAM sequence: CTG
atcaagtaggaggtcatttg

SEQ ID NO: 183633 - DNA, 20 bp, Artificial Sequence
  Description of Artificial Sequence: Synthetic oligonucleotide
  Target: ATXN1; (-) strand; PAM type: YTN; PAM sequence: TTC
ctgatcaagtaggaggtcat

SEQ ID NO: 183634 - DNA, 20 bp, Artificial Sequence
  Description of Artificial Sequence: Synthetic oligonucleotide
  Target: ATXN1; (-) strand; PAM type: YTN; PAM sequence: TTT
cctgatcaagtaggaggtca

SEQ ID NO: 183635 - DNA, 20 bp, Artificial Sequence
  Description of Artificial Sequence: Synthetic oligonucleotide
  Target: ATXN1; (-) strand; PAM type: YTN; PAM sequence: TTG
gccgtttcctgatcaagtag

SEQ ID NO: 183636 - DNA, 20 bp, Artificial Sequence
  Description of Artificial Sequence: Synthetic oligonucleotide
  Target: ATXN1; (-) strand; PAM type: YTN; PAM sequence: CTT
ggccgtttcctgatcaagta

SEQ ID NO: 183637 - DNA, 20 bp, Artificial Sequence
  Description of Artificial Sequence: Synthetic oligonucleotide
  Target: ATXN1; (-) strand; PAM type: YTN; PAM sequence: TTG
accaacttggccgtttcctg

SEQ ID NO: 183638 - DNA, 20 bp, Artificial Sequence
  Description of Artificial Sequence: Synthetic oligonucleotide
  Target: ATXN1; (-) strand; PAM type: YTN; PAM sequence: TTT
gaccaacttggccgtttcct

SEQ ID NO: 183639 - DNA, 20 bp, Artificial Sequence
  Description of Artificial Sequence: Synthetic oligonucleotide
  Target: ATXN1; (-) strand; PAM type: YTN; PAM sequence: CTT
tgaccaacttggccgtttcc

SEQ ID NO: 183640 - DNA, 20 bp, Artificial Sequence
  Description of Artificial Sequence: Synthetic oligonucleotide
  Target: ATXN1; (-) strand; PAM type: YTN; PAM sequence: TTA
tatctttgaccaacttggcc

SEQ ID NO: 183641 - DNA, 20 bp, Artificial Sequence
  Description of Artificial Sequence: Synthetic oligonucleotide
  Target: ATXN1; (-) strand; PAM type: YTN; PAM sequence: TTG
ccaaagaagttatatctttg

SEQ ID NO: 183642 - DNA, 20 bp, Artificial Sequence
  Description of Artificial Sequence: Synthetic oligonucleotide
  Target: ATXN1; (-) strand; PAM type: YTN; PAM sequence: TTT
gccaaagaagttatatcttt

SEQ ID NO: 183643 - DNA, 20 bp, Artificial Sequence
  Description of Artificial Sequence: Synthetic oligonucleotide
  Target: ATXN1; (-) strand; PAM type: YTN; PAM sequence: TTT
tgccaaagaagttatatctt

SEQ ID NO: 183644 - DNA, 20 bp, Artificial Sequence
  Description of Artificial Sequence: Synthetic oligonucleotide
  Target: ATXN1; (-) strand; PAM type: YTN; PAM sequence: TTG
gtattttgccaaagaagtta

SEQ ID NO: 183645 - DNA, 20 bp, Artificial Sequence
  Description of Artificial Sequence: Synthetic oligonucleotide
  Target: ATXN1; (-) strand; PAM type: YTN; PAM sequence: TTG
ttggtattttgccaaagaag

SEQ ID NO: 183646 - DNA, 20 bp, Artificial Sequence
  Description of Artificial Sequence: Synthetic oligonucleotide
  Target: ATXN1; (-) strand; PAM type: YTN; PAM sequence: TTT
gttggtattttgccaaagaa

SEQ ID NO: 183647 - DNA, 20 bp, Artificial Sequence
  Description of Artificial Sequence: Synthetic oligonucleotide
  Target: ATXN1; (-) strand; PAM type: YTN; PAM sequence: TTT
tgttggtattttgccaaaga

SEQ ID NO: 183648 - DNA, 20 bp, Artificial Sequence
  Description of Artificial Sequence: Synthetic oligonucleotide
  Target: ATXN1; (-) strand; PAM type: YTN; PAM sequence: TTA
acgttttgttggtattttgc

SEQ ID NO: 183649 - DNA, 20 bp, Artificial Sequence
  Description of Artificial Sequence: Synthetic oligonucleotide
  Target: ATXN1; (-) strand; PAM type: YTN; PAM sequence: TTT
aacgttttgttggtattttg

SEQ ID NO: 183650 - DNA, 20 bp, Artificial Sequence
  Description of Artificial Sequence: Synthetic oligonucleotide
  Target: ATXN1; (-) strand; PAM type: YTN; PAM sequence: TTT
taacgttttgttggtatttt

SEQ ID NO: 183651 - DNA, 20 bp, Artificial Sequence
  Description of Artificial Sequence: Synthetic oligonucleotide
  Target: ATXN1; (-) strand; PAM type: YTN; PAM sequence: TTT
ttaacgttttgttggtattt

SEQ ID NO: 183652 - DNA, 20 bp, Artificial Sequence
  Description of Artificial Sequence: Synthetic oligonucleotide
  Target: ATXN1; (-) strand; PAM type: YTN; PAM sequence: TTG
ggtaggtttttaacgttttg

SEQ ID NO: 183653 - DNA, 20 bp, Artificial Sequence
  Description of Artificial Sequence: Synthetic oligonucleotide
  Target: ATXN1; (-) strand; PAM type: YTN; PAM sequence: TTT
gggtaggtttttaacgtttt

SEQ ID NO: 183654 - DNA, 20 bp, Artificial Sequence
  Description of Artificial Sequence: Synthetic oligonucleotide
  Target: ATXN1; (-) strand; PAM type: YTN; PAM sequence: CTT
tgggtaggtttttaacgttt

SEQ ID NO: 183655 - DNA, 20 bp, Artificial Sequence
  Description of Artificial Sequence: Synthetic oligonucleotide
  Target: ATXN1; (-) strand; PAM type: YTN; PAM sequence: CTG
tgacatcctttgggtaggtt

SEQ ID NO: 183656 - DNA, 20 bp, Artificial Sequence
  Description of Artificial Sequence: Synthetic oligonucleotide
  Target: ATXN1; (-) strand; PAM type: YTN; PAM sequence: CTC
tgtgacatcctttgggtagg

SEQ ID NO: 183657 - DNA, 20 bp, Artificial Sequence
  Description of Artificial Sequence: Synthetic oligonucleotide
  Target: ATXN1; (-) strand; PAM type: YTN; PAM sequence: TTG
tctctgtgacatcctttggg

SEQ ID NO: 183658 - DNA, 20 bp, Artificial Sequence
  Description of Artificial Sequence: Synthetic oligonucleotide
  Target: ATXN1; (-) strand; PAM type: YTN; PAM sequence: CTT
gtctctgtgacatcctttgg

SEQ ID NO: 183659 - DNA, 20 bp, Artificial Sequence
  Description of Artificial Sequence: Synthetic oligonucleotide
  Target: ATXN1; (-) strand; PAM type: YTN; PAM sequence: TTC
ccttgtctctgtgacatcct

SEQ ID NO: 183660 - DNA, 20 bp, Artificial Sequence
  Description of Artificial Sequence: Synthetic oligonucleotide
  Target: ATXN1; (-) strand; PAM type: YTN; PAM sequence: CTG
ttcccttgtctctgtgacat

SEQ ID NO: 183661 - DNA, 20 bp, Artificial Sequence
  Description of Artificial Sequence: Synthetic oligonucleotide
  Target: ATXN1; (-) strand; PAM type: YTN; PAM sequence: CTC
tgttcccttgtctctgtgac

SEQ ID NO: 183662 - DNA, 20 bp, Artificial Sequence
  Description of Artificial Sequence: Synthetic oligonucleotide
  Target: ATXN1; (-) strand; PAM type: YTN; PAM sequence: TTG
gaacaactctgttcccttgt

SEQ ID NO: 183663 - DNA, 20 bp, Artificial Sequence
  Description of Artificial Sequence: Synthetic oligonucleotide
  Target: ATXN1; (-) strand; PAM type: YTN; PAM sequence: CTG
gttggaacaactctgttccc

SEQ ID NO: 183664 - DNA, 20 bp, Artificial Sequence
  Description of Artificial Sequence: Synthetic oligonucleotide
  Target: ATXN1; (-) strand; PAM type: YTN; PAM sequence: CTC
ctggttggaacaactctgtt

SEQ ID NO: 183665 - DNA, 20 bp, Artificial Sequence
  Description of Artificial Sequence: Synthetic oligonucleotide
  Target: ATXN1; (-) strand; PAM type: YTN; PAM sequence: TTG
accaacagtaaatctcctgg

SEQ ID NO: 183666 - DNA, 20 bp, Artificial Sequence
  Description of Artificial Sequence: Synthetic oligonucleotide
  Target: ATXN1; (-) strand; PAM type: YTN; PAM sequence: CTT
gaccaacagtaaatctcctg

SEQ ID NO: 183667 - DNA, 20 bp, Artificial Sequence
  Description of Artificial Sequence: Synthetic oligonucleotide
  Target: ATXN1; (-) strand; PAM type: YTN; PAM sequence: TTC
ccacaaggaatccatagatg

SEQ ID NO: 183668 - DNA, 20 bp, Artificial Sequence
  Description of Artificial Sequence: Synthetic oligonucleotide
  Target: ATXN1; (-) strand; PAM type: YTN; PAM sequence: CTT
cccacaaggaatccatagat

SEQ ID NO: 183669 - DNA, 20 bp, Artificial Sequence
  Description of Artificial Sequence: Synthetic oligonucleotide
  Target: ATXN1; (-) strand; PAM type: YTN; PAM sequence: CTG
agtatggtccttcccacaag

SEQ ID NO: 183670 - DNA, 20 bp, Artificial Sequence
  Description of Artificial Sequence: Synthetic oligonucleotide
  Target: ATXN1; (-) strand; PAM type: YTN; PAM sequence: TTA
ctgagtatggtccttcccac

SEQ ID NO: 183671 - DNA, 20 bp, Artificial Sequence
  Description of Artificial Sequence: Synthetic oligonucleotide
  Target: ATXN1; (-) strand; PAM type: YTN; PAM sequence: CTG
cagtgggggtagagaggatt

SEQ ID NO: 183672 - DNA, 20 bp, Artificial Sequence
  Description of Artificial Sequence: Synthetic oligonucleotide
  Target: ATXN1; (-) strand; PAM type: YTN; PAM sequence: TTA
actgcagtgggggtagagag

SEQ ID NO: 183673 - DNA, 20 bp, Artificial Sequence
  Description of Artificial Sequence: Synthetic oligonucleotide
  Target: ATXN1; (-) strand; PAM type: YTN; PAM sequence: CTT
aactgcagtgggggtagaga

SEQ ID NO: 183674 - DNA, 20 bp, Artificial Sequence
  Description of Artificial Sequence: Synthetic oligonucleotide
  Target: ATXN1; (-) strand; PAM type: YTN; PAM sequence: CTG
ccaccttaactgcagtgggg

SEQ ID NO: 183675 - DNA, 20 bp, Artificial Sequence
  Description of Artificial Sequence: Synthetic oligonucleotide
  Target: ATXN1; (-) strand; PAM type: YTN; PAM sequence: CTC
ctgccaccttaactgcagtg

SEQ ID NO: 183676 - DNA, 20 bp, Artificial Sequence
  Description of Artificial Sequence: Synthetic oligonucleotide
  Target: ATXN1; (-) strand; PAM type: YTN; PAM sequence: TTC
cactcctgccaccttaactg

SEQ ID NO: 183677 - DNA, 20 bp, Artificial Sequence
  Description of Artificial Sequence: Synthetic oligonucleotide
  Target: ATXN1; (-) strand; PAM type: YTN; PAM sequence: CTC
gcatgtagtgaatccaagat

SEQ ID NO: 183678 - DNA, 20 bp, Artificial Sequence
  Description of Artificial Sequence: Synthetic oligonucleotide
  Target: ATXN1; (-) strand; PAM type: YTN; PAM sequence: TTA
actcgcatgtagtgaatcca

SEQ ID NO: 183679 - DNA, 20 bp, Artificial Sequence
  Description of Artificial Sequence: Synthetic oligonucleotide
  Target: ATXN1; (-) strand; PAM type: YTN; PAM sequence: TTT
aactcgcatgtagtgaatcc

SEQ ID NO: 183680 - DNA, 20 bp, Artificial Sequence
  Description of Artificial Sequence: Synthetic oligonucleotide
  Target: ATXN1; (-) strand; PAM type: YTN; PAM sequence: TTC
agggggtgtccaaagtttaa

SEQ ID NO: 183681 - DNA, 20 bp, Artificial Sequence
  Description of Artificial Sequence: Synthetic oligonucleotide
  Target: ATXN1; (-) strand; PAM type: YTN; PAM sequence: CTT
cagggggtgtccaaagttta

SEQ ID NO: 183682 - DNA, 20 bp, Artificial Sequence
  Description of Artificial Sequence: Synthetic oligonucleotide
  Target: ATXN1; (-) strand; PAM type: YTN; PAM sequence: TTC
ttcagggggtgtccaaagtt

SEQ ID NO: 183683 - DNA, 20 bp, Artificial Sequence
  Description of Artificial Sequence: Synthetic oligonucleotide
  Target: ATXN1; (-) strand; PAM type: YTN; PAM sequence: CTA
caggttcttcagggggtgtc

SEQ ID NO: 183684 - DNA, 20 bp, Artificial Sequence
  Description of Artificial Sequence: Synthetic oligonucleotide
  Target: ATXN1; (-) strand; PAM type: YTN; PAM sequence: CTG
atggtcctacaggttcttca

SEQ ID NO: 183685 - DNA, 20 bp, Artificial Sequence
  Description of Artificial Sequence: Synthetic oligonucleotide
  Target: ATXN1; (-) strand; PAM type: YTN; PAM sequence: CTG
agctgatggtcctacaggtt

SEQ ID NO: 183686 - DNA, 20 bp, Artificial Sequence
  Description of Artificial Sequence: Synthetic oligonucleotide
  Target: ATXN1; (-) strand; PAM type: YTN; PAM sequence: CTC
ctgagctgatggtcctacag

SEQ ID NO: 183687 - DNA, 20 bp, Artificial Sequence
  Description of Artificial Sequence: Synthetic oligonucleotide
  Target: ATXN1; (-) strand; PAM type: YTN; PAM sequence: TTG
ggactcctgagctgatggtc

SEQ ID NO: 183688 - DNA, 20 bp, Artificial Sequence
  Description of Artificial Sequence: Synthetic oligonucleotide
  Target: ATXN1; (-) strand; PAM type: YTN; PAM sequence: CTT
gggactcctgagctgatggt

SEQ ID NO: 183689 - DNA, 20 bp, Artificial Sequence
  Description of Artificial Sequence: Synthetic oligonucleotide
  Target: ATXN1; (-) strand; PAM type: YTN; PAM sequence: CTG
atcttgggactcctgagctg

SEQ ID NO: 183690 - DNA, 20 bp, Artificial Sequence
  Description of Artificial Sequence: Synthetic oligonucleotide
  Target: ATXN1; (-) strand; PAM type: YTN; PAM sequence: CTG
gctgatcttgggactcctga

SEQ ID NO: 183691 - DNA, 20 bp, Artificial Sequence
  Description of Artificial Sequence: Synthetic oligonucleotide
  Target: ATXN1; (-) strand; PAM type: YTN; PAM sequence: CTG
gtctggctgatcttgggact

SEQ ID NO: 183692 - DNA, 20 bp, Artificial Sequence
  Description of Artificial Sequence: Synthetic oligonucleotide
  Target: ATXN1; (-) strand; PAM type: YTN; PAM sequence: TTA
tcgaggctggtctggctgat

SEQ ID NO: 183693 - DNA, 20 bp, Artificial Sequence
  Description of Artificial Sequence: Synthetic oligonucleotide
  Target: ATXN1; (-) strand; PAM type: YTN; PAM sequence: TTT
atcgaggctggtctggctga

SEQ ID NO: 183694 - DNA, 20 bp, Artificial Sequence
  Description of Artificial Sequence: Synthetic oligonucleotide
  Target: ATXN1; (-) strand; PAM type: YTN; PAM sequence: TTC
acaggtttatcgaggctggt

SEQ ID NO: 183695 - DNA, 20 bp, Artificial Sequence
  Description of Artificial Sequence: Synthetic oligonucleotide
  Target: ATXN1; (-) strand; PAM type: YTN; PAM sequence: TTC
caatggttcacaggtttatc

SEQ ID NO: 183696 - DNA, 20 bp, Artificial Sequence
  Description of Artificial Sequence: Synthetic oligonucleotide
  Target: ATXN1; (-) strand; PAM type: YTN; PAM sequence: CTT
ccaatggttcacaggtttat

SEQ ID NO: 183697 - DNA, 20 bp, Artificial Sequence
  Description of Artificial Sequence: Synthetic oligonucleotide
  Target: ATXN1; (-) strand; PAM type: YTN; PAM sequence: CTG
aaataggagacacaaatctt

SEQ ID NO: 183698 - DNA, 20 bp, Artificial Sequence
  Description of Artificial Sequence: Synthetic oligonucleotide
  Target: ATXN1; (-) strand; PAM type: YTN; PAM sequence: TTC
tgaaataggagacacaaatc

SEQ ID NO: 183699 - DNA, 20 bp, Artificial Sequence
  Description of Artificial Sequence: Synthetic oligonucleotide
  Target: ATXN1; (-) strand; PAM type: YTN; PAM sequence: CTT
ctgaaataggagacacaaat

SEQ ID NO: 183700 - DNA, 20 bp, Artificial Sequence
  Description of Artificial Sequence: Synthetic oligonucleotide
  Target: ATXN1; (-) strand; PAM type: YTN; PAM sequence: TTC
cttctgaaataggagacaca

SEQ ID NO: 183701 - DNA, 20 bp, Artificial Sequence
  Description of Artificial Sequence: Synthetic oligonucleotide
  Target: ATXN1; (-) strand; PAM type: YTN; PAM sequence: TTT
ccttctgaaataggagacac

SEQ ID NO: 183702 - DNA, 20 bp, Artificial Sequence
  Description of Artificial Sequence: Synthetic oligonucleotide
  Target: ATXN1; (-) strand; PAM type: YTN; PAM sequence: CTG
ggatgtttccttctgaaata

SEQ ID NO: 183703 - DNA, 20 bp, Artificial Sequence
  Description of Artificial Sequence: Synthetic oligonucleotide
  Target: ATXN1; (-) strand; PAM type: YTN; PAM sequence: TTA
gtctgggatgtttccttctg

SEQ ID NO: 183704 - DNA, 20 bp, Artificial Sequence
  Description of Artificial Sequence: Synthetic oligonucleotide
  Target: ATXN1; (-) strand; PAM type: YTN; PAM sequence: TTT
agtctgggatgtttccttct

SEQ ID NO: 183705 - DNA, 20 bp, Artificial Sequence
  Description of Artificial Sequence: Synthetic oligonucleotide
  Target: ATXN1; (-) strand; PAM type: YTN; PAM sequence: TTT
tagtctgggatgtttccttc

SEQ ID NO: 183706 - DNA, 20 bp, Artificial Sequence
  Description of Artificial Sequence: Synthetic oligonucleotide
  Target: ATXN1; (-) strand; PAM type: YTN; PAM sequence: TTT
ttagtctgggatgtttcctt

SEQ ID NO: 183707 - DNA, 20 bp, Artificial Sequence
  Description of Artificial Sequence: Synthetic oligonucleotide
  Target: ATXN1; (-) strand; PAM type: YTN; PAM sequence: CTT
tttagtctgggatgtttcct

SEQ ID NO: 183708 - DNA, 20 bp, Artificial Sequence
  Description of Artificial Sequence: Synthetic oligonucleotide
  Target: ATXN1; (-) strand; PAM type: YTN; PAM sequence: CTA
taggggcctttttagtctgg

SEQ ID NO: 183709 - DNA, 20 bp, Artificial Sequence
  Description of Artificial Sequence: Synthetic oligonucleotide
  Target: ATXN1; (-) strand; PAM type: YTN; PAM sequence: TTA
ggatcagctataggggcctt

SEQ ID NO: 183710 - DNA, 20 bp, Artificial Sequence
  Description of Artificial Sequence: Synthetic oligonucleotide
  Target: ATXN1; (-) strand; PAM type: YTN; PAM sequence: CTT
aggatcagctataggggcct

SEQ ID NO: 183711 - DNA, 20 bp, Artificial Sequence
  Description of Artificial Sequence: Synthetic oligonucleotide
  Target: ATXN1; (-) strand; PAM type: YTN; PAM sequence: TTC
cttaggatcagctatagggg

SEQ ID NO: 183712 - DNA, 20 bp, Artificial Sequence
  Description of Artificial Sequence: Synthetic oligonucleotide
  Target: ATXN1; (-) strand; PAM type: YTN; PAM sequence: TTT
ccttaggatcagctataggg

SEQ ID NO: 183713 - DNA, 20 bp, Artificial Sequence
  Description of Artificial Sequence: Synthetic oligonucleotide
  Target: ATXN1; (-) strand; PAM type: YTN; PAM sequence: TTT
tccttaggatcagctatagg

SEQ ID NO: 183714 - DNA, 20 bp, Artificial Sequence
  Description of Artificial Sequence: Synthetic oligonucleotide
  Target: ATXN1; (-) strand; PAM type: YTN; PAM sequence: TTT
ttccttaggatcagctatag

SEQ ID NO: 183715 - DNA, 20 bp, Artificial Sequence
  Description of Artificial Sequence: Synthetic oligonucleotide
  Target: ATXN1; (-) strand; PAM type: YTN; PAM sequence: TTA
aataggaaagagtttttcct

SEQ ID NO: 183716 - DNA, 20 bp, Artificial Sequence
  Description of Artificial Sequence: Synthetic oligonucleotide
  Target: ATXN1; (-) strand; PAM type: YTN; PAM sequence: TTT
aaataggaaagagtttttcc

SEQ ID NO: 183717 - DNA, 20 bp, Artificial Sequence
  Description of Artificial Sequence: Synthetic oligonucleotide
  Target: ATXN1; (-) strand; PAM type: YTN; PAM sequence: TTT
taaataggaaagagtttttc

SEQ ID NO: 183718 - DNA, 20 bp, Artificial Sequence
  Description of Artificial Sequence: Synthetic oligonucleotide
  Target: ATXN1; (-) strand; PAM type: YTN; PAM sequence: TTT
ttaaataggaaagagttttt

SEQ ID NO: 183719 - DNA, 20 bp, Artificial Sequence
  Description of Artificial Sequence: Synthetic oligonucleotide
  Target: ATXN1; (-) strand; PAM type: YTN; PAM sequence: CTT
tttaaataggaaagagtttt

SEQ ID NO: 183720 - DNA, 20 bp, Artificial Sequence
  Description of Artificial Sequence: Synthetic oligonucleotide
  Target: ATXN1; (-) strand; PAM type: YTN; PAM sequence: TTA
tcctttttaaataggaaaga

SEQ ID NO: 183721 - DNA, 20 bp, Artificial Sequence
  Description of Artificial Sequence: Synthetic oligonucleotide
  Target: ATXN1; (-) strand; PAM type: YTN; PAM sequence: CTT
atcctttttaaataggaaag

SEQ ID NO: 183722 - DNA, 20 bp, Artificial Sequence
  Description of Artificial Sequence: Synthetic oligonucleotide
  Target: ATXN1; (-) strand; PAM type: YTN; PAM sequence: TTC
acttatcctttttaaatagg

SEQ ID NO: 183723 - DNA, 20 bp, Artificial Sequence
  Description of Artificial Sequence: Synthetic oligonucleotide
  Target: ATXN1; (-) strand; PAM type: YTN; PAM sequence: TTT
cacttatcctttttaaatag

SEQ ID NO: 183724 - DNA, 20 bp, Artificial Sequence
  Description of Artificial Sequence: Synthetic oligonucleotide
  Target: ATXN1; (-) strand; PAM type: YTN; PAM sequence: TTT
tcacttatcctttttaaata

SEQ ID NO: 183725 - DNA, 20 bp, Artificial Sequence
  Description of Artificial Sequence: Synthetic oligonucleotide
  Target: ATXN1; (-) strand; PAM type: YTN; PAM sequence: TTA
tgtaggttttcacttatcct

SEQ ID NO: 183726 - DNA, 20 bp, Artificial Sequence
  Description of Artificial Sequence: Synthetic oligonucleotide
  Target: ATXN1; (-) strand; PAM type: YTN; PAM sequence: TTA
aagattatgtaggttttcac

SEQ ID NO: 183727 - DNA, 20 bp, Artificial Sequence
  Description of Artificial Sequence: Synthetic oligonucleotide
  Target: ATXN1; (-) strand; PAM type: YTN; PAM sequence: TTA
aaggggcaaggagtggtgtt

SEQ ID NO: 183728 - DNA, 20 bp, Artificial Sequence
  Description of Artificial Sequence: Synthetic oligonucleotide
  Target: ATXN1; (-) strand; PAM type: YTN; PAM sequence: TTC
cattaaaggggcaaggagtg

SEQ ID NO: 183729 - DNA, 20 bp, Artificial Sequence
  Description of Artificial Sequence: Synthetic oligonucleotide
  Target: ATXN1; (-) strand; PAM type: YTN; PAM sequence: CTG
taaaaggattccattaaagg

SEQ ID NO: 183730 - DNA, 20 bp, Artificial Sequence
  Description of Artificial Sequence: Synthetic oligonucleotide
  Target: ATXN1; (-) strand; PAM type: YTN; PAM sequence: TTA
ataatgtgatgaaactgtaa

SEQ ID NO: 183731 - DNA, 20 bp, Artificial Sequence
  Description of Artificial Sequence: Synthetic oligonucleotide
  Target: ATXN1; (-) strand; PAM type: YTN; PAM sequence: CTT
aataatgtgatgaaactgta

SEQ ID NO: 183732 - DNA, 20 bp, Artificial Sequence
  Description of Artificial Sequence: Synthetic oligonucleotide
  Target: ATXN1; (-) strand; PAM type: YTN; PAM sequence: CTG
cttaataatgtgatgaaact

SEQ ID NO: 183733 - DNA, 20 bp, Artificial Sequence
  Description of Artificial Sequence: Synthetic oligonucleotide
  Target: ATXN1; (-) strand; PAM type: YTN; PAM sequence: TTA
gtatactgcttaataatgtg

SEQ ID NO: 183734 - DNA, 20 bp, Artificial Sequence
  Description of Artificial Sequence: Synthetic oligonucleotide
  Target: ATXN1; (-) strand; PAM type: YTN; PAM sequence: CTG
caaagagaatggttagtata

SEQ ID NO: 183735 - DNA, 20 bp, Artificial Sequence
  Description of Artificial Sequence: Synthetic oligonucleotide
  Target: ATXN1; (-) strand; PAM type: YTN; PAM sequence: CTG
ctgcaaagagaatggttagt

SEQ ID NO: 183736 - DNA, 20 bp, Artificial Sequence
  Description of Artificial Sequence: Synthetic oligonucleotide
  Target: ATXN1; (-) strand; PAM type: YTN; PAM sequence: CTA
cagtatatagtcctgctgca

SEQ ID NO: 183737 - DNA, 20 bp, Artificial Sequence
  Description of Artificial Sequence: Synthetic oligonucleotide
  Target: ATXN1; (-) strand; PAM type: YTN; PAM sequence: TTG
tcccggcaggagctacagta

SEQ ID NO: 183738 - DNA, 20 bp, Artificial Sequence
  Description of Artificial Sequence: Synthetic oligonucleotide
  Target: ATXN1; (-) strand; PAM type: YTN; PAM sequence: TTT
gtcccggcaggagctacagt

SEQ ID NO: 183739 - DNA, 20 bp, Artificial Sequence
  Description of Artificial Sequence: Synthetic oligonucleotide
  Target: ATXN1; (-) strand; PAM type: YTN; PAM sequence: TTT
tgtcccggcaggagctacag

SEQ ID NO: 183740 - DNA, 20 bp, Artificial Sequence
  Description of Artificial Sequence: Synthetic oligonucleotide
  Target: ATXN1; (-) strand; PAM type: YTN; PAM sequence: TTT
ttgtcccggcaggagctaca

SEQ ID NO: 183741 - DNA, 20 bp, Artificial Sequence
  Description of Artificial Sequence: Synthetic oligonucleotide
  Target: ATXN1; (-) strand; PAM type: YTN; PAM sequence: TTA
ggatttttgtcccggcagga

SEQ ID NO: 183742 - DNA, 20 bp, Artificial Sequence
  Description of Artificial Sequence: Synthetic oligonucleotide
  Target: ATXN1; (-) strand; PAM type: YTN; PAM sequence: TTG
atgtgattaggatttttgtc

SEQ ID NO: 183743 - DNA, 20 bp, Artificial Sequence
  Description of Artificial Sequence: Synthetic oligonucleotide
  Target: ATXN1; (-) strand; PAM type: YTN; PAM sequence: TTG
catgtaaaaaaggttgatgt

SEQ ID NO: 183744 - DNA, 20 bp, Artificial Sequence
  Description of Artificial Sequence: Synthetic oligonucleotide
  Target: ATXN1; (-) strand; PAM type: YTN; PAM sequence: CTG
gattgcatgtaaaaaaggtt

SEQ ID NO: 183745 - DNA, 20 bp, Artificial Sequence
  Description of Artificial Sequence: Synthetic oligonucleotide
  Target: ATXN1; (-) strand; PAM type: YTN; PAM sequence: TTG
gaaatgtaagagcgtaaaag

SEQ ID NO: 183746 - DNA, 20 bp, Artificial Sequence
  Description of Artificial Sequence: Synthetic oligonucleotide
  Target: ATXN1; (-) strand; PAM type: YTN; PAM sequence: CTC
atgtaataggtgaggttgga

SEQ ID NO: 183747 - DNA, 20 bp, Artificial Sequence
  Description of Artificial Sequence: Synthetic oligonucleotide
  Target: ATXN1; (-) strand; PAM type: YTN; PAM sequence: TTG
ctcatgtaataggtgaggtt

SEQ ID NO: 183748 - DNA, 20 bp, Artificial Sequence
  Description of Artificial Sequence: Synthetic oligonucleotide
  Target: ATXN1; (-) strand; PAM type: YTN; PAM sequence: TTC
attgctcatgtaataggtga

SEQ ID NO: 183749 - DNA, 20 bp, Artificial Sequence
  Description of Artificial Sequence: Synthetic oligonucleotide
  Target: ATXN1; (-) strand; PAM type: YTN; PAM sequence: TTT
cattgctcatgtaataggtg

SEQ ID NO: 183750 - DNA, 20 bp, Artificial Sequence
  Description of Artificial Sequence: Synthetic oligonucleotide
  Target: ATXN1; (-) strand; PAM type: YTN; PAM sequence: TTT
tcattgctcatgtaataggt

SEQ ID NO: 183751 - DNA, 20 bp, Artificial Sequence
  Description of Artificial Sequence: Synthetic oligonucleotide
  Target: ATXN1; (-) strand; PAM type: YTN; PAM sequence: CTT
ttcattgctcatgtaatagg

SEQ ID NO: 183752 - DNA, 20 bp, Artificial Sequence
  Description of Artificial Sequence: Synthetic oligonucleotide
  Target: ATXN1; (-) strand; PAM type: YTN; PAM sequence: TTA
cagggcttttcattgctcat

SEQ ID NO: 183753 - DNA, 20 bp, Artificial Sequence
  Description of Artificial Sequence: Synthetic oligonucleotide
  Target: ATXN1; (-) strand; PAM type: YTN; PAM sequence: TTC
acggttacagggcttttcat

SEQ ID NO: 183754 - DNA, 20 bp, Artificial Sequence
  Description of Artificial Sequence: Synthetic oligonucleotide
  Target: ATXN1; (-) strand; PAM type: YTN; PAM sequence: TTA
agatggtattcacggttaca

SEQ ID NO: 183755 - DNA, 20 bp, Artificial Sequence
  Description of Artificial Sequence: Synthetic oligonucleotide
  Target: ATXN1; (-) strand; PAM type: YTN; PAM sequence: TTG
gaaagttaagatggtattca

SEQ ID NO: 183756 - DNA, 20 bp, Artificial Sequence
  Description of Artificial Sequence: Synthetic oligonucleotide
  Target: ATXN1; (-) strand; PAM type: YTN; PAM sequence: CTT
ggaaagttaagatggtattc

SEQ ID NO: 183757 - DNA, 20 bp, Artificial Sequence
  Description of Artificial Sequence: Synthetic oligonucleotide
  Target: ATXN1; (-) strand; PAM type: YTN; PAM sequence: TTG
gatgcataacggggcttgga

SEQ ID NO: 183758 - DNA, 20 bp, Artificial Sequence
  Description of Artificial Sequence: Synthetic oligonucleotide
  Target: ATXN1; (-) strand; PAM type: YTN; PAM sequence: TTG
cgttggatgcataacggggc

SEQ ID NO: 183759 - DNA, 20 bp, Artificial Sequence
  Description of Artificial Sequence: Synthetic oligonucleotide
  Target: ATXN1; (-) strand; PAM type: YTN; PAM sequence: CTG
ataacaggttgcgttggatg

SEQ ID NO: 183760 - DNA, 20 bp, Artificial Sequence
  Description of Artificial Sequence: Synthetic oligonucleotide
  Target: ATXN1; (-) strand; PAM type: YTN; PAM sequence: CTG
atgggatagtaggtgcccca

SEQ ID NO: 183761 - DNA, 20 bp, Artificial Sequence
  Description of Artificial Sequence: Synthetic oligonucleotide
  Target: ATXN1; (-) strand; PAM type: YTN; PAM sequence: TTA
cactgatgggatagtaggtg

SEQ ID NO: 183762 - DNA, 20 bp, Artificial Sequence
  Description of Artificial Sequence: Synthetic oligonucleotide
  Target: ATXN1; (-) strand; PAM type: YTN; PAM sequence: TTG
gagagtgtaattacactgat

SEQ ID NO: 183763 - DNA, 20 bp, Artificial Sequence
  Description of Artificial Sequence: Synthetic oligonucleotide
  Target: ATXN1; (-) strand; PAM type: YTN; PAM sequence: TTG
aagttggagagtgtaattac

SEQ ID NO: 183764 - DNA, 20 bp, Artificial Sequence
  Description of Artificial Sequence: Synthetic oligonucleotide
  Target: ATXN1; (-) strand; PAM type: YTN; PAM sequence: CTT
gaagttggagagtgtaatta

SEQ ID NO: 183765 - DNA, 20 bp, Artificial Sequence
  Description of Artificial Sequence: Synthetic oligonucleotide
  Target: ATXN1; (-) strand; PAM type: YTN; PAM sequence: TTG
gggcttgaagttggagagtg

SEQ ID NO: 183766 - DNA, 20 bp, Artificial Sequence
  Description of Artificial Sequence: Synthetic oligonucleotide
  Target: ATXN1; (-) strand; PAM type: YTN; PAM sequence: TTT
ggggcttgaagttggagagt

SEQ ID NO: 183767 - DNA, 20 bp, Artificial Sequence
  Description of Artificial Sequence: Synthetic oligonucleotide
  Target: ATXN1; (-) strand; PAM type: YTN; PAM sequence: CTA
tgatcatttggggcttgaag

SEQ ID NO: 183768 - DNA, 20 bp, Artificial Sequence
  Description of Artificial Sequence: Synthetic oligonucleotide
  Target: ATXN1; (-) strand; PAM type: YTN; PAM sequence: TTA
ctatgatcatttggggcttg

SEQ ID NO: 183769 - DNA, 20 bp, Artificial Sequence
  Description of Artificial Sequence: Synthetic oligonucleotide
  Target: ATXN1; (-) strand; PAM type: YTN; PAM sequence: TTG
gaagttactatgatcatttg

SEQ ID NO: 183770 - DNA, 20 bp, Artificial Sequence
  Description of Artificial Sequence: Synthetic oligonucleotide
  Target: ATXN1; (-) strand; PAM type: YTN; PAM sequence: CTT
ggaagttactatgatcattt

SEQ ID NO: 183771 - DNA, 20 bp, Artificial Sequence
  Description of Artificial Sequence: Synthetic oligonucleotide
  Target: ATXN1; (-) strand; PAM type: YTN; PAM sequence: TTG
ggtgccttggaagttactat

SEQ ID NO: 183772 - DNA, 20 bp, Artificial Sequence
  Description of Artificial Sequence: Synthetic oligonucleotide
  Target: ATXN1; (-) strand; PAM type: YTN; PAM sequence: TTT
gggtgccttggaagttacta

SEQ ID NO: 183773 - DNA, 20 bp, Artificial Sequence
  Description of Artificial Sequence: Synthetic oligonucleotide
  Target: ATXN1; (-) strand; PAM type: YTN; PAM sequence: CTG
aatagagcggtttgggtgcc

SEQ ID NO: 183774 - DNA, 20 bp, Artificial Sequence
  Description of Artificial Sequence: Synthetic oligonucleotide
  Target: ATXN1; (-) strand; PAM type: YTN; PAM sequence: CTG
agaagcggacaagccatctg

SEQ ID NO: 183775 - DNA, 20 bp, Artificial Sequence
  Description of Artificial Sequence: Synthetic oligonucleotide
  Target: ATXN1; (-) strand; PAM type: YTN; PAM sequence: TTG
ggggccctgagaagcggaca

SEQ ID NO: 183776 - DNA, 20 bp, Artificial Sequence
  Description of Artificial Sequence: Synthetic oligonucleotide
  Target: ATXN1; (-) strand; PAM type: YTN; PAM sequence: TTT
gggggccctgagaagcggac

SEQ ID NO: 183777 - DNA, 20 bp, Artificial Sequence
  Description of Artificial Sequence: Synthetic oligonucleotide
  Target: ATXN1; (-) strand; PAM type: YTN; PAM sequence: TTT
tgggggccctgagaagcgga

SEQ ID NO: 183778 - DNA, 20 bp, Artificial Sequence
  Description of Artificial Sequence: Synthetic oligonucleotide
  Target: ATXN1; (-) strand; PAM type: YTN; PAM sequence: TTT
ttgggggccctgagaagcgg

SEQ ID NO: 183779 - DNA, 20 bp, Artificial Sequence
  Description of Artificial Sequence: Synthetic oligonucleotide
  Target: ATXN1; (-) strand; PAM type: YTN; PAM sequence: TTA
agcagggaggaggtgatgat

SEQ ID NO: 183780 - DNA, 20 bp, Artificial Sequence
  Description of Artificial Sequence: Synthetic oligonucleotide
  Target: ATXN1; (-) strand; PAM type: YTN; PAM sequence: TTG
ttaagcagggaggaggtgat

SEQ ID NO: 183781 - DNA, 20 bp, Artificial Sequence
  Description of Artificial Sequence: Synthetic oligonucleotide
  Target: ATXN1; (-) strand; PAM type: YTN; PAM sequence: TTT
gttaagcagggaggaggtga

SEQ ID NO: 183782 - DNA, 20 bp, Artificial Sequence
  Description of Artificial Sequence: Synthetic oligonucleotide
  Target: ATXN1; (-) strand; PAM type: YTN; PAM sequence: CTG
tttgttaagcagggaggagg

SEQ ID NO: 183783 - DNA, 20 bp, Artificial Sequence
  Description of Artificial Sequence: Synthetic oligonucleotide
  Target: ATXN1; (-) strand; PAM type: YTN; PAM sequence: CTG
gactgtttgttaagcaggga

SEQ ID NO: 183784 - DNA, 20 bp, Artificial Sequence
  Description of Artificial Sequence: Synthetic oligonucleotide
  Target: ATXN1; (-) strand; PAM type: YTN; PAM sequence: TTA
caaaacctggactgtttgtt

SEQ ID NO: 183785 - DNA, 20 bp, Artificial Sequence
  Description of Artificial Sequence: Synthetic oligonucleotide
  Target: ATXN1; (-) strand; PAM type: YTN; PAM sequence: TTG
ccattacaaaacctggactg

SEQ ID NO: 183786 - DNA, 20 bp, Artificial Sequence
  Description of Artificial Sequence: Synthetic oligonucleotide
  Target: ATXN1; (-) strand; PAM type: YTN; PAM sequence: TTT
gccattacaaaacctggact

SEQ ID NO: 183787 - DNA, 20 bp, Artificial Sequence
  Description of Artificial Sequence: Synthetic oligonucleotide
  Target: ATXN1; (-) strand; PAM type: YTN; PAM sequence: CTG
cagggggtccaggggtgaat

SEQ ID NO: 183788 - DNA, 20 bp, Artificial Sequence
  Description of Artificial Sequence: Synthetic oligonucleotide
  Target: ATXN1; (-) strand; PAM type: YTN; PAM sequence: CTG
ctgcagggggtccaggggtg

SEQ ID NO: 183789 - DNA, 20 bp, Artificial Sequence
  Description of Artificial Sequence: Synthetic oligonucleotide
  Target: ATXN1; (-) strand; PAM type: YTN; PAM sequence: TTA
gtggtgggggtgctgctgca

SEQ ID NO: 183790 - DNA, 20 bp, Artificial Sequence
  Description of Artificial Sequence: Synthetic oligonucleotide
  Target: ATXN1; (-) strand; PAM type: YTN; PAM sequence: CTT
agtggtgggggtgctgctgc

SEQ ID NO: 183791 - DNA, 20 bp, Artificial Sequence
  Description of Artificial Sequence: Synthetic oligonucleotide
  Target: ATXN1; (-) strand; PAM type: YTN; PAM sequence: TTC
cttagtggtgggggtgctgc

SEQ ID NO: 183792 - DNA, 20 bp, Artificial Sequence
  Description of Artificial Sequence: Synthetic oligonucleotide
  Target: ATXN1; (-) strand; PAM type: YTN; PAM sequence: TTG
aaagagaggatgagaaggta

SEQ ID NO: 183793 - DNA, 20 bp, Artificial Sequence
  Description of Artificial Sequence: Synthetic oligonucleotide
  Target: ATXN1; (-) strand; PAM type: YTN; PAM sequence: TTC
aagagagtgattgaaagaga

SEQ ID NO: 183794 - DNA, 20 bp, Artificial Sequence
  Description of Artificial Sequence: Synthetic oligonucleotide
  Target: ATXN1; (-) strand; PAM type: YTN; PAM sequence: CTA
ggaaccattcaagagagtga

SEQ ID NO: 183795 - DNA, 20 bp, Artificial Sequence
  Description of Artificial Sequence: Synthetic oligonucleotide
  Target: ATXN1; (-) strand; PAM type: YTN; PAM sequence: CTA
ctaggaaccattcaagagag

SEQ ID NO: 183796 - DNA, 20 bp, Artificial Sequence
  Description of Artificial Sequence: Synthetic oligonucleotide
  Target: ATXN1; (-) strand; PAM type: YTN; PAM sequence: TTG
tatctactaggaaccattca

SEQ ID NO: 183797 - DNA, 20 bp, Artificial Sequence
  Description of Artificial Sequence: Synthetic oligonucleotide
  Target: ATXN1; (-) strand; PAM type: YTN; PAM sequence: TTT
gtatctactaggaaccattc

SEQ ID NO: 183798 - DNA, 20 bp, Artificial Sequence
  Description of Artificial Sequence: Synthetic oligonucleotide
  Target: ATXN1; (-) strand; PAM type: YTN; PAM sequence: TTT
tgtatctactaggaaccatt

SEQ ID NO: 183799 - DNA, 20 bp, Artificial Sequence
  Description of Artificial Sequence: Synthetic oligonucleotide
  Target: ATXN1; (-) strand; PAM type: YTN; PAM sequence: CTG
ttttgtatctactaggaacc

SEQ ID NO: 183800 - DNA, 20 bp, Artificial Sequence
  Description of Artificial Sequence: Synthetic oligonucleotide
  Target: ATXN1; (-) strand; PAM type: YTN; PAM sequence: TTG
gagaaaaaactgttttgtat

SEQ ID NO: 183801 - DNA, 20 bp, Artificial Sequence
  Description of Artificial Sequence: Synthetic oligonucleotide
  Target: ATXN1; (-) strand; PAM type: YTN; PAM sequence: TTC
ccattggagaaaaaactgtt

SEQ ID NO: 183802 - DNA, 20 bp, Artificial Sequence
  Description of Artificial Sequence: Synthetic oligonucleotide
  Target: ATXN1; (-) strand; PAM type: YTN; PAM sequence: TTT
cccattggagaaaaaactgt

SEQ ID NO: 183803 - DNA, 20 bp, Artificial Sequence
  Description of Artificial Sequence: Synthetic oligonucleotide
  Target: ATXN1; (-) strand; PAM type: YTN; PAM sequence: TTT
tcccattggagaaaaaactg

SEQ ID NO: 183804 - DNA, 20 bp, Artificial Sequence
  Description of Artificial Sequence: Synthetic oligonucleotide
  Target: ATXN1; (-) strand; PAM type: YTN; PAM sequence: CTA
ttttcccattggagaaaaaa

SEQ ID NO: 183805 - DNA, 20 bp, Artificial Sequence
  Description of Artificial Sequence: Synthetic oligonucleotide
  Target: ATXN1; (-) strand; PAM type: YTN; PAM sequence: CTC
tattttcccattggagaaaa

SEQ ID NO: 183806 - DNA, 20 bp, Artificial Sequence
  Description of Artificial Sequence: Synthetic oligonucleotide
  Target: ATXN1; (-) strand; PAM type: YTN; PAM sequence: CTG
tgctctattttcccattgga

SEQ ID NO: 183807 - DNA, 20 bp, Artificial Sequence
  Description of Artificial Sequence: Synthetic oligonucleotide
  Target: ATXN1; (-) strand; PAM type: YTN; PAM sequence: CTC
cctgtgctctattttcccat

SEQ ID NO: 183808 - DNA, 20 bp, Artificial Sequence
  Description of Artificial Sequence: Synthetic oligonucleotide
  Target: ATXN1; (-) strand; PAM type: YTN; PAM sequence: CTG
agtgactccctgtgctctat

SEQ ID NO: 183809 - DNA, 20 bp, Artificial Sequence
  Description of Artificial Sequence: Synthetic oligonucleotide
  Target: ATXN1; (-) strand; PAM type: YTN; PAM sequence: TTG
ggagcaaactgagtgactcc

SEQ ID NO: 183810 - DNA, 20 bp, Artificial Sequence
  Description of Artificial Sequence: Synthetic oligonucleotide
  Target: ATXN1; (-) strand; PAM type: YTN; PAM sequence: CTG
gaaaggggtgttgggagcaa

SEQ ID NO: 183811 - DNA, 20 bp, Artificial Sequence
  Description of Artificial Sequence: Synthetic oligonucleotide
  Target: ATXN1; (-) strand; PAM type: YTN; PAM sequence: CTG
gtgagtggctggaaaggggt

SEQ ID NO: 183812 - DNA, 20 bp, Artificial Sequence
  Description of Artificial Sequence: Synthetic oligonucleotide
  Target: ATXN1; (-) strand; PAM type: YTN; PAM sequence: TTG
ccaaggtagtctggtgagtg

SEQ ID NO: 183813 - DNA, 20 bp, Artificial Sequence
  Description of Artificial Sequence: Synthetic oligonucleotide
  Target: ATXN1; (-) strand; PAM type: YTN; PAM sequence: CTT
gccaaggtagtctggtgagt

SEQ ID NO: 183814 - DNA, 20 bp, Artificial Sequence
  Description of Artificial Sequence: Synthetic oligonucleotide
  Target: ATXN1; (-) strand; PAM type: YTN; PAM sequence: CTA
gagtacttgccaaggtagtc

SEQ ID NO: 183815 - DNA, 20 bp, Artificial Sequence
  Description of Artificial Sequence: Synthetic oligonucleotide
  Target: ATXN1; (-) strand; PAM type: YTN; PAM sequence: CTC
ctagagtacttgccaaggta

SEQ ID NO: 183816 - DNA, 20 bp, Artificial Sequence
  Description of Artificial Sequence: Synthetic oligonucleotide
  Target: ATXN1; (-) strand; PAM type: YTN; PAM sequence: TTC
ccatactcctagagtacttg

SEQ ID NO: 183817 - DNA, 20 bp, Artificial Sequence
  Description of Artificial Sequence: Synthetic oligonucleotide
  Target: ATXN1; (-) strand; PAM type: YTN; PAM sequence: TTT
cccatactcctagagtactt

SEQ ID NO: 183818 - DNA, 20 bp, Artificial Sequence
  Description of Artificial Sequence: Synthetic oligonucleotide
  Target: ATXN1; (-) strand; PAM type: YTN; PAM sequence: TTT
tcccatactcctagagtact

SEQ ID NO: 183819 - DNA, 20 bp, Artificial Sequence
  Description of Artificial Sequence: Synthetic oligonucleotide
  Target: ATXN1; (-) strand; PAM type: YTN; PAM sequence: TTC
attttcccatactcctagag

SEQ ID NO: 183820 - DNA, 20 bp, Artificial Sequence
  Description of Artificial Sequence: Synthetic oligonucleotide
  Target: ATXN1; (-) strand; PAM type: YTN; PAM sequence: TTT
cattttcccatactcctaga

SEQ ID NO: 183821 - DNA, 20 bp, Artificial Sequence
  Description of Artificial Sequence: Synthetic oligonucleotide
  Target: ATXN1; (-) strand; PAM type: YTN; PAM sequence: TTT
tcattttcccatactcctag

SEQ ID NO: 183822 - DNA, 20 bp, Artificial Sequence
  Description of Artificial Sequence: Synthetic oligonucleotide
  Target: ATXN1; (-) strand; PAM type: YTN; PAM sequence: TTG
ttttcattttcccatactcc

SEQ ID NO: 183823 - DNA, 20 bp, Artificial Sequence
  Description of Artificial Sequence: Synthetic oligonucleotide
  Target: ATXN1; (-) strand; PAM type: YTN; PAM sequence: TTG
ttgttttcattttcccatac

SEQ ID NO: 183824 - DNA, 20 bp, Artificial Sequence
  Description of Artificial Sequence: Synthetic oligonucleotide
  Target: ATXN1; (-) strand; PAM type: YTN; PAM sequence: TTT
gttgttttcattttcccata

SEQ ID NO: 183825 - DNA, 20 bp, Artificial Sequence
  Description of Artificial Sequence: Synthetic oligonucleotide
  Target: ATXN1; (-) strand; PAM type: YTN; PAM sequence: TTA
aaaaggtgtgtgagtttgtt

SEQ ID NO: 183826 - DNA, 20 bp, Artificial Sequence
  Description of Artificial Sequence: Synthetic oligonucleotide
  Target: ATXN1; (-) strand; PAM type: YTN; PAM sequence: TTG
tgtatgttaaaaaggtgtgt

SEQ ID NO: 183827 - DNA, 20 bp, Artificial Sequence
  Description of Artificial Sequence: Synthetic oligonucleotide
  Target: ATXN1; (-) strand; PAM type: YTN; PAM sequence: CTG
gttgtgtatgttaaaaaggt

SEQ ID NO: 183828 - DNA, 20 bp, Artificial Sequence
  Description of Artificial Sequence: Synthetic oligonucleotide
  Target: ATXN1; (-) strand; PAM type: YTN; PAM sequence: CTG
ggtagacagaactggttgtg

SEQ ID NO: 183829 - DNA, 20 bp, Artificial Sequence
  Description of Artificial Sequence: Synthetic oligonucleotide
  Target: ATXN1; (-) strand; PAM type: YTN; PAM sequence: TTG
gctgggtagacagaactggt

SEQ ID NO: 183830 - DNA, 20 bp, Artificial Sequence
  Description of Artificial Sequence: Synthetic oligonucleotide
  Target: ATXN1; (-) strand; PAM type: YTN; PAM sequence: CTT
ggctgggtagacagaactgg

SEQ ID NO: 183831 - DNA, 20 bp, Artificial Sequence
  Description of Artificial Sequence: Synthetic oligonucleotide
  Target: ATXN1; (-) strand; PAM type: YTN; PAM sequence: TTC
cacataagaatatgccttgg

SEQ ID NO: 183832 - DNA, 20 bp, Artificial Sequence
  Description of Artificial Sequence: Synthetic oligonucleotide
  Target: ATXN1; (-) strand; PAM type: YTN; PAM sequence: TTG
aagttccacataagaatatg

SEQ ID NO: 183833 - DNA, 20 bp, Artificial Sequence
  Description of Artificial Sequence: Synthetic oligonucleotide
  Target: ATXN1; (-) strand; PAM type: YTN; PAM sequence: TTA
gtggggaggcagatgtaagt

SEQ ID NO: 183834 - DNA, 20 bp, Artificial Sequence
  Description of Artificial Sequence: Synthetic oligonucleotide
  Target: ATXN1; (-) strand; PAM type: YTN; PAM sequence: CTG
tccagttagtggggaggcag

SEQ ID NO: 183835 - DNA, 20 bp, Artificial Sequence
  Description of Artificial Sequence: Synthetic oligonucleotide
  Target: ATXN1; (-) strand; PAM type: YTN; PAM sequence: CTA
aggtacaggtgcctgtccag

SEQ ID NO: 183836 - DNA, 20 bp, Artificial Sequence
  Description of Artificial Sequence: Synthetic oligonucleotide
  Target: ATXN1; (-) strand; PAM type: YTN; PAM sequence: TTA
ggaagactaaggtacaggtg

SEQ ID NO: 183837 - DNA, 20 bp, Artificial Sequence
  Description of Artificial Sequence: Synthetic oligonucleotide
  Target: ATXN1; (-) strand; PAM type: YTN; PAM sequence: CTT
aggaagactaaggtacaggt

SEQ ID NO: 183838 - DNA, 20 bp, Artificial Sequence
  Description of Artificial Sequence: Synthetic oligonucleotide
  Target: ATXN1; (-) strand; PAM type: YTN; PAM sequence: TTG
ggacttaggaagactaaggt

SEQ ID NO: 183839 - DNA, 20 bp, Artificial Sequence
  Description of Artificial Sequence: Synthetic oligonucleotide
  Target: ATXN1; (-) strand; PAM type: YTN; PAM sequence: TTA
atgttgggacttaggaagac

SEQ ID NO: 183840 - DNA, 20 bp, Artificial Sequence
  Description of Artificial Sequence: Synthetic oligonucleotide
  Target: ATXN1; (-) strand; PAM type: YTN; PAM sequence: CTG
cggtaatgttaatgttggga

SEQ ID NO: 183841 - DNA, 20 bp, Artificial Sequence
  Description of Artificial Sequence: Synthetic oligonucleotide
  Target: ATXN1; (-) strand; PAM type: YTN; PAM sequence: TTC
ctgcggtaatgttaatgttg

SEQ ID NO: 183842 - DNA, 20 bp, Artificial Sequence
  Description of Artificial Sequence: Synthetic oligonucleotide
  Target: ATXN1; (-) strand; PAM type: YTN; PAM sequence: TTT
cctgcggtaatgttaatgtt

SEQ ID NO: 183843 - DNA, 20 bp, Artificial Sequence
  Description of Artificial Sequence: Synthetic oligonucleotide
  Target: ATXN1; (-) strand; PAM type: YTN; PAM sequence: CTG
atttcctgcggtaatgttaa

SEQ ID NO: 183844 - DNA, 20 bp, Artificial Sequence
  Description of Artificial Sequence: Synthetic oligonucleotide
  Target: ATXN1; (-) strand; PAM type: YTN; PAM sequence: CTG
atagggtctgatttcctgcg

SEQ ID NO: 183845 - DNA, 20 bp, Artificial Sequence
  Description of Artificial Sequence: Synthetic oligonucleotide
  Target: ATXN1; (-) strand; PAM type: YTN; PAM sequence: TTG
aggggcactgatagggtctg

SEQ ID NO: 183846 - DNA, 20 bp, Artificial Sequence
  Description of Artificial Sequence: Synthetic oligonucleotide
  Target: ATXN1; (-) strand; PAM type: YTN; PAM sequence: TTT
gaggggcactgatagggtct

SEQ ID NO: 183847 - DNA, 20 bp, Artificial Sequence
  Description of Artificial Sequence: Synthetic oligonucleotide
  Target: ATXN1; (-) strand; PAM type: YTN; PAM sequence: CTT
tgaggggcactgatagggtc

SEQ ID NO: 183848 - DNA, 20 bp, Artificial Sequence
  Description of Artificial Sequence: Synthetic oligonucleotide
  Target: ATXN1; (-) strand; PAM type: YTN; PAM sequence: CTG
agctttgaggggcactgata

SEQ ID NO: 183849 - DNA, 20 bp, Artificial Sequence
  Description of Artificial Sequence: Synthetic oligonucleotide
  Target: ATXN1; (-) strand; PAM type: YTN; PAM sequence: CTG
acggacctgagctttgaggg

SEQ ID NO: 183850 - DNA, 20 bp, Artificial Sequence
  Description of Artificial Sequence: Synthetic oligonucleotide
  Target: ATXN1; (-) strand; PAM type: YTN; PAM sequence: CTG
tactgacggacctgagcttt

SEQ ID NO: 183851 - DNA, 20 bp, Artificial Sequence
  Description of Artificial Sequence: Synthetic oligonucleotide
  Target: ATXN1; (-) strand; PAM type: YTN; PAM sequence: TTG
tatggccctgtactgacgga

SEQ ID NO: 183852 - DNA, 20 bp, Artificial Sequence
  Description of Artificial Sequence: Synthetic oligonucleotide
  Target: ATXN1; (-) strand; PAM type: YTN; PAM sequence: TTA
gttgtatggccctgtactga

SEQ ID NO: 183853 - DNA, 20 bp, Artificial Sequence
  Description of Artificial Sequence: Synthetic oligonucleotide
  Target: ATXN1; (-) strand; PAM type: YTN; PAM sequence: TTA
accgtataagtaggggtatt

SEQ ID NO: 183854 - DNA, 20 bp, Artificial Sequence
  Description of Artificial Sequence: Synthetic oligonucleotide
  Target: ATXN1; (-) strand; PAM type: YTN; PAM sequence: CTT
aaccgtataagtaggggtat

SEQ ID NO: 183855 - DNA, 20 bp, Artificial Sequence
  Description of Artificial Sequence: Synthetic oligonucleotide
  Target: ATXN1; (-) strand; PAM type: YTN; PAM sequence: TTC
ttaaccgtataagtaggggt

SEQ ID NO: 183856 - DNA, 20 bp, Artificial Sequence
  Description of Artificial Sequence: Synthetic oligonucleotide
  Target: ATXN1; (-) strand; PAM type: YTN; PAM sequence: CTA
ttcttaaccgtataagtagg

SEQ ID NO: 183857 - DNA, 20 bp, Artificial Sequence
  Description of Artificial Sequence: Synthetic oligonucleotide
  Target: ATXN1; (-) strand; PAM type: YTN; PAM sequence: CTG
tagcagtggctattcttaac

SEQ ID NO: 183858 - DNA, 20 bp, Artificial Sequence
  Description of Artificial Sequence: Synthetic oligonucleotide
  Target: ATXN1; (-) strand; PAM type: YTN; PAM sequence: TTC
ctgtagcagtggctattctt

SEQ ID NO: 183859 - DNA, 20 bp, Artificial Sequence
  Description of Artificial Sequence: Synthetic oligonucleotide
  Target: ATXN1; (-) strand; PAM type: YTN; PAM sequence: CTG
gttcctgtagcagtggctat

SEQ ID NO: 183860 - DNA, 20 bp, Artificial Sequence
  Description of Artificial Sequence: Synthetic oligonucleotide
  Target: ATXN1; (-) strand; PAM type: YTN; PAM sequence: TTC
tggttcctgtagcagtggct

SEQ ID NO: 183861 - DNA, 20 bp, Artificial Sequence
  Description of Artificial Sequence: Synthetic oligonucleotide
  Target: ATXN1; (-) strand; PAM type: YTN; PAM sequence: CTA
ttctggttcctgtagcagtg

SEQ ID NO: 183862 - DNA, 20 bp, Artificial Sequence
  Description of Artificial Sequence: Synthetic oligonucleotide
  Target: ATXN1; (-) strand; PAM type: YTN; PAM sequence: CTG
gctattctggttcctgtagc

SEQ ID NO: 183863 - DNA, 20 bp, Artificial Sequence
  Description of Artificial Sequence: Synthetic oligonucleotide
  Target: ATXN1; (-) strand; PAM type: YTN; PAM sequence: TTG
agagtgtgtggtagtaggat

SEQ ID NO: 183864 - DNA, 20 bp, Artificial Sequence
  Description of Artificial Sequence: Synthetic oligonucleotide
  Target: ATXN1; (-) strand; PAM type: YTN; PAM sequence: TTT
gagagtgtgtggtagtagga

SEQ ID NO: 183865 - DNA, 20 bp, Artificial Sequence
  Description of Artificial Sequence: Synthetic oligonucleotide
  Target: ATXN1; (-) strand; PAM type: YTN; PAM sequence: CTT
tgagagtgtgtggtagtagg

SEQ ID NO: 183866 - DNA, 20 bp, Artificial Sequence
  Description of Artificial Sequence: Synthetic oligonucleotide
  Target: ATXN1; (-) strand; PAM type: YTN; PAM sequence: TTG
agaaatcctttgagagtgtg

SEQ ID NO: 183867 - DNA, 20 bp, Artificial Sequence
  Description of Artificial Sequence: Synthetic oligonucleotide
  Target: ATXN1; (-) strand; PAM type: YTN; PAM sequence: CTT
gagaaatcctttgagagtgt

SEQ ID NO: 183868 - DNA, 20 bp, Artificial Sequence
  Description of Artificial Sequence: Synthetic oligonucleotide
  Target: ATXN1; (-) strand; PAM type: YTN; PAM sequence: CTG
tcttgagaaatcctttgaga

SEQ ID NO: 183869 - DNA, 20 bp, Artificial Sequence
  Description of Artificial Sequence: Synthetic oligonucleotide
  Target: ATXN1; (-) strand; PAM type: YTN; PAM sequence: TTG
caaactgtcttgagaaatcc

SEQ ID NO: 183870 - DNA, 20 bp, Artificial Sequence
  Description of Artificial Sequence: Synthetic oligonucleotide
  Target: ATXN1; (-) strand; PAM type: YTN; PAM sequence: CTT
gcaaactgtcttgagaaatc

SEQ ID NO: 183871 - DNA, 20 bp, Artificial Sequence
  Description of Artificial Sequence: Synthetic oligonucleotide
  Target: ATXN1; (-) strand; PAM type: YTN; PAM sequence: TTC
ttgcaaactgtcttgagaaa

SEQ ID NO: 183872 - DNA, 20 bp, Artificial Sequence
  Description of Artificial Sequence: Synthetic oligonucleotide
  Target: ATXN1; (-) strand; PAM type: YTN; PAM sequence: TTT
cttgcaaactgtcttgagaa

SEQ ID NO: 183873 - DNA, 20 bp, Artificial Sequence
  Description of Artificial Sequence: Synthetic oligonucleotide
  Target: ATXN1; (-) strand; PAM type: YTN; PAM sequence: TTA
tttcttgcaaactgtcttga

SEQ ID NO: 183874 - DNA, 20 bp, Artificial Sequence
  Description of Artificial Sequence: Synthetic oligonucleotide
  Target: ATXN1; (-) strand; PAM type: YTN; PAM sequence: TTG
ttatttcttgcaaactgtct

SEQ ID NO: 183875 - DNA, 20 bp, Artificial Sequence
  Description of Artificial Sequence: Synthetic oligonucleotide
  Target: ATXN1; (-) strand; PAM type: YTN; PAM sequence: TTT
gttatttcttgcaaactgtc

SEQ ID NO: 183876 - DNA, 20 bp, Artificial Sequence
  Description of Artificial Sequence: Synthetic oligonucleotide
  Target: ATXN1; (-) strand; PAM type: YTN; PAM sequence: TTT
tgttatttcttgcaaactgt

SEQ ID NO: 183877 - DNA, 20 bp, Artificial Sequence
  Description of Artificial Sequence: Synthetic oligonucleotide
  Target: ATXN1; (-) strand; PAM type: YTN; PAM sequence: TTG
cagagtaaggatagattttg

SEQ ID NO: 183878 - DNA, 20 bp, Artificial Sequence
  Description of Artificial Sequence: Synthetic oligonucleotide
  Target: ATXN1; (-) strand; PAM type: YTN; PAM sequence: TTG
ggattgcagagtaaggatag

SEQ ID NO: 183879 - DNA, 20 bp, Artificial Sequence
  Description of Artificial Sequence: Synthetic oligonucleotide
  Target: ATXN1; (-) strand; PAM type: YTN; PAM sequence: TTT
gggattgcagagtaaggata

SEQ ID NO: 183880 - DNA, 20 bp, Artificial Sequence
  Description of Artificial Sequence: Synthetic oligonucleotide
  Target: ATXN1; (-) strand; PAM type: YTN; PAM sequence: CTA
tttgggattgcagagtaagg

SEQ ID NO: 183881 - DNA, 20 bp, Artificial Sequence
  Description of Artificial Sequence: Synthetic oligonucleotide
  Target: ATXN1; (-) strand; PAM type: YTN; PAM sequence: CTG
ccaaagagtctatttgggat

SEQ ID NO: 183882 - DNA, 20 bp, Artificial Sequence
  Description of Artificial Sequence: Synthetic oligonucleotide
  Target: ATXN1; (-) strand; PAM type: YTN; PAM sequence: CTA
ctgccaaagagtctatttgg

SEQ ID NO: 183883 - DNA, 20 bp, Artificial Sequence
  Description of Artificial Sequence: Synthetic oligonucleotide
  Target: ATXN1; (-) strand; PAM type: YTN; PAM sequence: TTC
actactgccaaagagtctat

SEQ ID NO: 183884 - DNA, 20 bp, Artificial Sequence
  Description of Artificial Sequence: Synthetic oligonucleotide
  Target: ATXN1; (-) strand; PAM type: YTN; PAM sequence: TTG
gatattcactactgccaaag

SEQ ID NO: 183885 - DNA, 20 bp, Artificial Sequence
  Description of Artificial Sequence: Synthetic oligonucleotide
  Target: ATXN1; (-) strand; PAM type: YTN; PAM sequence: TTT
ggatattcactactgccaaa

SEQ ID NO: 183886 - DNA, 20 bp, Artificial Sequence
  Description of Artificial Sequence: Synthetic oligonucleotide
  Target: ATXN1; (-) strand; PAM type: YTN; PAM sequence: TTT
tggatattcactactgccaa

SEQ ID NO: 183887 - DNA, 20 bp, Artificial Sequence
  Description of Artificial Sequence: Synthetic oligonucleotide
  Target: ATXN1; (-) strand; PAM type: YTN; PAM sequence: TTG
gcggttttggatattcacta

SEQ ID NO: 183888 - DNA, 20 bp, Artificial Sequence
  Description of Artificial Sequence: Synthetic oligonucleotide
  Target: ATXN1; (-) strand; PAM type: YTN; PAM sequence: CTT
ggcggttttggatattcact

SEQ ID NO: 183889 - DNA, 20 bp, Artificial Sequence
  Description of Artificial Sequence: Synthetic oligonucleotide
  Target: ATXN1; (-) strand; PAM type: YTN; PAM sequence: CTA
ggccttggcggttttggata

SEQ ID NO: 183890 - DNA, 20 bp, Artificial Sequence
  Description of Artificial Sequence: Synthetic oligonucleotide
  Target: ATXN1; (-) strand; PAM type: YTN; PAM sequence: CTC
agcagtgaggaggtctaggc

SEQ ID NO: 183891 - DNA, 20 bp, Artificial Sequence
  Description of Artificial Sequence: Synthetic oligonucleotide
  Target: ATXN1; (-) strand; PAM type: YTN; PAM sequence: TTC
tcagcagtgaggaggtctag

SEQ ID NO: 183892 - DNA, 20 bp, Artificial Sequence
  Description of Artificial Sequence: Synthetic oligonucleotide
  Target: ATXN1; (-) strand; PAM type: YTN; PAM sequence: TTT
ctcagcagtgaggaggtcta

SEQ ID NO: 183893 - DNA, 20 bp, Artificial Sequence
  Description of Artificial Sequence: Synthetic oligonucleotide
  Target: ATXN1; (-) strand; PAM type: YTN; PAM sequence: CTT
tctcagcagtgaggaggtct

SEQ ID NO: 183894 - DNA, 20 bp, Artificial Sequence
  Description of Artificial Sequence: Synthetic oligonucleotide
  Target: ATXN1; (-) strand; PAM type: YTN; PAM sequence: TTC
ctttctcagcagtgaggagg

SEQ ID NO: 183895 - DNA, 20 bp, Artificial Sequence
  Description of Artificial Sequence: Synthetic oligonucleotide
  Target: ATXN1; (-) strand; PAM type: YTN; PAM sequence: CTT
cctttctcagcagtgaggag

SEQ ID NO: 183896 - DNA, 20 bp, Artificial Sequence
  Description of Artificial Sequence: Synthetic oligonucleotide
  Target: ATXN1; (-) strand; PAM type: YTN; PAM sequence: CTA
agaaggtgcagagtcttcct

SEQ ID NO: 183897 - DNA, 20 bp, Artificial Sequence
  Description of Artificial Sequence: Synthetic oligonucleotide
  Target: ATXN1; (-) strand; PAM type: YTN; PAM sequence: CTC
ctaagaaggtgcagagtctt

SEQ ID NO: 183898 - DNA, 20 bp, Artificial Sequence
  Description of Artificial Sequence: Synthetic oligonucleotide
  Target: ATXN1; (-) strand; PAM type: YTN; PAM sequence: TTC
tcctaagaaggtgcagagtc

SEQ ID NO: 183899 - DNA, 20 bp, Artificial Sequence
  Description of Artificial Sequence: Synthetic oligonucleotide
  Target: ATXN1; (-) strand; PAM type: YTN; PAM sequence: CTT
ctcctaagaaggtgcagagt

SEQ ID NO: 183900 - DNA, 20 bp, Artificial Sequence
  Description of Artificial Sequence: Synthetic oligonucleotide
  Target: ATXN1; (-) strand; PAM type: YTN; PAM sequence: TTA
gtgtaaaaacaacagtcttc

SEQ ID NO: 183901 - DNA, 20 bp, Artificial Sequence
  Description of Artificial Sequence: Synthetic oligonucleotide
  Target: ATXN1; (-) strand; PAM type: YTN; PAM sequence: CTG
agtggttagtgtaaaaacaa

SEQ ID NO: 183902 - DNA, 20 bp, Artificial Sequence
  Description of Artificial Sequence: Synthetic oligonucleotide
  Target: ATXN1; (-) strand; PAM type: YTN; PAM sequence: CTA
tccctgagtggttagtgtaa

SEQ ID NO: 183903 - DNA, 20 bp, Artificial Sequence
  Description of Artificial Sequence: Synthetic oligonucleotide
  Target: ATXN1; (-) strand; PAM type: YTN; PAM sequence: TTG
tactatccctgagtggttag

SEQ ID NO: 183904 - DNA, 20 bp, Artificial Sequence
  Description of Artificial Sequence: Synthetic oligonucleotide
  Target: ATXN1; (-) strand; PAM type: YTN; PAM sequence: CTT
gtactatccctgagtggtta

SEQ ID NO: 183905 - DNA, 20 bp, Artificial Sequence
  Description of Artificial Sequence: Synthetic oligonucleotide
  Target: ATXN1; (-) strand; PAM type: YTN; PAM sequence: CTG
ggcagcatcttgtactatcc

SEQ ID NO: 183906 - DNA, 20 bp, Artificial Sequence
  Description of Artificial Sequence: Synthetic oligonucleotide
  Target: ATXN1; (-) strand; PAM type: YTN; PAM sequence: CTG
ctgggcagcatcttgtacta

SEQ ID NO: 183907 - DNA, 20 bp, Artificial Sequence
  Description of Artificial Sequence: Synthetic oligonucleotide
  Target: ATXN1; (-) strand; PAM type: YTN; PAM sequence: CTG
taactgctgggcagcatctt

SEQ ID NO: 183908 - DNA, 20 bp, Artificial Sequence
  Description of Artificial Sequence: Synthetic oligonucleotide
  Target: ATXN1; (-) strand; PAM type: YTN; PAM sequence: TTC
ctgtaactgctgggcagcat

SEQ ID NO: 183909 - DNA, 20 bp, Artificial Sequence
  Description of Artificial Sequence: Synthetic oligonucleotide
  Target: ATXN1; (-) strand; PAM type: YTN; PAM sequence: TTT
cctgtaactgctgggcagca

SEQ ID NO: 183910 - DNA, 20 bp, Artificial Sequence
  Description of Artificial Sequence: Synthetic oligonucleotide
  Target: ATXN1; (-) strand; PAM type: YTN; PAM sequence: TTT
tcctgtaactgctgggcagc

SEQ ID NO: 183911 - DNA, 20 bp, Artificial Sequence
  Description of Artificial Sequence: Synthetic oligonucleotide
  Target: ATXN1; (-) strand; PAM type: YTN; PAM sequence: CTT
ttcctgtaactgctgggcag

SEQ ID NO: 183912 - DNA, 20 bp, Artificial Sequence
  Description of Artificial Sequence: Synthetic oligonucleotide
  Target: ATXN1; (-) strand; PAM type: YTN; PAM sequence: TTC
agaagccttttcctgtaact

SEQ ID NO: 183913 - DNA, 20 bp, Artificial Sequence
  Description of Artificial Sequence: Synthetic oligonucleotide
  Target: ATXN1; (-) strand; PAM type: YTN; PAM sequence: TTT
cagaagccttttcctgtaac

SEQ ID NO: 183914 - DNA, 20 bp, Artificial Sequence
  Description of Artificial Sequence: Synthetic oligonucleotide
  Target: ATXN1; (-) strand; PAM type: YTN; PAM sequence: CTG
atttcagaagccttttcctg

SEQ ID NO: 183915 - DNA, 20 bp, Artificial Sequence
  Description of Artificial Sequence: Synthetic oligonucleotide
  Target: ATXN1; (-) strand; PAM type: YTN; PAM sequence: TTG
tctgatttcagaagcctttt

SEQ ID NO: 183916 - DNA, 20 bp, Artificial Sequence
  Description of Artificial Sequence: Synthetic oligonucleotide
  Target: ATXN1; (-) strand; PAM type: YTN; PAM sequence: TTG
aaaggcattgtctgatttca

SEQ ID NO: 183917 - DNA, 20 bp, Artificial Sequence
  Description of Artificial Sequence: Synthetic oligonucleotide
  Target: ATXN1; (-) strand; PAM type: YTN; PAM sequence: TTT
gaaaggcattgtctgatttc

SEQ ID NO: 183918 - DNA, 20 bp, Artificial Sequence
  Description of Artificial Sequence: Synthetic oligonucleotide
  Target: ATXN1; (-) strand; PAM type: YTN; PAM sequence: TTG
gtataagagtttgaaaggca

SEQ ID NO: 183919 - DNA, 20 bp, Artificial Sequence
  Description of Artificial Sequence: Synthetic oligonucleotide
  Target: ATXN1; (-) strand; PAM type: YTN; PAM sequence: CTA
gaggttggtataagagtttg

SEQ ID NO: 183920 - DNA, 20 bp, Artificial Sequence
  Description of Artificial Sequence: Synthetic oligonucleotide
  Target: ATXN1; (-) strand; PAM type: YTN; PAM sequence: CTC
tagaggttggtataagagtt

SEQ ID NO: 183921 - DNA, 20 bp, Artificial Sequence
  Description of Artificial Sequence: Synthetic oligonucleotide
  Target: ATXN1; (-) strand; PAM type: YTN; PAM sequence: TTG
cccaactctagaggttggta

SEQ ID NO: 183922 - DNA, 20 bp, Artificial Sequence
  Description of Artificial Sequence: Synthetic oligonucleotide
  Target: ATXN1; (-) strand; PAM type: YTN; PAM sequence: CTG
tcatgggacgtagaaagggg

SEQ ID NO: 183923 - DNA, 20 bp, Artificial Sequence
  Description of Artificial Sequence: Synthetic oligonucleotide
  Target: ATXN1; (-) strand; PAM type: YTN; PAM sequence: TTA
aaaacacagggcccgaaggt

SEQ ID NO: 183924 - DNA, 20 bp, Artificial Sequence
  Description of Artificial Sequence: Synthetic oligonucleotide
  Target: ATXN1; (-) strand; PAM type: YTN; PAM sequence: TTG
acaaagaggttaaaaacaca

SEQ ID NO: 183925 - DNA, 20 bp, Artificial Sequence
  Description of Artificial Sequence: Synthetic oligonucleotide
  Target: ATXN1; (-) strand; PAM type: YTN; PAM sequence: TTT
gacaaagaggttaaaaacac

SEQ ID NO: 183926 - DNA, 20 bp, Artificial Sequence
  Description of Artificial Sequence: Synthetic oligonucleotide
  Target: ATXN1; (-) strand; PAM type: YTN; PAM sequence: CTG
gaggaaacaaatttgacaaa

SEQ ID NO: 183927 - DNA, 20 bp, Artificial Sequence
  Description of Artificial Sequence: Synthetic oligonucleotide
  Target: ATXN1; (-) strand; PAM type: YTN; PAM sequence: TTG
atggtatcgatcctggagga

SEQ ID NO: 183928 - DNA, 20 bp, Artificial Sequence
  Description of Artificial Sequence: Synthetic oligonucleotide
  Target: ATXN1; (-) strand; PAM type: YTN; PAM sequence: CTT
gatggtatcgatcctggagg

SEQ ID NO: 183929 - DNA, 20 bp, Artificial Sequence
  Description of Artificial Sequence: Synthetic oligonucleotide
  Target: ATXN1; (-) strand; PAM type: YTN; PAM sequence: CTG
tagcttgatggtatcgatcc

SEQ ID NO: 183930 - DNA, 20 bp, Artificial Sequence
  Description of Artificial Sequence: Synthetic oligonucleotide
  Target: ATXN1; (-) strand; PAM type: YTN; PAM sequence: TTG
taagaccatctgtagcttga

SEQ ID NO: 183931 - DNA, 20 bp, Artificial Sequence
  Description of Artificial Sequence: Synthetic oligonucleotide
  Target: ATXN1; (-) strand; PAM type: YTN; PAM sequence: TTT
gtaagaccatctgtagcttg

SEQ ID NO: 183932 - DNA, 20 bp, Artificial Sequence
  Description of Artificial Sequence: Synthetic oligonucleotide
  Target: ATXN1; (-) strand; PAM type: YTN; PAM sequence: TTC
catttgtaagaccatctgta

SEQ ID NO: 183933 - DNA, 20 bp, Artificial Sequence
  Description of Artificial Sequence: Synthetic oligonucleotide
  Target: ATXN1; (-) strand; PAM type: YTN; PAM sequence: TTG
gggttccatttgtaagacca

SEQ ID NO: 183934 - DNA, 20 bp, Artificial Sequence
  Description of Artificial Sequence: Synthetic oligonucleotide
  Target: ATXN1; (-) strand; PAM type: YTN; PAM sequence: TTT
ggggttccatttgtaagacc

SEQ ID NO: 183935 - DNA, 20 bp, Artificial Sequence
  Description of Artificial Sequence: Synthetic oligonucleotide
  Target: ATXN1; (-) strand; PAM type: YTN; PAM sequence: CTC
atttggggttccatttgtaa

SEQ ID NO: 183936 - DNA, 20 bp, Artificial Sequence
  Description of Artificial Sequence: Synthetic oligonucleotide
  Target: ATXN1; (-) strand; PAM type: YTN; PAM sequence: TTG
agctcatttggggttccatt

SEQ ID NO: 183937 - DNA, 20 bp, Artificial Sequence
  Description of Artificial Sequence: Synthetic oligonucleotide
  Target: ATXN1; (-) strand; PAM type: YTN; PAM sequence: TTG
tgagttgagctcatttgggg

SEQ ID NO: 183938 - DNA, 20 bp, Artificial Sequence
  Description of Artificial Sequence: Synthetic oligonucleotide
  Target: ATXN1; (-) strand; PAM type: YTN; PAM sequence: TTG
gtagaagttgtgagttgagc

SEQ ID NO: 183939 - DNA, 20 bp, Artificial Sequence
  Description of Artificial Sequence: Synthetic oligonucleotide
  Target: ATXN1; (-) strand; PAM type: YTN; PAM sequence: CTT
ggtagaagttgtgagttgag

SEQ ID NO: 183940 - DNA, 20 bp, Artificial Sequence
  Description of Artificial Sequence: Synthetic oligonucleotide
  Target: ATXN1; (-) strand; PAM type: YTN; PAM sequence: CTG
gtgggtcagtccaggggtcc

SEQ ID NO: 183941 - DNA, 20 bp, Artificial Sequence
  Description of Artificial Sequence: Synthetic oligonucleotide
  Target: ATXN1; (-) strand; PAM type: YTN; PAM sequence: CTA
ggccaaagggctggtgggtc

SEQ ID NO: 183942 - DNA, 20 bp, Artificial Sequence
  Description of Artificial Sequence: Synthetic oligonucleotide
  Target: ATXN1; (-) strand; PAM type: YTN; PAM sequence: CTC
taggccaaagggctggtggg

SEQ ID NO: 183943 - DNA, 20 bp, Artificial Sequence
  Description of Artificial Sequence: Synthetic oligonucleotide
  Target: ATXN1; (-) strand; PAM type: YTN; PAM sequence: CTC
cagaggggaacactctaggc

SEQ ID NO: 183944 - DNA, 20 bp, Artificial Sequence
  Description of Artificial Sequence: Synthetic oligonucleotide
  Target: ATXN1; (-) strand; PAM type: YTN; PAM sequence: TTG
tagtgccctccagaggggaa

SEQ ID NO: 183945 - DNA, 20 bp, Artificial Sequence
  Description of Artificial Sequence: Synthetic oligonucleotide
  Target: ATXN1; (-) strand; PAM type: YTN; PAM sequence: CTG
cagttgtagtgccctccaga

SEQ ID NO: 183946 - DNA, 20 bp, Artificial Sequence
  Description of Artificial Sequence: Synthetic oligonucleotide
  Target: ATXN1; (-) strand; PAM type: YTN; PAM sequence: CTG
gataggggtgaagaaggggc

SEQ ID NO: 183947 - DNA, 20 bp, Artificial Sequence
  Description of Artificial Sequence: Synthetic oligonucleotide
  Target: ATXN1; (-) strand; PAM type: YTN; PAM sequence: CTG
ctggataggggtgaagaagg

SEQ ID NO: 183948 - DNA, 20 bp, Artificial Sequence
  Description of Artificial Sequence: Synthetic oligonucleotide
  Target: ATXN1; (-) strand; PAM type: YTN; PAM sequence: TTC
ctgctggataggggtgaaga

SEQ ID NO: 183949 - DNA, 20 bp, Artificial Sequence
  Description of Artificial Sequence: Synthetic oligonucleotide
  Target: ATXN1; (-) strand; PAM type: YTN; PAM sequence: CTT
cctgctggataggggtgaag

SEQ ID NO: 183950 - DNA, 20 bp, Artificial Sequence
  Description of Artificial Sequence: Synthetic oligonucleotide
  Target: ATXN1; (-) strand; PAM type: YTN; PAM sequence: CTA
cttcctgctggataggggtg

SEQ ID NO: 183951 - DNA, 20 bp, Artificial Sequence
  Description of Artificial Sequence: Synthetic oligonucleotide
  Target: ATXN1; (-) strand; PAM type: YTN; PAM sequence: CTA
gctacttcctgctggatagg

SEQ ID NO: 183952 - DNA, 20 bp, Artificial Sequence
  Description of Artificial Sequence: Synthetic oligonucleotide
  Target: ATXN1; (-) strand; PAM type: YTN; PAM sequence: CTC
tagctacttcctgctggata

SEQ ID NO: 183953 - DNA, 20 bp, Artificial Sequence
  Description of Artificial Sequence: Synthetic oligonucleotide
  Target: ATXN1; (-) strand; PAM type: YTN; PAM sequence: CTG
ctctagctacttcctgctgg

SEQ ID NO: 183954 - DNA, 20 bp, Artificial Sequence
  Description of Artificial Sequence: Synthetic oligonucleotide
  Target: ATXN1; (-) strand; PAM type: YTN; PAM sequence: CTG
ggtgatgactgctctagcta

SEQ ID NO: 183955 - DNA, 20 bp, Artificial Sequence
  Description of Artificial Sequence: Synthetic oligonucleotide
  Target: ATXN1; (-) strand; PAM type: YTN; PAM sequence: TTG
ggaactgggtgatgactgct

SEQ ID NO: 183956 - DNA, 20 bp, Artificial Sequence
  Description of Artificial Sequence: Synthetic oligonucleotide
  Target: ATXN1; (-) strand; PAM type: YTN; PAM sequence: CTG
ttgggaactgggtgatgact

SEQ ID NO: 183957 - DNA, 20 bp, Artificial Sequence
  Description of Artificial Sequence: Synthetic oligonucleotide
  Target: ATXN1; (-) strand; PAM type: YTN; PAM sequence: CTG
ctgttgggaactgggtgatg

SEQ ID NO: 183958 - DNA, 20 bp, Artificial Sequence
  Description of Artificial Sequence: Synthetic oligonucleotide
  Target: ATXN1; (-) strand; PAM type: YTN; PAM sequence: CTA
aacaggacaccccagctgct

SEQ ID NO: 183959 - DNA, 20 bp, Artificial Sequence
  Description of Artificial Sequence: Synthetic oligonucleotide
  Target: ATXN1; (-) strand; PAM type: YTN; PAM sequence: CTC
taaacaggacaccccagctg

SEQ ID NO: 183960 - DNA, 20 bp, Artificial Sequence
  Description of Artificial Sequence: Synthetic oligonucleotide
  Target: ATXN1; (-) strand; PAM type: YTN; PAM sequence: CTC
aatcccccctctaaacagga

SEQ ID NO: 183961 - DNA, 20 bp, Artificial Sequence
  Description of Artificial Sequence: Synthetic oligonucleotide
  Target: ATXN1; (-) strand; PAM type: YTN; PAM sequence: CTC
tcaatcccccctctaaacag

SEQ ID NO: 183962 - DNA, 20 bp, Artificial Sequence
  Description of Artificial Sequence: Synthetic oligonucleotide
  Target: ATXN1; (-) strand; PAM type: YTN; PAM sequence: CTC
acctctcaatcccccctcta

SEQ ID NO: 183963 - DNA, 20 bp, Artificial Sequence
  Description of Artificial Sequence: Synthetic oligonucleotide
  Target: ATXN1; (-) strand; PAM type: YTN; PAM sequence: CTG
gcctcacctctcaatccccc

SEQ ID NO: 183964 - DNA, 20 bp, Artificial Sequence
  Description of Artificial Sequence: Synthetic oligonucleotide
  Target: ATXN1; (-) strand; PAM type: YTN; PAM sequence: TTG
acccaggaagtccagctggc

SEQ ID NO: 183965 - DNA, 20 bp, Artificial Sequence
  Description of Artificial Sequence: Synthetic oligonucleotide
  Target: ATXN1; (-) strand; PAM type: YTN; PAM sequence: CTT
gacccaggaagtccagctgg

SEQ ID NO: 183966 - DNA, 20 bp, Artificial Sequence
  Description of Artificial Sequence: Synthetic oligonucleotide
  Target: ATXN1; (-) strand; PAM type: YTN; PAM sequence: CTA
cttgacccaggaagtccagc

SEQ ID NO: 183967 - DNA, 20 bp, Artificial Sequence
  Description of Artificial Sequence: Synthetic oligonucleotide
  Target: ATXN1; (-) strand; PAM type: YTN; PAM sequence: CTC
aagtccctacttgacccagg

SEQ ID NO: 183968 - DNA, 20 bp, Artificial Sequence
  Description of Artificial Sequence: Synthetic oligonucleotide
  Target: ATXN1; (-) strand; PAM type: YTN; PAM sequence: TTC
ctcaagtccctacttgaccc

SEQ ID NO: 183969 - DNA, 20 bp, Artificial Sequence
  Description of Artificial Sequence: Synthetic oligonucleotide
  Target: ATXN1; (-) strand; PAM type: YTN; PAM sequence: TTG
taagacaggaaagttcctca

SEQ ID NO: 183970 - DNA, 20 bp, Artificial Sequence
  Description of Artificial Sequence: Synthetic oligonucleotide
  Target: ATXN1; (-) strand; PAM type: YTN; PAM sequence: CTT
gtaagacaggaaagttcctc

SEQ ID NO: 183971 - DNA, 20 bp, Artificial Sequence
  Description of Artificial Sequence: Synthetic oligonucleotide
  Target: ATXN1; (-) strand; PAM type: YTN; PAM sequence: CTC
ttgtaagacaggaaagttcc

SEQ ID NO: 183972 - DNA, 20 bp, Artificial Sequence
  Description of Artificial Sequence: Synthetic oligonucleotide
  Target: ATXN1; (-) strand; PAM type: YTN; PAM sequence: TTA
catcctcttgtaagacagga

SEQ ID NO: 183973 - DNA, 20 bp, Artificial Sequence
  Description of Artificial Sequence: Synthetic oligonucleotide
  Target: ATXN1; (-) strand; PAM type: YTN; PAM sequence: TTT
acatcctcttgtaagacagg

SEQ ID NO: 183974 - DNA, 20 bp, Artificial Sequence
  Description of Artificial Sequence: Synthetic oligonucleotide
  Target: ATXN1; (-) strand; PAM type: YTN; PAM sequence: TTT
tacatcctcttgtaagacag

SEQ ID NO: 183975 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacatcctcttg

SEQ ID NO: 183976 - DNA, 20 bp, Artificial Sequence
  Description of Artificial Sequence: Synthetic oligonucleotide
  Target: ATXN1; (-) strand; PAM type: YTN; PAM sequence: CTG
attggtgcattttacatcct

SEQ ID NO: 183977 - DNA, 20 bp, Artificial Sequence
  Description of Artificial Sequence: Synthetic oligonucleotide
  Target: ATXN1; (-) strand; PAM type: YTN; PAM sequence: TTC
ctgattggtgcattttacat

SEQ ID NO: 183978 - DNA, 20 bp, Artificial Sequence
  Description of Artificial Sequence: Synthetic oligonucleotide
  Target: ATXN1; (-) strand; PAM type: YTN; PAM sequence: TTG
taagacaggaaagttcctga

SEQ ID NO: 183979 - DNA, 20 bp, Artificial Sequence
  Description of Artificial Sequence: Synthetic oligonucleotide
  Target: ATXN1; (-) strand; PAM type: YTN; PAM sequence: CTT
gtaagacaggaaagttcctg

SEQ ID NO: 183980 - DNA, 20 bp, Artificial Sequence
  Description of Artificial Sequence: Synthetic oligonucleotide
  Target: ATXN1; (-) strand; PAM type: YTN; PAM sequence: CTC
ttgtaagacaggaaagttcc

SEQ ID NO: 183981 - DNA, 20 bp, Artificial Sequence
  Description of Artificial Sequence: Synthetic oligonucleotide
  Target: ATXN1; (-) strand; PAM type: YTN; PAM sequence: TTA
cgaacctcttgtaagacagg

SEQ ID NO: 183982 - DNA, 20 bp, Artificial Sequence
  Description of Artificial Sequence: Synthetic oligonucleotide
  Target: ATXN1; (-) strand; PAM type: YTN; PAM sequence: TTT
acgaacctcttgtaagacag

SEQ ID NO: 183983 - DNA, 20 bp, Artificial Sequence
  Description of Artificial Sequence: Synthetic oligonucleotide
  Target: ATXN1; (-) strand; PAM type: YTN; PAM sequence: TTT
tacgaacctcttgtaagaca

SEQ ID NO: 183984 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacgaacctctt

SEQ ID NO: 183985 - DNA, 20 bp, Artificial Sequence
  Description of Artificial Sequence: Synthetic oligonucleotide
  Target: ATXN1; (-) strand; PAM type: YTN; PAM sequence: CTG
attggtgcattttacgaacc

SEQ ID NO: 183986 - DNA, 20 bp, Artificial Sequence
  Description of Artificial Sequence: Synthetic oligonucleotide
  Target: ATXN1; (-) strand; PAM type: YTN; PAM sequence: TTA
caaagtgctgattggtgcat

SEQ ID NO: 183987 - DNA, 20 bp, Artificial Sequence
  Description of Artificial Sequence: Synthetic oligonucleotide
  Target: ATXN1; (-) strand; PAM type: YTN; PAM sequence: TTT
acaaagtgctgattggtgca

SEQ ID NO: 183988 - DNA, 20 bp, Artificial Sequence
  Description of Artificial Sequence: Synthetic oligonucleotide
  Target: ATXN1; (-) strand; PAM type: YTN; PAM sequence: TTT
tacaaagtgctgattggtgc

SEQ ID NO: 183989 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacaaagtgctg

SEQ ID NO: 183990 - DNA, 20 bp, Artificial Sequence
  Description of Artificial Sequence: Synthetic oligonucleotide
  Target: ATXN1; (-) strand; PAM type: YTN; PAM sequence: TTA
ttggtgcattttacaaagtg

SEQ ID NO: 183991 - DNA, 20 bp, Artificial Sequence
  Description of Artificial Sequence: Synthetic oligonucleotide
  Target: ATXN1; (-) strand; PAM type: YTN; PAM sequence: CTT
attggtgcattttacaaagt

SEQ ID NO: 183992 - DNA, 20 bp, Artificial Sequence
  Description of Artificial Sequence: Synthetic oligonucleotide
  Target: ATXN1; (-) strand; PAM type: YTN; PAM sequence: TTA
cagagcacttattggtgcat

SEQ ID NO: 183993 - DNA, 20 bp, Artificial Sequence
  Description of Artificial Sequence: Synthetic oligonucleotide
  Target: ATXN1; (-) strand; PAM type: YTN; PAM sequence: TTT
acagagcacttattggtgca

SEQ ID NO: 183994 - DNA, 20 bp, Artificial Sequence
  Description of Artificial Sequence: Synthetic oligonucleotide
  Target: ATXN1; (-) strand; PAM type: YTN; PAM sequence: TTT
tacagagcacttattggtgc

SEQ ID NO: 183995 - DNA, 20 bp, Artificial Sequence
  Description of Artificial Sequence: Synthetic oligonucleotide
  Target: ATXN1; (-) strand; PAM type: YTN; PAM sequence: TTG
gtgcgttttacagagcactt

SEQ ID NO: 183996 - DNA, 20 bp, Artificial Sequence
  Description of Artificial Sequence: Synthetic oligonucleotide
  Target: ATXN1; (-) strand; PAM type: YTN; PAM sequence: CTA
attggtgcgttttacagagc

SEQ ID NO: 183997 - DNA, 20 bp, Artificial Sequence
  Description of Artificial Sequence: Synthetic oligonucleotide
  Target: ATXN1; (-) strand; PAM type: YTN; PAM sequence: TTA
cagagcactaattggtgcgt

SEQ ID NO: 183998 - DNA, 20 bp, Artificial Sequence
  Description of Artificial Sequence: Synthetic oligonucleotide
  Target: ATXN1; (-) strand; PAM type: YTN; PAM sequence: TTT
acagagcactaattggtgcg

SEQ ID NO: 183999 - DNA, 20 bp, Artificial Sequence
  Description of Artificial Sequence: Synthetic oligonucleotide
  Target: ATXN1; (-) strand; PAM type: YTN; PAM sequence: TTT
tacagagcactaattggtgc

SEQ ID NO: 184000 - DNA, 20 bp, Artificial Sequence
  Description of Artificial Sequence: Synthetic oligonucleotide
  Target: ATXN1; (-) strand; PAM type: YTN; PAM sequence: TTG
atgcattttacagagcacta

SEQ ID NO: 184001 - DNA, 20 bp, Artificial Sequence
  Description of Artificial Sequence: Synthetic oligonucleotide
  Target: ATXN1; (-) strand; PAM type: YTN; PAM sequence: CTG
attgatgcattttacagagc

SEQ ID NO: 184002 - DNA, 20 bp, Artificial Sequence
  Description of Artificial Sequence: Synthetic oligonucleotide
  Target: ATXN1; (-) strand; PAM type: YTN; PAM sequence: CTG
ctgattgatgcattttacag

SEQ ID NO: 184003 - DNA, 20 bp, Artificial Sequence
  Description of Artificial Sequence: Synthetic oligonucleotide
  Target: ATXN1; (-) strand; PAM type: YTN; PAM sequence: TTA
gaatcctgctgattgatgca

SEQ ID NO: 184004 - DNA, 20 bp, Artificial Sequence
  Description of Artificial Sequence: Synthetic oligonucleotide
  Target: ATXN1; (-) strand; PAM type: YTN; PAM sequence: TTT
agaatcctgctgattgatgc

SEQ ID NO: 184005 - DNA, 20 bp, Artificial Sequence
  Description of Artificial Sequence: Synthetic oligonucleotide
  Target: ATXN1; (-) strand; PAM type: YTN; PAM sequence: CTT
tagaatcctgctgattgatg

SEQ ID NO: 184006 - DNA, 20 bp, Artificial Sequence
  Description of Artificial Sequence: Synthetic oligonucleotide
  Target: ATXN1; (-) strand; PAM type: YTN; PAM sequence: CTA
cctttagaatcctgctgatt

SEQ ID NO: 184007 - DNA, 20 bp, Artificial Sequence
  Description of Artificial Sequence: Synthetic oligonucleotide
  Target: ATXN1; (-) strand; PAM type: YTN; PAM sequence: TTG
gctacctttagaatcctgct

SEQ ID NO: 184008 - DNA, 20 bp, Artificial Sequence
  Description of Artificial Sequence: Synthetic oligonucleotide
  Target: ATXN1; (-) strand; PAM type: YTN; PAM sequence: CTG
cgattggctacctttagaat

SEQ ID NO: 184009 - DNA, 20 bp, Artificial Sequence
  Description of Artificial Sequence: Synthetic oligonucleotide
  Target: ATXN1; (-) strand; PAM type: YTN; PAM sequence: CTC
cctgcgattggctaccttta

SEQ ID NO: 184010 - DNA, 20 bp, Artificial Sequence
  Description of Artificial Sequence: Synthetic oligonucleotide
  Target: ATXN1; (-) strand; PAM type: YTN; PAM sequence: TTC
aatcctccctgcgattggct

SEQ ID NO: 184011 - DNA, 20 bp, Artificial Sequence
  Description of Artificial Sequence: Synthetic oligonucleotide
  Target: ATXN1; (-) strand; PAM type: YTN; PAM sequence: TTT
caatcctccctgcgattggc

SEQ ID NO: 184012 - DNA, 20 bp, Artificial Sequence
  Description of Artificial Sequence: Synthetic oligonucleotide
  Target: ATXN1; (-) strand; PAM type: YTN; PAM sequence: TTT
tcaatcctccctgcgattgg

SEQ ID NO: 184013 - DNA, 20 bp, Artificial Sequence
  Description of Artificial Sequence: Synthetic oligonucleotide
  Target: ATXN1; (-) strand; PAM type: YTN; PAM sequence: TTT
ttcaatcctccctgcgattg

SEQ ID NO: 184014 - DNA, 20 bp, Artificial Sequence
  Description of Artificial Sequence: Synthetic oligonucleotide
  Target: ATXN1; (-) strand; PAM type: YTN; PAM sequence: TTT
tttcaatcctccctgcgatt

SEQ ID NO: 184015 - DNA, 20 bp, Artificial Sequence
  Description of Artificial Sequence: Synthetic oligonucleotide
  Target: ATXN1; (-) strand; PAM type: YTN; PAM sequence: TTT
ttttcaatcctccctgcgat

SEQ ID NO: 184016 - DNA, 20 bp, Artificial Sequence
  Description of Artificial Sequence: Synthetic oligonucleotide
  Target: ATXN1; (-) strand; PAM type: YTN; PAM sequence: CTT
tttttcaatcctccctgcga

SEQ ID NO: 184017 - DNA, 20 bp, Artificial Sequence
  Description of Artificial Sequence: Synthetic oligonucleotide
  Target: ATXN1; (-) strand; PAM type: YTN; PAM sequence: CTG
tcagagtgccctttttttca

SEQ ID NO: 184018 - DNA, 20 bp, Artificial Sequence
  Description of Artificial Sequence: Synthetic oligonucleotide
  Target: ATXN1; (-) strand; PAM type: YTN; PAM sequence: TTC
tgtcagagtgcccttttttt

SEQ ID NO: 184019 - DNA, 20 bp, Artificial Sequence
  Description of Artificial Sequence: Synthetic oligonucleotide
  Target: ATXN1; (-) strand; PAM type: YTN; PAM sequence: CTG
ttctgtcagagtgccctttt

SEQ ID NO: 184020 - DNA, 20 bp, Artificial Sequence
  Description of Artificial Sequence: Synthetic oligonucleotide
  Target: ATXN1; (-) strand; PAM type: YTN; PAM sequence: TTC
tgttctgtcagagtgccctt

SEQ ID NO: 184021 - DNA, 20 bp, Artificial Sequence
  Description of Artificial Sequence: Synthetic oligonucleotide
  Target: ATXN1; (-) strand; PAM type: YTN; PAM sequence: TTT
ctgttctgtcagagtgccct

SEQ ID NO: 184022 - DNA, 20 bp, Artificial Sequence
  Description of Artificial Sequence: Synthetic oligonucleotide
  Target: ATXN1; (-) strand; PAM type: YTN; PAM sequence: TTC
catttctgttctgtcagagt

SEQ ID NO: 184023 - DNA, 20 bp, Artificial Sequence
  Description of Artificial Sequence: Synthetic oligonucleotide
  Target: ATXN1; (-) strand; PAM type: YTN; PAM sequence: CTG
cccatgttccatttctgttc

SEQ ID NO: 184024 - DNA, 20 bp, Artificial Sequence
  Description of Artificial Sequence: Synthetic oligonucleotide
  Target: ATXN1; (-) strand; PAM type: YTN; PAM sequence: TTG
tccctgcccatgttccattt

SEQ ID NO: 184025 - DNA, 20 bp, Artificial Sequence
  Description of Artificial Sequence: Synthetic oligonucleotide
  Target: ATXN1; (-) strand; PAM type: YTN; PAM sequence: TTT
gtccctgcccatgttccatt

SEQ ID NO: 184026 - DNA, 20 bp, Artificial Sequence
  Description of Artificial Sequence: Synthetic oligonucleotide
  Target: ATXN1; (-) strand; PAM type: YTN; PAM sequence: TTA
tttgtccctgcccatgttcc

SEQ ID NO: 184027 - DNA, 20 bp, Artificial Sequence
  Description of Artificial Sequence: Synthetic oligonucleotide
  Target: ATXN1; (-) strand; PAM type: YTN; PAM sequence: CTT
atttgtccctgcccatgttc

SEQ ID NO: 184028 - DNA, 20 bp, Artificial Sequence
  Description of Artificial Sequence: Synthetic oligonucleotide
  Target: ATXN1; (-) strand; PAM type: YTN; PAM sequence: TTC
ccttatttgtccctgcccat

SEQ ID NO: 184029 - DNA, 20 bp, Artificial Sequence
  Description of Artificial Sequence: Synthetic oligonucleotide
  Target: ATXN1; (-) strand; PAM type: YTN; PAM sequence: TTA
ttcccttatttgtccctgcc

SEQ ID NO: 184030 - DNA, 20 bp, Artificial Sequence
  Description of Artificial Sequence: Synthetic oligonucleotide
  Target: ATXN1; (-) strand; PAM type: YTN; PAM sequence: TTT
attcccttatttgtccctgc

SEQ ID NO: 184031 - DNA, 20 bp, Artificial Sequence
  Description of Artificial Sequence: Synthetic oligonucleotide
  Target: ATXN1; (-) strand; PAM type: YTN; PAM sequence: TTT
tattcccttatttgtccctg

SEQ ID NO: 184032 - DNA, 20 bp, Artificial Sequence
  Description of Artificial Sequence: Synthetic oligonucleotide
  Target: ATXN1; (-) strand; PAM type: YTN; PAM sequence: CTT
ttattcccttatttgtccct

SEQ ID NO: 184033 - DNA, 20 bp, Artificial Sequence
  Description of Artificial Sequence: Synthetic oligonucleotide
  Target: ATXN1; (-) strand; PAM type: YTN; PAM sequence: CTG
tggtggccagcttttattcc

SEQ ID NO: 184034 - DNA, 20 bp, Artificial Sequence
  Description of Artificial Sequence: Synthetic oligonucleotide
  Target: ATXN1; (-) strand; PAM type: YTN; PAM sequence: CTG
gctgtggtggccagctttta

SEQ ID NO: 184035 - DNA, 20 bp, Artificial Sequence
  Description of Artificial Sequence: Synthetic oligonucleotide
  Target: ATXN1; (-) strand; PAM type: YTN; PAM sequence: CTG
ctggctgtggtggccagctt

SEQ ID NO: 184036 - DNA, 20 bp, Artificial Sequence
  Description of Artificial Sequence: Synthetic oligonucleotide
  Target: ATXN1; (-) strand; PAM type: YTN; PAM sequence: CTG
ctgctggctgtggtggccag

SEQ ID NO: 184037 - DNA, 20 bp, Artificial Sequence
  Description of Artificial Sequence: Synthetic oligonucleotide
  Target: ATXN1; (-) strand; PAM type: YTN; PAM sequence: TTG
ctgctgctggctgtggtggc

SEQ ID NO: 184038 - DNA, 20 bp, Artificial Sequence
  Description of Artificial Sequence: Synthetic oligonucleotide
  Target: ATXN1; (-) strand; PAM type: YTN; PAM sequence: TTC
cacagcgtggaaggggaccc

SEQ ID NO: 184039 - DNA, 20 bp, Artificial Sequence
  Description of Artificial Sequence: Synthetic oligonucleotide
  Target: ATXN1; (-) strand; PAM type: YTN; PAM sequence: CTT
ccacagcgtggaaggggacc

SEQ ID NO: 184040 - DNA, 20 bp, Artificial Sequence
  Description of Artificial Sequence: Synthetic oligonucleotide
  Target: ATXN1; (-) strand; PAM type: YTN; PAM sequence: TTG
tgaagagcaaaaggacaaag

SEQ ID NO: 184041 - DNA, 20 bp, Artificial Sequence
  Description of Artificial Sequence: Synthetic oligonucleotide
  Target: ATXN1; (-) strand; PAM type: YTN; PAM sequence: TTA
ttgtgaagagcaaaaggaca

SEQ ID NO: 184042 - DNA, 20 bp, Artificial Sequence
  Description of Artificial Sequence: Synthetic oligonucleotide
  Target: ATXN1; (-) strand; PAM type: YTN; PAM sequence: TTT
attgtgaagagcaaaaggac

SEQ ID NO: 184043 - DNA, 20 bp, Artificial Sequence
  Description of Artificial Sequence: Synthetic oligonucleotide
  Target: ATXN1; (-) strand; PAM type: YTN; PAM sequence: TTA
aagatggcatggacccaaag

SEQ ID NO: 184044 - DNA, 20 bp, Artificial Sequence
  Description of Artificial Sequence: Synthetic oligonucleotide
  Target: ATXN1; (-) strand; PAM type: YTN; PAM sequence: CTT
aaagatggcatggacccaaa

SEQ ID NO: 184045 - DNA, 20 bp, Artificial Sequence
  Description of Artificial Sequence: Synthetic oligonucleotide
  Target: ATXN1; (-) strand; PAM type: YTN; PAM sequence: CTC
ttaaagatggcatggaccca

SEQ ID NO: 184046 - DNA, 20 bp, Artificial Sequence
  Description of Artificial Sequence: Synthetic oligonucleotide
  Target: ATXN1; (-) strand; PAM type: YTN; PAM sequence: TTA
cagctcttaaagatggcatg

SEQ ID NO: 184047 - DNA, 20 bp, Artificial Sequence
  Description of Artificial Sequence: Synthetic oligonucleotide
  Target: ATXN1; (-) strand; PAM type: YTN; PAM sequence: TTC
atggtgagtgttacagctct

SEQ ID NO: 184048 - DNA, 20 bp, Artificial Sequence
  Description of Artificial Sequence: Synthetic oligonucleotide
  Target: ATXN1; (-) strand; PAM type: YTN; PAM sequence: CTT
catggtgagtgttacagctc

SEQ ID NO: 184049 - DNA, 20 bp, Artificial Sequence
  Description of Artificial Sequence: Synthetic oligonucleotide
  Target: ATXN1; (-) strand; PAM type: YTN; PAM sequence: CTG
cggaccttcatggtgagtgt

SEQ ID NO: 184050 - DNA, 20 bp, Artificial Sequence
  Description of Artificial Sequence: Synthetic oligonucleotide
  Target: ATXN1; (-) strand; PAM type: YTN; PAM sequence: TTC
aagaatggagctgcggacct

SEQ ID NO: 184051 - DNA, 20 bp, Artificial Sequence
  Description of Artificial Sequence: Synthetic oligonucleotide
  Target: ATXN1; (-) strand; PAM type: YTN; PAM sequence: CTT
caagaatggagctgcggacc

SEQ ID NO: 184052 - DNA, 20 bp, Artificial Sequence
  Description of Artificial Sequence: Synthetic oligonucleotide
  Target: ATXN1; (-) strand; PAM type: YTN; PAM sequence: CTG
acttcaagaatggagctgcg

SEQ ID NO: 184053 - DNA, 20 bp, Artificial Sequence
  Description of Artificial Sequence: Synthetic oligonucleotide
  Target: ATXN1; (-) strand; PAM type: YTN; PAM sequence: CTC
gctgacttcaagaatggagc

SEQ ID NO: 184054 - DNA, 20 bp, Artificial Sequence
  Description of Artificial Sequence: Synthetic oligonucleotide
  Target: ATXN1; (-) strand; PAM type: YTN; PAM sequence: TTA
tggtctcgctgacttcaaga

SEQ ID NO: 184055 - DNA, 20 bp, Artificial Sequence
  Description of Artificial Sequence: Synthetic oligonucleotide
  Target: ATXN1; (-) strand; PAM type: YTN; PAM sequence: TTT
atggtctcgctgacttcaag

SEQ ID NO: 184056 - DNA, 20 bp, Artificial Sequence
  Description of Artificial Sequence: Synthetic oligonucleotide
  Target: ATXN1; (-) strand; PAM type: YTN; PAM sequence: CTA
ccggtgggtttatggtctcg

SEQ ID NO: 184057 - DNA, 20 bp, Artificial Sequence
  Description of Artificial Sequence: Synthetic oligonucleotide
  Target: ATXN1; (-) strand; PAM type: YTN; PAM sequence: TTC
ctaccggtgggtttatggtc

SEQ ID NO: 184058 - DNA, 20 bp, Artificial Sequence
  Description of Artificial Sequence: Synthetic oligonucleotide
  Target: ATXN1; (-) strand; PAM type: YTN; PAM sequence: TTG
gttcctaccggtgggtttat

SEQ ID NO: 184059 - DNA, 20 bp, Artificial Sequence
  Description of Artificial Sequence: Synthetic oligonucleotide
  Target: ATXN1; (-) strand; PAM type: YTN; PAM sequence: CTG
gagttggttcctaccggtgg

SEQ ID NO: 184060 - DNA, 20 bp, Artificial Sequence
  Description of Artificial Sequence: Synthetic oligonucleotide
  Target: ATXN1; (-) strand; PAM type: YTN; PAM sequence: TTG
tgtctggagttggttcctac

SEQ ID NO: 184061 - DNA, 20 bp, Artificial Sequence
  Description of Artificial Sequence: Synthetic oligonucleotide
  Target: ATXN1; (-) strand; PAM type: YTN; PAM sequence: TTT
gtgtctggagttggttccta

SEQ ID NO: 184062 - DNA, 20 bp, Artificial Sequence
  Description of Artificial Sequence: Synthetic oligonucleotide
  Target: ATXN1; (-) strand; PAM type: YTN; PAM sequence: TTT
tgtgtctggagttggttcct

SEQ ID NO: 184063 - DNA, 20 bp, Artificial Sequence
  Description of Artificial Sequence: Synthetic oligonucleotide
  Target: ATXN1; (-) strand; PAM type: YTN; PAM sequence: TTT
ttgtgtctggagttggttcc

SEQ ID NO: 184064 - DNA, 20 bp, Artificial Sequence
  Description of Artificial Sequence: Synthetic oligonucleotide
  Target: ATXN1; (-) strand; PAM type: YTN; PAM sequence: CTT
tttgtgtctggagttggttc

SEQ ID NO: 184065 - DNA, 20 bp, Artificial Sequence
  Description of Artificial Sequence: Synthetic oligonucleotide
  Target: ATXN1; (-) strand; PAM type: YTN; PAM sequence: CTA
tgtctttttgtgtctggagt

SEQ ID NO: 184066 - DNA, 20 bp, Artificial Sequence
  Description of Artificial Sequence: Synthetic oligonucleotide
  Target: ATXN1; (-) strand; PAM type: YTN; PAM sequence: CTC
tatgtctttttgtgtctgga

SEQ ID NO: 184067 - DNA, 20 bp, Artificial Sequence
  Description of Artificial Sequence: Synthetic oligonucleotide
  Target: ATXN1; (-) strand; PAM type: YTN; PAM sequence: TTC
ctctatgtctttttgtgtct

SEQ ID NO: 184068 - DNA, 20 bp, Artificial Sequence
  Description of Artificial Sequence: Synthetic oligonucleotide
  Target: ATXN1; (-) strand; PAM type: YTN; PAM sequence: TTT
cctctatgtctttttgtgtc

SEQ ID NO: 184069 - DNA, 20 bp, Artificial Sequence
  Description of Artificial Sequence: Synthetic oligonucleotide
  Target: ATXN1; (-) strand; PAM type: YTN; PAM sequence: TTC
atgtggcaatatgcgtgtaa

SEQ ID NO: 184070 - DNA, 20 bp, Artificial Sequence
  Description of Artificial Sequence: Synthetic oligonucleotide
  Target: ATXN1; (-) strand; PAM type: YTN; PAM sequence: TTT
catgtggcaatatgcgtgta

SEQ ID NO: 184071 - DNA, 20 bp, Artificial Sequence
  Description of Artificial Sequence: Synthetic oligonucleotide
  Target: ATXN1; (-) strand; PAM type: YTN; PAM sequence: CTT
tcatgtggcaatatgcgtgt

SEQ ID NO: 184072 - DNA, 20 bp, Artificial Sequence
  Description of Artificial Sequence: Synthetic oligonucleotide
  Target: ATXN1; (-) strand; PAM type: YTN; PAM sequence: TTC
tttcatgtggcaatatgcgt

SEQ ID NO: 184073 - DNA, 20 bp, Artificial Sequence
  Description of Artificial Sequence: Synthetic oligonucleotide
  Target: ATXN1; (-) strand; PAM type: YTN; PAM sequence: CTT
ctttcatgtggcaatatgcg

SEQ ID NO: 184074 - DNA, 20 bp, Artificial Sequence
  Description of Artificial Sequence: Synthetic oligonucleotide
  Target: ATXN1; (-) strand; PAM type: YTN; PAM sequence: TTG
gcttctttcatgtggcaata

SEQ ID NO: 184075 - DNA, 20 bp, Artificial Sequence
  Description of Artificial Sequence: Synthetic oligonucleotide
  Target: ATXN1; (-) strand; PAM type: YTN; PAM sequence: TTC
acattggcttctttcatgtg

SEQ ID NO: 184076 - DNA, 20 bp, Artificial Sequence
  Description of Artificial Sequence: Synthetic oligonucleotide
  Target: ATXN1; (-) strand; PAM type: YTN; PAM sequence: TTT
cacattggcttctttcatgt

SEQ ID NO: 184077 - DNA, 20 bp, Artificial Sequence
  Description of Artificial Sequence: Synthetic oligonucleotide
  Target: ATXN1; (-) strand; PAM type: YTN; PAM sequence: TTT
tcacattggcttctttcatg

SEQ ID NO: 184078 - DNA, 20 bp, Artificial Sequence
  Description of Artificial Sequence: Synthetic oligonucleotide
  Target: ATXN1; (-) strand; PAM type: YTN; PAM sequence: CTT
ttcacattggcttctttcat

SEQ ID NO: 184079 - DNA, 20 bp, Artificial Sequence
  Description of Artificial Sequence: Synthetic oligonucleotide
  Target: ATXN1; (-) strand; PAM type: YTN; PAM sequence: TTG
gaatcatacagtatgtaccc

SEQ ID NO: 184080 - DNA, 20 bp, Artificial Sequence
  Description of Artificial Sequence: Synthetic oligonucleotide
  Target: ATXN1; (-) strand; PAM type: YTN; PAM sequence: TTC
caaaatgtcataaagttgga

SEQ ID NO: 184081 - DNA, 20 bp, Artificial Sequence
  Description of Artificial Sequence: Synthetic oligonucleotide
  Target: ATXN1; (-) strand; PAM type: YTN; PAM sequence: TTT
ccaaaatgtcataaagttgg

SEQ ID NO: 184082 - DNA, 20 bp, Artificial Sequence
  Description of Artificial Sequence: Synthetic oligonucleotide
  Target: ATXN1; (-) strand; PAM type: YTN; PAM sequence: TTT
tccaaaatgtcataaagttg

SEQ ID NO: 184083 - DNA, 20 bp, Artificial Sequence
  Description of Artificial Sequence: Synthetic oligonucleotide
  Target: ATXN1; (-) strand; PAM type: YTN; PAM sequence: CTT
ttccaaaatgtcataaagtt

SEQ ID NO: 184084 - DNA, 20 bp, Artificial Sequence
  Description of Artificial Sequence: Synthetic oligonucleotide
  Target: ATXN1; (-) strand; PAM type: YTN; PAM sequence: TTG
ccttttccaaaatgtcataa

SEQ ID NO: 184085 - DNA, 20 bp, Artificial Sequence
  Description of Artificial Sequence: Synthetic oligonucleotide
  Target: ATXN1; (-) strand; PAM type: YTN; PAM sequence: TTT
gccttttccaaaatgtcata

SEQ ID NO: 184086 - DNA, 20 bp, Artificial Sequence
  Description of Artificial Sequence: Synthetic oligonucleotide
  Target: ATXN1; (-) strand; PAM type: YTN; PAM sequence: CTT
tgccttttccaaaatgtcat

SEQ ID NO: 184087 - DNA, 20 bp, Artificial Sequence
  Description of Artificial Sequence: Synthetic oligonucleotide
  Target: ATXN1; (-) strand; PAM type: YTN; PAM sequence: CTG
tagctttgccttttccaaaa

SEQ ID NO: 184088 - DNA, 20 bp, Artificial Sequence
  Description of Artificial Sequence: Synthetic oligonucleotide
  Target: ATXN1; (-) strand; PAM type: YTN; PAM sequence: CTA
tccctgtagctttgcctttt

SEQ ID NO: 184089 - DNA, 20 bp, Artificial Sequence
  Description of Artificial Sequence: Synthetic oligonucleotide
  Target: ATXN1; (-) strand; PAM type: YTN; PAM sequence: TTA
ctatccctgtagctttgcct

SEQ ID NO: 184090 - DNA, 20 bp, Artificial Sequence
  Description of Artificial Sequence: Synthetic oligonucleotide
  Target: ATXN1; (-) strand; PAM type: YTN; PAM sequence: TTT
actatccctgtagctttgcc

SEQ ID NO: 184091 - DNA, 20 bp, Artificial Sequence
  Description of Artificial Sequence: Synthetic oligonucleotide
  Target: ATXN1; (-) strand; PAM type: YTN; PAM sequence: TTT
tactatccctgtagctttgc

SEQ ID NO: 184092 - DNA, 20 bp, Artificial Sequence
  Description of Artificial Sequence: Synthetic oligonucleotide
  Target: ATXN1; (-) strand; PAM type: YTN; PAM sequence: TTT
ttactatccctgtagctttg

SEQ ID NO: 184093 - DNA, 20 bp, Artificial Sequence
  Description of Artificial Sequence: Synthetic oligonucleotide
  Target: ATXN1; (-) strand; PAM type: YTN; PAM sequence: TTT
tttactatccctgtagcttt

SEQ ID NO: 184094 - DNA, 20 bp, Artificial Sequence
  Description of Artificial Sequence: Synthetic oligonucleotide
  Target: ATXN1; (-) strand; PAM type: YTN; PAM sequence: TTT
ttttactatccctgtagctt

SEQ ID NO: 184095 - DNA, 20 bp, Artificial Sequence
  Description of Artificial Sequence: Synthetic oligonucleotide
  Target: ATXN1; (-) strand; PAM type: YTN; PAM sequence: TTT
tttttactatccctgtagct

SEQ ID NO: 184096 - DNA, 20 bp, Artificial Sequence
  Description of Artificial Sequence: Synthetic oligonucleotide
  Target: ATXN1; (-) strand; PAM type: YTN; PAM sequence: TTT
ttttttactatccctgtagc

SEQ ID NO: 184097 - DNA, 20 bp, Artificial Sequence
  Description of Artificial Sequence: Synthetic oligonucleotide
  Target: ATXN1; (-) strand; PAM type: YTN; PAM sequence: TTT
tttttttactatccctgtag

SEQ ID NO: 184098 - DNA, 20 bp, Artificial Sequence
  Description of Artificial Sequence: Synthetic oligonucleotide
  Target: ATXN1; (-) strand; PAM type: YTN; PAM sequence: TTT
ttttttttactatccctgta

SEQ ID NO: 184099 - DNA, 20 bp, Artificial Sequence
  Description of Artificial Sequence: Synthetic oligonucleotide
  Target: ATXN1; (-) strand; PAM type: YTN; PAM sequence: TTT
tttttttttactatccctgt

SEQ ID NO: 184100 - DNA, 20 bp, Artificial Sequence
  Description of Artificial Sequence: Synthetic oligonucleotide
  Target: ATXN1; (-) strand; PAM type: YTN; PAM sequence: TTT
ttttttttttactatccctg

SEQ ID NO: 184101 - DNA, 20 bp, Artificial Sequence
  Description of Artificial Sequence: Synthetic oligonucleotide
  Target: ATXN1; (-) strand; PAM type: YTN; PAM sequence: TTT
tttttttttttactatccct

SEQ ID NO: 184102 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttactatccc

SEQ ID NO: 184103 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttactatcc

SEQ ID NO: 184104 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttactatc

SEQ ID NO: 184105 - DNA, 20 bp, Artificial Sequence
  Description of Artificial Sequence: Synthetic oligonucleotide
  Target: ATXN1; (-) strand; PAM type: YTN; PAM sequence: CTG
atttttttttttttttttac

SEQ ID NO: 184106 - DNA, 20 bp, Artificial Sequence
  Description of Artificial Sequence: Synthetic oligonucleotide
  Target: ATXN1; (-) strand; PAM type: YTN; PAM sequence: CTC
ccaatccccaaaacccctga

SEQ ID NO: 184107 - DNA, 20 bp, Artificial Sequence
  Description of Artificial Sequence: Synthetic oligonucleotide
  Target: ATXN1; (-) strand; PAM type: YTN; PAM sequence: TTC
ctcccaatccccaaaacccc

SEQ ID NO: 184108 - DNA, 20 bp, Artificial Sequence
  Description of Artificial Sequence: Synthetic oligonucleotide
  Target: ATXN1; (-) strand; PAM type: YTN; PAM sequence: TTG
ttcctcccaatccccaaaac

SEQ ID NO: 184109 - DNA, 20 bp, Artificial Sequence
  Description of Artificial Sequence: Synthetic oligonucleotide
  Target: ATXN1; (-) strand; PAM type: YTN; PAM sequence: TTT
gttcctcccaatccccaaaa

SEQ ID NO: 184110 - DNA, 20 bp, Artificial Sequence
  Description of Artificial Sequence: Synthetic oligonucleotide
  Target: ATXN1; (-) strand; PAM type: YTN; PAM sequence: TTA
tttgttcctcccaatcccca

SEQ ID NO: 184111 - DNA, 20 bp, Artificial Sequence
  Description of Artificial Sequence: Synthetic oligonucleotide
  Target: ATXN1; (-) strand; PAM type: YTN; PAM sequence: CTT
atttgttcctcccaatcccc

SEQ ID NO: 184112 - DNA, 20 bp, Artificial Sequence
  Description of Artificial Sequence: Synthetic oligonucleotide
  Target: ATXN1; (-) strand; PAM type: YTN; PAM sequence: CTG
cttatttgttcctcccaatc

SEQ ID NO: 184113 - DNA, 20 bp, Artificial Sequence
  Description of Artificial Sequence: Synthetic oligonucleotide
  Target: ATXN1; (-) strand; PAM type: YTN; PAM sequence: CTC
tgcttatttgttcctcccaa

SEQ ID NO: 184114 - DNA, 20 bp, Artificial Sequence
  Description of Artificial Sequence: Synthetic oligonucleotide
  Target: ATXN1; (-) strand; PAM type: YTN; PAM sequence: TTG
tgctctgcttatttgttcct

SEQ ID NO: 184115 - DNA, 20 bp, Artificial Sequence
  Description of Artificial Sequence: Synthetic oligonucleotide
  Target: ATXN1; (-) strand; PAM type: YTN; PAM sequence: TTT
gtgctctgcttatttgttcc

SEQ ID NO: 184116 - DNA, 20 bp, Artificial Sequence
  Description of Artificial Sequence: Synthetic oligonucleotide
  Target: ATXN1; (-) strand; PAM type: YTN; PAM sequence: CTT
tgtgctctgcttatttgttc

SEQ ID NO: 184117 - DNA, 20 bp, Artificial Sequence
  Description of Artificial Sequence: Synthetic oligonucleotide
  Target: ATXN1; (-) strand; PAM type: YTN; PAM sequence: CTC
tttgtgctctgcttatttgt

SEQ ID NO: 184118 - DNA, 20 bp, Artificial Sequence
  Description of Artificial Sequence: Synthetic oligonucleotide
  Target: ATXN1; (-) strand; PAM type: YTN; PAM sequence: CTA
acaactctttgtgctctgct

SEQ ID NO: 184119 - DNA, 20 bp, Artificial Sequence
  Description of Artificial Sequence: Synthetic oligonucleotide
  Target: ATXN1; (-) strand; PAM type: YTN; PAM sequence: TTG
acaaatagatgacatgtgtc

SEQ ID NO: 184120 - DNA, 20 bp, Artificial Sequence
  Description of Artificial Sequence: Synthetic oligonucleotide
  Target: ATXN1; (-) strand; PAM type: YTN; PAM sequence: TTT
gacaaatagatgacatgtgt

SEQ ID NO: 184121 - DNA, 20 bp, Artificial Sequence
  Description of Artificial Sequence: Synthetic oligonucleotide
  Target: ATXN1; (-) strand; PAM type: YTN; PAM sequence: CTG
tgtttgacaaatagatgaca

SEQ ID NO: 184122 - DNA, 20 bp, Artificial Sequence
  Description of Artificial Sequence: Synthetic oligonucleotide
  Target: ATXN1; (-) strand; PAM type: YTN; PAM sequence: TTC
tgtgtttgacaaatagatga

SEQ ID NO: 184123 - DNA, 20 bp, Artificial Sequence
  Description of Artificial Sequence: Synthetic oligonucleotide
  Target: ATXN1; (-) strand; PAM type: YTN; PAM sequence: TTG
tacattctgtgtttgacaaa

SEQ ID NO: 184124 - DNA, 20 bp, Artificial Sequence
  Description of Artificial Sequence: Synthetic oligonucleotide
  Target: ATXN1; (-) strand; PAM type: YTN; PAM sequence: CTG
ttgtacattctgtgtttgac

SEQ ID NO: 184125 - DNA, 20 bp, Artificial Sequence
  Description of Artificial Sequence: Synthetic oligonucleotide
  Target: ATXN1; (-) strand; PAM type: YTN; PAM sequence: TTC
ctgttgtacattctgtgttt

SEQ ID NO: 184126 - DNA, 20 bp, Artificial Sequence
  Description of Artificial Sequence: Synthetic oligonucleotide
  Target: ATXN1; (-) strand; PAM type: YTN; PAM sequence: CTT
cctgttgtacattctgtgtt

SEQ ID NO: 184127 - DNA, 20 bp, Artificial Sequence
  Description of Artificial Sequence: Synthetic oligonucleotide
  Target: ATXN1; (-) strand; PAM type: YTN; PAM sequence: TTC
ttcctgttgtacattctgtg

SEQ ID NO: 184128 - DNA, 20 bp, Artificial Sequence
  Description of Artificial Sequence: Synthetic oligonucleotide
  Target: ATXN1; (-) strand; PAM type: YTN; PAM sequence: TTC
attcttcctgttgtacattc

SEQ ID NO: 184129 - DNA, 20 bp, Artificial Sequence
  Description of Artificial Sequence: Synthetic oligonucleotide
  Target: ATXN1; (-) strand; PAM type: YTN; PAM sequence: TTA
gagttcattcttcctgttgt

SEQ ID NO: 184130 - DNA, 20 bp, Artificial Sequence
  Description of Artificial Sequence: Synthetic oligonucleotide
  Target: ATXN1; (-) strand; PAM type: YTN; PAM sequence: TTC
atgttagagttcattcttcc

SEQ ID NO: 184131 - DNA, 20 bp, Artificial Sequence
  Description of Artificial Sequence: Synthetic oligonucleotide
  Target: ATXN1; (-) strand; PAM type: YTN; PAM sequence: CTA
tagttcatgttagagttcat

SEQ ID NO: 184132 - DNA, 20 bp, Artificial Sequence
  Description of Artificial Sequence: Synthetic oligonucleotide
  Target: ATXN1; (-) strand; PAM type: YTN; PAM sequence: CTA
aagtctatagttcatgttag

SEQ ID NO: 184133 - DNA, 20 bp, Artificial Sequence
  Description of Artificial Sequence: Synthetic oligonucleotide
  Target: ATXN1; (-) strand; PAM type: YTN; PAM sequence: TTA
actaaagtctatagttcatg

SEQ ID NO: 184134 - DNA, 20 bp, Artificial Sequence
  Description of Artificial Sequence: Synthetic oligonucleotide
  Target: ATXN1; (-) strand; PAM type: YTN; PAM sequence: TTA
ttaactaaagtctatagttc

SEQ ID NO: 184135 - DNA, 20 bp, Artificial Sequence
  Description of Artificial Sequence: Synthetic oligonucleotide
  Target: ATXN1; (-) strand; PAM type: YTN; PAM sequence: TTA
ttattaactaaagtctatag

SEQ ID NO: 184136 - DNA, 20 bp, Artificial Sequence
  Description of Artificial Sequence: Synthetic oligonucleotide
  Target: ATXN1; (-) strand; PAM type: YTN; PAM sequence: CTA
atatggatacattattatta

SEQ ID NO: 184137 - DNA, 20 bp, Artificial Sequence
  Description of Artificial Sequence: Synthetic oligonucleotide
  Target: ATXN1; (-) strand; PAM type: YTN; PAM sequence: TTG
aactaatatggatacattat

SEQ ID NO: 184138 - DNA, 20 bp, Artificial Sequence
  Description of Artificial Sequence: Synthetic oligonucleotide
  Target: ATXN1; (-) strand; PAM type: YTN; PAM sequence: TTG
aaattgaactaatatggata

SEQ ID NO: 184139 - DNA, 20 bp, Artificial Sequence
  Description of Artificial Sequence: Synthetic oligonucleotide
  Target: ATXN1; (-) strand; PAM type: YTN; PAM sequence: TTG
ttgaaattgaactaatatgg

SEQ ID NO: 184140 - DNA, 20 bp, Artificial Sequence
  Description of Artificial Sequence: Synthetic oligonucleotide
  Target: ATXN1; (-) strand; PAM type: YTN; PAM sequence: TTT
gttgaaattgaactaatatg

SEQ ID NO: 184141 - DNA, 20 bp, Artificial Sequence
  Description of Artificial Sequence: Synthetic oligonucleotide
  Target: ATXN1; (-) strand; PAM type: YTN; PAM sequence: TTA
catttgttgaaattgaacta

SEQ ID NO: 184142 - DNA, 20 bp, Artificial Sequence
  Description of Artificial Sequence: Synthetic oligonucleotide
  Target: ATXN1; (-) strand; PAM type: YTN; PAM sequence: CTT
acatttgttgaaattgaact

SEQ ID NO: 184143 - DNA, 20 bp, Artificial Sequence
  Description of Artificial Sequence: Synthetic oligonucleotide
  Target: ATXN1; (-) strand; PAM type: YTN; PAM sequence: TTG
catcttacatttgttgaaat

SEQ ID NO: 184144 - DNA, 20 bp, Artificial Sequence
  Description of Artificial Sequence: Synthetic oligonucleotide
  Target: ATXN1; (-) strand; PAM type: YTN; PAM sequence: CTT
gcatcttacatttgttgaaa

SEQ ID NO: 184145 - DNA, 20 bp, Artificial Sequence
  Description of Artificial Sequence: Synthetic oligonucleotide
  Target: ATXN1; (-) strand; PAM type: YTN; PAM sequence: CTA
acatcttgcatcttacattt

SEQ ID NO: 184146 - DNA, 20 bp, Artificial Sequence
  Description of Artificial Sequence: Synthetic oligonucleotide
  Target: ATXN1; (-) strand; PAM type: YTN; PAM sequence: CTG
ctaacatcttgcatcttaca

SEQ ID NO: 184147 - DNA, 20 bp, Artificial Sequence
  Description of Artificial Sequence: Synthetic oligonucleotide
  Target: ATXN1; (-) strand; PAM type: YTN; PAM sequence: CTA
ctgctaacatcttgcatctt

SEQ ID NO: 184148 - DNA, 20 bp, Artificial Sequence
  Description of Artificial Sequence: Synthetic oligonucleotide
  Target: ATXN1; (-) strand; PAM type: YTN; PAM sequence: CTG
acaaacagtgtccctactgc

SEQ ID NO: 184149 - DNA, 20 bp, Artificial Sequence
  Description of Artificial Sequence: Synthetic oligonucleotide
  Target: ATXN1; (-) strand; PAM type: YTN; PAM sequence: CTC
cccgacccctgacaaacagt

SEQ ID NO: 184150 - DNA, 20 bp, Artificial Sequence
  Description of Artificial Sequence: Synthetic oligonucleotide
  Target: ATXN1; (-) strand; PAM type: YTN; PAM sequence: CTA
gcctccccgacccctgacaa

SEQ ID NO: 184151 - DNA, 20 bp, Artificial Sequence
  Description of Artificial Sequence: Synthetic oligonucleotide
  Target: ATXN1; (-) strand; PAM type: YTN; PAM sequence: TTC
ctagcctccccgacccctga

SEQ ID NO: 184152 - DNA, 20 bp, Artificial Sequence
  Description of Artificial Sequence: Synthetic oligonucleotide
  Target: ATXN1; (-) strand; PAM type: YTN; PAM sequence: CTA
tattcctagcctccccgacc

SEQ ID NO: 184153 - DNA, 20 bp, Artificial Sequence
  Description of Artificial Sequence: Synthetic oligonucleotide
  Target: ATXN1; (-) strand; PAM type: YTN; PAM sequence: TTC
ctatattcctagcctccccg

SEQ ID NO: 184154 - DNA, 20 bp, Artificial Sequence
  Description of Artificial Sequence: Synthetic oligonucleotide
  Target: ATXN1; (-) strand; PAM type: YTN; PAM sequence: TTG
aaagtacaaagagttcctat

SEQ ID NO: 184155 - DNA, 20 bp, Artificial Sequence
  Description of Artificial Sequence: Synthetic oligonucleotide
  Target: ATXN1; (-) strand; PAM type: YTN; PAM sequence: TTT
gaaagtacaaagagttccta

SEQ ID NO: 184156 - DNA, 20 bp, Artificial Sequence
  Description of Artificial Sequence: Synthetic oligonucleotide
  Target: ATXN1; (-) strand; PAM type: YTN; PAM sequence: TTG
atttgaaagtacaaagagtt

SEQ ID NO: 184157 - DNA, 20 bp, Artificial Sequence
  Description of Artificial Sequence: Synthetic oligonucleotide
  Target: ATXN1; (-) strand; PAM type: YTN; PAM sequence: TTA
cagaaaaattgatttgaaag

SEQ ID NO: 184158 - DNA, 20 bp, Artificial Sequence
  Description of Artificial Sequence: Synthetic oligonucleotide
  Target: ATXN1; (-) strand; PAM type: YTN; PAM sequence: TTT
acagaaaaattgatttgaaa

SEQ ID NO: 184159 - DNA, 20 bp, Artificial Sequence
  Description of Artificial Sequence: Synthetic oligonucleotide
  Target: ATXN1; (-) strand; PAM type: YTN; PAM sequence: TTA
ggtttacagaaaaattgatt

SEQ ID NO: 184160 - DNA, 20 bp, Artificial Sequence
  Description of Artificial Sequence: Synthetic oligonucleotide
  Target: ATXN1; (-) strand; PAM type: YTN; PAM sequence: TTT
aggtttacagaaaaattgat

SEQ ID NO: 184161 - DNA, 20 bp, Artificial Sequence
  Description of Artificial Sequence: Synthetic oligonucleotide
  Target: ATXN1; (-) strand; PAM type: YTN; PAM sequence: TTT
taggtttacagaaaaattga

SEQ ID NO: 184162 - DNA, 20 bp, Artificial Sequence
  Description of Artificial Sequence: Synthetic oligonucleotide
  Target: ATXN1; (-) strand; PAM type: YTN; PAM sequence: TTA
tagaacagttttaggtttac

SEQ ID NO: 184163 - DNA, 20 bp, Artificial Sequence
  Description of Artificial Sequence: Synthetic oligonucleotide
  Target: ATXN1; (-) strand; PAM type: YTN; PAM sequence: TTT
atagaacagttttaggttta

SEQ ID NO: 184164 - DNA, 20 bp, Artificial Sequence
  Description of Artificial Sequence: Synthetic oligonucleotide
  Target: ATXN1; (-) strand; PAM type: YTN; PAM sequence: TTT
tatagaacagttttaggttt

SEQ ID NO: 184165 - DNA, 20 bp, Artificial Sequence
  Description of Artificial Sequence: Synthetic oligonucleotide
  Target: ATXN1; (-) strand; PAM type: YTN; PAM sequence: TTT
ttatagaacagttttaggtt

SEQ ID NO: 184166 - DNA, 20 bp, Artificial Sequence
  Description of Artificial Sequence: Synthetic oligonucleotide
  Target: ATXN1; (-) strand; PAM type: YTN; PAM sequence: TTT
tttatagaacagttttaggt

SEQ ID NO: 184167 - DNA, 20 bp, Artificial Sequence
  Description of Artificial Sequence: Synthetic oligonucleotide
  Target: ATXN1; (-) strand; PAM type: YTN; PAM sequence: CTT
ttttatagaacagttttagg

SEQ ID NO: 184168 - DNA, 20 bp, Artificial Sequence
  Description of Artificial Sequence: Synthetic oligonucleotide
  Target: ATXN1; (-) strand; PAM type: YTN; PAM sequence: TTA
ataggcttttttatagaaca

SEQ ID NO: 184169 - DNA, 20 bp, Artificial Sequence
  Description of Artificial Sequence: Synthetic oligonucleotide
  Target: ATXN1; (-) strand; PAM type: YTN; PAM sequence: TTA
attaataggcttttttatag

SEQ ID NO: 184170 - DNA, 20 bp, Artificial Sequence
  Description of Artificial Sequence: Synthetic oligonucleotide
  Target: ATXN1; (-) strand; PAM type: YTN; PAM sequence: TTT
aattaataggcttttttata

SEQ ID NO: 184171 - DNA, 20 bp, Artificial Sequence
  Description of Artificial Sequence: Synthetic oligonucleotide
  Target: ATXN1; (-) strand; PAM type: YTN; PAM sequence: TTT
taattaataggcttttttat

SEQ ID NO: 184172 - DNA, 20 bp, Artificial Sequence
  Description of Artificial Sequence: Synthetic oligonucleotide
  Target: ATXN1; (-) strand; PAM type: YTN; PAM sequence: TTT
ttaattaataggctttttta

SEQ ID NO: 184173 - DNA, 20 bp, Artificial Sequence
  Description of Artificial Sequence: Synthetic oligonucleotide
  Target: ATXN1; (-) strand; PAM type: YTN; PAM sequence: TTT
tttaattaataggctttttt

SEQ ID NO: 184174 - DNA, 20 bp, Artificial Sequence
  Description of Artificial Sequence: Synthetic oligonucleotide
  Target: ATXN1; (-) strand; PAM type: YTN; PAM sequence: TTG
ttttttaattaataggcttt

SEQ ID NO: 184175 - DNA, 20 bp, Artificial Sequence
  Description of Artificial Sequence: Synthetic oligonucleotide
  Target: ATXN1; (-) strand; PAM type: YTN; PAM sequence: TTT
gttttttaattaataggctt

SEQ ID NO: 184176 - DNA, 20 bp, Artificial Sequence
  Description of Artificial Sequence: Synthetic oligonucleotide
  Target: ATXN1; (-) strand; PAM type: YTN; PAM sequence: TTT
tgttttttaattaataggct

SEQ ID NO: 184177 - DNA, 20 bp, Artificial Sequence
  Description of Artificial Sequence: Synthetic oligonucleotide
  Target: ATXN1; (-) strand; PAM type: YTN; PAM sequence: TTT
ttgttttttaattaataggc

SEQ ID NO: 184178 - DNA, 20 bp, Artificial Sequence
  Description of Artificial Sequence: Synthetic oligonucleotide
  Target: ATXN1; (-) strand; PAM type: YTN; PAM sequence: TTG
tttttgttttttaattaata

SEQ ID NO: 184179 - DNA, 20 bp, Artificial Sequence
  Description of Artificial Sequence: Synthetic oligonucleotide
  Target: ATXN1; (-) strand; PAM type: YTN; PAM sequence: TTG
ttgtttttgttttttaatta

SEQ ID NO: 184180 - DNA, 20 bp, Artificial Sequence
  Description of Artificial Sequence: Synthetic oligonucleotide
  Target: ATXN1; (-) strand; PAM type: YTN; PAM sequence: TTG
ttgttgtttttgttttttaa

SEQ ID NO: 184181 - DNA, 20 bp, Artificial Sequence
  Description of Artificial Sequence: Synthetic oligonucleotide
  Target: ATXN1; (-) strand; PAM type: YTN; PAM sequence: CTG
tcagtgcagtgttgttgttg

SEQ ID NO: 184182 - DNA, 20 bp, Artificial Sequence
  Description of Artificial Sequence: Synthetic oligonucleotide
  Target: ATXN1; (-) strand; PAM type: YTN; PAM sequence: TTC
aaacagctgtcagtgcagtg

SEQ ID NO: 184183 - DNA, 20 bp, Artificial Sequence
  Description of Artificial Sequence: Synthetic oligonucleotide
  Target: ATXN1; (-) strand; PAM type: YTN; PAM sequence: CTT
caaacagctgtcagtgcagt

SEQ ID NO: 184184 - DNA, 20 bp, Artificial Sequence
  Description of Artificial Sequence: Synthetic oligonucleotide
  Target: ATXN1; (-) strand; PAM type: YTN; PAM sequence: CTG
ggaggaacacttcaaacagc

SEQ ID NO: 184185 - DNA, 20 bp, Artificial Sequence
  Description of Artificial Sequence: Synthetic oligonucleotide
  Target: ATXN1; (-) strand; PAM type: YTN; PAM sequence: CTG
gaaggacacctgggaggaac

SEQ ID NO: 184186 - DNA, 20 bp, Artificial Sequence
  Description of Artificial Sequence: Synthetic oligonucleotide
  Target: ATXN1; (-) strand; PAM type: YTN; PAM sequence: CTA
gtatctggaaggacacctgg

SEQ ID NO: 184187 - DNA, 20 bp, Artificial Sequence
  Description of Artificial Sequence: Synthetic oligonucleotide
  Target: ATXN1; (-) strand; PAM type: YTN; PAM sequence: CTA
gctagtatctggaaggacac

SEQ ID NO: 184188 - DNA, 20 bp, Artificial Sequence
  Description of Artificial Sequence: Synthetic oligonucleotide
  Target: ATXN1; (-) strand; PAM type: YTN; PAM sequence: CTC
tagctagtatctggaaggac

SEQ ID NO: 184189 - DNA, 20 bp, Artificial Sequence
  Description of Artificial Sequence: Synthetic oligonucleotide
  Target: ATXN1; (-) strand; PAM type: YTN; PAM sequence: TTG
gctctagctagtatctggaa

SEQ ID NO: 184190 - DNA, 20 bp, Artificial Sequence
  Description of Artificial Sequence: Synthetic oligonucleotide
  Target: ATXN1; (-) strand; PAM type: YTN; PAM sequence: CTT
ggctctagctagtatctgga

SEQ ID NO: 184191 - DNA, 20 bp, Artificial Sequence
  Description of Artificial Sequence: Synthetic oligonucleotide
  Target: ATXN1; (-) strand; PAM type: YTN; PAM sequence: TTC
cacttggctctagctagtat

SEQ ID NO: 184192 - DNA, 20 bp, Artificial Sequence
  Description of Artificial Sequence: Synthetic oligonucleotide
  Target: ATXN1; (-) strand; PAM type: YTN; PAM sequence: TTA
attccacttggctctagcta

SEQ ID NO: 184193 - DNA, 20 bp, Artificial Sequence
  Description of Artificial Sequence: Synthetic oligonucleotide
  Target: ATXN1; (-) strand; PAM type: YTN; PAM sequence: CTG
attaattccacttggctcta

SEQ ID NO: 184194 - DNA, 20 bp, Artificial Sequence
  Description of Artificial Sequence: Synthetic oligonucleotide
  Target: ATXN1; (-) strand; PAM type: YTN; PAM sequence: TTG
cctgattaattccacttggc

SEQ ID NO: 184195 - DNA, 20 bp, Artificial Sequence
  Description of Artificial Sequence: Synthetic oligonucleotide
  Target: ATXN1; (-) strand; PAM type: YTN; PAM sequence: CTT
gcctgattaattccacttgg

SEQ ID NO: 184196 - DNA, 20 bp, Artificial Sequence
  Description of Artificial Sequence: Synthetic oligonucleotide
  Target: ATXN1; (-) strand; PAM type: YTN; PAM sequence: TTG
caccttgcctgattaattcc

SEQ ID NO: 184197 - DNA, 20 bp, Artificial Sequence
  Description of Artificial Sequence: Synthetic oligonucleotide
  Target: ATXN1; (-) strand; PAM type: YTN; PAM sequence: CTA
ccacacccagccgttgcacc

SEQ ID NO: 184198 - DNA, 20 bp, Artificial Sequence
  Description of Artificial Sequence: Synthetic oligonucleotide
  Target: ATXN1; (-) strand; PAM type: YTN; PAM sequence: TTA
caggcatcagctaccacacc

SEQ ID NO: 184199 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatcagctac

SEQ ID NO: 184200 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 184201 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 184202 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 184203 - DNA, 20 bp, Artificial Sequence
  Description of Artificial Sequence: Synthetic oligonucleotide
  Target: ATXN1; (-) strand; PAM type: YTN; PAM sequence: CTG
ccttggcctcccaaagtgct

SEQ ID NO: 184204 - DNA, 20 bp, Artificial Sequence
  Description of Artificial Sequence: Synthetic oligonucleotide
  Target: ATXN1; (-) strand; PAM type: YTN; PAM sequence: TTG
gtgatcaacctgccttggcc

SEQ ID NO: 184205 - DNA, 20 bp, Artificial Sequence
  Description of Artificial Sequence: Synthetic oligonucleotide
  Target: ATXN1; (-) strand; PAM type: YTN; PAM sequence: TTT
ggtgatcaacctgccttggc

SEQ ID NO: 184206 - DNA, 20 bp, Artificial Sequence
  Description of Artificial Sequence: Synthetic oligonucleotide
  Target: ATXN1; (-) strand; PAM type: YTN; PAM sequence: CTT
tggtgatcaacctgccttgg

SEQ ID NO: 184207 - DNA, 20 bp, Artificial Sequence
  Description of Artificial Sequence: Synthetic oligonucleotide
  Target: ATXN1; (-) strand; PAM type: YTN; PAM sequence: CTG
ccctttggtgatcaacctgc

SEQ ID NO: 184208 - DNA, 20 bp, Artificial Sequence
  Description of Artificial Sequence: Synthetic oligonucleotide
  Target: ATXN1; (-) strand; PAM type: YTN; PAM sequence: CTC
ctgccctttggtgatcaacc

SEQ ID NO: 184209 - DNA, 20 bp, Artificial Sequence
  Description of Artificial Sequence: Synthetic oligonucleotide
  Target: ATXN1; (-) strand; PAM type: YTN; PAM sequence: CTG
gtctcctgccctttggtgat

SEQ ID NO: 184210 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcctgccc

SEQ ID NO: 184211 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 184212 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 184213 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacca

SEQ ID NO: 184214 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcacc

SEQ ID NO: 184215 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 184216 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 184217 - DNA, 20 bp, Artificial Sequence
  Description of Artificial Sequence: Synthetic oligonucleotide
  Target: ATXN1; (-) strand; PAM type: YTN; PAM sequence: CTA
tttttagtagagacggggtt

SEQ ID NO: 184218 - DNA, 20 bp, Artificial Sequence
  Description of Artificial Sequence: Synthetic oligonucleotide
  Target: ATXN1; (-) strand; PAM type: YTN; PAM sequence: TTC
tatttttagtagagacgggg

SEQ ID NO: 184219 - DNA, 20 bp, Artificial Sequence
  Description of Artificial Sequence: Synthetic oligonucleotide
  Target: ATXN1; (-) strand; PAM type: YTN; PAM sequence: TTT
ctatttttagtagagacggg

SEQ ID NO: 184220 - DNA, 20 bp, Artificial Sequence
  Description of Artificial Sequence: Synthetic oligonucleotide
  Target: ATXN1; (-) strand; PAM type: YTN; PAM sequence: TTT
tctatttttagtagagacgg

SEQ ID NO: 184221 - DNA, 20 bp, Artificial Sequence
  Description of Artificial Sequence: Synthetic oligonucleotide
  Target: ATXN1; (-) strand; PAM type: YTN; PAM sequence: TTT
ttctatttttagtagagacg

SEQ ID NO: 184222 - DNA, 20 bp, Artificial Sequence
  Description of Artificial Sequence: Synthetic oligonucleotide
  Target: ATXN1; (-) strand; PAM type: YTN; PAM sequence: CTA
atttttctatttttagtaga

SEQ ID NO: 184223 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcccagctaattt

SEQ ID NO: 184224 - DNA, 20 bp, Artificial Sequence
  Description of Artificial Sequence: Synthetic oligonucleotide
  Target: ATXN1; (-) strand; PAM type: YTN; PAM sequence: CTA
cagacacctgccaccatgcc

SEQ ID NO: 184225 - DNA, 20 bp, Artificial Sequence
  Description of Artificial Sequence: Synthetic oligonucleotide
  Target: ATXN1; (-) strand; PAM type: YTN; PAM sequence: CTG
ggactacagacacctgccac

SEQ ID NO: 184226 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggactacag

SEQ ID NO: 184227 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 184228 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 184229 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 184230 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 184231 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 184232 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcaattctcctgc

SEQ ID NO: 184233 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcaattctcc

SEQ ID NO: 184234 - DNA, 20 bp, Artificial Sequence
  Description of Artificial Sequence: Synthetic oligonucleotide
  Target: ATXN1; (-) strand; PAM type: YTN; PAM sequence: CTC
cgtctcctgggttcaagcaa

SEQ ID NO: 184235 - DNA, 20 bp, Artificial Sequence
  Description of Artificial Sequence: Synthetic oligonucleotide
  Target: ATXN1; (-) strand; PAM type: YTN; PAM sequence: CTC
acggcaacctccgtctcctg

SEQ ID NO: 184236 - DNA, 20 bp, Artificial Sequence
  Description of Artificial Sequence: Synthetic oligonucleotide
  Target: ATXN1; (-) strand; PAM type: YTN; PAM sequence: TTG
gctcacggcaacctccgtct

SEQ ID NO: 184237 - DNA, 20 bp, Artificial Sequence
  Description of Artificial Sequence: Synthetic oligonucleotide
  Target: ATXN1; (-) strand; PAM type: YTN; PAM sequence: CTT
ggctcacggcaacctccgtc

SEQ ID NO: 184238 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacgatctt

SEQ ID NO: 184239 - DNA, 20 bp, Artificial Sequence
  Description of Artificial Sequence: Synthetic oligonucleotide
  Target: ATXN1; (-) strand; PAM type: YTN; PAM sequence: TTG
tcacccaggctggagtgcag

SEQ ID NO: 184240 - DNA, 20 bp, Artificial Sequence
  Description of Artificial Sequence: Synthetic oligonucleotide
  Target: ATXN1; (-) strand; PAM type: YTN; PAM sequence: CTT
gtcacccaggctggagtgca

SEQ ID NO: 184241 - DNA, 20 bp, Artificial Sequence
  Description of Artificial Sequence: Synthetic oligonucleotide
  Target: ATXN1; (-) strand; PAM type: YTN; PAM sequence: CTC
ttgtcacccaggctggagtg

SEQ ID NO: 184242 - DNA, 20 bp, Artificial Sequence
  Description of Artificial Sequence: Synthetic oligonucleotide
  Target: ATXN1; (-) strand; PAM type: YTN; PAM sequence: TTC
actcttgtcacccaggctgg

SEQ ID NO: 184243 - DNA, 20 bp, Artificial Sequence
  Description of Artificial Sequence: Synthetic oligonucleotide
  Target: ATXN1; (-) strand; PAM type: YTN; PAM sequence: TTT
cactcttgtcacccaggctg

SEQ ID NO: 184244 - DNA, 20 bp, Artificial Sequence
  Description of Artificial Sequence: Synthetic oligonucleotide
  Target: ATXN1; (-) strand; PAM type: YTN; PAM sequence: TTG
gaaatggaatttcactcttg

SEQ ID NO: 184245 - DNA, 20 bp, Artificial Sequence
  Description of Artificial Sequence: Synthetic oligonucleotide
  Target: ATXN1; (-) strand; PAM type: YTN; PAM sequence: TTT
ggaaatggaatttcactctt

SEQ ID NO: 184246 - DNA, 20 bp, Artificial Sequence
  Description of Artificial Sequence: Synthetic oligonucleotide
  Target: ATXN1; (-) strand; PAM type: YTN; PAM sequence: TTT
tggaaatggaatttcactct

SEQ ID NO: 184247 - DNA, 20 bp, Artificial Sequence
  Description of Artificial Sequence: Synthetic oligonucleotide
  Target: ATXN1; (-) strand; PAM type: YTN; PAM sequence: TTT
ttggaaatggaatttcactc

SEQ ID NO: 184248 - DNA, 20 bp, Artificial Sequence
  Description of Artificial Sequence: Synthetic oligonucleotide
  Target: ATXN1; (-) strand; PAM type: YTN; PAM sequence: TTG
tttttggaaatggaatttca

SEQ ID NO: 184249 - DNA, 20 bp, Artificial Sequence
  Description of Artificial Sequence: Synthetic oligonucleotide
  Target: ATXN1; (-) strand; PAM type: YTN; PAM sequence: TTT
gtttttggaaatggaatttc

SEQ ID NO: 184250 - DNA, 20 bp, Artificial Sequence
  Description of Artificial Sequence: Synthetic oligonucleotide
  Target: ATXN1; (-) strand; PAM type: YTN; PAM sequence: TTT
tgtttttggaaatggaattt

SEQ ID NO: 184251 - DNA, 20 bp, Artificial Sequence
  Description of Artificial Sequence: Synthetic oligonucleotide
  Target: ATXN1; (-) strand; PAM type: YTN; PAM sequence: TTG
ttttgtttttggaaatggaa

SEQ ID NO: 184252 - DNA, 20 bp, Artificial Sequence
  Description of Artificial Sequence: Synthetic oligonucleotide
  Target: ATXN1; (-) strand; PAM type: YTN; PAM sequence: TTT
gttttgtttttggaaatgga

SEQ ID NO: 184253 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttttggaaatgg

SEQ ID NO: 184254 - DNA, 20 bp, Artificial Sequence
  Description of Artificial Sequence: Synthetic oligonucleotide
  Target: ATXN1; (-) strand; PAM type: YTN; PAM sequence: TTG
ttttgttttgtttttggaaa

SEQ ID NO: 184255 - DNA, 20 bp, Artificial Sequence
  Description of Artificial Sequence: Synthetic oligonucleotide
  Target: ATXN1; (-) strand; PAM type: YTN; PAM sequence: TTT
gttttgttttgtttttggaa

SEQ ID NO: 184256 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttgtttttgga

SEQ ID NO: 184257 - DNA, 20 bp, Artificial Sequence
  Description of Artificial Sequence: Synthetic oligonucleotide
  Target: ATXN1; (-) strand; PAM type: YTN; PAM sequence: TTG
ttttgttttgttttgttttt

SEQ ID NO: 184258 - DNA, 20 bp, Artificial Sequence
  Description of Artificial Sequence: Synthetic oligonucleotide
  Target: ATXN1; (-) strand; PAM type: YTN; PAM sequence: TTT
gttttgttttgttttgtttt

SEQ ID NO: 184259 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttgttttgttt

SEQ ID NO: 184260 - DNA, 20 bp, Artificial Sequence
  Description of Artificial Sequence: Synthetic oligonucleotide
  Target: ATXN1; (-) strand; PAM type: YTN; PAM sequence: TTT
ttgttttgttttgttttgtt

SEQ ID NO: 184261 - DNA, 20 bp, Artificial Sequence
  Description of Artificial Sequence: Synthetic oligonucleotide
  Target: ATXN1; (-) strand; PAM type: YTN; PAM sequence: TTT
tttgttttgttttgttttgt

SEQ ID NO: 184262 - DNA, 20 bp, Artificial Sequence
  Description of Artificial Sequence: Synthetic oligonucleotide
  Target: ATXN1; (-) strand; PAM type: YTN; PAM sequence: CTG
attttttgttttgttttgtt

SEQ ID NO: 184263 - DNA, 20 bp, Artificial Sequence
  Description of Artificial Sequence: Synthetic oligonucleotide
  Target: ATXN1; (-) strand; PAM type: YTN; PAM sequence: TTC
cctgattttttgttttgttt

SEQ ID NO: 184264 - DNA, 20 bp, Artificial Sequence
  Description of Artificial Sequence: Synthetic oligonucleotide
  Target: ATXN1; (-) strand; PAM type: YTN; PAM sequence: CTT
ccctgattttttgttttgtt

SEQ ID NO: 184265 - DNA, 20 bp, Artificial Sequence
  Description of Artificial Sequence: Synthetic oligonucleotide
  Target: ATXN1; (-) strand; PAM type: YTN; PAM sequence: TTA
tggcaccttccctgattttt

SEQ ID NO: 184266 - DNA, 20 bp, Artificial Sequence
  Description of Artificial Sequence: Synthetic oligonucleotide
  Target: ATXN1; (-) strand; PAM type: YTN; PAM sequence: TTT
atggcaccttccctgatttt

SEQ ID NO: 184267 - DNA, 20 bp, Artificial Sequence
  Description of Artificial Sequence: Synthetic oligonucleotide
  Target: ATXN1; (-) strand; PAM type: YTN; PAM sequence: CTT
tatggcaccttccctgattt

SEQ ID NO: 184268 - DNA, 20 bp, Artificial Sequence
  Description of Artificial Sequence: Synthetic oligonucleotide
  Target: ATXN1; (-) strand; PAM type: YTN; PAM sequence: CTG
ggagtcatctttatggcacc

SEQ ID NO: 184269 - DNA, 20 bp, Artificial Sequence
  Description of Artificial Sequence: Synthetic oligonucleotide
  Target: ATXN1; (-) strand; PAM type: YTN; PAM sequence: TTG
cctgggagtcatctttatgg

SEQ ID NO: 184270 - DNA, 20 bp, Artificial Sequence
  Description of Artificial Sequence: Synthetic oligonucleotide
  Target: ATXN1; (-) strand; PAM type: YTN; PAM sequence: CTT
gcctgggagtcatctttatg

SEQ ID NO: 184271 - DNA, 20 bp, Artificial Sequence
  Description of Artificial Sequence: Synthetic oligonucleotide
  Target: ATXN1; (-) strand; PAM type: YTN; PAM sequence: TTC
aaaccttgcctgggagtcat

SEQ ID NO: 184272 - DNA, 20 bp, Artificial Sequence
  Description of Artificial Sequence: Synthetic oligonucleotide
  Target: ATXN1; (-) strand; PAM type: YTN; PAM sequence: CTT
caaaccttgcctgggagtca

SEQ ID NO: 184273 - DNA, 20 bp, Artificial Sequence
  Description of Artificial Sequence: Synthetic oligonucleotide
  Target: ATXN1; (-) strand; PAM type: YTN; PAM sequence: CTA
gcccttcaaaccttgcctgg

SEQ ID NO: 184274 - DNA, 20 bp, Artificial Sequence
  Description of Artificial Sequence: Synthetic oligonucleotide
  Target: ATXN1; (-) strand; PAM type: YTN; PAM sequence: CTC
tagcccttcaaaccttgcct

SEQ ID NO: 184275 - DNA, 20 bp, Artificial Sequence
  Description of Artificial Sequence: Synthetic oligonucleotide
  Target: ATXN1; (-) strand; PAM type: YTN; PAM sequence: CTC
ctctagcccttcaaaccttg

SEQ ID NO: 184276 - DNA, 20 bp, Artificial Sequence
  Description of Artificial Sequence: Synthetic oligonucleotide
  Target: ATXN1; (-) strand; PAM type: YTN; PAM sequence: CTC
tcctctagcccttcaaacct

SEQ ID NO: 184277 - DNA, 20 bp, Artificial Sequence
  Description of Artificial Sequence: Synthetic oligonucleotide
  Target: ATXN1; (-) strand; PAM type: YTN; PAM sequence: CTG
gctctcctctagcccttcaa

SEQ ID NO: 184278 - DNA, 20 bp, Artificial Sequence
  Description of Artificial Sequence: Synthetic oligonucleotide
  Target: ATXN1; (-) strand; PAM type: YTN; PAM sequence: TTG
gccaaaaaactggctctcct

SEQ ID NO: 184279 - DNA, 20 bp, Artificial Sequence
  Description of Artificial Sequence: Synthetic oligonucleotide
  Target: ATXN1; (-) strand; PAM type: YTN; PAM sequence: CTT
ggccaaaaaactggctctcc

SEQ ID NO: 184280 - DNA, 20 bp, Artificial Sequence
  Description of Artificial Sequence: Synthetic oligonucleotide
  Target: ATXN1; (-) strand; PAM type: YTN; PAM sequence: TTC
ttggccaaaaaactggctct

SEQ ID NO: 184281 - DNA, 20 bp, Artificial Sequence
  Description of Artificial Sequence: Synthetic oligonucleotide
  Target: ATXN1; (-) strand; PAM type: YTN; PAM sequence: CTA
gttcttggccaaaaaactgg

SEQ ID NO: 184282 - DNA, 20 bp, Artificial Sequence
  Description of Artificial Sequence: Synthetic oligonucleotide
  Target: ATXN1; (-) strand; PAM type: YTN; PAM sequence: CTC
ctagttcttggccaaaaaac

SEQ ID NO: 184283 - DNA, 20 bp, Artificial Sequence
  Description of Artificial Sequence: Synthetic oligonucleotide
  Target: ATXN1; (-) strand; PAM type: YTN; PAM sequence: TTG
catcctcctagttcttggcc

SEQ ID NO: 184284 - DNA, 20 bp, Artificial Sequence
  Description of Artificial Sequence: Synthetic oligonucleotide
  Target: ATXN1; (-) strand; PAM type: YTN; PAM sequence: CTG
aatcattgcatcctcctagt

SEQ ID NO: 184285 - DNA, 20 bp, Artificial Sequence
  Description of Artificial Sequence: Synthetic oligonucleotide
  Target: ATXN1; (-) strand; PAM type: YTN; PAM sequence: CTC
atccccatctgaatcattgc

SEQ ID NO: 184286 - DNA, 20 bp, Artificial Sequence
  Description of Artificial Sequence: Synthetic oligonucleotide
  Target: ATXN1; (-) strand; PAM type: YTN; PAM sequence: TTG
ccctcatccccatctgaatc

SEQ ID NO: 184287 - DNA, 20 bp, Artificial Sequence
  Description of Artificial Sequence: Synthetic oligonucleotide
  Target: ATXN1; (-) strand; PAM type: YTN; PAM sequence: CTT
gccctcatccccatctgaat

SEQ ID NO: 184288 - DNA, 20 bp, Artificial Sequence
  Description of Artificial Sequence: Synthetic oligonucleotide
  Target: ATXN1; (-) strand; PAM type: YTN; PAM sequence: CTG
cccttgccctcatccccatc

SEQ ID NO: 184289 - DNA, 20 bp, Artificial Sequence
  Description of Artificial Sequence: Synthetic oligonucleotide
  Target: ATXN1; (-) strand; PAM type: YTN; PAM sequence: TTC
atcccaccccagaccctgcc

SEQ ID NO: 184290 - DNA, 20 bp, Artificial Sequence
  Description of Artificial Sequence: Synthetic oligonucleotide
  Target: ATXN1; (-) strand; PAM type: YTN; PAM sequence: TTC
cccatgcattcatcccaccc

SEQ ID NO: 184291 - DNA, 20 bp, Artificial Sequence
  Description of Artificial Sequence: Synthetic oligonucleotide
  Target: ATXN1; (-) strand; PAM type: YTN; PAM sequence: CTT
ccccatgcattcatcccacc

SEQ ID NO: 184292 - DNA, 20 bp, Artificial Sequence
  Description of Artificial Sequence: Synthetic oligonucleotide
  Target: ATXN1; (-) strand; PAM type: YTN; PAM sequence: CTC
ttccccatgcattcatccca

SEQ ID NO: 184293 - DNA, 20 bp, Artificial Sequence
  Description of Artificial Sequence: Synthetic oligonucleotide
  Target: ATXN1; (-) strand; PAM type: YTN; PAM sequence: CTA
ctcttccccatgcattcatc

SEQ ID NO: 184294 - DNA, 20 bp, Artificial Sequence
  Description of Artificial Sequence: Synthetic oligonucleotide
  Target: ATXN1; (-) strand; PAM type: YTN; PAM sequence: CTG
actactcttccccatgcatt

SEQ ID NO: 184295 - DNA, 20 bp, Artificial Sequence
  Description of Artificial Sequence: Synthetic oligonucleotide
  Target: ATXN1; (-) strand; PAM type: YTN; PAM sequence: CTG
ctgactactcttccccatgc

SEQ ID NO: 184296 - DNA, 20 bp, Artificial Sequence
  Description of Artificial Sequence: Synthetic oligonucleotide
  Target: ATXN1; (-) strand; PAM type: YTN; PAM sequence: CTC
tgctgactactcttccccat

SEQ ID NO: 184297 - DNA, 20 bp, Artificial Sequence
  Description of Artificial Sequence: Synthetic oligonucleotide
  Target: ATXN1; (-) strand; PAM type: YTN; PAM sequence: TTC
cggtcaaacatgatgctctg

SEQ ID NO: 184298 - DNA, 20 bp, Artificial Sequence
  Description of Artificial Sequence: Synthetic oligonucleotide
  Target: ATXN1; (-) strand; PAM type: YTN; PAM sequence: CTT
ccggtcaaacatgatgctct

SEQ ID NO: 184299 - DNA, 20 bp, Artificial Sequence
  Description of Artificial Sequence: Synthetic oligonucleotide
  Target: ATXN1; (-) strand; PAM type: YTN; PAM sequence: TTG
tcttccggtcaaacatgatg

SEQ ID NO: 184300 - DNA, 20 bp, Artificial Sequence
  Description of Artificial Sequence: Synthetic oligonucleotide
  Target: ATXN1; (-) strand; PAM type: YTN; PAM sequence: CTT
gtcttccggtcaaacatgat

SEQ ID NO: 184301 - DNA, 20 bp, Artificial Sequence
  Description of Artificial Sequence: Synthetic oligonucleotide
  Target: ATXN1; (-) strand; PAM type: YTN; PAM sequence: CTC
ttgtcttccggtcaaacatg

SEQ ID NO: 184302 - DNA, 20 bp, Artificial Sequence
  Description of Artificial Sequence: Synthetic oligonucleotide
  Target: ATXN1; (-) strand; PAM type: YTN; PAM sequence: TTG
tggctcttgtcttccggtca

SEQ ID NO: 184303 - DNA, 20 bp, Artificial Sequence
  Description of Artificial Sequence: Synthetic oligonucleotide
  Target: ATXN1; (-) strand; PAM type: YTN; PAM sequence: CTT
gtggctcttgtcttccggtc

SEQ ID NO: 184304 - DNA, 20 bp, Artificial Sequence
  Description of Artificial Sequence: Synthetic oligonucleotide
  Target: ATXN1; (-) strand; PAM type: YTN; PAM sequence: CTG
gaggcttgtggctcttgtct

SEQ ID NO: 184305 - DNA, 20 bp, Artificial Sequence
  Description of Artificial Sequence: Synthetic oligonucleotide
  Target: ATXN1; (-) strand; PAM type: YTN; PAM sequence: CTA
aagaactggaggcttgtggc

SEQ ID NO: 184306 - DNA, 20 bp, Artificial Sequence
  Description of Artificial Sequence: Synthetic oligonucleotide
  Target: ATXN1; (-) strand; PAM type: YTN; PAM sequence: CTG
ctaaagaactggaggcttgt

SEQ ID NO: 184307 - DNA, 20 bp, Artificial Sequence
  Description of Artificial Sequence: Synthetic oligonucleotide
  Target: ATXN1; (-) strand; PAM type: YTN; PAM sequence: TTC
tgctaaagaactggaggctt

SEQ ID NO: 184308 - DNA, 20 bp, Artificial Sequence
  Description of Artificial Sequence: Synthetic oligonucleotide
  Target: ATXN1; (-) strand; PAM type: YTN; PAM sequence: CTT
ctgctaaagaactggaggct

SEQ ID NO: 184309 - DNA, 20 bp, Artificial Sequence
  Description of Artificial Sequence: Synthetic oligonucleotide
  Target: ATXN1; (-) strand; PAM type: YTN; PAM sequence: TTC
ttctgctaaagaactggagg

SEQ ID NO: 184310 - DNA, 20 bp, Artificial Sequence
  Description of Artificial Sequence: Synthetic oligonucleotide
  Target: ATXN1; (-) strand; PAM type: YTN; PAM sequence: CTC
cagttcttctgctaaagaac

SEQ ID NO: 184311 - DNA, 20 bp, Artificial Sequence
  Description of Artificial Sequence: Synthetic oligonucleotide
  Target: ATXN1; (-) strand; PAM type: YTN; PAM sequence: TTA
cctccagttcttctgctaaa

SEQ ID NO: 184312 - DNA, 20 bp, Artificial Sequence
  Description of Artificial Sequence: Synthetic oligonucleotide
  Target: ATXN1; (-) strand; PAM type: YTN; PAM sequence: TTT
acctccagttcttctgctaa

SEQ ID NO: 184313 - DNA, 20 bp, Artificial Sequence
  Description of Artificial Sequence: Synthetic oligonucleotide
  Target: ATXN1; (-) strand; PAM type: YTN; PAM sequence: CTT
tacctccagttcttctgcta

SEQ ID NO: 184314 - DNA, 20 bp, Artificial Sequence
  Description of Artificial Sequence: Synthetic oligonucleotide
  Target: ATXN1; (-) strand; PAM type: YTN; PAM sequence: CTA
tctttacctccagttcttct

SEQ ID NO: 184315 - DNA, 20 bp, Artificial Sequence
  Description of Artificial Sequence: Synthetic oligonucleotide
  Target: ATXN1; (-) strand; PAM type: YTN; PAM sequence: TTG
atgcacctatctttacctcc

SEQ ID NO: 184316 - DNA, 20 bp, Artificial Sequence
  Description of Artificial Sequence: Synthetic oligonucleotide
  Target: ATXN1; (-) strand; PAM type: YTN; PAM sequence: TTT
gatgcacctatctttacctc

SEQ ID NO: 184317 - DNA, 20 bp, Artificial Sequence
  Description of Artificial Sequence: Synthetic oligonucleotide
  Target: ATXN1; (-) strand; PAM type: YTN; PAM sequence: CTT
tgatgcacctatctttacct

SEQ ID NO: 184318 - DNA, 20 bp, Artificial Sequence
  Description of Artificial Sequence: Synthetic oligonucleotide
  Target: ATXN1; (-) strand; PAM type: YTN; PAM sequence: CTA
tctttgatgcacctatcttt

SEQ ID NO: 184319 - DNA, 20 bp, Artificial Sequence
  Description of Artificial Sequence: Synthetic oligonucleotide
  Target: ATXN1; (-) strand; PAM type: YTN; PAM sequence: CTA
atcacaggctatctttgatg

SEQ ID NO: 184320 - DNA, 20 bp, Artificial Sequence
  Description of Artificial Sequence: Synthetic oligonucleotide
  Target: ATXN1; (-) strand; PAM type: YTN; PAM sequence: CTC
ctaatcacaggctatctttg

SEQ ID NO: 184321 - DNA, 20 bp, Artificial Sequence
  Description of Artificial Sequence: Synthetic oligonucleotide
  Target: ATXN1; (-) strand; PAM type: YTN; PAM sequence: TTA
acctcctaatcacaggctat

SEQ ID NO: 184322 - DNA, 20 bp, Artificial Sequence
  Description of Artificial Sequence: Synthetic oligonucleotide
  Target: ATXN1; (-) strand; PAM type: YTN; PAM sequence: TTT
aacctcctaatcacaggcta

SEQ ID NO: 184323 - DNA, 20 bp, Artificial Sequence
  Description of Artificial Sequence: Synthetic oligonucleotide
  Target: ATXN1; (-) strand; PAM type: YTN; PAM sequence: TTT
taacctcctaatcacaggct

SEQ ID NO: 184324 - DNA, 20 bp, Artificial Sequence
  Description of Artificial Sequence: Synthetic oligonucleotide
  Target: ATXN1; (-) strand; PAM type: YTN; PAM sequence: TTC
attttaacctcctaatcaca

SEQ ID NO: 184325 - DNA, 20 bp, Artificial Sequence
  Description of Artificial Sequence: Synthetic oligonucleotide
  Target: ATXN1; (-) strand; PAM type: YTN; PAM sequence: TTT
cattttaacctcctaatcac

SEQ ID NO: 184326 - DNA, 20 bp, Artificial Sequence
  Description of Artificial Sequence: Synthetic oligonucleotide
  Target: ATXN1; (-) strand; PAM type: YTN; PAM sequence: TTC
agatttcattttaacctcct

SEQ ID NO: 184327 - DNA, 20 bp, Artificial Sequence
  Description of Artificial Sequence: Synthetic oligonucleotide
  Target: ATXN1; (-) strand; PAM type: YTN; PAM sequence: TTT
cagatttcattttaacctcc

SEQ ID NO: 184328 - DNA, 20 bp, Artificial Sequence
  Description of Artificial Sequence: Synthetic oligonucleotide
  Target: ATXN1; (-) strand; PAM type: YTN; PAM sequence: CTT
tcagatttcattttaacctc

SEQ ID NO: 184329 - DNA, 20 bp, Artificial Sequence
  Description of Artificial Sequence: Synthetic oligonucleotide
  Target: ATXN1; (-) strand; PAM type: YTN; PAM sequence: CTG
tctttcagatttcattttaa

SEQ ID NO: 184330 - DNA, 20 bp, Artificial Sequence
  Description of Artificial Sequence: Synthetic oligonucleotide
  Target: ATXN1; (-) strand; PAM type: YTN; PAM sequence: CTC
tgtctttcagatttcatttt

SEQ ID NO: 184331 - DNA, 20 bp, Artificial Sequence
  Description of Artificial Sequence: Synthetic oligonucleotide
  Target: ATXN1; (-) strand; PAM type: YTN; PAM sequence: CTG
gagtgactctgtctttcaga

SEQ ID NO: 184332 - DNA, 20 bp, Artificial Sequence
  Description of Artificial Sequence: Synthetic oligonucleotide
  Target: ATXN1; (-) strand; PAM type: YTN; PAM sequence: TTC
ccagagtctggagtgactct

SEQ ID NO: 184333 - DNA, 20 bp, Artificial Sequence
  Description of Artificial Sequence: Synthetic oligonucleotide
  Target: ATXN1; (-) strand; PAM type: YTN; PAM sequence: TTT
cccagagtctggagtgactc

SEQ ID NO: 184334 - DNA, 20 bp, Artificial Sequence
  Description of Artificial Sequence: Synthetic oligonucleotide
  Target: ATXN1; (-) strand; PAM type: YTN; PAM sequence: CTT
tcccagagtctggagtgact

SEQ ID NO: 184335 - DNA, 20 bp, Artificial Sequence
  Description of Artificial Sequence: Synthetic oligonucleotide
  Target: ATXN1; (-) strand; PAM type: YTN; PAM sequence: TTG
catcatgagctttcccagag

SEQ ID NO: 184336 - DNA, 20 bp, Artificial Sequence
  Description of Artificial Sequence: Synthetic oligonucleotide
  Target: ATXN1; (-) strand; PAM type: YTN; PAM sequence: TTG
attgcatcatgagctttccc

SEQ ID NO: 184337 - DNA, 20 bp, Artificial Sequence
  Description of Artificial Sequence: Synthetic oligonucleotide
  Target: ATXN1; (-) strand; PAM type: YTN; PAM sequence: TTT
gattgcatcatgagctttcc

SEQ ID NO: 184338 - DNA, 20 bp, Artificial Sequence
  Description of Artificial Sequence: Synthetic oligonucleotide
  Target: ATXN1; (-) strand; PAM type: YTN; PAM sequence: TTT
tgattgcatcatgagctttc

SEQ ID NO: 184339 - DNA, 20 bp, Artificial Sequence
  Description of Artificial Sequence: Synthetic oligonucleotide
  Target: ATXN1; (-) strand; PAM type: YTN; PAM sequence: TTG
gtacatcattttgattgcat

SEQ ID NO: 184340 - DNA, 20 bp, Artificial Sequence
  Description of Artificial Sequence: Synthetic oligonucleotide
  Target: ATXN1; (-) strand; PAM type: YTN; PAM sequence: CTT
ggtacatcattttgattgca

SEQ ID NO: 184341 - DNA, 20 bp, Artificial Sequence
  Description of Artificial Sequence: Synthetic oligonucleotide
  Target: ATXN1; (-) strand; PAM type: YTN; PAM sequence: CTC
ttggtacatcattttgattg

SEQ ID NO: 184342 - DNA, 20 bp, Artificial Sequence
  Description of Artificial Sequence: Synthetic oligonucleotide
  Target: ATXN1; (-) strand; PAM type: YTN; PAM sequence: TTA
gcagagacacctcttggtac

SEQ ID NO: 184343 - DNA, 20 bp, Artificial Sequence
  Description of Artificial Sequence: Synthetic oligonucleotide
  Target: ATXN1; (-) strand; PAM type: YTN; PAM sequence: CTT
agcagagacacctcttggta

SEQ ID NO: 184344 - DNA, 20 bp, Artificial Sequence
  Description of Artificial Sequence: Synthetic oligonucleotide
  Target: ATXN1; (-) strand; PAM type: YTN; PAM sequence: TTA
tgtggcccggacttagcaga

SEQ ID NO: 184345 - DNA, 20 bp, Artificial Sequence
  Description of Artificial Sequence: Synthetic oligonucleotide
  Target: ATXN1; (-) strand; PAM type: YTN; PAM sequence: TTT
atgtggcccggacttagcag

SEQ ID NO: 184346 - DNA, 20 bp, Artificial Sequence
  Description of Artificial Sequence: Synthetic oligonucleotide
  Target: ATXN1; (-) strand; PAM type: YTN; PAM sequence: CTT
tatgtggcccggacttagca

SEQ ID NO: 184347 - DNA, 20 bp, Artificial Sequence
  Description of Artificial Sequence: Synthetic oligonucleotide
  Target: ATXN1; (-) strand; PAM type: YTN; PAM sequence: CTC
atgtctttatgtggcccgga

SEQ ID NO: 184348 - DNA, 20 bp, Artificial Sequence
  Description of Artificial Sequence: Synthetic oligonucleotide
  Target: ATXN1; (-) strand; PAM type: YTN; PAM sequence: CTC
tcatgtctttatgtggcccg

SEQ ID NO: 184349 - DNA, 20 bp, Artificial Sequence
  Description of Artificial Sequence: Synthetic oligonucleotide
  Target: ATXN1; (-) strand; PAM type: YTN; PAM sequence: CTC
cccatctctcatgtctttat

SEQ ID NO: 184350 - DNA, 20 bp, Artificial Sequence
  Description of Artificial Sequence: Synthetic oligonucleotide
  Target: ATXN1; (-) strand; PAM type: YTN; PAM sequence: CTG
tagtgggcctccccatctct

SEQ ID NO: 184351 - DNA, 20 bp, Artificial Sequence
  Description of Artificial Sequence: Synthetic oligonucleotide
  Target: ATXN1; (-) strand; PAM type: YTN; PAM sequence: CTC
acctgtagtgggcctcccca

SEQ ID NO: 184352 - DNA, 20 bp, Artificial Sequence
  Description of Artificial Sequence: Synthetic oligonucleotide
  Target: ATXN1; (-) strand; PAM type: YTN; PAM sequence: CTC
atgacctcacctgtagtggg

SEQ ID NO: 184353 - DNA, 20 bp, Artificial Sequence
  Description of Artificial Sequence: Synthetic oligonucleotide
  Target: ATXN1; (-) strand; PAM type: YTN; PAM sequence: CTC
aaagcaaggactcatgacct

SEQ ID NO: 184354 - DNA, 20 bp, Artificial Sequence
  Description of Artificial Sequence: Synthetic oligonucleotide
  Target: ATXN1; (-) strand; PAM type: YTN; PAM sequence: TTC
cctcaaagcaaggactcatg

SEQ ID NO: 184355 - DNA, 20 bp, Artificial Sequence
  Description of Artificial Sequence: Synthetic oligonucleotide
  Target: ATXN1; (-) strand; PAM type: YTN; PAM sequence: TTT
ccctcaaagcaaggactcat

SEQ ID NO: 184356 - DNA, 20 bp, Artificial Sequence
  Description of Artificial Sequence: Synthetic oligonucleotide
  Target: ATXN1; (-) strand; PAM type: YTN; PAM sequence: CTT
tccctcaaagcaaggactca

SEQ ID NO: 184357 - DNA, 20 bp, Artificial Sequence
  Description of Artificial Sequence: Synthetic oligonucleotide
  Target: ATXN1; (-) strand; PAM type: YTN; PAM sequence: TTA
ctttccctcaaagcaaggac

SEQ ID NO: 184358 - DNA, 20 bp, Artificial Sequence
  Description of Artificial Sequence: Synthetic oligonucleotide
  Target: ATXN1; (-) strand; PAM type: YTN; PAM sequence: TTT
actttccctcaaagcaagga

SEQ ID NO: 184359 - DNA, 20 bp, Artificial Sequence
  Description of Artificial Sequence: Synthetic oligonucleotide
  Target: ATXN1; (-) strand; PAM type: YTN; PAM sequence: CTG
tttactttccctcaaagcaa

SEQ ID NO: 184360 - DNA, 20 bp, Artificial Sequence
  Description of Artificial Sequence: Synthetic oligonucleotide
  Target: ATXN1; (-) strand; PAM type: YTN; PAM sequence: TTC
tgtttactttccctcaaagc

SEQ ID NO: 184361 - DNA, 20 bp, Artificial Sequence
  Description of Artificial Sequence: Synthetic oligonucleotide
  Target: ATXN1; (-) strand; PAM type: YTN; PAM sequence: TTT
ctgtttactttccctcaaag

SEQ ID NO: 184362 - DNA, 20 bp, Artificial Sequence
  Description of Artificial Sequence: Synthetic oligonucleotide
  Target: ATXN1; (-) strand; PAM type: YTN; PAM sequence: TTT
tctgtttactttccctcaaa

SEQ ID NO: 184363 - DNA, 20 bp, Artificial Sequence
  Description of Artificial Sequence: Synthetic oligonucleotide
  Target: ATXN1; (-) strand; PAM type: YTN; PAM sequence: TTG
tattttctgtttactttccc

SEQ ID NO: 184364 - DNA, 20 bp, Artificial Sequence
  Description of Artificial Sequence: Synthetic oligonucleotide
  Target: ATXN1; (-) strand; PAM type: YTN; PAM sequence: CTT
gtattttctgtttactttcc

SEQ ID NO: 184365 - DNA, 20 bp, Artificial Sequence
  Description of Artificial Sequence: Synthetic oligonucleotide
  Target: ATXN1; (-) strand; PAM type: YTN; PAM sequence: TTA
gaatccttgtattttctgtt

SEQ ID NO: 184366 - DNA, 20 bp, Artificial Sequence
  Description of Artificial Sequence: Synthetic oligonucleotide
  Target: ATXN1; (-) strand; PAM type: YTN; PAM sequence: CTT
agaatccttgtattttctgt

SEQ ID NO: 184367 - DNA, 20 bp, Artificial Sequence
  Description of Artificial Sequence: Synthetic oligonucleotide
  Target: ATXN1; (-) strand; PAM type: YTN; PAM sequence: TTC
ccttagaatccttgtatttt

SEQ ID NO: 184368 - DNA, 20 bp, Artificial Sequence
  Description of Artificial Sequence: Synthetic oligonucleotide
  Target: ATXN1; (-) strand; PAM type: YTN; PAM sequence: TTA
tgcattcccttagaatcctt

SEQ ID NO: 184369 - DNA, 20 bp, Artificial Sequence
  Description of Artificial Sequence: Synthetic oligonucleotide
  Target: ATXN1; (-) strand; PAM type: YTN; PAM sequence: TTG
gaaattatgcattcccttag

SEQ ID NO: 184370 - DNA, 20 bp, Artificial Sequence
  Description of Artificial Sequence: Synthetic oligonucleotide
  Target: ATXN1; (-) strand; PAM type: YTN; PAM sequence: CTT
ggaaattatgcattccctta

SEQ ID NO: 184371 - DNA, 20 bp, Artificial Sequence
  Description of Artificial Sequence: Synthetic oligonucleotide
  Target: ATXN1; (-) strand; PAM type: YTN; PAM sequence: TTC
ttggaaattatgcattccct

SEQ ID NO: 184372 - DNA, 20 bp, Artificial Sequence
  Description of Artificial Sequence: Synthetic oligonucleotide
  Target: ATXN1; (-) strand; PAM type: YTN; PAM sequence: TTT
cttggaaattatgcattccc

SEQ ID NO: 184373 - DNA, 20 bp, Artificial Sequence
  Description of Artificial Sequence: Synthetic oligonucleotide
  Target: ATXN1; (-) strand; PAM type: YTN; PAM sequence: TTT
tcttggaaattatgcattcc

SEQ ID NO: 184374 - DNA, 20 bp, Artificial Sequence
  Description of Artificial Sequence: Synthetic oligonucleotide
  Target: ATXN1; (-) strand; PAM type: YTN; PAM sequence: CTT
ttcttggaaattatgcattc

SEQ ID NO: 184375 - DNA, 20 bp, Artificial Sequence
  Description of Artificial Sequence: Synthetic oligonucleotide
  Target: ATXN1; (-) strand; PAM type: YTN; PAM sequence: CTA
tgacttttcttggaaattat

SEQ ID NO: 184376 - DNA, 20 bp, Artificial Sequence
  Description of Artificial Sequence: Synthetic oligonucleotide
  Target: ATXN1; (-) strand; PAM type: YTN; PAM sequence: TTC
gctatgacttttcttggaaa

SEQ ID NO: 184377 - DNA, 20 bp, Artificial Sequence
  Description of Artificial Sequence: Synthetic oligonucleotide
  Target: ATXN1; (-) strand; PAM type: YTN; PAM sequence: CTG
gacacagttcgctatgactt

SEQ ID NO: 184378 - DNA, 20 bp, Artificial Sequence
  Description of Artificial Sequence: Synthetic oligonucleotide
  Target: ATXN1; (-) strand; PAM type: YTN; PAM sequence: TTC
ctggacacagttcgctatga

SEQ ID NO: 184379 - DNA, 20 bp, Artificial Sequence
  Description of Artificial Sequence: Synthetic oligonucleotide
  Target: ATXN1; (-) strand; PAM type: YTN; PAM sequence: CTT
cctggacacagttcgctatg

SEQ ID NO: 184380 - DNA, 20 bp, Artificial Sequence
  Description of Artificial Sequence: Synthetic oligonucleotide
  Target: ATXN1; (-) strand; PAM type: YTN; PAM sequence: CTC
agcttcctggacacagttcg

SEQ ID NO: 184381 - DNA, 20 bp, Artificial Sequence
  Description of Artificial Sequence: Synthetic oligonucleotide
  Target: ATXN1; (-) strand; PAM type: YTN; PAM sequence: TTC
catctcagcttcctggacac

SEQ ID NO: 184382 - DNA, 20 bp, Artificial Sequence
  Description of Artificial Sequence: Synthetic oligonucleotide
  Target: ATXN1; (-) strand; PAM type: YTN; PAM sequence: CTT
ccatctcagcttcctggaca

SEQ ID NO: 184383 - DNA, 20 bp, Artificial Sequence
  Description of Artificial Sequence: Synthetic oligonucleotide
  Target: ATXN1; (-) strand; PAM type: YTN; PAM sequence: CTC
ttccatctcagcttcctgga

SEQ ID NO: 184384 - DNA, 20 bp, Artificial Sequence
  Description of Artificial Sequence: Synthetic oligonucleotide
  Target: ATXN1; (-) strand; PAM type: YTN; PAM sequence: TTC
ctcttccatctcagcttcct

SEQ ID NO: 184385 - DNA, 20 bp, Artificial Sequence
  Description of Artificial Sequence: Synthetic oligonucleotide
  Target: ATXN1; (-) strand; PAM type: YTN; PAM sequence: TTA
ttcctcttccatctcagctt

SEQ ID NO: 184386 - DNA, 20 bp, Artificial Sequence
  Description of Artificial Sequence: Synthetic oligonucleotide
  Target: ATXN1; (-) strand; PAM type: YTN; PAM sequence: TTA
agaagttattcctcttccat

SEQ ID NO: 184387 - DNA, 20 bp, Artificial Sequence
  Description of Artificial Sequence: Synthetic oligonucleotide
  Target: ATXN1; (-) strand; PAM type: YTN; PAM sequence: TTT
aagaagttattcctcttcca

SEQ ID NO: 184388 - DNA, 20 bp, Artificial Sequence
  Description of Artificial Sequence: Synthetic oligonucleotide
  Target: ATXN1; (-) strand; PAM type: YTN; PAM sequence: TTT
taagaagttattcctcttcc

SEQ ID NO: 184389 - DNA, 20 bp, Artificial Sequence
  Description of Artificial Sequence: Synthetic oligonucleotide
  Target: ATXN1; (-) strand; PAM type: YTN; PAM sequence: CTT
ttaagaagttattcctcttc

SEQ ID NO: 184390 - DNA, 20 bp, Artificial Sequence
  Description of Artificial Sequence: Synthetic oligonucleotide
  Target: ATXN1; (-) strand; PAM type: YTN; PAM sequence: TTA
gtacttttaagaagttattc

SEQ ID NO: 184391 - DNA, 20 bp, Artificial Sequence
  Description of Artificial Sequence: Synthetic oligonucleotide
  Target: ATXN1; (-) strand; PAM type: YTN; PAM sequence: TTT
agtacttttaagaagttatt

SEQ ID NO: 184392 - DNA, 20 bp, Artificial Sequence
  Description of Artificial Sequence: Synthetic oligonucleotide
  Target: ATXN1; (-) strand; PAM type: YTN; PAM sequence: CTG
gccacatttagtacttttaa

SEQ ID NO: 184393 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcgcc

SEQ ID NO: 184394 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 184395 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 184396 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 184397 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 184398 - DNA, 20 bp, Artificial Sequence
  Description of Artificial Sequence: Synthetic oligonucleotide
  Target: ATXN1; (-) strand; PAM type: YTN; PAM sequence: TTG
tggtccacccgccttggcct

SEQ ID NO: 184399 - DNA, 20 bp, Artificial Sequence
  Description of Artificial Sequence: Synthetic oligonucleotide
  Target: ATXN1; (-) strand; PAM type: YTN; PAM sequence: CTT
gtggtccacccgccttggcc

SEQ ID NO: 184400 - DNA, 20 bp, Artificial Sequence
  Description of Artificial Sequence: Synthetic oligonucleotide
  Target: ATXN1; (-) strand; PAM type: YTN; PAM sequence: CTG
accttgtggtccacccgcct

SEQ ID NO: 184401 - DNA, 20 bp, Artificial Sequence
  Description of Artificial Sequence: Synthetic oligonucleotide
  Target: ATXN1; (-) strand; PAM type: YTN; PAM sequence: CTC
ctgaccttgtggtccacccg

SEQ ID NO: 184402 - DNA, 20 bp, Artificial Sequence
  Description of Artificial Sequence: Synthetic oligonucleotide
  Target: ATXN1; (-) strand; PAM type: YTN; PAM sequence: CTC
gatctcctgaccttgtggtc

SEQ ID NO: 184403 - DNA, 20 bp, Artificial Sequence
  Description of Artificial Sequence: Synthetic oligonucleotide
  Target: ATXN1; (-) strand; PAM type: YTN; PAM sequence: TTC
tcgatctcctgaccttgtgg

SEQ ID NO: 184404 - DNA, 20 bp, Artificial Sequence
  Description of Artificial Sequence: Synthetic oligonucleotide
  Target: ATXN1; (-) strand; PAM type: YTN; PAM sequence: TTA
gccaggatgttctcgatctc

SEQ ID NO: 184405 - DNA, 20 bp, Artificial Sequence
  Description of Artificial Sequence: Synthetic oligonucleotide
  Target: ATXN1; (-) strand; PAM type: YTN; PAM sequence: CTG
tgttagccaggatgttctcg

SEQ ID NO: 184406 - DNA, 20 bp, Artificial Sequence
  Description of Artificial Sequence: Synthetic oligonucleotide
  Target: ATXN1; (-) strand; PAM type: YTN; PAM sequence: TTC
actgtgttagccaggatgtt

SEQ ID NO: 184407 - DNA, 20 bp, Artificial Sequence
  Description of Artificial Sequence: Synthetic oligonucleotide
  Target: ATXN1; (-) strand; PAM type: YTN; PAM sequence: TTT
cactgtgttagccaggatgt

SEQ ID NO: 184408 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcactg

SEQ ID NO: 184409 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcact

SEQ ID NO: 184410 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 184411 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 184412 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 184413 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 184414 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 184415 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 184416 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 184417 - DNA, 20 bp, Artificial Sequence
  Description of Artificial Sequence: Synthetic oligonucleotide
  Target: ATXN1; (-) strand; PAM type: YTN; PAM sequence: CTG
cgcccagctaatttttgtat

SEQ ID NO: 184418 - DNA, 20 bp, Artificial Sequence
  Description of Artificial Sequence: Synthetic oligonucleotide
  Target: ATXN1; (-) strand; PAM type: YTN; PAM sequence: CTG
ccactgcgcccagctaattt

SEQ ID NO: 184419 - DNA, 20 bp, Artificial Sequence
  Description of Artificial Sequence: Synthetic oligonucleotide
  Target: ATXN1; (-) strand; PAM type: YTN; PAM sequence: TTA
caggcacctgccactgcgcc

SEQ ID NO: 184420 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcacctgccac

SEQ ID NO: 184421 - DNA, 20 bp, Artificial Sequence
  Description of Artificial Sequence: Synthetic oligonucleotide
  Target: ATXN1; (-) strand; PAM type: YTN; PAM sequence: CTA
gtagctgggattacaggcac

SEQ ID NO: 184422 - DNA, 20 bp, Artificial Sequence
  Description of Artificial Sequence: Synthetic oligonucleotide
  Target: ATXN1; (-) strand; PAM type: YTN; PAM sequence: CTC
cctagtagctgggattacag

SEQ ID NO: 184423 - DNA, 20 bp, Artificial Sequence
  Description of Artificial Sequence: Synthetic oligonucleotide
  Target: ATXN1; (-) strand; PAM type: YTN; PAM sequence: CTC
agcctccctagtagctggga

SEQ ID NO: 184424 - DNA, 20 bp, Artificial Sequence
  Description of Artificial Sequence: Synthetic oligonucleotide
  Target: ATXN1; (-) strand; PAM type: YTN; PAM sequence: CTG
cctcagcctccctagtagct

SEQ ID NO: 184425 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctccctagta

SEQ ID NO: 184426 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctccctag

SEQ ID NO: 184427 - DNA, 20 bp, Artificial Sequence
  Description of Artificial Sequence: Synthetic oligonucleotide
  Target: ATXN1; (-) strand; PAM type: YTN; PAM sequence: CTG
ggtacaagcgattctcctgc

SEQ ID NO: 184428 - DNA, 20 bp, Artificial Sequence
  Description of Artificial Sequence: Synthetic oligonucleotide
  Target: ATXN1; (-) strand; PAM type: YTN; PAM sequence: CTG
cccccgcctgggtacaagcg

SEQ ID NO: 184429 - DNA, 20 bp, Artificial Sequence
  Description of Artificial Sequence: Synthetic oligonucleotide
  Target: ATXN1; (-) strand; PAM type: YTN; PAM sequence: CTC
tgcccccgcctgggtacaag

SEQ ID NO: 184430 - DNA, 20 bp, Artificial Sequence
  Description of Artificial Sequence: Synthetic oligonucleotide
  Target: ATXN1; (-) strand; PAM type: YTN; PAM sequence: CTG
caatctctgcccccgcctgg

SEQ ID NO: 184431 - DNA, 20 bp, Artificial Sequence
  Description of Artificial Sequence: Synthetic oligonucleotide
  Target: ATXN1; (-) strand; PAM type: YTN; PAM sequence: CTC
actgcaatctctgcccccgc

SEQ ID NO: 184432 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaatctctgcc

SEQ ID NO: 184433 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgcaatctc

SEQ ID NO: 184434 - DNA, 20 bp, Artificial Sequence
  Description of Artificial Sequence: Synthetic oligonucleotide
  Target: ATXN1; (-) strand; PAM type: YTN; PAM sequence: CTG
tcacccagactggagtgcag

SEQ ID NO: 184435 - DNA, 20 bp, Artificial Sequence
  Description of Artificial Sequence: Synthetic oligonucleotide
  Target: ATXN1; (-) strand; PAM type: YTN; PAM sequence: CTC
tgtcacccagactggagtgc

SEQ ID NO: 184436 - DNA, 20 bp, Artificial Sequence
  Description of Artificial Sequence: Synthetic oligonucleotide
  Target: ATXN1; (-) strand; PAM type: YTN; PAM sequence: CTG
actctgtcacccagactgga

SEQ ID NO: 184437 - DNA, 20 bp, Artificial Sequence
  Description of Artificial Sequence: Synthetic oligonucleotide
  Target: ATXN1; (-) strand; PAM type: YTN; PAM sequence: TTG
agatggggtctgactctgtc

SEQ ID NO: 184438 - DNA, 20 bp, Artificial Sequence
  Description of Artificial Sequence: Synthetic oligonucleotide
  Target: ATXN1; (-) strand; PAM type: YTN; PAM sequence: TTT
gagatggggtctgactctgt

SEQ ID NO: 184439 - DNA, 20 bp, Artificial Sequence
  Description of Artificial Sequence: Synthetic oligonucleotide
  Target: ATXN1; (-) strand; PAM type: YTN; PAM sequence: TTT
tgagatggggtctgactctg

SEQ ID NO: 184440 - DNA, 20 bp, Artificial Sequence
  Description of Artificial Sequence: Synthetic oligonucleotide
  Target: ATXN1; (-) strand; PAM type: YTN; PAM sequence: TTT
ttgagatggggtctgactct

SEQ ID NO: 184441 - DNA, 20 bp, Artificial Sequence
  Description of Artificial Sequence: Synthetic oligonucleotide
  Target: ATXN1; (-) strand; PAM type: YTN; PAM sequence: TTT
tttgagatggggtctgactc

SEQ ID NO: 184442 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggggtctgact

SEQ ID NO: 184443 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggggtctgac

SEQ ID NO: 184444 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggggtctga

SEQ ID NO: 184445 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggggtctg

SEQ ID NO: 184446 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggggtct

SEQ ID NO: 184447 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggggtc

SEQ ID NO: 184448 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggggt

SEQ ID NO: 184449 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatgggg

SEQ ID NO: 184450 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagatggg

SEQ ID NO: 184451 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagatgg

SEQ ID NO: 184452 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagatg

SEQ ID NO: 184453 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagat

SEQ ID NO: 184454 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 184455 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 184456 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 184457 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 184458 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184459 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184460 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184461 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184462 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184463 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184464 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184465 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184466 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184467 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184468 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 184469 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttt

SEQ ID NO: 184470 - DNA, 20 bp, Artificial Sequence
  Description of Artificial Sequence: Synthetic oligonucleotide
  Target: ATXN1; (-) strand; PAM type: YTN; PAM sequence: TTA
ggcctttttttttttttttt

SEQ ID NO: 184471 - DNA, 20 bp, Artificial Sequence
  Description of Artificial Sequence: Synthetic oligonucleotide
  Target: ATXN1; (-) strand; PAM type: YTN; PAM sequence: TTT
aggccttttttttttttttt

SEQ ID NO: 184472 - DNA, 20 bp, Artificial Sequence
  Description of Artificial Sequence: Synthetic oligonucleotide
  Target: ATXN1; (-) strand; PAM type: YTN; PAM sequence: CTG
acatttaggccttttttttt

SEQ ID NO: 184473 - DNA, 20 bp, Artificial Sequence
  Description of Artificial Sequence: Synthetic oligonucleotide
  Target: ATXN1; (-) strand; PAM type: YTN; PAM sequence: CTC
ctgacatttaggcctttttt

SEQ ID NO: 184474 - DNA, 20 bp, Artificial Sequence
  Description of Artificial Sequence: Synthetic oligonucleotide
  Target: ATXN1; (-) strand; PAM type: YTN; PAM sequence: TTC
cctcctgacatttaggcctt

SEQ ID NO: 184475 - DNA, 20 bp, Artificial Sequence
  Description of Artificial Sequence: Synthetic oligonucleotide
  Target: ATXN1; (-) strand; PAM type: YTN; PAM sequence: TTG
ggttccctcctgacatttag

SEQ ID NO: 184476 - DNA, 20 bp, Artificial Sequence
  Description of Artificial Sequence: Synthetic oligonucleotide
  Target: ATXN1; (-) strand; PAM type: YTN; PAM sequence: CTT
gggttccctcctgacattta

SEQ ID NO: 184477 - DNA, 20 bp, Artificial Sequence
  Description of Artificial Sequence: Synthetic oligonucleotide
  Target: ATXN1; (-) strand; PAM type: YTN; PAM sequence: CTC
ttgggttccctcctgacatt

SEQ ID NO: 184478 - DNA, 20 bp, Artificial Sequence
  Description of Artificial Sequence: Synthetic oligonucleotide
  Target: ATXN1; (-) strand; PAM type: YTN; PAM sequence: TTA
tcctcttgggttccctcctg

SEQ ID NO: 184479 - DNA, 20 bp, Artificial Sequence
  Description of Artificial Sequence: Synthetic oligonucleotide
  Target: ATXN1; (-) strand; PAM type: YTN; PAM sequence: TTG
atagagagttatcctcttgg

SEQ ID NO: 184480 - DNA, 20 bp, Artificial Sequence
  Description of Artificial Sequence: Synthetic oligonucleotide
  Target: ATXN1; (-) strand; PAM type: YTN; PAM sequence: CTT
gatagagagttatcctcttg

SEQ ID NO: 184481 - DNA, 20 bp, Artificial Sequence
  Description of Artificial Sequence: Synthetic oligonucleotide
  Target: ATXN1; (-) strand; PAM type: YTN; PAM sequence: CTA
cttgatagagagttatcctc

SEQ ID NO: 184482 - DNA, 20 bp, Artificial Sequence
  Description of Artificial Sequence: Synthetic oligonucleotide
  Target: ATXN1; (-) strand; PAM type: YTN; PAM sequence: CTA
ggaaccctacttgatagaga

SEQ ID NO: 184483 - DNA, 20 bp, Artificial Sequence
  Description of Artificial Sequence: Synthetic oligonucleotide
  Target: ATXN1; (-) strand; PAM type: YTN; PAM sequence: CTG
aaagagaagaaatctaggaa

SEQ ID NO: 184484 - DNA, 20 bp, Artificial Sequence
  Description of Artificial Sequence: Synthetic oligonucleotide
  Target: ATXN1; (-) strand; PAM type: YTN; PAM sequence: TTC
tgaaagagaagaaatctagg

SEQ ID NO: 184485 - DNA, 20 bp, Artificial Sequence
  Description of Artificial Sequence: Synthetic oligonucleotide
  Target: ATXN1; (-) strand; PAM type: YTN; PAM sequence: CTA
aatatgatcagatgagaatt

SEQ ID NO: 184486 - DNA, 20 bp, Artificial Sequence
  Description of Artificial Sequence: Synthetic oligonucleotide
  Target: ATXN1; (-) strand; PAM type: YTN; PAM sequence: CTA
tcctaaatatgatcagatga

SEQ ID NO: 184487 - DNA, 20 bp, Artificial Sequence
  Description of Artificial Sequence: Synthetic oligonucleotide
  Target: ATXN1; (-) strand; PAM type: YTN; PAM sequence: TTG
cgctatcctaaatatgatca

SEQ ID NO: 184488 - DNA, 20 bp, Artificial Sequence
  Description of Artificial Sequence: Synthetic oligonucleotide
  Target: ATXN1; (-) strand; PAM type: YTN; PAM sequence: CTT
gcgctatcctaaatatgatc

SEQ ID NO: 184489 - DNA, 20 bp, Artificial Sequence
  Description of Artificial Sequence: Synthetic oligonucleotide
  Target: ATXN1; (-) strand; PAM type: YTN; PAM sequence: CTC
ttgcgctatcctaaatatga

SEQ ID NO: 184490 - DNA, 20 bp, Artificial Sequence
  Description of Artificial Sequence: Synthetic oligonucleotide
  Target: ATXN1; (-) strand; PAM type: YTN; PAM sequence: CTG
ccctcttgcgctatcctaaa

SEQ ID NO: 184491 - DNA, 20 bp, Artificial Sequence
  Description of Artificial Sequence: Synthetic oligonucleotide
  Target: ATXN1; (-) strand; PAM type: YTN; PAM sequence: TTG
tactgccctcttgcgctatc

SEQ ID NO: 184492 - DNA, 20 bp, Artificial Sequence
  Description of Artificial Sequence: Synthetic oligonucleotide
  Target: ATXN1; (-) strand; PAM type: YTN; PAM sequence: CTG
ccaatatcaattgtactgcc

SEQ ID NO: 184493 - DNA, 20 bp, Artificial Sequence
  Description of Artificial Sequence: Synthetic oligonucleotide
  Target: ATXN1; (-) strand; PAM type: YTN; PAM sequence: TTC
tgccaatatcaattgtactg

SEQ ID NO: 184494 - DNA, 20 bp, Artificial Sequence
  Description of Artificial Sequence: Synthetic oligonucleotide
  Target: ATXN1; (-) strand; PAM type: YTN; PAM sequence: TTT
ctgccaatatcaattgtact

SEQ ID NO: 184495 - DNA, 20 bp, Artificial Sequence
  Description of Artificial Sequence: Synthetic oligonucleotide
  Target: ATXN1; (-) strand; PAM type: YTN; PAM sequence: TTT
tctgccaatatcaattgtac

SEQ ID NO: 184496 - DNA, 20 bp, Artificial Sequence
  Description of Artificial Sequence: Synthetic oligonucleotide
  Target: ATXN1; (-) strand; PAM type: YTN; PAM sequence: CTT
ttctgccaatatcaattgta

SEQ ID NO: 184497 - DNA, 20 bp, Artificial Sequence
  Description of Artificial Sequence: Synthetic oligonucleotide
  Target: ATXN1; (-) strand; PAM type: YTN; PAM sequence: CTC
ttttctgccaatatcaattg

SEQ ID NO: 184498 - DNA, 20 bp, Artificial Sequence
  Description of Artificial Sequence: Synthetic oligonucleotide
  Target: ATXN1; (-) strand; PAM type: YTN; PAM sequence: TTC
tcttttctgccaatatcaat

SEQ ID NO: 184499 - DNA, 20 bp, Artificial Sequence
  Description of Artificial Sequence: Synthetic oligonucleotide
  Target: ATXN1; (-) strand; PAM type: YTN; PAM sequence: TTT
ctcttttctgccaatatcaa

SEQ ID NO: 184500 - DNA, 20 bp, Artificial Sequence
  Description of Artificial Sequence: Synthetic oligonucleotide
  Target: ATXN1; (-) strand; PAM type: YTN; PAM sequence: TTT
tctcttttctgccaatatca

SEQ ID NO: 184501 - DNA, 20 bp, Artificial Sequence
  Description of Artificial Sequence: Synthetic oligonucleotide
  Target: ATXN1; (-) strand; PAM type: YTN; PAM sequence: CTT
ttctcttttctgccaatatc

SEQ ID NO: 184502 - DNA, 20 bp, Artificial Sequence
  Description of Artificial Sequence: Synthetic oligonucleotide
  Target: ATXN1; (-) strand; PAM type: YTN; PAM sequence: TTG
gatatgcccccttttctctt

SEQ ID NO: 184503 - DNA, 20 bp, Artificial Sequence
  Description of Artificial Sequence: Synthetic oligonucleotide
  Target: ATXN1; (-) strand; PAM type: YTN; PAM sequence: TTC
accagttggatatgccccct

SEQ ID NO: 184504 - DNA, 20 bp, Artificial Sequence
  Description of Artificial Sequence: Synthetic oligonucleotide
  Target: ATXN1; (-) strand; PAM type: YTN; PAM sequence: TTT
caccagttggatatgccccc

SEQ ID NO: 184505 - DNA, 20 bp, Artificial Sequence
  Description of Artificial Sequence: Synthetic oligonucleotide
  Target: ATXN1; (-) strand; PAM type: YTN; PAM sequence: TTC
gatttcaccagttggatatg

SEQ ID NO: 184506 - DNA, 20 bp, Artificial Sequence
  Description of Artificial Sequence: Synthetic oligonucleotide
  Target: ATXN1; (-) strand; PAM type: YTN; PAM sequence: CTT
cgatttcaccagttggatat

SEQ ID NO: 184507 - DNA, 20 bp, Artificial Sequence
  Description of Artificial Sequence: Synthetic oligonucleotide
  Target: ATXN1; (-) strand; PAM type: YTN; PAM sequence: TTC
ttcgatttcaccagttggat

SEQ ID NO: 184508 - DNA, 20 bp, Artificial Sequence
  Description of Artificial Sequence: Synthetic oligonucleotide
  Target: ATXN1; (-) strand; PAM type: YTN; PAM sequence: TTC
cagtatatgaatgtaagagt

SEQ ID NO: 184509 - DNA, 20 bp, Artificial Sequence
  Description of Artificial Sequence: Synthetic oligonucleotide
  Target: ATXN1; (-) strand; PAM type: YTN; PAM sequence: TTT
ccagtatatgaatgtaagag

SEQ ID NO: 184510 - DNA, 20 bp, Artificial Sequence
  Description of Artificial Sequence: Synthetic oligonucleotide
  Target: ATXN1; (-) strand; PAM type: YTN; PAM sequence: TTT
tccagtatatgaatgtaaga

SEQ ID NO: 184511 - DNA, 20 bp, Artificial Sequence
  Description of Artificial Sequence: Synthetic oligonucleotide
  Target: ATXN1; (-) strand; PAM type: YTN; PAM sequence: CTT
ttccagtatatgaatgtaag

SEQ ID NO: 184512 - DNA, 20 bp, Artificial Sequence
  Description of Artificial Sequence: Synthetic oligonucleotide
  Target: ATXN1; (-) strand; PAM type: YTN; PAM sequence: CTG
acttttccagtatatgaatg

SEQ ID NO: 184513 - DNA, 20 bp, Artificial Sequence
  Description of Artificial Sequence: Synthetic oligonucleotide
  Target: ATXN1; (-) strand; PAM type: YTN; PAM sequence: CTA
ctgacttttccagtatatga

SEQ ID NO: 184514 - DNA, 20 bp, Artificial Sequence
  Description of Artificial Sequence: Synthetic oligonucleotide
  Target: ATXN1; (-) strand; PAM type: YTN; PAM sequence: CTG
gctactgacttttccagtat

SEQ ID NO: 184515 - DNA, 20 bp, Artificial Sequence
  Description of Artificial Sequence: Synthetic oligonucleotide
  Target: ATXN1; (-) strand; PAM type: YTN; PAM sequence: TTC
tggctactgacttttccagt

SEQ ID NO: 184516 - DNA, 20 bp, Artificial Sequence
  Description of Artificial Sequence: Synthetic oligonucleotide
  Target: ATXN1; (-) strand; PAM type: YTN; PAM sequence: TTT
ctggctactgacttttccag

SEQ ID NO: 184517 - DNA, 20 bp, Artificial Sequence
  Description of Artificial Sequence: Synthetic oligonucleotide
  Target: ATXN1; (-) strand; PAM type: YTN; PAM sequence: TTT
tctggctactgacttttcca

SEQ ID NO: 184518 - DNA, 20 bp, Artificial Sequence
  Description of Artificial Sequence: Synthetic oligonucleotide
  Target: ATXN1; (-) strand; PAM type: YTN; PAM sequence: TTT
ttctggctactgacttttcc

SEQ ID NO: 184519 - DNA, 20 bp, Artificial Sequence
  Description of Artificial Sequence: Synthetic oligonucleotide
  Target: ATXN1; (-) strand; PAM type: YTN; PAM sequence: TTC
aaaatatttttctggctact

SEQ ID NO: 184520 - DNA, 20 bp, Artificial Sequence
  Description of Artificial Sequence: Synthetic oligonucleotide
  Target: ATXN1; (-) strand; PAM type: YTN; PAM sequence: TTT
caaaatatttttctggctac

SEQ ID NO: 184521 - DNA, 20 bp, Artificial Sequence
  Description of Artificial Sequence: Synthetic oligonucleotide
  Target: ATXN1; (-) strand; PAM type: YTN; PAM sequence: TTT
tcaaaatatttttctggcta

SEQ ID NO: 184522 - DNA, 20 bp, Artificial Sequence
  Description of Artificial Sequence: Synthetic oligonucleotide
  Target: ATXN1; (-) strand; PAM type: YTN; PAM sequence: TTA
cagattttcaaaatattttt

SEQ ID NO: 184523 - DNA, 20 bp, Artificial Sequence
  Description of Artificial Sequence: Synthetic oligonucleotide
  Target: ATXN1; (-) strand; PAM type: YTN; PAM sequence: TTA
ttacagattttcaaaatatt

SEQ ID NO: 184524 - DNA, 20 bp, Artificial Sequence
  Description of Artificial Sequence: Synthetic oligonucleotide
  Target: ATXN1; (-) strand; PAM type: YTN; PAM sequence: CTG
aattattacagattttcaaa

SEQ ID NO: 184525 - DNA, 20 bp, Artificial Sequence
  Description of Artificial Sequence: Synthetic oligonucleotide
  Target: ATXN1; (-) strand; PAM type: YTN; PAM sequence: TTC
catctgaattattacagatt

SEQ ID NO: 184526 - DNA, 20 bp, Artificial Sequence
  Description of Artificial Sequence: Synthetic oligonucleotide
  Target: ATXN1; (-) strand; PAM type: YTN; PAM sequence: TTT
ccatctgaattattacagat

SEQ ID NO: 184527 - DNA, 20 bp, Artificial Sequence
  Description of Artificial Sequence: Synthetic oligonucleotide
  Target: ATXN1; (-) strand; PAM type: YTN; PAM sequence: CTT
tccatctgaattattacaga

SEQ ID NO: 184528 - DNA, 20 bp, Artificial Sequence
  Description of Artificial Sequence: Synthetic oligonucleotide
  Target: ATXN1; (-) strand; PAM type: YTN; PAM sequence: TTG
tgaatgtctttccatctgaa

SEQ ID NO: 184529 - DNA, 20 bp, Artificial Sequence
  Description of Artificial Sequence: Synthetic oligonucleotide
  Target: ATXN1; (-) strand; PAM type: YTN; PAM sequence: TTG
caaaagttgtgaatgtcttt

SEQ ID NO: 184530 - DNA, 20 bp, Artificial Sequence
  Description of Artificial Sequence: Synthetic oligonucleotide
  Target: ATXN1; (-) strand; PAM type: YTN; PAM sequence: CTC
acattgcaaaagttgtgaat

SEQ ID NO: 184531 - DNA, 20 bp, Artificial Sequence
  Description of Artificial Sequence: Synthetic oligonucleotide
  Target: ATXN1; (-) strand; PAM type: YTN; PAM sequence: CTC
tcacattgcaaaagttgtga

SEQ ID NO: 184532 - DNA, 20 bp, Artificial Sequence
  Description of Artificial Sequence: Synthetic oligonucleotide
  Target: ATXN1; (-) strand; PAM type: YTN; PAM sequence: TTC
tctcacattgcaaaagttgt

SEQ ID NO: 184533 - DNA, 20 bp, Artificial Sequence
  Description of Artificial Sequence: Synthetic oligonucleotide
  Target: ATXN1; (-) strand; PAM type: YTN; PAM sequence: CTT
ctctcacattgcaaaagttg

SEQ ID NO: 184534 - DNA, 20 bp, Artificial Sequence
  Description of Artificial Sequence: Synthetic oligonucleotide
  Target: ATXN1; (-) strand; PAM type: YTN; PAM sequence: TTC
ttctctcacattgcaaaagt

SEQ ID NO: 184535 - DNA, 20 bp, Artificial Sequence
  Description of Artificial Sequence: Synthetic oligonucleotide
  Target: ATXN1; (-) strand; PAM type: YTN; PAM sequence: TTT
cttctctcacattgcaaaag

SEQ ID NO: 184536 - DNA, 20 bp, Artificial Sequence
  Description of Artificial Sequence: Synthetic oligonucleotide
  Target: ATXN1; (-) strand; PAM type: YTN; PAM sequence: TTC
cgaaatttcttctctcacat

SEQ ID NO: 184537 - DNA, 20 bp, Artificial Sequence
  Description of Artificial Sequence: Synthetic oligonucleotide
  Target: ATXN1; (-) strand; PAM type: YTN; PAM sequence: TTT
ccgaaatttcttctctcaca

SEQ ID NO: 184538 - DNA, 20 bp, Artificial Sequence
  Description of Artificial Sequence: Synthetic oligonucleotide
  Target: ATXN1; (-) strand; PAM type: YTN; PAM sequence: TTT
tccgaaatttcttctctcac

SEQ ID NO: 184539 - DNA, 20 bp, Artificial Sequence
  Description of Artificial Sequence: Synthetic oligonucleotide
  Target: ATXN1; (-) strand; PAM type: YTN; PAM sequence: CTT
ttccgaaatttcttctctca

SEQ ID NO: 184540 - DNA, 20 bp, Artificial Sequence
  Description of Artificial Sequence: Synthetic oligonucleotide
  Target: ATXN1; (-) strand; PAM type: YTN; PAM sequence: CTA
cttttccgaaatttcttctc

SEQ ID NO: 184541 - DNA, 20 bp, Artificial Sequence
  Description of Artificial Sequence: Synthetic oligonucleotide
  Target: ATXN1; (-) strand; PAM type: YTN; PAM sequence: TTG
atctacttttccgaaatttc

SEQ ID NO: 184542 - DNA, 20 bp, Artificial Sequence
  Description of Artificial Sequence: Synthetic oligonucleotide
  Target: ATXN1; (-) strand; PAM type: YTN; PAM sequence: CTT
gatctacttttccgaaattt

SEQ ID NO: 184543 - DNA, 20 bp, Artificial Sequence
  Description of Artificial Sequence: Synthetic oligonucleotide
  Target: ATXN1; (-) strand; PAM type: YTN; PAM sequence: TTA
cagaaatagaatcgtgcttg

SEQ ID NO: 184544 - DNA, 20 bp, Artificial Sequence
  Description of Artificial Sequence: Synthetic oligonucleotide
  Target: ATXN1; (-) strand; PAM type: YTN; PAM sequence: TTT
acagaaatagaatcgtgctt

SEQ ID NO: 184545 - DNA, 20 bp, Artificial Sequence
  Description of Artificial Sequence: Synthetic oligonucleotide
  Target: ATXN1; (-) strand; PAM type: YTN; PAM sequence: CTT
tacagaaatagaatcgtgct

SEQ ID NO: 184546 - DNA, 20 bp, Artificial Sequence
  Description of Artificial Sequence: Synthetic oligonucleotide
  Target: ATXN1; (-) strand; PAM type: YTN; PAM sequence: CTA
tggatatatatatatacaaa

SEQ ID NO: 184547 - DNA, 20 bp, Artificial Sequence
  Description of Artificial Sequence: Synthetic oligonucleotide
  Target: ATXN1; (-) strand; PAM type: YTN; PAM sequence: TTC
tatggatatatatatataca

SEQ ID NO: 184548 - DNA, 20 bp, Artificial Sequence
  Description of Artificial Sequence: Synthetic oligonucleotide
  Target: ATXN1; (-) strand; PAM type: YTN; PAM sequence: TTT
ctatggatatatatatatac

SEQ ID NO: 184549 - DNA, 20 bp, Artificial Sequence
  Description of Artificial Sequence: Synthetic oligonucleotide
  Target: ATXN1; (-) strand; PAM type: YTN; PAM sequence: TTT
tctatggatatatatatata

SEQ ID NO: 184550 - DNA, 20 bp, Artificial Sequence
  Description of Artificial Sequence: Synthetic oligonucleotide
  Target: ATXN1; (-) strand; PAM type: YTN; PAM sequence: TTC
cagaagattttctatggata

SEQ ID NO: 184551 - DNA, 20 bp, Artificial Sequence
  Description of Artificial Sequence: Synthetic oligonucleotide
  Target: ATXN1; (-) strand; PAM type: YTN; PAM sequence: CTT
ccagaagattttctatggat

SEQ ID NO: 184552 - DNA, 20 bp, Artificial Sequence
  Description of Artificial Sequence: Synthetic oligonucleotide
  Target: ATXN1; (-) strand; PAM type: YTN; PAM sequence: TTC
ttccagaagattttctatgg

SEQ ID NO: 184553 - DNA, 20 bp, Artificial Sequence
  Description of Artificial Sequence: Synthetic oligonucleotide
  Target: ATXN1; (-) strand; PAM type: YTN; PAM sequence: TTT
cttccagaagattttctatg

SEQ ID NO: 184554 - DNA, 20 bp, Artificial Sequence
  Description of Artificial Sequence: Synthetic oligonucleotide
  Target: ATXN1; (-) strand; PAM type: YTN; PAM sequence: TTT
tcttccagaagattttctat

SEQ ID NO: 184555 - DNA, 20 bp, Artificial Sequence
  Description of Artificial Sequence: Synthetic oligonucleotide
  Target: ATXN1; (-) strand; PAM type: YTN; PAM sequence: TTG
agtgtgttttcttccagaag

SEQ ID NO: 184556 - DNA, 20 bp, Artificial Sequence
  Description of Artificial Sequence: Synthetic oligonucleotide
  Target: ATXN1; (-) strand; PAM type: YTN; PAM sequence: TTT
gagtgtgttttcttccagaa

SEQ ID NO: 184557 - DNA, 20 bp, Artificial Sequence
  Description of Artificial Sequence: Synthetic oligonucleotide
  Target: ATXN1; (-) strand; PAM type: YTN; PAM sequence: TTA
gcatttgagtgtgttttctt

SEQ ID NO: 184558 - DNA, 20 bp, Artificial Sequence
  Description of Artificial Sequence: Synthetic oligonucleotide
  Target: ATXN1; (-) strand; PAM type: YTN; PAM sequence: TTC
accaccgttagcatttgagt

SEQ ID NO: 184559 - DNA, 20 bp, Artificial Sequence
  Description of Artificial Sequence: Synthetic oligonucleotide
  Target: ATXN1; (-) strand; PAM type: YTN; PAM sequence: CTG
cccatagatgttcaccaccg

SEQ ID NO: 184560 - DNA, 20 bp, Artificial Sequence
  Description of Artificial Sequence: Synthetic oligonucleotide
  Target: ATXN1; (-) strand; PAM type: YTN; PAM sequence: CTA
cctgcccatagatgttcacc

SEQ ID NO: 184561 - DNA, 20 bp, Artificial Sequence
  Description of Artificial Sequence: Synthetic oligonucleotide
  Target: ATXN1; (-) strand; PAM type: YTN; PAM sequence: TTA
tctacctgcccatagatgtt

SEQ ID NO: 184562 - DNA, 20 bp, Artificial Sequence
  Description of Artificial Sequence: Synthetic oligonucleotide
  Target: ATXN1; (-) strand; PAM type: YTN; PAM sequence: TTA
ttatctacctgcccatagat

SEQ ID NO: 184563 - DNA, 20 bp, Artificial Sequence
  Description of Artificial Sequence: Synthetic oligonucleotide
  Target: ATXN1; (-) strand; PAM type: YTN; PAM sequence: CTG
ccatgtcattattatctacc

SEQ ID NO: 184564 - DNA, 20 bp, Artificial Sequence
  Description of Artificial Sequence: Synthetic oligonucleotide
  Target: ATXN1; (-) strand; PAM type: YTN; PAM sequence: TTA
aaaatctgccatgtcattat

SEQ ID NO: 184565 - DNA, 20 bp, Artificial Sequence
  Description of Artificial Sequence: Synthetic oligonucleotide
  Target: ATXN1; (-) strand; PAM type: YTN; PAM sequence: CTA
gtaatattaaaaatctgcca

SEQ ID NO: 184566 - DNA, 20 bp, Artificial Sequence
  Description of Artificial Sequence: Synthetic oligonucleotide
  Target: ATXN1; (-) strand; PAM type: YTN; PAM sequence: TTA
aggaaatacaaactagtaat

SEQ ID NO: 184567 - DNA, 20 bp, Artificial Sequence
  Description of Artificial Sequence: Synthetic oligonucleotide
  Target: ATXN1; (-) strand; PAM type: YTN; PAM sequence: TTG
aagagaaattaaggaaatac

SEQ ID NO: 184568 - DNA, 20 bp, Artificial Sequence
  Description of Artificial Sequence: Synthetic oligonucleotide
  Target: ATXN1; (-) strand; PAM type: YTN; PAM sequence: CTT
gaagagaaattaaggaaata

SEQ ID NO: 184569 - DNA, 20 bp, Artificial Sequence
  Description of Artificial Sequence: Synthetic oligonucleotide
  Target: ATXN1; (-) strand; PAM type: YTN; PAM sequence: CTG
taatagcttgaagagaaatt

SEQ ID NO: 184570 - DNA, 20 bp, Artificial Sequence
  Description of Artificial Sequence: Synthetic oligonucleotide
  Target: ATXN1; (-) strand; PAM type: YTN; PAM sequence: CTC
tgtaatagcttgaagagaaa

SEQ ID NO: 184571 - DNA, 20 bp, Artificial Sequence
  Description of Artificial Sequence: Synthetic oligonucleotide
  Target: ATXN1; (-) strand; PAM type: YTN; PAM sequence: TTC
tctgtaatagcttgaagaga

SEQ ID NO: 184572 - DNA, 20 bp, Artificial Sequence
  Description of Artificial Sequence: Synthetic oligonucleotide
  Target: ATXN1; (-) strand; PAM type: YTN; PAM sequence: TTA
catggattctctgtaatagc

SEQ ID NO: 184573 - DNA, 20 bp, Artificial Sequence
  Description of Artificial Sequence: Synthetic oligonucleotide
  Target: ATXN1; (-) strand; PAM type: YTN; PAM sequence: TTT
acatggattctctgtaatag

SEQ ID NO: 184574 - DNA, 20 bp, Artificial Sequence
  Description of Artificial Sequence: Synthetic oligonucleotide
  Target: ATXN1; (-) strand; PAM type: YTN; PAM sequence: TTT
tacatggattctctgtaata

SEQ ID NO: 184575 - DNA, 20 bp, Artificial Sequence
  Description of Artificial Sequence: Synthetic oligonucleotide
  Target: ATXN1; (-) strand; PAM type: YTN; PAM sequence: CTT
ttacatggattctctgtaat

SEQ ID NO: 184576 - DNA, 20 bp, Artificial Sequence
  Description of Artificial Sequence: Synthetic oligonucleotide
  Target: ATXN1; (-) strand; PAM type: YTN; PAM sequence: TTA
gtcttttacatggattctct

SEQ ID NO: 184577 - DNA, 20 bp, Artificial Sequence
  Description of Artificial Sequence: Synthetic oligonucleotide
  Target: ATXN1; (-) strand; PAM type: YTN; PAM sequence: TTG
aaaacattagtcttttacat

SEQ ID NO: 184578 - DNA, 20 bp, Artificial Sequence
  Description of Artificial Sequence: Synthetic oligonucleotide
  Target: ATXN1; (-) strand; PAM type: YTN; PAM sequence: TTC
attgaaaacattagtctttt

SEQ ID NO: 184579 - DNA, 20 bp, Artificial Sequence
  Description of Artificial Sequence: Synthetic oligonucleotide
  Target: ATXN1; (-) strand; PAM type: YTN; PAM sequence: TTT
cattgaaaacattagtcttt

SEQ ID NO: 184580 - DNA, 20 bp, Artificial Sequence
  Description of Artificial Sequence: Synthetic oligonucleotide
  Target: ATXN1; (-) strand; PAM type: YTN; PAM sequence: CTT
tcattgaaaacattagtctt

SEQ ID NO: 184581 - DNA, 20 bp, Artificial Sequence
  Description of Artificial Sequence: Synthetic oligonucleotide
  Target: ATXN1; (-) strand; PAM type: YTN; PAM sequence: TTA
atcctttcattgaaaacatt

SEQ ID NO: 184582 - DNA, 20 bp, Artificial Sequence
  Description of Artificial Sequence: Synthetic oligonucleotide
  Target: ATXN1; (-) strand; PAM type: YTN; PAM sequence: TTA
tgagatggaaagaacattaa

SEQ ID NO: 184583 - DNA, 20 bp, Artificial Sequence
  Description of Artificial Sequence: Synthetic oligonucleotide
  Target: ATXN1; (-) strand; PAM type: YTN; PAM sequence: TTG
agttatgagatggaaagaac

SEQ ID NO: 184584 - DNA, 20 bp, Artificial Sequence
  Description of Artificial Sequence: Synthetic oligonucleotide
  Target: ATXN1; (-) strand; PAM type: YTN; PAM sequence: CTT
gagttatgagatggaaagaa

SEQ ID NO: 184585 - DNA, 20 bp, Artificial Sequence
  Description of Artificial Sequence: Synthetic oligonucleotide
  Target: ATXN1; (-) strand; PAM type: YTN; PAM sequence: TTG
gaaacttgagttatgagatg

SEQ ID NO: 184586 - DNA, 20 bp, Artificial Sequence
  Description of Artificial Sequence: Synthetic oligonucleotide
  Target: ATXN1; (-) strand; PAM type: YTN; PAM sequence: TTA
ttggaaacttgagttatgag

SEQ ID NO: 184587 - DNA, 20 bp, Artificial Sequence
  Description of Artificial Sequence: Synthetic oligonucleotide
  Target: ATXN1; (-) strand; PAM type: YTN; PAM sequence: CTC
agcgaggaagacgttattgg

SEQ ID NO: 184588 - DNA, 20 bp, Artificial Sequence
  Description of Artificial Sequence: Synthetic oligonucleotide
  Target: ATXN1; (-) strand; PAM type: YTN; PAM sequence: CTA
ccctcagcgaggaagacgtt

SEQ ID NO: 184589 - DNA, 20 bp, Artificial Sequence
  Description of Artificial Sequence: Synthetic oligonucleotide
  Target: ATXN1; (-) strand; PAM type: YTN; PAM sequence: TTC
taccctcagcgaggaagacg

SEQ ID NO: 184590 - DNA, 20 bp, Artificial Sequence
  Description of Artificial Sequence: Synthetic oligonucleotide
  Target: ATXN1; (-) strand; PAM type: YTN; PAM sequence: CTA
ttctaccctcagcgaggaag

SEQ ID NO: 184591 - DNA, 20 bp, Artificial Sequence
  Description of Artificial Sequence: Synthetic oligonucleotide
  Target: ATXN1; (-) strand; PAM type: YTN; PAM sequence: CTG
actattctaccctcagcgag

SEQ ID NO: 184592 - DNA, 20 bp, Artificial Sequence
  Description of Artificial Sequence: Synthetic oligonucleotide
  Target: ATXN1; (-) strand; PAM type: YTN; PAM sequence: TTG
tgtaaggcactgactattct

SEQ ID NO: 184593 - DNA, 20 bp, Artificial Sequence
  Description of Artificial Sequence: Synthetic oligonucleotide
  Target: ATXN1; (-) strand; PAM type: YTN; PAM sequence: TTT
gtgtaaggcactgactattc

SEQ ID NO: 184594 - DNA, 20 bp, Artificial Sequence
  Description of Artificial Sequence: Synthetic oligonucleotide
  Target: ATXN1; (-) strand; PAM type: YTN; PAM sequence: TTT
tgtgtaaggcactgactatt

SEQ ID NO: 184595 - DNA, 20 bp, Artificial Sequence
  Description of Artificial Sequence: Synthetic oligonucleotide
  Target: ATXN1; (-) strand; PAM type: YTN; PAM sequence: CTT
ttgtgtaaggcactgactat

SEQ ID NO: 184596 - DNA, 20 bp, Artificial Sequence
  Description of Artificial Sequence: Synthetic oligonucleotide
  Target: ATXN1; (-) strand; PAM type: YTN; PAM sequence: CTG
gcttttgtgtaaggcactga

SEQ ID NO: 184597 - DNA, 20 bp, Artificial Sequence
  Description of Artificial Sequence: Synthetic oligonucleotide
  Target: ATXN1; (-) strand; PAM type: YTN; PAM sequence: TTA
atgcaaacactggcttttgt

SEQ ID NO: 184598 - DNA, 20 bp, Artificial Sequence
  Description of Artificial Sequence: Synthetic oligonucleotide
  Target: ATXN1; (-) strand; PAM type: YTN; PAM sequence: TTT
aatgcaaacactggcttttg

SEQ ID NO: 184599 - DNA, 20 bp, Artificial Sequence
  Description of Artificial Sequence: Synthetic oligonucleotide
  Target: ATXN1; (-) strand; PAM type: YTN; PAM sequence: CTG
caccacagtcatttaatgca

SEQ ID NO: 184600 - DNA, 20 bp, Artificial Sequence
  Description of Artificial Sequence: Synthetic oligonucleotide
  Target: ATXN1; (-) strand; PAM type: YTN; PAM sequence: TTA
tgcgaggctgcaccacagtc

SEQ ID NO: 184601 - DNA, 20 bp, Artificial Sequence
  Description of Artificial Sequence: Synthetic oligonucleotide
  Target: ATXN1; (-) strand; PAM type: YTN; PAM sequence: TTA
tgttatgcgaggctgcacca

SEQ ID NO: 184602 - DNA, 20 bp, Artificial Sequence
  Description of Artificial Sequence: Synthetic oligonucleotide
  Target: ATXN1; (-) strand; PAM type: YTN; PAM sequence: TTT
atgttatgcgaggctgcacc

SEQ ID NO: 184603 - DNA, 20 bp, Artificial Sequence
  Description of Artificial Sequence: Synthetic oligonucleotide
  Target: ATXN1; (-) strand; PAM type: YTN; PAM sequence: TTG
aagtcatttatgttatgcga

SEQ ID NO: 184604 - DNA, 20 bp, Artificial Sequence
  Description of Artificial Sequence: Synthetic oligonucleotide
  Target: ATXN1; (-) strand; PAM type: YTN; PAM sequence: CTG
ttgaagtcatttatgttatg

SEQ ID NO: 184605 - DNA, 20 bp, Artificial Sequence
  Description of Artificial Sequence: Synthetic oligonucleotide
  Target: ATXN1; (-) strand; PAM type: YTN; PAM sequence: TTG
tgcatcaggatgtggctgtt

SEQ ID NO: 184606 - DNA, 20 bp, Artificial Sequence
  Description of Artificial Sequence: Synthetic oligonucleotide
  Target: ATXN1; (-) strand; PAM type: YTN; PAM sequence: CTT
gtgcatcaggatgtggctgt

SEQ ID NO: 184607 - DNA, 20 bp, Artificial Sequence
  Description of Artificial Sequence: Synthetic oligonucleotide
  Target: ATXN1; (-) strand; PAM type: YTN; PAM sequence: TTC
ccttgtgcatcaggatgtgg

SEQ ID NO: 184608 - DNA, 20 bp, Artificial Sequence
  Description of Artificial Sequence: Synthetic oligonucleotide
  Target: ATXN1; (-) strand; PAM type: YTN; PAM sequence: TTT
cccttgtgcatcaggatgtg

SEQ ID NO: 184609 - DNA, 20 bp, Artificial Sequence
  Description of Artificial Sequence: Synthetic oligonucleotide
  Target: ATXN1; (-) strand; PAM type: YTN; PAM sequence: TTT
tcccttgtgcatcaggatgt

SEQ ID NO: 184610 - DNA, 20 bp, Artificial Sequence
  Description of Artificial Sequence: Synthetic oligonucleotide
  Target: ATXN1; (-) strand; PAM type: YTN; PAM sequence: TTG
ttttcccttgtgcatcagga

SEQ ID NO: 184611 - DNA, 20 bp, Artificial Sequence
  Description of Artificial Sequence: Synthetic oligonucleotide
  Target: ATXN1; (-) strand; PAM type: YTN; PAM sequence: TTT
gttttcccttgtgcatcagg

SEQ ID NO: 184612 - DNA, 20 bp, Artificial Sequence
  Description of Artificial Sequence: Synthetic oligonucleotide
  Target: ATXN1; (-) strand; PAM type: YTN; PAM sequence: CTT
tgttttcccttgtgcatcag

SEQ ID NO: 184613 - DNA, 20 bp, Artificial Sequence
  Description of Artificial Sequence: Synthetic oligonucleotide
  Target: ATXN1; (-) strand; PAM type: YTN; PAM sequence: TTC
ctttgttttcccttgtgcat

SEQ ID NO: 184614 - DNA, 20 bp, Artificial Sequence
  Description of Artificial Sequence: Synthetic oligonucleotide
  Target: ATXN1; (-) strand; PAM type: YTN; PAM sequence: TTC
cattcctttgttttcccttg

SEQ ID NO: 184615 - DNA, 20 bp, Artificial Sequence
  Description of Artificial Sequence: Synthetic oligonucleotide
  Target: ATXN1; (-) strand; PAM type: YTN; PAM sequence: TTT
ccattcctttgttttccctt

SEQ ID NO: 184616 - DNA, 20 bp, Artificial Sequence
  Description of Artificial Sequence: Synthetic oligonucleotide
  Target: ATXN1; (-) strand; PAM type: YTN; PAM sequence: TTG
aaatttccattcctttgttt

SEQ ID NO: 184617 - DNA, 20 bp, Artificial Sequence
  Description of Artificial Sequence: Synthetic oligonucleotide
  Target: ATXN1; (-) strand; PAM type: YTN; PAM sequence: TTT
gaaatttccattcctttgtt

SEQ ID NO: 184618 - DNA, 20 bp, Artificial Sequence
  Description of Artificial Sequence: Synthetic oligonucleotide
  Target: ATXN1; (-) strand; PAM type: YTN; PAM sequence: TTT
tgaaatttccattcctttgt

SEQ ID NO: 184619 - DNA, 20 bp, Artificial Sequence
  Description of Artificial Sequence: Synthetic oligonucleotide
  Target: ATXN1; (-) strand; PAM type: YTN; PAM sequence: TTT
ttgaaatttccattcctttg

SEQ ID NO: 184620 - DNA, 20 bp, Artificial Sequence
  Description of Artificial Sequence: Synthetic oligonucleotide
  Target: ATXN1; (-) strand; PAM type: YTN; PAM sequence: CTT
tttgaaatttccattccttt

SEQ ID NO: 184621 - DNA, 20 bp, Artificial Sequence
  Description of Artificial Sequence: Synthetic oligonucleotide
  Target: ATXN1; (-) strand; PAM type: YTN; PAM sequence: TTA
gctttttgaaatttccattc

SEQ ID NO: 184622 - DNA, 20 bp, Artificial Sequence
  Description of Artificial Sequence: Synthetic oligonucleotide
  Target: ATXN1; (-) strand; PAM type: YTN; PAM sequence: TTT
agctttttgaaatttccatt

SEQ ID NO: 184623 - DNA, 20 bp, Artificial Sequence
  Description of Artificial Sequence: Synthetic oligonucleotide
  Target: ATXN1; (-) strand; PAM type: YTN; PAM sequence: CTT
tagctttttgaaatttccat

SEQ ID NO: 184624 - DNA, 20 bp, Artificial Sequence
  Description of Artificial Sequence: Synthetic oligonucleotide
  Target: ATXN1; (-) strand; PAM type: YTN; PAM sequence: TTG
tgactttagctttttgaaat

SEQ ID NO: 184625 - DNA, 20 bp, Artificial Sequence
  Description of Artificial Sequence: Synthetic oligonucleotide
  Target: ATXN1; (-) strand; PAM type: YTN; PAM sequence: TTT
gtgactttagctttttgaaa

SEQ ID NO: 184626 - DNA, 20 bp, Artificial Sequence
  Description of Artificial Sequence: Synthetic oligonucleotide
  Target: ATXN1; (-) strand; PAM type: YTN; PAM sequence: TTT
tgtgactttagctttttgaa

SEQ ID NO: 184627 - DNA, 20 bp, Artificial Sequence
  Description of Artificial Sequence: Synthetic oligonucleotide
  Target: ATXN1; (-) strand; PAM type: YTN; PAM sequence: TTT
ttgtgactttagctttttga

SEQ ID NO: 184628 - DNA, 20 bp, Artificial Sequence
  Description of Artificial Sequence: Synthetic oligonucleotide
  Target: ATXN1; (-) strand; PAM type: YTN; PAM sequence: CTT
tttgtgactttagctttttg

SEQ ID NO: 184629 - DNA, 20 bp, Artificial Sequence
  Description of Artificial Sequence: Synthetic oligonucleotide
  Target: ATXN1; (-) strand; PAM type: YTN; PAM sequence: TTA
ctttttgtgactttagcttt

SEQ ID NO: 184630 - DNA, 20 bp, Artificial Sequence
  Description of Artificial Sequence: Synthetic oligonucleotide
  Target: ATXN1; (-) strand; PAM type: YTN; PAM sequence: TTC
cattactttttgtgacttta

SEQ ID NO: 184631 - DNA, 20 bp, Artificial Sequence
  Description of Artificial Sequence: Synthetic oligonucleotide
  Target: ATXN1; (-) strand; PAM type: YTN; PAM sequence: CTT
ccattactttttgtgacttt

SEQ ID NO: 184632 - DNA, 20 bp, Artificial Sequence
  Description of Artificial Sequence: Synthetic oligonucleotide
  Target: ATXN1; (-) strand; PAM type: YTN; PAM sequence: CTC
cttccattactttttgtgac

SEQ ID NO: 184633 - DNA, 20 bp, Artificial Sequence
  Description of Artificial Sequence: Synthetic oligonucleotide
  Target: ATXN1; (-) strand; PAM type: YTN; PAM sequence: CTA
ctccttccattactttttgt

SEQ ID NO: 184634 - DNA, 20 bp, Artificial Sequence
  Description of Artificial Sequence: Synthetic oligonucleotide
  Target: ATXN1; (-) strand; PAM type: YTN; PAM sequence: TTA
ctactccttccattactttt

SEQ ID NO: 184635 - DNA, 20 bp, Artificial Sequence
  Description of Artificial Sequence: Synthetic oligonucleotide
  Target: ATXN1; (-) strand; PAM type: YTN; PAM sequence: TTG
ttactactccttccattact

SEQ ID NO: 184636 - DNA, 20 bp, Artificial Sequence
  Description of Artificial Sequence: Synthetic oligonucleotide
  Target: ATXN1; (-) strand; PAM type: YTN; PAM sequence: CTG
ttgttactactccttccatt

SEQ ID NO: 184637 - DNA, 20 bp, Artificial Sequence
  Description of Artificial Sequence: Synthetic oligonucleotide
  Target: ATXN1; (-) strand; PAM type: YTN; PAM sequence: CTG
ctgttgttactactccttcc

SEQ ID NO: 184638 - DNA, 20 bp, Artificial Sequence
  Description of Artificial Sequence: Synthetic oligonucleotide
  Target: ATXN1; (-) strand; PAM type: YTN; PAM sequence: TTG
ctgctgttgttactactcct

SEQ ID NO: 184639 - DNA, 20 bp, Artificial Sequence
  Description of Artificial Sequence: Synthetic oligonucleotide
  Target: ATXN1; (-) strand; PAM type: YTN; PAM sequence: TTT
gctgctgttgttactactcc

SEQ ID NO: 184640 - DNA, 20 bp, Artificial Sequence
  Description of Artificial Sequence: Synthetic oligonucleotide
  Target: ATXN1; (-) strand; PAM type: YTN; PAM sequence: CTT
tgctgctgttgttactactc

SEQ ID NO: 184641 - DNA, 20 bp, Artificial Sequence
  Description of Artificial Sequence: Synthetic oligonucleotide
  Target: ATXN1; (-) strand; PAM type: YTN; PAM sequence: TTC
cctttgctgctgttgttact

SEQ ID NO: 184642 - DNA, 20 bp, Artificial Sequence
  Description of Artificial Sequence: Synthetic oligonucleotide
  Target: ATXN1; (-) strand; PAM type: YTN; PAM sequence: TTT
ccctttgctgctgttgttac

SEQ ID NO: 184643 - DNA, 20 bp, Artificial Sequence
  Description of Artificial Sequence: Synthetic oligonucleotide
  Target: ATXN1; (-) strand; PAM type: YTN; PAM sequence: CTC
cccgcccagggcatttccct

SEQ ID NO: 184644 - DNA, 20 bp, Artificial Sequence
  Description of Artificial Sequence: Synthetic oligonucleotide
  Target: ATXN1; (-) strand; PAM type: YTN; PAM sequence: CTG
tctccccgcccagggcattt

SEQ ID NO: 184645 - DNA, 20 bp, Artificial Sequence
  Description of Artificial Sequence: Synthetic oligonucleotide
  Target: ATXN1; (-) strand; PAM type: YTN; PAM sequence: CTG
gggatgtgtgggtgggggtc

SEQ ID NO: 184646 - DNA, 20 bp, Artificial Sequence
  Description of Artificial Sequence: Synthetic oligonucleotide
  Target: ATXN1; (-) strand; PAM type: YTN; PAM sequence: CTC
cagagtcaagaaaacaagtg

SEQ ID NO: 184647 - DNA, 20 bp, Artificial Sequence
  Description of Artificial Sequence: Synthetic oligonucleotide
  Target: ATXN1; (-) strand; PAM type: YTN; PAM sequence: CTA
atcaagaaagcgcctccaga

SEQ ID NO: 184648 - DNA, 20 bp, Artificial Sequence
  Description of Artificial Sequence: Synthetic oligonucleotide
  Target: ATXN1; (-) strand; PAM type: YTN; PAM sequence: TTA
aatagactaatcaagaaagc

SEQ ID NO: 184649 - DNA, 20 bp, Artificial Sequence
  Description of Artificial Sequence: Synthetic oligonucleotide
  Target: ATXN1; (-) strand; PAM type: YTN; PAM sequence: TTT
aaatagactaatcaagaaag

SEQ ID NO: 184650 - DNA, 20 bp, Artificial Sequence
  Description of Artificial Sequence: Synthetic oligonucleotide
  Target: ATXN1; (-) strand; PAM type: YTN; PAM sequence: TTT
taaatagactaatcaagaaa

SEQ ID NO: 184651 - DNA, 20 bp, Artificial Sequence
  Description of Artificial Sequence: Synthetic oligonucleotide
  Target: ATXN1; (-) strand; PAM type: YTN; PAM sequence: TTT
ttaaatagactaatcaagaa

SEQ ID NO: 184652 - DNA, 20 bp, Artificial Sequence
  Description of Artificial Sequence: Synthetic oligonucleotide
  Target: ATXN1; (-) strand; PAM type: YTN; PAM sequence: TTT
tttaaatagactaatcaaga

SEQ ID NO: 184653 - DNA, 20 bp, Artificial Sequence
  Description of Artificial Sequence: Synthetic oligonucleotide
  Target: ATXN1; (-) strand; PAM type: YTN; PAM sequence: TTT
ttttaaatagactaatcaag

SEQ ID NO: 184654 - DNA, 20 bp, Artificial Sequence
  Description of Artificial Sequence: Synthetic oligonucleotide
  Target: ATXN1; (-) strand; PAM type: YTN; PAM sequence: TTA
aaacaataacatttttttaa

SEQ ID NO: 184655 - DNA, 20 bp, Artificial Sequence
  Description of Artificial Sequence: Synthetic oligonucleotide
  Target: ATXN1; (-) strand; PAM type: YTN; PAM sequence: TTT
aaaacaataacattttttta

SEQ ID NO: 184656 - DNA, 20 bp, Artificial Sequence
  Description of Artificial Sequence: Synthetic oligonucleotide
  Target: ATXN1; (-) strand; PAM type: YTN; PAM sequence: TTT
taaaacaataacattttttt

SEQ ID NO: 184657 - DNA, 20 bp, Artificial Sequence
  Description of Artificial Sequence: Synthetic oligonucleotide
  Target: ATXN1; (-) strand; PAM type: YTN; PAM sequence: TTT
ttaaaacaataacatttttt

SEQ ID NO: 184658 - DNA, 20 bp, Artificial Sequence
  Description of Artificial Sequence: Synthetic oligonucleotide
  Target: ATXN1; (-) strand; PAM type: YTN; PAM sequence: CTA
caatttttaaaacaataaca

SEQ ID NO: 184659 - DNA, 20 bp, Artificial Sequence
  Description of Artificial Sequence: Synthetic oligonucleotide
  Target: ATXN1; (-) strand; PAM type: YTN; PAM sequence: TTA
gctacaatttttaaaacaat

SEQ ID NO: 184660 - DNA, 20 bp, Artificial Sequence
  Description of Artificial Sequence: Synthetic oligonucleotide
  Target: ATXN1; (-) strand; PAM type: YTN; PAM sequence: TTT
agctacaatttttaaaacaa

SEQ ID NO: 184661 - DNA, 20 bp, Artificial Sequence
  Description of Artificial Sequence: Synthetic oligonucleotide
  Target: ATXN1; (-) strand; PAM type: YTN; PAM sequence: TTT
tagctacaatttttaaaaca

SEQ ID NO: 184662 - DNA, 20 bp, Artificial Sequence
  Description of Artificial Sequence: Synthetic oligonucleotide
  Target: ATXN1; (-) strand; PAM type: YTN; PAM sequence: TTT
ttagctacaatttttaaaac

SEQ ID NO: 184663 - DNA, 20 bp, Artificial Sequence
  Description of Artificial Sequence: Synthetic oligonucleotide
  Target: ATXN1; (-) strand; PAM type: YTN; PAM sequence: TTA
tttttagctacaatttttaa

SEQ ID NO: 184664 - DNA, 20 bp, Artificial Sequence
  Description of Artificial Sequence: Synthetic oligonucleotide
  Target: ATXN1; (-) strand; PAM type: YTN; PAM sequence: TTG
atgttatttttagctacaat

SEQ ID NO: 184665 - DNA, 20 bp, Artificial Sequence
  Description of Artificial Sequence: Synthetic oligonucleotide
  Target: ATXN1; (-) strand; PAM type: YTN; PAM sequence: TTT
gatgttatttttagctacaa

SEQ ID NO: 184666 - DNA, 20 bp, Artificial Sequence
  Description of Artificial Sequence: Synthetic oligonucleotide
  Target: ATXN1; (-) strand; PAM type: YTN; PAM sequence: TTT
tgatgttatttttagctaca

SEQ ID NO: 184667 - DNA, 20 bp, Artificial Sequence
  Description of Artificial Sequence: Synthetic oligonucleotide
  Target: ATXN1; (-) strand; PAM type: YTN; PAM sequence: TTG
tgcattttgatgttattttt

SEQ ID NO: 184668 - DNA, 20 bp, Artificial Sequence
  Description of Artificial Sequence: Synthetic oligonucleotide
  Target: ATXN1; (-) strand; PAM type: YTN; PAM sequence: CTG
catatgttgtgcattttgat

SEQ ID NO: 184669 - DNA, 20 bp, Artificial Sequence
  Description of Artificial Sequence: Synthetic oligonucleotide
  Target: ATXN1; (-) strand; PAM type: YTN; PAM sequence: TTC
tgcatatgttgtgcattttg

SEQ ID NO: 184670 - DNA, 20 bp, Artificial Sequence
  Description of Artificial Sequence: Synthetic oligonucleotide
  Target: ATXN1; (-) strand; PAM type: YTN; PAM sequence: TTT
ctgcatatgttgtgcatttt

SEQ ID NO: 184671 - DNA, 20 bp, Artificial Sequence
  Description of Artificial Sequence: Synthetic oligonucleotide
  Target: ATXN1; (-) strand; PAM type: YTN; PAM sequence: TTG
catcatggggtgtttctgca

SEQ ID NO: 184672 - DNA, 20 bp, Artificial Sequence
  Description of Artificial Sequence: Synthetic oligonucleotide
  Target: ATXN1; (-) strand; PAM type: YTN; PAM sequence: TTT
gcatcatggggtgtttctgc

SEQ ID NO: 184673 - DNA, 20 bp, Artificial Sequence
  Description of Artificial Sequence: Synthetic oligonucleotide
  Target: ATXN1; (-) strand; PAM type: YTN; PAM sequence: TTC
atacataatttgcatcatgg

SEQ ID NO: 184674 - DNA, 20 bp, Artificial Sequence
  Description of Artificial Sequence: Synthetic oligonucleotide
  Target: ATXN1; (-) strand; PAM type: YTN; PAM sequence: CTT
catacataatttgcatcatg

SEQ ID NO: 184675 - DNA, 20 bp, Artificial Sequence
  Description of Artificial Sequence: Synthetic oligonucleotide
  Target: ATXN1; (-) strand; PAM type: YTN; PAM sequence: CTC
ttcatacataatttgcatca

SEQ ID NO: 184676 - DNA, 20 bp, Artificial Sequence
  Description of Artificial Sequence: Synthetic oligonucleotide
  Target: ATXN1; (-) strand; PAM type: YTN; PAM sequence: CTG
catcctcttcatacataatt

SEQ ID NO: 184677 - DNA, 20 bp, Artificial Sequence
  Description of Artificial Sequence: Synthetic oligonucleotide
  Target: ATXN1; (-) strand; PAM type: YTN; PAM sequence: CTC
ccggccacatcgctgcatcc

SEQ ID NO: 184678 - DNA, 20 bp, Artificial Sequence
  Description of Artificial Sequence: Synthetic oligonucleotide
  Target: ATXN1; (-) strand; PAM type: YTN; PAM sequence: CTA
actcccggccacatcgctgc

SEQ ID NO: 184679 - DNA, 20 bp, Artificial Sequence
  Description of Artificial Sequence: Synthetic oligonucleotide
  Target: ATXN1; (-) strand; PAM type: YTN; PAM sequence: TTC
atgctaactcccggccacat

SEQ ID NO: 184680 - DNA, 20 bp, Artificial Sequence
  Description of Artificial Sequence: Synthetic oligonucleotide
  Target: ATXN1; (-) strand; PAM type: YTN; PAM sequence: CTT
catgctaactcccggccaca

SEQ ID NO: 184681 - DNA, 20 bp, Artificial Sequence
  Description of Artificial Sequence: Synthetic oligonucleotide
  Target: ATXN1; (-) strand; PAM type: YTN; PAM sequence: CTC
cgtgatagaataaccacgct

SEQ ID NO: 184682 - DNA, 20 bp, Artificial Sequence
  Description of Artificial Sequence: Synthetic oligonucleotide
  Target: ATXN1; (-) strand; PAM type: YTN; PAM sequence: TTG
tggatgaggagcatatctcc

SEQ ID NO: 184683 - DNA, 20 bp, Artificial Sequence
  Description of Artificial Sequence: Synthetic oligonucleotide
  Target: ATXN1; (-) strand; PAM type: YTN; PAM sequence: TTT
gtggatgaggagcatatctc

SEQ ID NO: 184684 - DNA, 20 bp, Artificial Sequence
  Description of Artificial Sequence: Synthetic oligonucleotide
  Target: ATXN1; (-) strand; PAM type: YTN; PAM sequence: CTG
gtttgtggatgaggagcata

SEQ ID NO: 184685 - DNA, 20 bp, Artificial Sequence
  Description of Artificial Sequence: Synthetic oligonucleotide
  Target: ATXN1; (-) strand; PAM type: YTN; PAM sequence: CTC
tggtttgtggatgaggagca

SEQ ID NO: 184686 - DNA, 20 bp, Artificial Sequence
  Description of Artificial Sequence: Synthetic oligonucleotide
  Target: ATXN1; (-) strand; PAM type: YTN; PAM sequence: TTG
gaccgtgcgtccctctggtt

SEQ ID NO: 184687 - DNA, 20 bp, Artificial Sequence
  Description of Artificial Sequence: Synthetic oligonucleotide
  Target: ATXN1; (-) strand; PAM type: YTN; PAM sequence: CTG
gtgattggaccgtgcgtccc

SEQ ID NO: 184688 - DNA, 20 bp, Artificial Sequence
  Description of Artificial Sequence: Synthetic oligonucleotide
  Target: ATXN1; (-) strand; PAM type: YTN; PAM sequence: CTG
acactggtgattggaccgtg

SEQ ID NO: 184689 - DNA, 20 bp, Artificial Sequence
  Description of Artificial Sequence: Synthetic oligonucleotide
  Target: ATXN1; (-) strand; PAM type: YTN; PAM sequence: TTG
acaaataaaaccaaacagta

SEQ ID NO: 184690 - DNA, 20 bp, Artificial Sequence
  Description of Artificial Sequence: Synthetic oligonucleotide
  Target: ATXN1; (-) strand; PAM type: YTN; PAM sequence: TTT
gacaaataaaaccaaacagt

SEQ ID NO: 184691 - DNA, 20 bp, Artificial Sequence
  Description of Artificial Sequence: Synthetic oligonucleotide
  Target: ATXN1; (-) strand; PAM type: YTN; PAM sequence: TTT
tgacaaataaaaccaaacag

SEQ ID NO: 184692 - DNA, 20 bp, Artificial Sequence
  Description of Artificial Sequence: Synthetic oligonucleotide
  Target: ATXN1; (-) strand; PAM type: YTN; PAM sequence: CTG
catgtaaagcagtagttttg

SEQ ID NO: 184693 - DNA, 20 bp, Artificial Sequence
  Description of Artificial Sequence: Synthetic oligonucleotide
  Target: ATXN1; (-) strand; PAM type: YTN; PAM sequence: CTC
tgcatgtaaagcagtagttt

SEQ ID NO: 184694 - DNA, 20 bp, Artificial Sequence
  Description of Artificial Sequence: Synthetic oligonucleotide
  Target: ATXN1; (-) strand; PAM type: YTN; PAM sequence: CTC
ctctgcatgtaaagcagtag

SEQ ID NO: 184695 - DNA, 20 bp, Artificial Sequence
  Description of Artificial Sequence: Synthetic oligonucleotide
  Target: ATXN1; (-) strand; PAM type: YTN; PAM sequence: CTC
cctcctctgcatgtaaagca

SEQ ID NO: 184696 - DNA, 20 bp, Artificial Sequence
  Description of Artificial Sequence: Synthetic oligonucleotide
  Target: ATXN1; (-) strand; PAM type: YTN; PAM sequence: CTC
ctccctcctctgcatgtaaa

SEQ ID NO: 184697 - DNA, 20 bp, Artificial Sequence
  Description of Artificial Sequence: Synthetic oligonucleotide
  Target: ATXN1; (-) strand; PAM type: YTN; PAM sequence: CTC
catcccccacccgaagaaac

SEQ ID NO: 184698 - DNA, 20 bp, Artificial Sequence
  Description of Artificial Sequence: Synthetic oligonucleotide
  Target: ATXN1; (-) strand; PAM type: YTN; PAM sequence: CTC
cctccatcccccacccgaag

SEQ ID NO: 184699 - DNA, 20 bp, Artificial Sequence
  Description of Artificial Sequence: Synthetic oligonucleotide
  Target: ATXN1; (-) strand; PAM type: YTN; PAM sequence: CTA
taatgctccctccatccccc

SEQ ID NO: 184700 - DNA, 20 bp, Artificial Sequence
  Description of Artificial Sequence: Synthetic oligonucleotide
  Target: ATXN1; (-) strand; PAM type: YTN; PAM sequence: TTC
tataatgctccctccatccc

SEQ ID NO: 184701 - DNA, 20 bp, Artificial Sequence
  Description of Artificial Sequence: Synthetic oligonucleotide
  Target: ATXN1; (-) strand; PAM type: YTN; PAM sequence: CTT
ctataatgctccctccatcc

SEQ ID NO: 184702 - DNA, 20 bp, Artificial Sequence
  Description of Artificial Sequence: Synthetic oligonucleotide
  Target: ATXN1; (-) strand; PAM type: YTN; PAM sequence: TTC
ttctataatgctccctccat

SEQ ID NO: 184703 - DNA, 20 bp, Artificial Sequence
  Description of Artificial Sequence: Synthetic oligonucleotide
  Target: ATXN1; (-) strand; PAM type: YTN; PAM sequence: CTG
ggatgcgtgttcttctataa

SEQ ID NO: 184704 - DNA, 20 bp, Artificial Sequence
  Description of Artificial Sequence: Synthetic oligonucleotide
  Target: ATXN1; (-) strand; PAM type: YTN; PAM sequence: CTG
tcactgggatgcgtgttctt

SEQ ID NO: 184705 - DNA, 20 bp, Artificial Sequence
  Description of Artificial Sequence: Synthetic oligonucleotide
  Target: ATXN1; (-) strand; PAM type: YTN; PAM sequence: TTA
aaaatactgtcactgggatg

SEQ ID NO: 184706 - DNA, 20 bp, Artificial Sequence
  Description of Artificial Sequence: Synthetic oligonucleotide
  Target: ATXN1; (-) strand; PAM type: YTN; PAM sequence: TTT
aaaaatactgtcactgggat

SEQ ID NO: 184707 - DNA, 20 bp, Artificial Sequence
  Description of Artificial Sequence: Synthetic oligonucleotide
  Target: ATXN1; (-) strand; PAM type: YTN; PAM sequence: CTT
taaaaatactgtcactggga

SEQ ID NO: 184708 - DNA, 20 bp, Artificial Sequence
  Description of Artificial Sequence: Synthetic oligonucleotide
  Target: ATXN1; (-) strand; PAM type: YTN; PAM sequence: TTC
agaaaagatggtagatagag

SEQ ID NO: 184709 - DNA, 20 bp, Artificial Sequence
  Description of Artificial Sequence: Synthetic oligonucleotide
  Target: ATXN1; (-) strand; PAM type: YTN; PAM sequence: TTA
gttcagaaaagatggtagat

SEQ ID NO: 184710 - DNA, 20 bp, Artificial Sequence
  Description of Artificial Sequence: Synthetic oligonucleotide
  Target: ATXN1; (-) strand; PAM type: YTN; PAM sequence: TTG
ttagttcagaaaagatggta

SEQ ID NO: 184711 - DNA, 20 bp, Artificial Sequence
  Description of Artificial Sequence: Synthetic oligonucleotide
  Target: ATXN1; (-) strand; PAM type: YTN; PAM sequence: TTC
aaggtgaaattgttagttca

SEQ ID NO: 184712 - DNA, 20 bp, Artificial Sequence
  Description of Artificial Sequence: Synthetic oligonucleotide
  Target: ATXN1; (-) strand; PAM type: YTN; PAM sequence: TTT
caaggtgaaattgttagttc

SEQ ID NO: 184713 - DNA, 20 bp, Artificial Sequence
  Description of Artificial Sequence: Synthetic oligonucleotide
  Target: ATXN1; (-) strand; PAM type: YTN; PAM sequence: TTG
taacagatttcaaggtgaaa

SEQ ID NO: 184714 - DNA, 20 bp, Artificial Sequence
  Description of Artificial Sequence: Synthetic oligonucleotide
  Target: ATXN1; (-) strand; PAM type: YTN; PAM sequence: TTA
ttgtaacagatttcaaggtg

SEQ ID NO: 184715 - DNA, 20 bp, Artificial Sequence
  Description of Artificial Sequence: Synthetic oligonucleotide
  Target: ATXN1; (-) strand; PAM type: YTN; PAM sequence: CTT
attgtaacagatttcaaggt

SEQ ID NO: 184716 - DNA, 20 bp, Artificial Sequence
  Description of Artificial Sequence: Synthetic oligonucleotide
  Target: ATXN1; (-) strand; PAM type: YTN; PAM sequence: TTA
aaggtacttattgtaacaga

SEQ ID NO: 184717 - DNA, 20 bp, Artificial Sequence
  Description of Artificial Sequence: Synthetic oligonucleotide
  Target: ATXN1; (-) strand; PAM type: YTN; PAM sequence: TTG
attaaaggtacttattgtaa

SEQ ID NO: 184718 - DNA, 20 bp, Artificial Sequence
  Description of Artificial Sequence: Synthetic oligonucleotide
  Target: ATXN1; (-) strand; PAM type: YTN; PAM sequence: TTT
gattaaaggtacttattgta

SEQ ID NO: 184719 - DNA, 20 bp, Artificial Sequence
  Description of Artificial Sequence: Synthetic oligonucleotide
  Target: ATXN1; (-) strand; PAM type: YTN; PAM sequence: TTT
tgattaaaggtacttattgt

SEQ ID NO: 184720 - DNA, 20 bp, Artificial Sequence
  Description of Artificial Sequence: Synthetic oligonucleotide
  Target: ATXN1; (-) strand; PAM type: YTN; PAM sequence: CTT
ttgattaaaggtacttattg

SEQ ID NO: 184721 - DNA, 20 bp, Artificial Sequence
  Description of Artificial Sequence: Synthetic oligonucleotide
  Target: ATXN1; (-) strand; PAM type: YTN; PAM sequence: CTA
tagtgaatgtatgcccatag

SEQ ID NO: 184722 - DNA, 20 bp, Artificial Sequence
  Description of Artificial Sequence: Synthetic oligonucleotide
  Target: ATXN1; (-) strand; PAM type: YTN; PAM sequence: CTA
cagtaaatagctatagtgaa

SEQ ID NO: 184723 - DNA, 20 bp, Artificial Sequence
  Description of Artificial Sequence: Synthetic oligonucleotide
  Target: ATXN1; (-) strand; PAM type: YTN; PAM sequence: CTG
aaataatgaactacagtaaa

SEQ ID NO: 184724 - DNA, 20 bp, Artificial Sequence
  Description of Artificial Sequence: Synthetic oligonucleotide
  Target: ATXN1; (-) strand; PAM type: YTN; PAM sequence: TTG
caatatgctgaaataatgaa

SEQ ID NO: 184725 - DNA, 20 bp, Artificial Sequence
  Description of Artificial Sequence: Synthetic oligonucleotide
  Target: ATXN1; (-) strand; PAM type: YTN; PAM sequence: CTA
caacaatgataattgcaata

SEQ ID NO: 184726 - DNA, 20 bp, Artificial Sequence
  Description of Artificial Sequence: Synthetic oligonucleotide
  Target: ATXN1; (-) strand; PAM type: YTN; PAM sequence: TTG
aaggctacaacaatgataat

SEQ ID NO: 184727 - DNA, 20 bp, Artificial Sequence
  Description of Artificial Sequence: Synthetic oligonucleotide
  Target: ATXN1; (-) strand; PAM type: YTN; PAM sequence: TTA
atgcaataggattgaaggct

SEQ ID NO: 184728 - DNA, 20 bp, Artificial Sequence
  Description of Artificial Sequence: Synthetic oligonucleotide
  Target: ATXN1; (-) strand; PAM type: YTN; PAM sequence: CTA
cattaatgcaataggattga

SEQ ID NO: 184729 - DNA, 20 bp, Artificial Sequence
  Description of Artificial Sequence: Synthetic oligonucleotide
  Target: ATXN1; (-) strand; PAM type: YTN; PAM sequence: CTC
ctacattaatgcaataggat

SEQ ID NO: 184730 - DNA, 20 bp, Artificial Sequence
  Description of Artificial Sequence: Synthetic oligonucleotide
  Target: ATXN1; (-) strand; PAM type: YTN; PAM sequence: TTC
atactcctacattaatgcaa

SEQ ID NO: 184731 - DNA, 20 bp, Artificial Sequence
  Description of Artificial Sequence: Synthetic oligonucleotide
  Target: ATXN1; (-) strand; PAM type: YTN; PAM sequence: TTT
catactcctacattaatgca

SEQ ID NO: 184732 - DNA, 20 bp, Artificial Sequence
  Description of Artificial Sequence: Synthetic oligonucleotide
  Target: ATXN1; (-) strand; PAM type: YTN; PAM sequence: TTT
tcatactcctacattaatgc

SEQ ID NO: 184733 - DNA, 20 bp, Artificial Sequence
  Description of Artificial Sequence: Synthetic oligonucleotide
  Target: ATXN1; (-) strand; PAM type: YTN; PAM sequence: TTT
ttcatactcctacattaatg

SEQ ID NO: 184734 - DNA, 20 bp, Artificial Sequence
  Description of Artificial Sequence: Synthetic oligonucleotide
  Target: ATXN1; (-) strand; PAM type: YTN; PAM sequence: CTT
tttcatactcctacattaat

SEQ ID NO: 184735 - DNA, 20 bp, Artificial Sequence
  Description of Artificial Sequence: Synthetic oligonucleotide
  Target: ATXN1; (-) strand; PAM type: YTN; PAM sequence: CTG
actttttcatactcctacat

SEQ ID NO: 184736 - DNA, 20 bp, Artificial Sequence
  Description of Artificial Sequence: Synthetic oligonucleotide
  Target: ATXN1; (-) strand; PAM type: YTN; PAM sequence: TTC
tgactttttcatactcctac

SEQ ID NO: 184737 - DNA, 20 bp, Artificial Sequence
  Description of Artificial Sequence: Synthetic oligonucleotide
  Target: ATXN1; (-) strand; PAM type: YTN; PAM sequence: TTT
ctgactttttcatactccta

SEQ ID NO: 184738 - DNA, 20 bp, Artificial Sequence
  Description of Artificial Sequence: Synthetic oligonucleotide
  Target: ATXN1; (-) strand; PAM type: YTN; PAM sequence: CTT
tctgactttttcatactcct

SEQ ID NO: 184739 - DNA, 20 bp, Artificial Sequence
  Description of Artificial Sequence: Synthetic oligonucleotide
  Target: ATXN1; (-) strand; PAM type: YTN; PAM sequence: TTC
ctttctgactttttcatact

SEQ ID NO: 184740 - DNA, 20 bp, Artificial Sequence
  Description of Artificial Sequence: Synthetic oligonucleotide
  Target: ATXN1; (-) strand; PAM type: YTN; PAM sequence: TTT
cctttctgactttttcatac

SEQ ID NO: 184741 - DNA, 20 bp, Artificial Sequence
  Description of Artificial Sequence: Synthetic oligonucleotide
  Target: ATXN1; (-) strand; PAM type: YTN; PAM sequence: TTT
tcctttctgactttttcata

SEQ ID NO: 184742 - DNA, 20 bp, Artificial Sequence
  Description of Artificial Sequence: Synthetic oligonucleotide
  Target: ATXN1; (-) strand; PAM type: YTN; PAM sequence: TTA
agttttcctttctgactttt

SEQ ID NO: 184743 - DNA, 20 bp, Artificial Sequence
  Description of Artificial Sequence: Synthetic oligonucleotide
  Target: ATXN1; (-) strand; PAM type: YTN; PAM sequence: TTT
aagttttcctttctgacttt

SEQ ID NO: 184744 - DNA, 20 bp, Artificial Sequence
  Description of Artificial Sequence: Synthetic oligonucleotide
  Target: ATXN1; (-) strand; PAM type: YTN; PAM sequence: TTT
taagttttcctttctgactt

SEQ ID NO: 184745 - DNA, 20 bp, Artificial Sequence
  Description of Artificial Sequence: Synthetic oligonucleotide
  Target: ATXN1; (-) strand; PAM type: YTN; PAM sequence: CTG
ttttaagttttcctttctga

SEQ ID NO: 184746 - DNA, 20 bp, Artificial Sequence
  Description of Artificial Sequence: Synthetic oligonucleotide
  Target: ATXN1; (-) strand; PAM type: YTN; PAM sequence: TTA
aaatgaactgttttaagttt

SEQ ID NO: 184747 - DNA, 20 bp, Artificial Sequence
  Description of Artificial Sequence: Synthetic oligonucleotide
  Target: ATXN1; (-) strand; PAM type: YTN; PAM sequence: TTT
aaaatgaactgttttaagtt

SEQ ID NO: 184748 - DNA, 20 bp, Artificial Sequence
  Description of Artificial Sequence: Synthetic oligonucleotide
  Target: ATXN1; (-) strand; PAM type: YTN; PAM sequence: TTA
acaggcaatacagtttaaaa

SEQ ID NO: 184749 - DNA, 20 bp, Artificial Sequence
  Description of Artificial Sequence: Synthetic oligonucleotide
  Target: ATXN1; (-) strand; PAM type: YTN; PAM sequence: TTG
ttaacaggcaatacagttta

SEQ ID NO: 184750 - DNA, 20 bp, Artificial Sequence
  Description of Artificial Sequence: Synthetic oligonucleotide
  Target: ATXN1; (-) strand; PAM type: YTN; PAM sequence: TTG
gacagggttgttaacaggca

SEQ ID NO: 184751 - DNA, 20 bp, Artificial Sequence
  Description of Artificial Sequence: Synthetic oligonucleotide
  Target: ATXN1; (-) strand; PAM type: YTN; PAM sequence: TTT
ggacagggttgttaacaggc

SEQ ID NO: 184752 - DNA, 20 bp, Artificial Sequence
  Description of Artificial Sequence: Synthetic oligonucleotide
  Target: ATXN1; (-) strand; PAM type: YTN; PAM sequence: TTT
tggacagggttgttaacagg

SEQ ID NO: 184753 - DNA, 20 bp, Artificial Sequence
  Description of Artificial Sequence: Synthetic oligonucleotide
  Target: ATXN1; (-) strand; PAM type: YTN; PAM sequence: CTA
aaattttggacagggttgtt

SEQ ID NO: 184754 - DNA, 20 bp, Artificial Sequence
  Description of Artificial Sequence: Synthetic oligonucleotide
  Target: ATXN1; (-) strand; PAM type: YTN; PAM sequence: CTA
ctaaaattttggacagggtt

SEQ ID NO: 184755 - DNA, 20 bp, Artificial Sequence
  Description of Artificial Sequence: Synthetic oligonucleotide
  Target: ATXN1; (-) strand; PAM type: YTN; PAM sequence: TTA
cctactaaaattttggacag

SEQ ID NO: 184756 - DNA, 20 bp, Artificial Sequence
  Description of Artificial Sequence: Synthetic oligonucleotide
  Target: ATXN1; (-) strand; PAM type: YTN; PAM sequence: TTT
acctactaaaattttggaca

SEQ ID NO: 184757 - DNA, 20 bp, Artificial Sequence
  Description of Artificial Sequence: Synthetic oligonucleotide
  Target: ATXN1; (-) strand; PAM type: YTN; PAM sequence: TTT
tacctactaaaattttggac

SEQ ID NO: 184758 - DNA, 20 bp, Artificial Sequence
  Description of Artificial Sequence: Synthetic oligonucleotide
  Target: ATXN1; (-) strand; PAM type: YTN; PAM sequence: TTT
ttacctactaaaattttgga

SEQ ID NO: 184759 - DNA, 20 bp, Artificial Sequence
  Description of Artificial Sequence: Synthetic oligonucleotide
  Target: ATXN1; (-) strand; PAM type: YTN; PAM sequence: TTT
tttacctactaaaattttgg

SEQ ID NO: 184760 - DNA, 20 bp, Artificial Sequence
  Description of Artificial Sequence: Synthetic oligonucleotide
  Target: ATXN1; (-) strand; PAM type: YTN; PAM sequence: CTT
ttttacctactaaaattttg

SEQ ID NO: 184761 - DNA, 20 bp, Artificial Sequence
  Description of Artificial Sequence: Synthetic oligonucleotide
  Target: ATXN1; (-) strand; PAM type: YTN; PAM sequence: TTC
agcttttttacctactaaaa

SEQ ID NO: 184762 - DNA, 20 bp, Artificial Sequence
  Description of Artificial Sequence: Synthetic oligonucleotide
  Target: ATXN1; (-) strand; PAM type: YTN; PAM sequence: TTG
taggcagtggttcagctttt

SEQ ID NO: 184763 - DNA, 20 bp, Artificial Sequence
  Description of Artificial Sequence: Synthetic oligonucleotide
  Target: ATXN1; (-) strand; PAM type: YTN; PAM sequence: CTT
gtaggcagtggttcagcttt

SEQ ID NO: 184764 - DNA, 20 bp, Artificial Sequence
  Description of Artificial Sequence: Synthetic oligonucleotide
  Target: ATXN1; (-) strand; PAM type: YTN; PAM sequence: TTC
ttgtaggcagtggttcagct

SEQ ID NO: 184765 - DNA, 20 bp, Artificial Sequence
  Description of Artificial Sequence: Synthetic oligonucleotide
  Target: ATXN1; (-) strand; PAM type: YTN; PAM sequence: CTT
cttgtaggcagtggttcagc

SEQ ID NO: 184766 - DNA, 20 bp, Artificial Sequence
  Description of Artificial Sequence: Synthetic oligonucleotide
  Target: ATXN1; (-) strand; PAM type: YTN; PAM sequence: TTG
gtcttcttgtaggcagtggt

SEQ ID NO: 184767 - DNA, 20 bp, Artificial Sequence
  Description of Artificial Sequence: Synthetic oligonucleotide
  Target: ATXN1; (-) strand; PAM type: YTN; PAM sequence: TTT
ggtcttcttgtaggcagtgg

SEQ ID NO: 184768 - DNA, 20 bp, Artificial Sequence
  Description of Artificial Sequence: Synthetic oligonucleotide
  Target: ATXN1; (-) strand; PAM type: YTN; PAM sequence: TTT
tggtcttcttgtaggcagtg

SEQ ID NO: 184769 - DNA, 20 bp, Artificial Sequence
  Description of Artificial Sequence: Synthetic oligonucleotide
  Target: ATXN1; (-) strand; PAM type: YTN; PAM sequence: CTT
ttggtcttcttgtaggcagt

SEQ ID NO: 184770 - DNA, 20 bp, Artificial Sequence
  Description of Artificial Sequence: Synthetic oligonucleotide
  Target: ATXN1; (-) strand; PAM type: YTN; PAM sequence: TTC
agacaatcttttggtcttct

SEQ ID NO: 184771 - DNA, 20 bp, Artificial Sequence
  Description of Artificial Sequence: Synthetic oligonucleotide
  Target: ATXN1; (-) strand; PAM type: YTN; PAM sequence: CTT
cagacaatcttttggtcttc

SEQ ID NO: 184772 - DNA, 20 bp, Artificial Sequence
  Description of Artificial Sequence: Synthetic oligonucleotide
  Target: ATXN1; (-) strand; PAM type: YTN; PAM sequence: CTA
aatggaatcttcagacaatc

SEQ ID NO: 184773 - DNA, 20 bp, Artificial Sequence
  Description of Artificial Sequence: Synthetic oligonucleotide
  Target: ATXN1; (-) strand; PAM type: YTN; PAM sequence: TTA
cagagaacaggaaacaagta

SEQ ID NO: 184774 - DNA, 20 bp, Artificial Sequence
  Description of Artificial Sequence: Synthetic oligonucleotide
  Target: ATXN1; (-) strand; PAM type: YTN; PAM sequence: TTT
acagagaacaggaaacaagt

SEQ ID NO: 184775 - DNA, 20 bp, Artificial Sequence
  Description of Artificial Sequence: Synthetic oligonucleotide
  Target: ATXN1; (-) strand; PAM type: YTN; PAM sequence: TTT
tacagagaacaggaaacaag

SEQ ID NO: 184776 - DNA, 20 bp, Artificial Sequence
  Description of Artificial Sequence: Synthetic oligonucleotide
  Target: ATXN1; (-) strand; PAM type: YTN; PAM sequence: TTA
ccaagagaatatccgtgttt

SEQ ID NO: 184777 - DNA, 20 bp, Artificial Sequence
  Description of Artificial Sequence: Synthetic oligonucleotide
  Target: ATXN1; (-) strand; PAM type: YTN; PAM sequence: TTT
accaagagaatatccgtgtt

SEQ ID NO: 184778 - DNA, 20 bp, Artificial Sequence
  Description of Artificial Sequence: Synthetic oligonucleotide
  Target: ATXN1; (-) strand; PAM type: YTN; PAM sequence: CTT
taccaagagaatatccgtgt

SEQ ID NO: 184779 - DNA, 20 bp, Artificial Sequence
  Description of Artificial Sequence: Synthetic oligonucleotide
  Target: ATXN1; (-) strand; PAM type: YTN; PAM sequence: CTA
gatagaaatagaaatggaat

SEQ ID NO: 184780 - DNA, 20 bp, Artificial Sequence
  Description of Artificial Sequence: Synthetic oligonucleotide
  Target: ATXN1; (-) strand; PAM type: YTN; PAM sequence: TTC
gatggtcactagatagaaat

SEQ ID NO: 184781 - DNA, 20 bp, Artificial Sequence
  Description of Artificial Sequence: Synthetic oligonucleotide
  Target: ATXN1; (-) strand; PAM type: YTN; PAM sequence: TTA
caacatattcgatggtcact

SEQ ID NO: 184782 - DNA, 20 bp, Artificial Sequence
  Description of Artificial Sequence: Synthetic oligonucleotide
  Target: ATXN1; (-) strand; PAM type: YTN; PAM sequence: TTA
ataggtaaacaagttacaac

SEQ ID NO: 184783 - DNA, 20 bp, Artificial Sequence
  Description of Artificial Sequence: Synthetic oligonucleotide
  Target: ATXN1; (-) strand; PAM type: YTN; PAM sequence: TTT
aataggtaaacaagttacaa

SEQ ID NO: 184784 - DNA, 20 bp, Artificial Sequence
  Description of Artificial Sequence: Synthetic oligonucleotide
  Target: ATXN1; (-) strand; PAM type: YTN; PAM sequence: CTA
tttaataggtaaacaagtta

SEQ ID NO: 184785 - DNA, 20 bp, Artificial Sequence
  Description of Artificial Sequence: Synthetic oligonucleotide
  Target: ATXN1; (-) strand; PAM type: YTN; PAM sequence: TTC
cctatttaataggtaaacaa

SEQ ID NO: 184786 - DNA, 20 bp, Artificial Sequence
  Description of Artificial Sequence: Synthetic oligonucleotide
  Target: ATXN1; (-) strand; PAM type: YTN; PAM sequence: CTA
taattccctatttaataggt

SEQ ID NO: 184787 - DNA, 20 bp, Artificial Sequence
  Description of Artificial Sequence: Synthetic oligonucleotide
  Target: ATXN1; (-) strand; PAM type: YTN; PAM sequence: TTG
ctataattccctatttaata

SEQ ID NO: 184788 - DNA, 20 bp, Artificial Sequence
  Description of Artificial Sequence: Synthetic oligonucleotide
  Target: ATXN1; (-) strand; PAM type: YTN; PAM sequence: TTA
ttgctataattccctattta

SEQ ID NO: 184789 - DNA, 20 bp, Artificial Sequence
  Description of Artificial Sequence: Synthetic oligonucleotide
  Target: ATXN1; (-) strand; PAM type: YTN; PAM sequence: CTA
tgattattgctataattccc

SEQ ID NO: 184790 - DNA, 20 bp, Artificial Sequence
  Description of Artificial Sequence: Synthetic oligonucleotide
  Target: ATXN1; (-) strand; PAM type: YTN; PAM sequence: TTC
ctatgattattgctataatt

SEQ ID NO: 184791 - DNA, 20 bp, Artificial Sequence
  Description of Artificial Sequence: Synthetic oligonucleotide
  Target: ATXN1; (-) strand; PAM type: YTN; PAM sequence: CTG
caattcctatgattattgct

SEQ ID NO: 184792 - DNA, 20 bp, Artificial Sequence
  Description of Artificial Sequence: Synthetic oligonucleotide
  Target: ATXN1; (-) strand; PAM type: YTN; PAM sequence: CTG
ccactgcaattcctatgatt

SEQ ID NO: 184793 - DNA, 20 bp, Artificial Sequence
  Description of Artificial Sequence: Synthetic oligonucleotide
  Target: ATXN1; (-) strand; PAM type: YTN; PAM sequence: TTA
ctgccactgcaattcctatg

SEQ ID NO: 184794 - DNA, 20 bp, Artificial Sequence
  Description of Artificial Sequence: Synthetic oligonucleotide
  Target: ATXN1; (-) strand; PAM type: YTN; PAM sequence: TTG
ttactgccactgcaattcct

SEQ ID NO: 184795 - DNA, 20 bp, Artificial Sequence
  Description of Artificial Sequence: Synthetic oligonucleotide
  Target: ATXN1; (-) strand; PAM type: YTN; PAM sequence: TTA
ttgttactgccactgcaatt

SEQ ID NO: 184796 - DNA, 20 bp, Artificial Sequence
  Description of Artificial Sequence: Synthetic oligonucleotide
  Target: ATXN1; (-) strand; PAM type: YTN; PAM sequence: TTT
attgttactgccactgcaat

SEQ ID NO: 184797 - DNA, 20 bp, Artificial Sequence
  Description of Artificial Sequence: Synthetic oligonucleotide
  Target: ATXN1; (-) strand; PAM type: YTN; PAM sequence: TTT
tattgttactgccactgcaa

SEQ ID NO: 184798 - DNA, 20 bp, Artificial Sequence
  Description of Artificial Sequence: Synthetic oligonucleotide
  Target: ATXN1; (-) strand; PAM type: YTN; PAM sequence: TTT
ttattgttactgccactgca

SEQ ID NO: 184799 - DNA, 20 bp, Artificial Sequence
  Description of Artificial Sequence: Synthetic oligonucleotide
  Target: ATXN1; (-) strand; PAM type: YTN; PAM sequence: CTG
gtttttattgttactgccac

SEQ ID NO: 184800 - DNA, 20 bp, Artificial Sequence
  Description of Artificial Sequence: Synthetic oligonucleotide
  Target: ATXN1; (-) strand; PAM type: YTN; PAM sequence: TTC
tggtttttattgttactgcc

SEQ ID NO: 184801 - DNA, 20 bp, Artificial Sequence
  Description of Artificial Sequence: Synthetic oligonucleotide
  Target: ATXN1; (-) strand; PAM type: YTN; PAM sequence: TTA
ttctggtttttattgttact

SEQ ID NO: 184802 - DNA, 20 bp, Artificial Sequence
  Description of Artificial Sequence: Synthetic oligonucleotide
  Target: ATXN1; (-) strand; PAM type: YTN; PAM sequence: TTA
ttattctggtttttattgtt

SEQ ID NO: 184803 - DNA, 20 bp, Artificial Sequence
  Description of Artificial Sequence: Synthetic oligonucleotide
  Target: ATXN1; (-) strand; PAM type: YTN; PAM sequence: CTA
tgaaggcaaataggagacaa

SEQ ID NO: 184804 - DNA, 20 bp, Artificial Sequence
  Description of Artificial Sequence: Synthetic oligonucleotide
  Target: ATXN1; (-) strand; PAM type: YTN; PAM sequence: TTA
ctatgaaggcaaataggaga

SEQ ID NO: 184805 - DNA, 20 bp, Artificial Sequence
  Description of Artificial Sequence: Synthetic oligonucleotide
  Target: ATXN1; (-) strand; PAM type: YTN; PAM sequence: TTA
gtaatgttactatgaaggca

SEQ ID NO: 184806 - DNA, 20 bp, Artificial Sequence
  Description of Artificial Sequence: Synthetic oligonucleotide
  Target: ATXN1; (-) strand; PAM type: YTN; PAM sequence: CTT
agtaatgttactatgaaggc

SEQ ID NO: 184807 - DNA, 20 bp, Artificial Sequence
  Description of Artificial Sequence: Synthetic oligonucleotide
  Target: ATXN1; (-) strand; PAM type: YTN; PAM sequence: TTC
ttagtaatgttactatgaag

SEQ ID NO: 184808 - DNA, 20 bp, Artificial Sequence
  Description of Artificial Sequence: Synthetic oligonucleotide
  Target: ATXN1; (-) strand; PAM type: YTN; PAM sequence: TTA
gttcttagtaatgttactat

SEQ ID NO: 184809 - DNA, 20 bp, Artificial Sequence
  Description of Artificial Sequence: Synthetic oligonucleotide
  Target: ATXN1; (-) strand; PAM type: YTN; PAM sequence: TTA
ttagttcttagtaatgttac

SEQ ID NO: 184810 - DNA, 20 bp, Artificial Sequence
  Description of Artificial Sequence: Synthetic oligonucleotide
  Target: ATXN1; (-) strand; PAM type: YTN; PAM sequence: TTT
attagttcttagtaatgtta

SEQ ID NO: 184811 - DNA, 20 bp, Artificial Sequence
  Description of Artificial Sequence: Synthetic oligonucleotide
  Target: ATXN1; (-) strand; PAM type: YTN; PAM sequence: CTC
agagtttattagttcttagt

SEQ ID NO: 184812 - DNA, 20 bp, Artificial Sequence
  Description of Artificial Sequence: Synthetic oligonucleotide
  Target: ATXN1; (-) strand; PAM type: YTN; PAM sequence: CTA
gcctcagagtttattagttc

SEQ ID NO: 184813 - DNA, 20 bp, Artificial Sequence
  Description of Artificial Sequence: Synthetic oligonucleotide
  Target: ATXN1; (-) strand; PAM type: YTN; PAM sequence: CTC
tagcctcagagtttattagt

SEQ ID NO: 184814 - DNA, 20 bp, Artificial Sequence
  Description of Artificial Sequence: Synthetic oligonucleotide
  Target: ATXN1; (-) strand; PAM type: YTN; PAM sequence: TTA
gtctctagcctcagagttta

SEQ ID NO: 184815 - DNA, 20 bp, Artificial Sequence
  Description of Artificial Sequence: Synthetic oligonucleotide
  Target: ATXN1; (-) strand; PAM type: YTN; PAM sequence: TTT
agtctctagcctcagagttt

SEQ ID NO: 184816 - DNA, 20 bp, Artificial Sequence
  Description of Artificial Sequence: Synthetic oligonucleotide
  Target: ATXN1; (-) strand; PAM type: YTN; PAM sequence: CTT
tagtctctagcctcagagtt

SEQ ID NO: 184817 - DNA, 20 bp, Artificial Sequence
  Description of Artificial Sequence: Synthetic oligonucleotide
  Target: ATXN1; (-) strand; PAM type: YTN; PAM sequence: TTA
ctttagtctctagcctcaga

SEQ ID NO: 184818 - DNA, 20 bp, Artificial Sequence
  Description of Artificial Sequence: Synthetic oligonucleotide
  Target: ATXN1; (-) strand; PAM type: YTN; PAM sequence: CTT
actttagtctctagcctcag

SEQ ID NO: 184819 - DNA, 20 bp, Artificial Sequence
  Description of Artificial Sequence: Synthetic oligonucleotide
  Target: ATXN1; (-) strand; PAM type: YTN; PAM sequence: TTC
ttactttagtctctagcctc

SEQ ID NO: 184820 - DNA, 20 bp, Artificial Sequence
  Description of Artificial Sequence: Synthetic oligonucleotide
  Target: ATXN1; (-) strand; PAM type: YTN; PAM sequence: CTA
aaccaaattcttactttagt

SEQ ID NO: 184821 - DNA, 20 bp, Artificial Sequence
  Description of Artificial Sequence: Synthetic oligonucleotide
  Target: ATXN1; (-) strand; PAM type: YTN; PAM sequence: CTC
aaaataaaataaaataaaaa

SEQ ID NO: 184822 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaataaaataaaa

SEQ ID NO: 184823 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagtgagactccg

SEQ ID NO: 184824 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagtga

SEQ ID NO: 184825 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 184826 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcgtgcc

SEQ ID NO: 184827 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccaagatcgtgc

SEQ ID NO: 184828 - DNA, 20 bp, Artificial Sequence
  Description of Artificial Sequence: Synthetic oligonucleotide
  Target: ATXN1; (-) strand; PAM type: YTN; PAM sequence: CTG
ggaagtggagcttgcagtga

SEQ ID NO: 184829 - DNA, 20 bp, Artificial Sequence
  Description of Artificial Sequence: Synthetic oligonucleotide
  Target: ATXN1; (-) strand; PAM type: YTN; PAM sequence: CTG
aggcgggagaatggcgtgaa

SEQ ID NO: 184830 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcgggagaa

SEQ ID NO: 184831 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcggga

SEQ ID NO: 184832 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcaggag

SEQ ID NO: 184833 - DNA, 20 bp, Artificial Sequence
  Description of Artificial Sequence: Synthetic oligonucleotide
  Target: ATXN1; (-) strand; PAM type: YTN; PAM sequence: TTA
gccacgcgtggtggcatgcg

SEQ ID NO: 184834 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaccaaatta

SEQ ID NO: 184835 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaccaaa

SEQ ID NO: 184836 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaacca

SEQ ID NO: 184837 - DNA, 20 bp, Artificial Sequence
  Description of Artificial Sequence: Synthetic oligonucleotide
  Target: ATXN1; (-) strand; PAM type: YTN; PAM sequence: CTA
acacagtgaaaccccgtctc

SEQ ID NO: 184838 - DNA, 20 bp, Artificial Sequence
  Description of Artificial Sequence: Synthetic oligonucleotide
  Target: ATXN1; (-) strand; PAM type: YTN; PAM sequence: CTG
actaacacagtgaaaccccg

SEQ ID NO: 184839 - DNA, 20 bp, Artificial Sequence
  Description of Artificial Sequence: Synthetic oligonucleotide
  Target: ATXN1; (-) strand; PAM type: YTN; PAM sequence: TTA
ggaggccgaggcgggcagat

SEQ ID NO: 184840 - DNA, 20 bp, Artificial Sequence
  Description of Artificial Sequence: Synthetic oligonucleotide
  Target: ATXN1; (-) strand; PAM type: YTN; PAM sequence: TTT
aggaggccgaggcgggcaga

SEQ ID NO: 184841 - DNA, 20 bp, Artificial Sequence
  Description of Artificial Sequence: Synthetic oligonucleotide
  Target: ATXN1; (-) strand; PAM type: YTN; PAM sequence: CTT
taggaggccgaggcgggcag

SEQ ID NO: 184842 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttaggag

SEQ ID NO: 184843 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 184844 - DNA, 20 bp, Artificial Sequence
  Description of Artificial Sequence: Synthetic oligonucleotide
  Target: ATXN1; (-) strand; PAM type: YTN; PAM sequence: TTA
taaggtaataaccagtccgg

SEQ ID NO: 184845 - DNA, 20 bp, Artificial Sequence
  Description of Artificial Sequence: Synthetic oligonucleotide
  Target: ATXN1; (-) strand; PAM type: YTN; PAM sequence: TTT
ataaggtaataaccagtccg

SEQ ID NO: 184846 - DNA, 20 bp, Artificial Sequence
  Description of Artificial Sequence: Synthetic oligonucleotide
  Target: ATXN1; (-) strand; PAM type: YTN; PAM sequence: CTT
tataaggtaataaccagtcc

SEQ ID NO: 184847 - DNA, 20 bp, Artificial Sequence
  Description of Artificial Sequence: Synthetic oligonucleotide
  Target: ATXN1; (-) strand; PAM type: YTN; PAM sequence: TTC
cctttataaggtaataacca

SEQ ID NO: 184848 - DNA, 20 bp, Artificial Sequence
  Description of Artificial Sequence: Synthetic oligonucleotide
  Target: ATXN1; (-) strand; PAM type: YTN; PAM sequence: CTT
ccctttataaggtaataacc

SEQ ID NO: 184849 - DNA, 20 bp, Artificial Sequence
  Description of Artificial Sequence: Synthetic oligonucleotide
  Target: ATXN1; (-) strand; PAM type: YTN; PAM sequence: TTG
atggtacttccctttataag

SEQ ID NO: 184850 - DNA, 20 bp, Artificial Sequence
  Description of Artificial Sequence: Synthetic oligonucleotide
  Target: ATXN1; (-) strand; PAM type: YTN; PAM sequence: TTT
gatggtacttccctttataa

SEQ ID NO: 184851 - DNA, 20 bp, Artificial Sequence
  Description of Artificial Sequence: Synthetic oligonucleotide
  Target: ATXN1; (-) strand; PAM type: YTN; PAM sequence: CTG
ataacaatttgatggtactt

SEQ ID NO: 184852 - DNA, 20 bp, Artificial Sequence
  Description of Artificial Sequence: Synthetic oligonucleotide
  Target: ATXN1; (-) strand; PAM type: YTN; PAM sequence: CTC
tgataacaatttgatggtac

SEQ ID NO: 184853 - DNA, 20 bp, Artificial Sequence
  Description of Artificial Sequence: Synthetic oligonucleotide
  Target: ATXN1; (-) strand; PAM type: YTN; PAM sequence: TTA
ctctgataacaatttgatgg

SEQ ID NO: 184854 - DNA, 20 bp, Artificial Sequence
  Description of Artificial Sequence: Synthetic oligonucleotide
  Target: ATXN1; (-) strand; PAM type: YTN; PAM sequence: CTG
gaaacaagttactctgataa

SEQ ID NO: 184855 - DNA, 20 bp, Artificial Sequence
  Description of Artificial Sequence: Synthetic oligonucleotide
  Target: ATXN1; (-) strand; PAM type: YTN; PAM sequence: TTC
cctggaaacaagttactctg

SEQ ID NO: 184856 - DNA, 20 bp, Artificial Sequence
  Description of Artificial Sequence: Synthetic oligonucleotide
  Target: ATXN1; (-) strand; PAM type: YTN; PAM sequence: CTT
ccctggaaacaagttactct

SEQ ID NO: 184857 - DNA, 20 bp, Artificial Sequence
  Description of Artificial Sequence: Synthetic oligonucleotide
  Target: ATXN1; (-) strand; PAM type: YTN; PAM sequence: TTC
atcccacagtggcttccctg

SEQ ID NO: 184858 - DNA, 20 bp, Artificial Sequence
  Description of Artificial Sequence: Synthetic oligonucleotide
  Target: ATXN1; (-) strand; PAM type: YTN; PAM sequence: TTC
attcatcccacagtggcttc

SEQ ID NO: 184859 - DNA, 20 bp, Artificial Sequence
  Description of Artificial Sequence: Synthetic oligonucleotide
  Target: ATXN1; (-) strand; PAM type: YTN; PAM sequence: CTG
ttcattcatcccacagtggc

SEQ ID NO: 184860 - DNA, 20 bp, Artificial Sequence
  Description of Artificial Sequence: Synthetic oligonucleotide
  Target: ATXN1; (-) strand; PAM type: YTN; PAM sequence: TTC
cagtgactgttcattcatcc

SEQ ID NO: 184861 - DNA, 20 bp, Artificial Sequence
  Description of Artificial Sequence: Synthetic oligonucleotide
  Target: ATXN1; (-) strand; PAM type: YTN; PAM sequence: CTG
gttccagtgactgttcattc

SEQ ID NO: 184862 - DNA, 20 bp, Artificial Sequence
  Description of Artificial Sequence: Synthetic oligonucleotide
  Target: ATXN1; (-) strand; PAM type: YTN; PAM sequence: TTA
ctggttccagtgactgttca

SEQ ID NO: 184863 - DNA, 20 bp, Artificial Sequence
  Description of Artificial Sequence: Synthetic oligonucleotide
  Target: ATXN1; (-) strand; PAM type: YTN; PAM sequence: CTT
actggttccagtgactgttc

SEQ ID NO: 184864 - DNA, 20 bp, Artificial Sequence
  Description of Artificial Sequence: Synthetic oligonucleotide
  Target: ATXN1; (-) strand; PAM type: YTN; PAM sequence: CTC
gcttactggttccagtgact

SEQ ID NO: 184865 - DNA, 20 bp, Artificial Sequence
  Description of Artificial Sequence: Synthetic oligonucleotide
  Target: ATXN1; (-) strand; PAM type: YTN; PAM sequence: CTA
gcccagggatagcatatact

SEQ ID NO: 184866 - DNA, 20 bp, Artificial Sequence
  Description of Artificial Sequence: Synthetic oligonucleotide
  Target: ATXN1; (-) strand; PAM type: YTN; PAM sequence: CTC
ctagcccagggatagcatat

SEQ ID NO: 184867 - DNA, 20 bp, Artificial Sequence
  Description of Artificial Sequence: Synthetic oligonucleotide
  Target: ATXN1; (-) strand; PAM type: YTN; PAM sequence: TTC
agtatataccagcaactcct

SEQ ID NO: 184868 - DNA, 20 bp, Artificial Sequence
  Description of Artificial Sequence: Synthetic oligonucleotide
  Target: ATXN1; (-) strand; PAM type: YTN; PAM sequence: CTT
cagtatataccagcaactcc

SEQ ID NO: 184869 - DNA, 20 bp, Artificial Sequence
  Description of Artificial Sequence: Synthetic oligonucleotide
  Target: ATXN1; (-) strand; PAM type: YTN; PAM sequence: CTG
tgtacttcagtatataccag

SEQ ID NO: 184870 - DNA, 20 bp, Artificial Sequence
  Description of Artificial Sequence: Synthetic oligonucleotide
  Target: ATXN1; (-) strand; PAM type: YTN; PAM sequence: TTG
taactgtgtacttcagtata

SEQ ID NO: 184871 - DNA, 20 bp, Artificial Sequence
  Description of Artificial Sequence: Synthetic oligonucleotide
  Target: ATXN1; (-) strand; PAM type: YTN; PAM sequence: TTT
gtaactgtgtacttcagtat

SEQ ID NO: 184872 - DNA, 20 bp, Artificial Sequence
  Description of Artificial Sequence: Synthetic oligonucleotide
  Target: ATXN1; (-) strand; PAM type: YTN; PAM sequence: TTG
atttgtaactgtgtacttca

SEQ ID NO: 184873 - DNA, 20 bp, Artificial Sequence
  Description of Artificial Sequence: Synthetic oligonucleotide
  Target: ATXN1; (-) strand; PAM type: YTN; PAM sequence: TTG
cattgatttgtaactgtgta

SEQ ID NO: 184874 - DNA, 20 bp, Artificial Sequence
  Description of Artificial Sequence: Synthetic oligonucleotide
  Target: ATXN1; (-) strand; PAM type: YTN; PAM sequence: TTT
gcattgatttgtaactgtgt

SEQ ID NO: 184875 - DNA, 20 bp, Artificial Sequence
  Description of Artificial Sequence: Synthetic oligonucleotide
  Target: ATXN1; (-) strand; PAM type: YTN; PAM sequence: CTT
tgcattgatttgtaactgtg

SEQ ID NO: 184876 - DNA, 20 bp, Artificial Sequence
  Description of Artificial Sequence: Synthetic oligonucleotide
  Target: ATXN1; (-) strand; PAM type: YTN; PAM sequence: TTG
ctttgcattgatttgtaact

SEQ ID NO: 184877 - DNA, 20 bp, Artificial Sequence
  Description of Artificial Sequence: Synthetic oligonucleotide
  Target: ATXN1; (-) strand; PAM type: YTN; PAM sequence: TTT
gctttgcattgatttgtaac

SEQ ID NO: 184878 - DNA, 20 bp, Artificial Sequence
  Description of Artificial Sequence: Synthetic oligonucleotide
  Target: ATXN1; (-) strand; PAM type: YTN; PAM sequence: CTA
atttgctttgcattgatttg

SEQ ID NO: 184879 - DNA, 20 bp, Artificial Sequence
  Description of Artificial Sequence: Synthetic oligonucleotide
  Target: ATXN1; (-) strand; PAM type: YTN; PAM sequence: TTG
gctaatttgctttgcattga

SEQ ID NO: 184880 - DNA, 20 bp, Artificial Sequence
  Description of Artificial Sequence: Synthetic oligonucleotide
  Target: ATXN1; (-) strand; PAM type: YTN; PAM sequence: TTT
ggctaatttgctttgcattg

SEQ ID NO: 184881 - DNA, 20 bp, Artificial Sequence
  Description of Artificial Sequence: Synthetic oligonucleotide
  Target: ATXN1; (-) strand; PAM type: YTN; PAM sequence: TTT
tggctaatttgctttgcatt

SEQ ID NO: 184882 - DNA, 20 bp, Artificial Sequence
  Description of Artificial Sequence: Synthetic oligonucleotide
  Target: ATXN1; (-) strand; PAM type: YTN; PAM sequence: CTT
ttggctaatttgctttgcat

SEQ ID NO: 184883 - DNA, 20 bp, Artificial Sequence
  Description of Artificial Sequence: Synthetic oligonucleotide
  Target: ATXN1; (-) strand; PAM type: YTN; PAM sequence: CTC
ttttggctaatttgctttgc

SEQ ID NO: 184884 - DNA, 20 bp, Artificial Sequence
  Description of Artificial Sequence: Synthetic oligonucleotide
  Target: ATXN1; (-) strand; PAM type: YTN; PAM sequence: TTG
cctcttttggctaatttgct

SEQ ID NO: 184885 - DNA, 20 bp, Artificial Sequence
  Description of Artificial Sequence: Synthetic oligonucleotide
  Target: ATXN1; (-) strand; PAM type: YTN; PAM sequence: TTT
gcctcttttggctaatttgc

SEQ ID NO: 184886 - DNA, 20 bp, Artificial Sequence
  Description of Artificial Sequence: Synthetic oligonucleotide
  Target: ATXN1; (-) strand; PAM type: YTN; PAM sequence: TTT
tgcctcttttggctaatttg

SEQ ID NO: 184887 - DNA, 20 bp, Artificial Sequence
  Description of Artificial Sequence: Synthetic oligonucleotide
  Target: ATXN1; (-) strand; PAM type: YTN; PAM sequence: CTT
ttgcctcttttggctaattt

SEQ ID NO: 184888 - DNA, 20 bp, Artificial Sequence
  Description of Artificial Sequence: Synthetic oligonucleotide
  Target: ATXN1; (-) strand; PAM type: YTN; PAM sequence: TTA
gaaaggggagtgacttttgc

SEQ ID NO: 184889 - DNA, 20 bp, Artificial Sequence
  Description of Artificial Sequence: Synthetic oligonucleotide
  Target: ATXN1; (-) strand; PAM type: YTN; PAM sequence: CTT
agaaaggggagtgacttttg

SEQ ID NO: 184890 - DNA, 20 bp, Artificial Sequence
  Description of Artificial Sequence: Synthetic oligonucleotide
  Target: ATXN1; (-) strand; PAM type: YTN; PAM sequence: CTG
cttagaaaggggagtgactt

SEQ ID NO: 184891 - DNA, 20 bp, Artificial Sequence
  Description of Artificial Sequence: Synthetic oligonucleotide
  Target: ATXN1; (-) strand; PAM type: YTN; PAM sequence: TTA
acaatctgcttagaaagggg

SEQ ID NO: 184892 - DNA, 20 bp, Artificial Sequence
  Description of Artificial Sequence: Synthetic oligonucleotide
  Target: ATXN1; (-) strand; PAM type: YTN; PAM sequence: TTG
ttaacaatctgcttagaaag

SEQ ID NO: 184893 - DNA, 20 bp, Artificial Sequence
  Description of Artificial Sequence: Synthetic oligonucleotide
  Target: ATXN1; (-) strand; PAM type: YTN; PAM sequence: TTA
ggacattgttaacaatctgc

SEQ ID NO: 184894 - DNA, 20 bp, Artificial Sequence
  Description of Artificial Sequence: Synthetic oligonucleotide
  Target: ATXN1; (-) strand; PAM type: YTN; PAM sequence: CTT
aggacattgttaacaatctg

SEQ ID NO: 184895 - DNA, 20 bp, Artificial Sequence
  Description of Artificial Sequence: Synthetic oligonucleotide
  Target: ATXN1; (-) strand; PAM type: YTN; PAM sequence: CTC
ttaggacattgttaacaatc

SEQ ID NO: 184896 - DNA, 20 bp, Artificial Sequence
  Description of Artificial Sequence: Synthetic oligonucleotide
  Target: ATXN1; (-) strand; PAM type: YTN; PAM sequence: TTC
tcttaggacattgttaacaa

SEQ ID NO: 184897 - DNA, 20 bp, Artificial Sequence
  Description of Artificial Sequence: Synthetic oligonucleotide
  Target: ATXN1; (-) strand; PAM type: YTN; PAM sequence: TTG
cattctcttaggacattgtt

SEQ ID NO: 184898 - DNA, 20 bp, Artificial Sequence
  Description of Artificial Sequence: Synthetic oligonucleotide
  Target: ATXN1; (-) strand; PAM type: YTN; PAM sequence: CTT
gcattctcttaggacattgt

SEQ ID NO: 184899 - DNA, 20 bp, Artificial Sequence
  Description of Artificial Sequence: Synthetic oligonucleotide
  Target: ATXN1; (-) strand; PAM type: YTN; PAM sequence: TTA
aatgcttgcattctcttagg

SEQ ID NO: 184900 - DNA, 20 bp, Artificial Sequence
  Description of Artificial Sequence: Synthetic oligonucleotide
  Target: ATXN1; (-) strand; PAM type: YTN; PAM sequence: TTT
aaatgcttgcattctcttag

SEQ ID NO: 184901 - DNA, 20 bp, Artificial Sequence
  Description of Artificial Sequence: Synthetic oligonucleotide
  Target: ATXN1; (-) strand; PAM type: YTN; PAM sequence: TTT
taaatgcttgcattctctta

SEQ ID NO: 184902 - DNA, 20 bp, Artificial Sequence
  Description of Artificial Sequence: Synthetic oligonucleotide
  Target: ATXN1; (-) strand; PAM type: YTN; PAM sequence: TTT
ttaaatgcttgcattctctt

SEQ ID NO: 184903 - DNA, 20 bp, Artificial Sequence
  Description of Artificial Sequence: Synthetic oligonucleotide
  Target: ATXN1; (-) strand; PAM type: YTN; PAM sequence: TTC
caatatcagccatgtacagt

SEQ ID NO: 184904 - DNA, 20 bp, Artificial Sequence
  Description of Artificial Sequence: Synthetic oligonucleotide
  Target: ATXN1; (-) strand; PAM type: YTN; PAM sequence: TTT
ccaatatcagccatgtacag

SEQ ID NO: 184905 - DNA, 20 bp, Artificial Sequence
  Description of Artificial Sequence: Synthetic oligonucleotide
  Target: ATXN1; (-) strand; PAM type: YTN; PAM sequence: CTC
aatatttccaatatcagcca

SEQ ID NO: 184906 - DNA, 20 bp, Artificial Sequence
  Description of Artificial Sequence: Synthetic oligonucleotide
  Target: ATXN1; (-) strand; PAM type: YTN; PAM sequence: CTA
aatctcaatatttccaatat

SEQ ID NO: 184907 - DNA, 20 bp, Artificial Sequence
  Description of Artificial Sequence: Synthetic oligonucleotide
  Target: ATXN1; (-) strand; PAM type: YTN; PAM sequence: CTC
taaatctcaatatttccaat

SEQ ID NO: 184908 - DNA, 20 bp, Artificial Sequence
  Description of Artificial Sequence: Synthetic oligonucleotide
  Target: ATXN1; (-) strand; PAM type: YTN; PAM sequence: TTG
ctctaaatctcaatatttcc

SEQ ID NO: 184909 - DNA, 20 bp, Artificial Sequence
  Description of Artificial Sequence: Synthetic oligonucleotide
  Target: ATXN1; (-) strand; PAM type: YTN; PAM sequence: CTA
gttgctctaaatctcaatat

SEQ ID NO: 184910 - DNA, 20 bp, Artificial Sequence
  Description of Artificial Sequence: Synthetic oligonucleotide
  Target: ATXN1; (-) strand; PAM type: YTN; PAM sequence: CTC
tagttgctctaaatctcaat

SEQ ID NO: 184911 - DNA, 20 bp, Artificial Sequence
  Description of Artificial Sequence: Synthetic oligonucleotide
  Target: ATXN1; (-) strand; PAM type: YTN; PAM sequence: TTC
tctagttgctctaaatctca

SEQ ID NO: 184912 - DNA, 20 bp, Artificial Sequence
  Description of Artificial Sequence: Synthetic oligonucleotide
  Target: ATXN1; (-) strand; PAM type: YTN; PAM sequence: CTT
ctctagttgctctaaatctc

SEQ ID NO: 184913 - DNA, 20 bp, Artificial Sequence
  Description of Artificial Sequence: Synthetic oligonucleotide
  Target: ATXN1; (-) strand; PAM type: YTN; PAM sequence: CTG
aaaacttctctagttgctct

SEQ ID NO: 184914 - DNA, 20 bp, Artificial Sequence
  Description of Artificial Sequence: Synthetic oligonucleotide
  Target: ATXN1; (-) strand; PAM type: YTN; PAM sequence: CTC
aagcatctgaaaacttctct

SEQ ID NO: 184915 - DNA, 20 bp, Artificial Sequence
  Description of Artificial Sequence: Synthetic oligonucleotide
  Target: ATXN1; (-) strand; PAM type: YTN; PAM sequence: TTC
tcaagcatctgaaaacttct

SEQ ID NO: 184916 - DNA, 20 bp, Artificial Sequence
  Description of Artificial Sequence: Synthetic oligonucleotide
  Target: ATXN1; (-) strand; PAM type: YTN; PAM sequence: TTC
aatgtatattctcaagcatc

SEQ ID NO: 184917 - DNA, 20 bp, Artificial Sequence
  Description of Artificial Sequence: Synthetic oligonucleotide
  Target: ATXN1; (-) strand; PAM type: YTN; PAM sequence: TTT
caatgtatattctcaagcat

SEQ ID NO: 184918 - DNA, 20 bp, Artificial Sequence
  Description of Artificial Sequence: Synthetic oligonucleotide
  Target: ATXN1; (-) strand; PAM type: YTN; PAM sequence: TTC
aaaagtaaggtgatgtttca

SEQ ID NO: 184919 - DNA, 20 bp, Artificial Sequence
  Description of Artificial Sequence: Synthetic oligonucleotide
  Target: ATXN1; (-) strand; PAM type: YTN; PAM sequence: CTG
ttcaaaagtaaggtgatgtt

SEQ ID NO: 184920 - DNA, 20 bp, Artificial Sequence
  Description of Artificial Sequence: Synthetic oligonucleotide
  Target: ATXN1; (-) strand; PAM type: YTN; PAM sequence: TTC
tgttcaaaagtaaggtgatg

SEQ ID NO: 184921 - DNA, 20 bp, Artificial Sequence
  Description of Artificial Sequence: Synthetic oligonucleotide
  Target: ATXN1; (-) strand; PAM type: YTN; PAM sequence: TTG
tgttctgttcaaaagtaagg

SEQ ID NO: 184922 - DNA, 20 bp, Artificial Sequence
  Description of Artificial Sequence: Synthetic oligonucleotide
  Target: ATXN1; (-) strand; PAM type: YTN; PAM sequence: TTT
gtgttctgttcaaaagtaag

SEQ ID NO: 184923 - DNA, 20 bp, Artificial Sequence
  Description of Artificial Sequence: Synthetic oligonucleotide
  Target: ATXN1; (-) strand; PAM type: YTN; PAM sequence: CTA
agtaagtttgtgttctgttc

SEQ ID NO: 184924 - DNA, 20 bp, Artificial Sequence
  Description of Artificial Sequence: Synthetic oligonucleotide
  Target: ATXN1; (-) strand; PAM type: YTN; PAM sequence: TTC
agaagaagcatcgatctaag

SEQ ID NO: 184925 - DNA, 20 bp, Artificial Sequence
  Description of Artificial Sequence: Synthetic oligonucleotide
  Target: ATXN1; (-) strand; PAM type: YTN; PAM sequence: CTA
ttcagaagaagcatcgatct

SEQ ID NO: 184926 - DNA, 20 bp, Artificial Sequence
  Description of Artificial Sequence: Synthetic oligonucleotide
  Target: ATXN1; (-) strand; PAM type: YTN; PAM sequence: TTC
tattcagaagaagcatcgat

SEQ ID NO: 184927 - DNA, 20 bp, Artificial Sequence
  Description of Artificial Sequence: Synthetic oligonucleotide
  Target: ATXN1; (-) strand; PAM type: YTN; PAM sequence: CTT
ctattcagaagaagcatcga

SEQ ID NO: 184928 - DNA, 20 bp, Artificial Sequence
  Description of Artificial Sequence: Synthetic oligonucleotide
  Target: ATXN1; (-) strand; PAM type: YTN; PAM sequence: CTG
cttctattcagaagaagcat

SEQ ID NO: 184929 - DNA, 20 bp, Artificial Sequence
  Description of Artificial Sequence: Synthetic oligonucleotide
  Target: ATXN1; (-) strand; PAM type: YTN; PAM sequence: TTC
tgcttctattcagaagaagc

SEQ ID NO: 184930 - DNA, 20 bp, Artificial Sequence
  Description of Artificial Sequence: Synthetic oligonucleotide
  Target: ATXN1; (-) strand; PAM type: YTN; PAM sequence: TTT
ctgcttctattcagaagaag

SEQ ID NO: 184931 - DNA, 20 bp, Artificial Sequence
  Description of Artificial Sequence: Synthetic oligonucleotide
  Target: ATXN1; (-) strand; PAM type: YTN; PAM sequence: TTT
tctgcttctattcagaagaa

SEQ ID NO: 184932 - DNA, 20 bp, Artificial Sequence
  Description of Artificial Sequence: Synthetic oligonucleotide
  Target: ATXN1; (-) strand; PAM type: YTN; PAM sequence: TTT
ttctgcttctattcagaaga

SEQ ID NO: 184933 - DNA, 20 bp, Artificial Sequence
  Description of Artificial Sequence: Synthetic oligonucleotide
  Target: ATXN1; (-) strand; PAM type: YTN; PAM sequence: TTT
tttctgcttctattcagaag

SEQ ID NO: 184934 - DNA, 20 bp, Artificial Sequence
  Description of Artificial Sequence: Synthetic oligonucleotide
  Target: ATXN1; (-) strand; PAM type: YTN; PAM sequence: TTT
ttttctgcttctattcagaa

SEQ ID NO: 184935 - DNA, 20 bp, Artificial Sequence
  Description of Artificial Sequence: Synthetic oligonucleotide
  Target: ATXN1; (-) strand; PAM type: YTN; PAM sequence: TTT
tttttctgcttctattcaga

SEQ ID NO: 184936 - DNA, 20 bp, Artificial Sequence
  Description of Artificial Sequence: Synthetic oligonucleotide
  Target: ATXN1; (-) strand; PAM type: YTN; PAM sequence: TTT
ttttttctgcttctattcag

SEQ ID NO: 184937 - DNA, 20 bp, Artificial Sequence
  Description of Artificial Sequence: Synthetic oligonucleotide
  Target: ATXN1; (-) strand; PAM type: YTN; PAM sequence: TTT
tttttttctgcttctattca

SEQ ID NO: 184938 - DNA, 20 bp, Artificial Sequence
  Description of Artificial Sequence: Synthetic oligonucleotide
  Target: ATXN1; (-) strand; PAM type: YTN; PAM sequence: TTT
ttttttttctgcttctattc

SEQ ID NO: 184939 - DNA, 20 bp, Artificial Sequence
  Description of Artificial Sequence: Synthetic oligonucleotide
  Target: ATXN1; (-) strand; PAM type: YTN; PAM sequence: TTT
tttttttttctgcttctatt

SEQ ID NO: 184940 - DNA, 20 bp, Artificial Sequence
  Description of Artificial Sequence: Synthetic oligonucleotide
  Target: ATXN1; (-) strand; PAM type: YTN; PAM sequence: CTT
ttttttttttctgcttctat

SEQ ID NO: 184941 - DNA, 20 bp, Artificial Sequence
  Description of Artificial Sequence: Synthetic oligonucleotide
  Target: ATXN1; (-) strand; PAM type: YTN; PAM sequence: CTA
ccttttttttttttctgctt

SEQ ID NO: 184942 - DNA, 20 bp, Artificial Sequence
  Description of Artificial Sequence: Synthetic oligonucleotide
  Target: ATXN1; (-) strand; PAM type: YTN; PAM sequence: CTA
tcacagtcctaccttttttt

SEQ ID NO: 184943 - DNA, 20 bp, Artificial Sequence
  Description of Artificial Sequence: Synthetic oligonucleotide
  Target: ATXN1; (-) strand; PAM type: YTN; PAM sequence: TTC
tatcacagtcctaccttttt

SEQ ID NO: 184944 - DNA, 20 bp, Artificial Sequence
  Description of Artificial Sequence: Synthetic oligonucleotide
  Target: ATXN1; (-) strand; PAM type: YTN; PAM sequence: TTT
ctatcacagtcctacctttt

SEQ ID NO: 184945 - DNA, 20 bp, Artificial Sequence
  Description of Artificial Sequence: Synthetic oligonucleotide
  Target: ATXN1; (-) strand; PAM type: YTN; PAM sequence: TTT
tctatcacagtcctaccttt

SEQ ID NO: 184946 - DNA, 20 bp, Artificial Sequence
  Description of Artificial Sequence: Synthetic oligonucleotide
  Target: ATXN1; (-) strand; PAM type: YTN; PAM sequence: CTG
aaatagttttctatcacagt

SEQ ID NO: 184947 - DNA, 20 bp, Artificial Sequence
  Description of Artificial Sequence: Synthetic oligonucleotide
  Target: ATXN1; (-) strand; PAM type: YTN; PAM sequence: CTC
tgaaatagttttctatcaca

SEQ ID NO: 184948 - DNA, 20 bp, Artificial Sequence
  Description of Artificial Sequence: Synthetic oligonucleotide
  Target: ATXN1; (-) strand; PAM type: YTN; PAM sequence: TTG
gtccagatgagtggatcaac

SEQ ID NO: 184949 - DNA, 20 bp, Artificial Sequence
  Description of Artificial Sequence: Synthetic oligonucleotide
  Target: ATXN1; (-) strand; PAM type: YTN; PAM sequence: CTT
ggtccagatgagtggatcaa

SEQ ID NO: 184950 - DNA, 20 bp, Artificial Sequence
  Description of Artificial Sequence: Synthetic oligonucleotide
  Target: ATXN1; (-) strand; PAM type: YTN; PAM sequence: TTA
ggtgcagggacttggtccag

SEQ ID NO: 184951 - DNA, 20 bp, Artificial Sequence
  Description of Artificial Sequence: Synthetic oligonucleotide
  Target: ATXN1; (-) strand; PAM type: YTN; PAM sequence: TTT
aggtgcagggacttggtcca

SEQ ID NO: 184952 - DNA, 20 bp, Artificial Sequence
  Description of Artificial Sequence: Synthetic oligonucleotide
  Target: ATXN1; (-) strand; PAM type: YTN; PAM sequence: TTT
taggtgcagggacttggtcc

SEQ ID NO: 184953 - DNA, 20 bp, Artificial Sequence
  Description of Artificial Sequence: Synthetic oligonucleotide
  Target: ATXN1; (-) strand; PAM type: YTN; PAM sequence: TTT
ttaggtgcagggacttggtc

SEQ ID NO: 184954 - DNA, 20 bp, Artificial Sequence
  Description of Artificial Sequence: Synthetic oligonucleotide
  Target: ATXN1; (-) strand; PAM type: YTN; PAM sequence: CTG
tatttttaggtgcagggact

SEQ ID NO: 184955 - DNA, 20 bp, Artificial Sequence
  Description of Artificial Sequence: Synthetic oligonucleotide
  Target: ATXN1; (-) strand; PAM type: YTN; PAM sequence: TTC
ctgtatttttaggtgcaggg

SEQ ID NO: 184956 - DNA, 20 bp, Artificial Sequence
  Description of Artificial Sequence: Synthetic oligonucleotide
  Target: ATXN1; (-) strand; PAM type: YTN; PAM sequence: CTT
cctgtatttttaggtgcagg

SEQ ID NO: 184957 - DNA, 20 bp, Artificial Sequence
  Description of Artificial Sequence: Synthetic oligonucleotide
  Target: ATXN1; (-) strand; PAM type: YTN; PAM sequence: CTA
acttcctgtatttttaggtg

SEQ ID NO: 184958 - DNA, 20 bp, Artificial Sequence
  Description of Artificial Sequence: Synthetic oligonucleotide
  Target: ATXN1; (-) strand; PAM type: YTN; PAM sequence: TTA
aaatctaacttcctgtattt

SEQ ID NO: 184959 - DNA, 20 bp, Artificial Sequence
  Description of Artificial Sequence: Synthetic oligonucleotide
  Target: ATXN1; (-) strand; PAM type: YTN; PAM sequence: CTT
aaaatctaacttcctgtatt

SEQ ID NO: 184960 - DNA, 20 bp, Artificial Sequence
  Description of Artificial Sequence: Synthetic oligonucleotide
  Target: ATXN1; (-) strand; PAM type: YTN; PAM sequence: TTA
gaaaccttaaaatctaactt

SEQ ID NO: 184961 - DNA, 20 bp, Artificial Sequence
  Description of Artificial Sequence: Synthetic oligonucleotide
  Target: ATXN1; (-) strand; PAM type: YTN; PAM sequence: TTT
agaaaccttaaaatctaact

SEQ ID NO: 184962 - DNA, 20 bp, Artificial Sequence
  Description of Artificial Sequence: Synthetic oligonucleotide
  Target: ATXN1; (-) strand; PAM type: YTN; PAM sequence: TTT
tagaaaccttaaaatctaac

SEQ ID NO: 184963 - DNA, 20 bp, Artificial Sequence
  Description of Artificial Sequence: Synthetic oligonucleotide
  Target: ATXN1; (-) strand; PAM type: YTN; PAM sequence: TTG
gcagattttagaaaccttaa

SEQ ID NO: 184964 - DNA, 20 bp, Artificial Sequence
  Description of Artificial Sequence: Synthetic oligonucleotide
  Target: ATXN1; (-) strand; PAM type: YTN; PAM sequence: TTT
ggcagattttagaaacctta

SEQ ID NO: 184965 - DNA, 20 bp, Artificial Sequence
  Description of Artificial Sequence: Synthetic oligonucleotide
  Target: ATXN1; (-) strand; PAM type: YTN; PAM sequence: TTT
tggcagattttagaaacctt

SEQ ID NO: 184966 - DNA, 20 bp, Artificial Sequence
  Description of Artificial Sequence: Synthetic oligonucleotide
  Target: ATXN1; (-) strand; PAM type: YTN; PAM sequence: TTG
cacagttttggcagatttta

SEQ ID NO: 184967 - DNA, 20 bp, Artificial Sequence
  Description of Artificial Sequence: Synthetic oligonucleotide
  Target: ATXN1; (-) strand; PAM type: YTN; PAM sequence: CTG
ttgcacagttttggcagatt

SEQ ID NO: 184968 - DNA, 20 bp, Artificial Sequence
  Description of Artificial Sequence: Synthetic oligonucleotide
  Target: ATXN1; (-) strand; PAM type: YTN; PAM sequence: CTC
tgttgcacagttttggcaga

SEQ ID NO: 184969 - DNA, 20 bp, Artificial Sequence
  Description of Artificial Sequence: Synthetic oligonucleotide
  Target: ATXN1; (-) strand; PAM type: YTN; PAM sequence: TTG
gacagccaagggccagctct

SEQ ID NO: 184970 - DNA, 20 bp, Artificial Sequence
  Description of Artificial Sequence: Synthetic oligonucleotide
  Target: ATXN1; (-) strand; PAM type: YTN; PAM sequence: TTT
ggacagccaagggccagctc

SEQ ID NO: 184971 - DNA, 20 bp, Artificial Sequence
  Description of Artificial Sequence: Synthetic oligonucleotide
  Target: ATXN1; (-) strand; PAM type: YTN; PAM sequence: CTA
gaaggtttggacagccaagg

SEQ ID NO: 184972 - DNA, 20 bp, Artificial Sequence
  Description of Artificial Sequence: Synthetic oligonucleotide
  Target: ATXN1; (-) strand; PAM type: YTN; PAM sequence: TTC
tagaaggtttggacagccaa

SEQ ID NO: 184973 - DNA, 20 bp, Artificial Sequence
  Description of Artificial Sequence: Synthetic oligonucleotide
  Target: ATXN1; (-) strand; PAM type: YTN; PAM sequence: TTT
ctagaaggtttggacagcca

SEQ ID NO: 184974 - DNA, 20 bp, Artificial Sequence
  Description of Artificial Sequence: Synthetic oligonucleotide
  Target: ATXN1; (-) strand; PAM type: YTN; PAM sequence: CTT
tctagaaggtttggacagcc

SEQ ID NO: 184975 - DNA, 20 bp, Artificial Sequence
  Description of Artificial Sequence: Synthetic oligonucleotide
  Target: ATXN1; (-) strand; PAM type: YTN; PAM sequence: CTG
cctttctagaaggtttggac

SEQ ID NO: 184976 - DNA, 20 bp, Artificial Sequence
  Description of Artificial Sequence: Synthetic oligonucleotide
  Target: ATXN1; (-) strand; PAM type: YTN; PAM sequence: CTC
tgcctttctagaaggtttgg

SEQ ID NO: 184977 - DNA, 20 bp, Artificial Sequence
  Description of Artificial Sequence: Synthetic oligonucleotide
  Target: ATXN1; (-) strand; PAM type: YTN; PAM sequence: TTA
aaactctgcctttctagaag

SEQ ID NO: 184978 - DNA, 20 bp, Artificial Sequence
  Description of Artificial Sequence: Synthetic oligonucleotide
  Target: ATXN1; (-) strand; PAM type: YTN; PAM sequence: TTT
aaaactctgcctttctagaa

SEQ ID NO: 184979 - DNA, 20 bp, Artificial Sequence
  Description of Artificial Sequence: Synthetic oligonucleotide
  Target: ATXN1; (-) strand; PAM type: YTN; PAM sequence: TTT
taaaactctgcctttctaga

SEQ ID NO: 184980 - DNA, 20 bp, Artificial Sequence
  Description of Artificial Sequence: Synthetic oligonucleotide
  Target: ATXN1; (-) strand; PAM type: YTN; PAM sequence: TTG
ggtgcccacggtgtaagtgc

SEQ ID NO: 184981 - DNA, 20 bp, Artificial Sequence
  Description of Artificial Sequence: Synthetic oligonucleotide
  Target: ATXN1; (-) strand; PAM type: YTN; PAM sequence: TTA
ttgggtgcccacggtgtaag

SEQ ID NO: 184982 - DNA, 20 bp, Artificial Sequence
  Description of Artificial Sequence: Synthetic oligonucleotide
  Target: ATXN1; (-) strand; PAM type: YTN; PAM sequence: TTT
attgggtgcccacggtgtaa

SEQ ID NO: 184983 - DNA, 20 bp, Artificial Sequence
  Description of Artificial Sequence: Synthetic oligonucleotide
  Target: ATXN1; (-) strand; PAM type: YTN; PAM sequence: TTC
atcaagcatttattgggtgc

SEQ ID NO: 184984 - DNA, 20 bp, Artificial Sequence
  Description of Artificial Sequence: Synthetic oligonucleotide
  Target: ATXN1; (-) strand; PAM type: YTN; PAM sequence: TTA
ttcatcaagcatttattggg

SEQ ID NO: 184985 - DNA, 20 bp, Artificial Sequence
  Description of Artificial Sequence: Synthetic oligonucleotide
  Target: ATXN1; (-) strand; PAM type: YTN; PAM sequence: TTT
attcatcaagcatttattgg

SEQ ID NO: 184986 - DNA, 20 bp, Artificial Sequence
  Description of Artificial Sequence: Synthetic oligonucleotide
  Target: ATXN1; (-) strand; PAM type: YTN; PAM sequence: CTC
atttattcatcaagcattta

SEQ ID NO: 184987 - DNA, 20 bp, Artificial Sequence
  Description of Artificial Sequence: Synthetic oligonucleotide
  Target: ATXN1; (-) strand; PAM type: YTN; PAM sequence: TTC
actcatttattcatcaagca

SEQ ID NO: 184988 - DNA, 20 bp, Artificial Sequence
  Description of Artificial Sequence: Synthetic oligonucleotide
  Target: ATXN1; (-) strand; PAM type: YTN; PAM sequence: TTT
cactcatttattcatcaagc

SEQ ID NO: 184989 - DNA, 20 bp, Artificial Sequence
  Description of Artificial Sequence: Synthetic oligonucleotide
  Target: ATXN1; (-) strand; PAM type: YTN; PAM sequence: TTC
atttcactcatttattcatc

SEQ ID NO: 184990 - DNA, 20 bp, Artificial Sequence
  Description of Artificial Sequence: Synthetic oligonucleotide
  Target: ATXN1; (-) strand; PAM type: YTN; PAM sequence: TTC
attcatttcactcatttatt

SEQ ID NO: 184991 - DNA, 20 bp, Artificial Sequence
  Description of Artificial Sequence: Synthetic oligonucleotide
  Target: ATXN1; (-) strand; PAM type: YTN; PAM sequence: TTC
attcattcatttcactcatt

SEQ ID NO: 184992 - DNA, 20 bp, Artificial Sequence
  Description of Artificial Sequence: Synthetic oligonucleotide
  Target: ATXN1; (-) strand; PAM type: YTN; PAM sequence: TTC
atgcattcattcattcattt

SEQ ID NO: 184993 - DNA, 20 bp, Artificial Sequence
  Description of Artificial Sequence: Synthetic oligonucleotide
  Target: ATXN1; (-) strand; PAM type: YTN; PAM sequence: TTT
catgcattcattcattcatt

SEQ ID NO: 184994 - DNA, 20 bp, Artificial Sequence
  Description of Artificial Sequence: Synthetic oligonucleotide
  Target: ATXN1; (-) strand; PAM type: YTN; PAM sequence: CTT
tcatgcattcattcattcat

SEQ ID NO: 184995 - DNA, 20 bp, Artificial Sequence
  Description of Artificial Sequence: Synthetic oligonucleotide
  Target: ATXN1; (-) strand; PAM type: YTN; PAM sequence: TTC
tttcatgcattcattcattc

SEQ ID NO: 184996 - DNA, 20 bp, Artificial Sequence
  Description of Artificial Sequence: Synthetic oligonucleotide
  Target: ATXN1; (-) strand; PAM type: YTN; PAM sequence: CTC
attctttcatgcattcattc

SEQ ID NO: 184997 - DNA, 20 bp, Artificial Sequence
  Description of Artificial Sequence: Synthetic oligonucleotide
  Target: ATXN1; (-) strand; PAM type: YTN; PAM sequence: CTC
actcattctttcatgcattc

SEQ ID NO: 184998 - DNA, 20 bp, Artificial Sequence
  Description of Artificial Sequence: Synthetic oligonucleotide
  Target: ATXN1; (-) strand; PAM type: YTN; PAM sequence: CTA
ctcactcattctttcatgca

SEQ ID NO: 184999 - DNA, 20 bp, Artificial Sequence
  Description of Artificial Sequence: Synthetic oligonucleotide
  Target: ATXN1; (-) strand; PAM type: YTN; PAM sequence: TTC
aataagctactcactcattc

SEQ ID NO: 185000 - DNA, 20 bp, Artificial Sequence
  Description of Artificial Sequence: Synthetic oligonucleotide
  Target: ATXN1; (-) strand; PAM type: YTN; PAM sequence: TTT
caataagctactcactcatt

SEQ ID NO: 185001 - DNA, 20 bp, Artificial Sequence
  Description of Artificial Sequence: Synthetic oligonucleotide
  Target: ATXN1; (-) strand; PAM type: YTN; PAM sequence: CTT
tcaataagctactcactcat

SEQ ID NO: 185002 - DNA, 20 bp, Artificial Sequence
  Description of Artificial Sequence: Synthetic oligonucleotide
  Target: ATXN1; (-) strand; PAM type: YTN; PAM sequence: CTA
atagaatgtcacagacaact

SEQ ID NO: 185003 - DNA, 20 bp, Artificial Sequence
  Description of Artificial Sequence: Synthetic oligonucleotide
  Target: ATXN1; (-) strand; PAM type: YTN; PAM sequence: TTC
aggccctaatagaatgtcac

SEQ ID NO: 185004 - DNA, 20 bp, Artificial Sequence
  Description of Artificial Sequence: Synthetic oligonucleotide
  Target: ATXN1; (-) strand; PAM type: YTN; PAM sequence: TTT
caggccctaatagaatgtca

SEQ ID NO: 185005 - DNA, 20 bp, Artificial Sequence
  Description of Artificial Sequence: Synthetic oligonucleotide
  Target: ATXN1; (-) strand; PAM type: YTN; PAM sequence: TTT
tcaggccctaatagaatgtc

SEQ ID NO: 185006 - DNA, 20 bp, Artificial Sequence
  Description of Artificial Sequence: Synthetic oligonucleotide
  Target: ATXN1; (-) strand; PAM type: YTN; PAM sequence: TTT
ttcaggccctaatagaatgt

SEQ ID NO: 185007 - DNA, 20 bp, Artificial Sequence
  Description of Artificial Sequence: Synthetic oligonucleotide
  Target: ATXN1; (-) strand; PAM type: YTN; PAM sequence: TTG
gtttttcaggccctaataga

SEQ ID NO: 185008 - DNA, 20 bp, Artificial Sequence
  Description of Artificial Sequence: Synthetic oligonucleotide
  Target: ATXN1; (-) strand; PAM type: YTN; PAM sequence: CTG
ttggtttttcaggccctaat

SEQ ID NO: 185009 - DNA, 20 bp, Artificial Sequence
  Description of Artificial Sequence: Synthetic oligonucleotide
  Target: ATXN1; (-) strand; PAM type: YTN; PAM sequence: TTG
ctgttggtttttcaggccct

SEQ ID NO: 185010 - DNA, 20 bp, Artificial Sequence
  Description of Artificial Sequence: Synthetic oligonucleotide
  Target: ATXN1; (-) strand; PAM type: YTN; PAM sequence: TTG
tataattgctgttggttttt

SEQ ID NO: 185011 - DNA, 20 bp, Artificial Sequence
  Description of Artificial Sequence: Synthetic oligonucleotide
  Target: ATXN1; (-) strand; PAM type: YTN; PAM sequence: CTT
gtataattgctgttggtttt

SEQ ID NO: 185012 - DNA, 20 bp, Artificial Sequence
  Description of Artificial Sequence: Synthetic oligonucleotide
  Target: ATXN1; (-) strand; PAM type: YTN; PAM sequence: CTC
ttgtataattgctgttggtt

SEQ ID NO: 185013 - DNA, 20 bp, Artificial Sequence
  Description of Artificial Sequence: Synthetic oligonucleotide
  Target: ATXN1; (-) strand; PAM type: YTN; PAM sequence: TTA
agggcaagactcttgtataa

SEQ ID NO: 185014 - DNA, 20 bp, Artificial Sequence
  Description of Artificial Sequence: Synthetic oligonucleotide
  Target: ATXN1; (-) strand; PAM type: YTN; PAM sequence: CTT
aagggcaagactcttgtata

SEQ ID NO: 185015 - DNA, 20 bp, Artificial Sequence
  Description of Artificial Sequence: Synthetic oligonucleotide
  Target: ATXN1; (-) strand; PAM type: YTN; PAM sequence: TTC
ttaagggcaagactcttgta

SEQ ID NO: 185016 - DNA, 20 bp, Artificial Sequence
  Description of Artificial Sequence: Synthetic oligonucleotide
  Target: ATXN1; (-) strand; PAM type: YTN; PAM sequence: CTT
cttaagggcaagactcttgt

SEQ ID NO: 185017 - DNA, 20 bp, Artificial Sequence
  Description of Artificial Sequence: Synthetic oligonucleotide
  Target: ATXN1; (-) strand; PAM type: YTN; PAM sequence: CTG
atagaatagaagcttcttaa

SEQ ID NO: 185018 - DNA, 20 bp, Artificial Sequence
  Description of Artificial Sequence: Synthetic oligonucleotide
  Target: ATXN1; (-) strand; PAM type: YTN; PAM sequence: CTC
ctgatagaatagaagcttct

SEQ ID NO: 185019 - DNA, 20 bp, Artificial Sequence
  Description of Artificial Sequence: Synthetic oligonucleotide
  Target: ATXN1; (-) strand; PAM type: YTN; PAM sequence: TTC
tcctgatagaatagaagctt

SEQ ID NO: 185020 - DNA, 20 bp, Artificial Sequence
  Description of Artificial Sequence: Synthetic oligonucleotide
  Target: ATXN1; (-) strand; PAM type: YTN; PAM sequence: CTT
ctcctgatagaatagaagct

SEQ ID NO: 185021 - DNA, 20 bp, Artificial Sequence
  Description of Artificial Sequence: Synthetic oligonucleotide
  Target: ATXN1; (-) strand; PAM type: YTN; PAM sequence: TTG
cttctcctgatagaatagaa

SEQ ID NO: 185022 - DNA, 20 bp, Artificial Sequence
  Description of Artificial Sequence: Synthetic oligonucleotide
  Target: ATXN1; (-) strand; PAM type: YTN; PAM sequence: TTT
gcttctcctgatagaataga

SEQ ID NO: 185023 - DNA, 20 bp, Artificial Sequence
  Description of Artificial Sequence: Synthetic oligonucleotide
  Target: ATXN1; (-) strand; PAM type: YTN; PAM sequence: TTT
tgcttctcctgatagaatag

SEQ ID NO: 185024 - DNA, 20 bp, Artificial Sequence
  Description of Artificial Sequence: Synthetic oligonucleotide
  Target: ATXN1; (-) strand; PAM type: YTN; PAM sequence: TTT
ttgcttctcctgatagaata

SEQ ID NO: 185025 - DNA, 20 bp, Artificial Sequence
  Description of Artificial Sequence: Synthetic oligonucleotide
  Target: ATXN1; (-) strand; PAM type: YTN; PAM sequence: TTA
tatttttgcttctcctgata

SEQ ID NO: 185026 - DNA, 20 bp, Artificial Sequence
  Description of Artificial Sequence: Synthetic oligonucleotide
  Target: ATXN1; (-) strand; PAM type: YTN; PAM sequence: TTT
atatttttgcttctcctgat

SEQ ID NO: 185027 - DNA, 20 bp, Artificial Sequence
  Description of Artificial Sequence: Synthetic oligonucleotide
  Target: ATXN1; (-) strand; PAM type: YTN; PAM sequence: TTA
tttatatttttgcttctcct

SEQ ID NO: 185028 - DNA, 20 bp, Artificial Sequence
  Description of Artificial Sequence: Synthetic oligonucleotide
  Target: ATXN1; (-) strand; PAM type: YTN; PAM sequence: CTT
atttatatttttgcttctcc

SEQ ID NO: 185029 - DNA, 20 bp, Artificial Sequence
  Description of Artificial Sequence: Synthetic oligonucleotide
  Target: ATXN1; (-) strand; PAM type: YTN; PAM sequence: TTA
aacttatttatatttttgct

SEQ ID NO: 185030 - DNA, 20 bp, Artificial Sequence
  Description of Artificial Sequence: Synthetic oligonucleotide
  Target: ATXN1; (-) strand; PAM type: YTN; PAM sequence: CTG
tattaaacttatttatattt

SEQ ID NO: 185031 - DNA, 20 bp, Artificial Sequence
  Description of Artificial Sequence: Synthetic oligonucleotide
  Target: ATXN1; (-) strand; PAM type: YTN; PAM sequence: CTG
caagtatcacactgtattaa

SEQ ID NO: 185032 - DNA, 20 bp, Artificial Sequence
  Description of Artificial Sequence: Synthetic oligonucleotide
  Target: ATXN1; (-) strand; PAM type: YTN; PAM sequence: TTA
ctgcaagtatcacactgtat

SEQ ID NO: 185033 - DNA, 20 bp, Artificial Sequence
  Description of Artificial Sequence: Synthetic oligonucleotide
  Target: ATXN1; (-) strand; PAM type: YTN; PAM sequence: TTA
ttactgcaagtatcacactg

SEQ ID NO: 185034 - DNA, 20 bp, Artificial Sequence
  Description of Artificial Sequence: Synthetic oligonucleotide
  Target: ATXN1; (-) strand; PAM type: YTN; PAM sequence: TTG
cattattactgcaagtatca

SEQ ID NO: 185035 - DNA, 20 bp, Artificial Sequence
  Description of Artificial Sequence: Synthetic oligonucleotide
  Target: ATXN1; (-) strand; PAM type: YTN; PAM sequence: CTT
gcattattactgcaagtatc

SEQ ID NO: 185036 - DNA, 20 bp, Artificial Sequence
  Description of Artificial Sequence: Synthetic oligonucleotide
  Target: ATXN1; (-) strand; PAM type: YTN; PAM sequence: CTG
ataaggtcttgcattattac

SEQ ID NO: 185037 - DNA, 20 bp, Artificial Sequence
  Description of Artificial Sequence: Synthetic oligonucleotide
  Target: ATXN1; (-) strand; PAM type: YTN; PAM sequence: CTC
cctgataaggtcttgcatta

SEQ ID NO: 185038 - DNA, 20 bp, Artificial Sequence
  Description of Artificial Sequence: Synthetic oligonucleotide
  Target: ATXN1; (-) strand; PAM type: YTN; PAM sequence: TTG
ctccctgataaggtcttgca

SEQ ID NO: 185039 - DNA, 20 bp, Artificial Sequence
  Description of Artificial Sequence: Synthetic oligonucleotide
  Target: ATXN1; (-) strand; PAM type: YTN; PAM sequence: CTA
attgctccctgataaggtct

SEQ ID NO: 185040 - DNA, 20 bp, Artificial Sequence
  Description of Artificial Sequence: Synthetic oligonucleotide
  Target: ATXN1; (-) strand; PAM type: YTN; PAM sequence: TTC
actaattgctccctgataag

SEQ ID NO: 185041 - DNA, 20 bp, Artificial Sequence
  Description of Artificial Sequence: Synthetic oligonucleotide
  Target: ATXN1; (-) strand; PAM type: YTN; PAM sequence: CTT
cactaattgctccctgataa

SEQ ID NO: 185042 - DNA, 20 bp, Artificial Sequence
  Description of Artificial Sequence: Synthetic oligonucleotide
  Target: ATXN1; (-) strand; PAM type: YTN; PAM sequence: TTC
ttcactaattgctccctgat

SEQ ID NO: 185043 - DNA, 20 bp, Artificial Sequence
  Description of Artificial Sequence: Synthetic oligonucleotide
  Target: ATXN1; (-) strand; PAM type: YTN; PAM sequence: CTA
gttcttcactaattgctccc

SEQ ID NO: 185044 - DNA, 20 bp, Artificial Sequence
  Description of Artificial Sequence: Synthetic oligonucleotide
  Target: ATXN1; (-) strand; PAM type: YTN; PAM sequence: TTG
cctagttcttcactaattgc

SEQ ID NO: 185045 - DNA, 20 bp, Artificial Sequence
  Description of Artificial Sequence: Synthetic oligonucleotide
  Target: ATXN1; (-) strand; PAM type: YTN; PAM sequence: CTT
gcctagttcttcactaattg

SEQ ID NO: 185046 - DNA, 20 bp, Artificial Sequence
  Description of Artificial Sequence: Synthetic oligonucleotide
  Target: ATXN1; (-) strand; PAM type: YTN; PAM sequence: TTA
accccttgcctagttcttca

SEQ ID NO: 185047 - DNA, 20 bp, Artificial Sequence
  Description of Artificial Sequence: Synthetic oligonucleotide
  Target: ATXN1; (-) strand; PAM type: YTN; PAM sequence: TTT
aaccccttgcctagttcttc

SEQ ID NO: 185048 - DNA, 20 bp, Artificial Sequence
  Description of Artificial Sequence: Synthetic oligonucleotide
  Target: ATXN1; (-) strand; PAM type: YTN; PAM sequence: CTT
taaccccttgcctagttctt

SEQ ID NO: 185049 - DNA, 20 bp, Artificial Sequence
  Description of Artificial Sequence: Synthetic oligonucleotide
  Target: ATXN1; (-) strand; PAM type: YTN; PAM sequence: TTC
tttaaccccttgcctagttc

SEQ ID NO: 185050 - DNA, 20 bp, Artificial Sequence
  Description of Artificial Sequence: Synthetic oligonucleotide
  Target: ATXN1; (-) strand; PAM type: YTN; PAM sequence: TTT
ctttaaccccttgcctagtt

SEQ ID NO: 185051 - DNA, 20 bp, Artificial Sequence
  Description of Artificial Sequence: Synthetic oligonucleotide
  Target: ATXN1; (-) strand; PAM type: YTN; PAM sequence: CTT
tctttaaccccttgcctagt

SEQ ID NO: 185052 - DNA, 20 bp, Artificial Sequence
  Description of Artificial Sequence: Synthetic oligonucleotide
  Target: ATXN1; (-) strand; PAM type: YTN; PAM sequence: TTA
gaagctttctttaacccctt

SEQ ID NO: 185053 - DNA, 20 bp, Artificial Sequence
  Description of Artificial Sequence: Synthetic oligonucleotide
  Target: ATXN1; (-) strand; PAM type: YTN; PAM sequence: CTT
agaagctttctttaacccct

SEQ ID NO: 185054 - DNA, 20 bp, Artificial Sequence
  Description of Artificial Sequence: Synthetic oligonucleotide
  Target: ATXN1; (-) strand; PAM type: YTN; PAM sequence: CTA
tcttagaagctttctttaac

SEQ ID NO: 185055 - DNA, 20 bp, Artificial Sequence
  Description of Artificial Sequence: Synthetic oligonucleotide
  Target: ATXN1; (-) strand; PAM type: YTN; PAM sequence: TTA
gatcctatcttagaagcttt

SEQ ID NO: 185056 - DNA, 20 bp, Artificial Sequence
  Description of Artificial Sequence: Synthetic oligonucleotide
  Target: ATXN1; (-) strand; PAM type: YTN; PAM sequence: TTA
attagatcctatcttagaag

SEQ ID NO: 185057 - DNA, 20 bp, Artificial Sequence
  Description of Artificial Sequence: Synthetic oligonucleotide
  Target: ATXN1; (-) strand; PAM type: YTN; PAM sequence: TTT
aattagatcctatcttagaa

SEQ ID NO: 185058 - DNA, 20 bp, Artificial Sequence
  Description of Artificial Sequence: Synthetic oligonucleotide
  Target: ATXN1; (-) strand; PAM type: YTN; PAM sequence: TTG
tttaattagatcctatctta

SEQ ID NO: 185059 - DNA, 20 bp, Artificial Sequence
  Description of Artificial Sequence: Synthetic oligonucleotide
  Target: ATXN1; (-) strand; PAM type: YTN; PAM sequence: TTT
gtttaattagatcctatctt

SEQ ID NO: 185060 - DNA, 20 bp, Artificial Sequence
  Description of Artificial Sequence: Synthetic oligonucleotide
  Target: ATXN1; (-) strand; PAM type: YTN; PAM sequence: TTG
gtgtgaatttgtttaattag

SEQ ID NO: 185061 - DNA, 20 bp, Artificial Sequence
  Description of Artificial Sequence: Synthetic oligonucleotide
  Target: ATXN1; (-) strand; PAM type: YTN; PAM sequence: CTT
ggtgtgaatttgtttaatta

SEQ ID NO: 185062 - DNA, 20 bp, Artificial Sequence
  Description of Artificial Sequence: Synthetic oligonucleotide
  Target: ATXN1; (-) strand; PAM type: YTN; PAM sequence: TTA
gcaccttggtgtgaatttgt

SEQ ID NO: 185063 - DNA, 20 bp, Artificial Sequence
  Description of Artificial Sequence: Synthetic oligonucleotide
  Target: ATXN1; (-) strand; PAM type: YTN; PAM sequence: CTG
gggcagaggccacagataag

SEQ ID NO: 185064 - DNA, 20 bp, Artificial Sequence
  Description of Artificial Sequence: Synthetic oligonucleotide
  Target: ATXN1; (-) strand; PAM type: YTN; PAM sequence: TTA
aaatgcaaatgatcctgggg

SEQ ID NO: 185065 - DNA, 20 bp, Artificial Sequence
  Description of Artificial Sequence: Synthetic oligonucleotide
  Target: ATXN1; (-) strand; PAM type: YTN; PAM sequence: CTA
ttaaaatgcaaatgatcctg

SEQ ID NO: 185066 - DNA, 20 bp, Artificial Sequence
  Description of Artificial Sequence: Synthetic oligonucleotide
  Target: ATXN1; (-) strand; PAM type: YTN; PAM sequence: TTC
tattaaaatgcaaatgatcc

SEQ ID NO: 185067 - DNA, 20 bp, Artificial Sequence
  Description of Artificial Sequence: Synthetic oligonucleotide
  Target: ATXN1; (-) strand; PAM type: YTN; PAM sequence: TTT
ctattaaaatgcaaatgatc

SEQ ID NO: 185068 - DNA, 20 bp, Artificial Sequence
  Description of Artificial Sequence: Synthetic oligonucleotide
  Target: ATXN1; (-) strand; PAM type: YTN; PAM sequence: TTT
tctattaaaatgcaaatgat

SEQ ID NO: 185069 - DNA, 20 bp, Artificial Sequence
  Description of Artificial Sequence: Synthetic oligonucleotide
  Target: ATXN1; (-) strand; PAM type: YTN; PAM sequence: CTA
gttttctattaaaatgcaaa

SEQ ID NO: 185070 - DNA, 20 bp, Artificial Sequence
  Description of Artificial Sequence: Synthetic oligonucleotide
  Target: ATXN1; (-) strand; PAM type: YTN; PAM sequence: CTC
aagtatcaagcaaagccatc

SEQ ID NO: 185071 - DNA, 20 bp, Artificial Sequence
  Description of Artificial Sequence: Synthetic oligonucleotide
  Target: ATXN1; (-) strand; PAM type: YTN; PAM sequence: TTC
agtcctcaagtatcaagcaa

SEQ ID NO: 185072 - DNA, 20 bp, Artificial Sequence
  Description of Artificial Sequence: Synthetic oligonucleotide
  Target: ATXN1; (-) strand; PAM type: YTN; PAM sequence: CTA
atagtagttcagtcctcaag

SEQ ID NO: 185073 - DNA, 20 bp, Artificial Sequence
  Description of Artificial Sequence: Synthetic oligonucleotide
  Target: ATXN1; (-) strand; PAM type: YTN; PAM sequence: CTA
ctaatagtagttcagtcctc

SEQ ID NO: 185074 - DNA, 20 bp, Artificial Sequence
  Description of Artificial Sequence: Synthetic oligonucleotide
  Target: ATXN1; (-) strand; PAM type: YTN; PAM sequence: CTG
aaatgctactaatagtagtt

SEQ ID NO: 185075 - DNA, 20 bp, Artificial Sequence
  Description of Artificial Sequence: Synthetic oligonucleotide
  Target: ATXN1; (-) strand; PAM type: YTN; PAM sequence: CTG
aggcctgaaatgctactaat

SEQ ID NO: 185076 - DNA, 20 bp, Artificial Sequence
  Description of Artificial Sequence: Synthetic oligonucleotide
  Target: ATXN1; (-) strand; PAM type: YTN; PAM sequence: TTC
ctgaggcctgaaatgctact

SEQ ID NO: 185077 - DNA, 20 bp, Artificial Sequence
  Description of Artificial Sequence: Synthetic oligonucleotide
  Target: ATXN1; (-) strand; PAM type: YTN; PAM sequence: TTT
cctgaggcctgaaatgctac

SEQ ID NO: 185078 - DNA, 20 bp, Artificial Sequence
  Description of Artificial Sequence: Synthetic oligonucleotide
  Target: ATXN1; (-) strand; PAM type: YTN; PAM sequence: CTT
tcctgaggcctgaaatgcta

SEQ ID NO: 185079 - DNA, 20 bp, Artificial Sequence
  Description of Artificial Sequence: Synthetic oligonucleotide
  Target: ATXN1; (-) strand; PAM type: YTN; PAM sequence: CTC
tttcctgaggcctgaaatgc

SEQ ID NO: 185080 - DNA, 20 bp, Artificial Sequence
  Description of Artificial Sequence: Synthetic oligonucleotide
  Target: ATXN1; (-) strand; PAM type: YTN; PAM sequence: CTG
acctctttcctgaggcctga

SEQ ID NO: 185081 - DNA, 20 bp, Artificial Sequence
  Description of Artificial Sequence: Synthetic oligonucleotide
  Target: ATXN1; (-) strand; PAM type: YTN; PAM sequence: CTG
ctgacctctttcctgaggcc

SEQ ID NO: 185082 - DNA, 20 bp, Artificial Sequence
  Description of Artificial Sequence: Synthetic oligonucleotide
  Target: ATXN1; (-) strand; PAM type: YTN; PAM sequence: TTC
tgctgacctctttcctgagg

SEQ ID NO: 185083 - DNA, 20 bp, Artificial Sequence
  Description of Artificial Sequence: Synthetic oligonucleotide
  Target: ATXN1; (-) strand; PAM type: YTN; PAM sequence: TTT
ctgctgacctctttcctgag

SEQ ID NO: 185084 - DNA, 20 bp, Artificial Sequence
  Description of Artificial Sequence: Synthetic oligonucleotide
  Target: ATXN1; (-) strand; PAM type: YTN; PAM sequence: CTT
tctgctgacctctttcctga

SEQ ID NO: 185085 - DNA, 20 bp, Artificial Sequence
  Description of Artificial Sequence: Synthetic oligonucleotide
  Target: ATXN1; (-) strand; PAM type: YTN; PAM sequence: TTG
aagcatcctttctgctgacc

SEQ ID NO: 185086 - DNA, 20 bp, Artificial Sequence
  Description of Artificial Sequence: Synthetic oligonucleotide
  Target: ATXN1; (-) strand; PAM type: YTN; PAM sequence: TTT
gaagcatcctttctgctgac

SEQ ID NO: 185087 - DNA, 20 bp, Artificial Sequence
  Description of Artificial Sequence: Synthetic oligonucleotide
  Target: ATXN1; (-) strand; PAM type: YTN; PAM sequence: TTA
tttgaagcatcctttctgct

SEQ ID NO: 185088 - DNA, 20 bp, Artificial Sequence
  Description of Artificial Sequence: Synthetic oligonucleotide
  Target: ATXN1; (-) strand; PAM type: YTN; PAM sequence: CTA
gtagtgttatttgaagcatc

SEQ ID NO: 185089 - DNA, 20 bp, Artificial Sequence
  Description of Artificial Sequence: Synthetic oligonucleotide
  Target: ATXN1; (-) strand; PAM type: YTN; PAM sequence: CTG
cctagtagtgttatttgaag

SEQ ID NO: 185090 - DNA, 20 bp, Artificial Sequence
  Description of Artificial Sequence: Synthetic oligonucleotide
  Target: ATXN1; (-) strand; PAM type: YTN; PAM sequence: TTC
tgcctagtagtgttatttga

SEQ ID NO: 185091 - DNA, 20 bp, Artificial Sequence
  Description of Artificial Sequence: Synthetic oligonucleotide
  Target: ATXN1; (-) strand; PAM type: YTN; PAM sequence: TTT
ctgcctagtagtgttatttg

SEQ ID NO: 185092 - DNA, 20 bp, Artificial Sequence
  Description of Artificial Sequence: Synthetic oligonucleotide
  Target: ATXN1; (-) strand; PAM type: YTN; PAM sequence: CTT
tctgcctagtagtgttattt

SEQ ID NO: 185093 - DNA, 20 bp, Artificial Sequence
  Description of Artificial Sequence: Synthetic oligonucleotide
  Target: ATXN1; (-) strand; PAM type: YTN; PAM sequence: CTG
taggtagactttctgcctag

SEQ ID NO: 185094 - DNA, 20 bp, Artificial Sequence
  Description of Artificial Sequence: Synthetic oligonucleotide
  Target: ATXN1; (-) strand; PAM type: YTN; PAM sequence: TTC
atgatagaactgtaggtaga

SEQ ID NO: 185095 - DNA, 20 bp, Artificial Sequence
  Description of Artificial Sequence: Synthetic oligonucleotide
  Target: ATXN1; (-) strand; PAM type: YTN; PAM sequence: TTT
catgatagaactgtaggtag

SEQ ID NO: 185096 - DNA, 20 bp, Artificial Sequence
  Description of Artificial Sequence: Synthetic oligonucleotide
  Target: ATXN1; (-) strand; PAM type: YTN; PAM sequence: TTT
tcatgatagaactgtaggta

SEQ ID NO: 185097 - DNA, 20 bp, Artificial Sequence
  Description of Artificial Sequence: Synthetic oligonucleotide
  Target: ATXN1; (-) strand; PAM type: YTN; PAM sequence: TTT
ttcatgatagaactgtaggt

SEQ ID NO: 185098 - DNA, 20 bp, Artificial Sequence
  Description of Artificial Sequence: Synthetic oligonucleotide
  Target: ATXN1; (-) strand; PAM type: YTN; PAM sequence: TTT
tttcatgatagaactgtagg

SEQ ID NO: 185099 - DNA, 20 bp, Artificial Sequence
  Description of Artificial Sequence: Synthetic oligonucleotide
  Target: ATXN1; (-) strand; PAM type: YTN; PAM sequence: CTT
ttttcatgatagaactgtag

SEQ ID NO: 185100 - DNA, 20 bp, Artificial Sequence
  Description of Artificial Sequence: Synthetic oligonucleotide
  Target: ATXN1; (-) strand; PAM type: YTN; PAM sequence: TTG
aaccttttttcatgatagaa

SEQ ID NO: 185101 - DNA, 20 bp, Artificial Sequence
  Description of Artificial Sequence: Synthetic oligonucleotide
  Target: ATXN1; (-) strand; PAM type: YTN; PAM sequence: TTT
gaaccttttttcatgataga

SEQ ID NO: 185102 - DNA, 20 bp, Artificial Sequence
  Description of Artificial Sequence: Synthetic oligonucleotide
  Target: ATXN1; (-) strand; PAM type: YTN; PAM sequence: CTT
tgaaccttttttcatgatag

SEQ ID NO: 185103 - DNA, 20 bp, Artificial Sequence
  Description of Artificial Sequence: Synthetic oligonucleotide
  Target: ATXN1; (-) strand; PAM type: YTN; PAM sequence: CTA
cccactttgaaccttttttc

SEQ ID NO: 185104 - DNA, 20 bp, Artificial Sequence
  Description of Artificial Sequence: Synthetic oligonucleotide
  Target: ATXN1; (-) strand; PAM type: YTN; PAM sequence: TTG
catctacccactttgaacct

SEQ ID NO: 185105 - DNA, 20 bp, Artificial Sequence
  Description of Artificial Sequence: Synthetic oligonucleotide
  Target: ATXN1; (-) strand; PAM type: YTN; PAM sequence: CTT
gcatctacccactttgaacc

SEQ ID NO: 185106 - DNA, 20 bp, Artificial Sequence
  Description of Artificial Sequence: Synthetic oligonucleotide
  Target: ATXN1; (-) strand; PAM type: YTN; PAM sequence: TTG
aagaagccttgcatctaccc

SEQ ID NO: 185107 - DNA, 20 bp, Artificial Sequence
  Description of Artificial Sequence: Synthetic oligonucleotide
  Target: ATXN1; (-) strand; PAM type: YTN; PAM sequence: TTT
gaagaagccttgcatctacc

SEQ ID NO: 185108 - DNA, 20 bp, Artificial Sequence
  Description of Artificial Sequence: Synthetic oligonucleotide
  Target: ATXN1; (-) strand; PAM type: YTN; PAM sequence: TTA
gatacaagtgtttgaagaag

SEQ ID NO: 185109 - DNA, 20 bp, Artificial Sequence
  Description of Artificial Sequence: Synthetic oligonucleotide
  Target: ATXN1; (-) strand; PAM type: YTN; PAM sequence: TTA
ttagatacaagtgtttgaag

SEQ ID NO: 185110 - DNA, 20 bp, Artificial Sequence
  Description of Artificial Sequence: Synthetic oligonucleotide
  Target: ATXN1; (-) strand; PAM type: YTN; PAM sequence: TTT
attagatacaagtgtttgaa

SEQ ID NO: 185111 - DNA, 20 bp, Artificial Sequence
  Description of Artificial Sequence: Synthetic oligonucleotide
  Target: ATXN1; (-) strand; PAM type: YTN; PAM sequence: CTT
tattagatacaagtgtttga

SEQ ID NO: 185112 - DNA, 20 bp, Artificial Sequence
  Description of Artificial Sequence: Synthetic oligonucleotide
  Target: ATXN1; (-) strand; PAM type: YTN; PAM sequence: TTC
acgtctttattagatacaag

SEQ ID NO: 185113 - DNA, 20 bp, Artificial Sequence
  Description of Artificial Sequence: Synthetic oligonucleotide
  Target: ATXN1; (-) strand; PAM type: YTN; PAM sequence: TTT
cacgtctttattagatacaa

SEQ ID NO: 185114 - DNA, 20 bp, Artificial Sequence
  Description of Artificial Sequence: Synthetic oligonucleotide
  Target: ATXN1; (-) strand; PAM type: YTN; PAM sequence: CTT
tcacgtctttattagataca

SEQ ID NO: 185115 - DNA, 20 bp, Artificial Sequence
  Description of Artificial Sequence: Synthetic oligonucleotide
  Target: ATXN1; (-) strand; PAM type: YTN; PAM sequence: CTC
tttcacgtctttattagata

SEQ ID NO: 185116 - DNA, 20 bp, Artificial Sequence
  Description of Artificial Sequence: Synthetic oligonucleotide
  Target: ATXN1; (-) strand; PAM type: YTN; PAM sequence: CTC
tctttcacgtctttattaga

SEQ ID NO: 185117 - DNA, 20 bp, Artificial Sequence
  Description of Artificial Sequence: Synthetic oligonucleotide
  Target: ATXN1; (-) strand; PAM type: YTN; PAM sequence: TTC
accaactctctttcacgtct

SEQ ID NO: 185118 - DNA, 20 bp, Artificial Sequence
  Description of Artificial Sequence: Synthetic oligonucleotide
  Target: ATXN1; (-) strand; PAM type: YTN; PAM sequence: CTT
caccaactctctttcacgtc

SEQ ID NO: 185119 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcacc

SEQ ID NO: 185120 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 185121 - DNA, 20 bp, Artificial Sequence
  Description of Artificial Sequence: Synthetic oligonucleotide
  Target: ATXN1; (-) strand; PAM type: YTN; PAM sequence: CTC
ccaaagcactgggattacag

SEQ ID NO: 185122 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagcactggga

SEQ ID NO: 185123 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagcact

SEQ ID NO: 185124 - DNA, 20 bp, Artificial Sequence
  Description of Artificial Sequence: Synthetic oligonucleotide
  Target: ATXN1; (-) strand; PAM type: YTN; PAM sequence: CTG
cctgcctcggcctcccaaag

SEQ ID NO: 185125 - DNA, 20 bp, Artificial Sequence
  Description of Artificial Sequence: Synthetic oligonucleotide
  Target: ATXN1; (-) strand; PAM type: YTN; PAM sequence: CTC
aggtgatctgcctgcctcgg

SEQ ID NO: 185126 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatctgcctgc

SEQ ID NO: 185127 - DNA, 20 bp, Artificial Sequence
  Description of Artificial Sequence: Synthetic oligonucleotide
  Target: ATXN1; (-) strand; PAM type: YTN; PAM sequence: TTC
ctgacctcaggtgatctgcc

SEQ ID NO: 185128 - DNA, 20 bp, Artificial Sequence
  Description of Artificial Sequence: Synthetic oligonucleotide
  Target: ATXN1; (-) strand; PAM type: YTN; PAM sequence: CTC
aaattcctgacctcaggtga

SEQ ID NO: 185129 - DNA, 20 bp, Artificial Sequence
  Description of Artificial Sequence: Synthetic oligonucleotide
  Target: ATXN1; (-) strand; PAM type: YTN; PAM sequence: CTG
gtctcaaattcctgacctca

SEQ ID NO: 185130 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctcaaattc

SEQ ID NO: 185131 - DNA, 20 bp, Artificial Sequence
  Description of Artificial Sequence: Synthetic oligonucleotide
  Target: ATXN1; (-) strand; PAM type: YTN; PAM sequence: TTG
ccatgttggtcaggctggtc

SEQ ID NO: 185132 - DNA, 20 bp, Artificial Sequence
  Description of Artificial Sequence: Synthetic oligonucleotide
  Target: ATXN1; (-) strand; PAM type: YTN; PAM sequence: TTT
gccatgttggtcaggctggt

SEQ ID NO: 185133 - DNA, 20 bp, Artificial Sequence
  Description of Artificial Sequence: Synthetic oligonucleotide
  Target: ATXN1; (-) strand; PAM type: YTN; PAM sequence: TTT
tgccatgttggtcaggctgg

SEQ ID NO: 185134 - DNA, 20 bp, Artificial Sequence
  Description of Artificial Sequence: Synthetic oligonucleotide
  Target: ATXN1; (-) strand; PAM type: YTN; PAM sequence: TTA
gtagggtcagggttttgcca

SEQ ID NO: 185135 - DNA, 20 bp, Artificial Sequence
  Description of Artificial Sequence: Synthetic oligonucleotide
  Target: ATXN1; (-) strand; PAM type: YTN; PAM sequence: TTT
agtagggtcagggttttgcc

SEQ ID NO: 185136 - DNA, 20 bp, Artificial Sequence
  Description of Artificial Sequence: Synthetic oligonucleotide
  Target: ATXN1; (-) strand; PAM type: YTN; PAM sequence: TTT
tagtagggtcagggttttgc

SEQ ID NO: 185137 - DNA, 20 bp, Artificial Sequence
  Description of Artificial Sequence: Synthetic oligonucleotide
  Target: ATXN1; (-) strand; PAM type: YTN; PAM sequence: TTT
ttagtagggtcagggttttg

SEQ ID NO: 185138 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagggtcaggg

SEQ ID NO: 185139 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagggtcagg

SEQ ID NO: 185140 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagggtcag

SEQ ID NO: 185141 - DNA, 20 bp, Artificial Sequence
  Description of Artificial Sequence: Synthetic oligonucleotide
  Target: ATXN1; (-) strand; PAM type: YTN; PAM sequence: CTA
attttgtatttttagtaggg

SEQ ID NO: 185142 - DNA, 20 bp, Artificial Sequence
  Description of Artificial Sequence: Synthetic oligonucleotide
  Target: ATXN1; (-) strand; PAM type: YTN; PAM sequence: TTA
caggtgcccgccaccacacc

SEQ ID NO: 185143 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcccgccac

SEQ ID NO: 185144 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 185145 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 185146 - DNA, 20 bp, Artificial Sequence
  Description of Artificial Sequence: Synthetic oligonucleotide
  Target: ATXN1; (-) strand; PAM type: YTN; PAM sequence: TTG
cctcagcctcccaagtagct

SEQ ID NO: 185147 - DNA, 20 bp, Artificial Sequence
  Description of Artificial Sequence: Synthetic oligonucleotide
  Target: ATXN1; (-) strand; PAM type: YTN; PAM sequence: CTG
ttgcctcagcctcccaagta

SEQ ID NO: 185148 - DNA, 20 bp, Artificial Sequence
  Description of Artificial Sequence: Synthetic oligonucleotide
  Target: ATXN1; (-) strand; PAM type: YTN; PAM sequence: TTC
tgttgcctcagcctcccaag

SEQ ID NO: 185149 - DNA, 20 bp, Artificial Sequence
  Description of Artificial Sequence: Synthetic oligonucleotide
  Target: ATXN1; (-) strand; PAM type: YTN; PAM sequence: TTC
aagcaattctgttgcctcag

SEQ ID NO: 185150 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaattctgt

SEQ ID NO: 185151 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagcaatt

SEQ ID NO: 185152 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagcaa

SEQ ID NO: 185153 - DNA, 20 bp, Artificial Sequence
  Description of Artificial Sequence: Synthetic oligonucleotide
  Target: ATXN1; (-) strand; PAM type: YTN; PAM sequence: CTC
aaaacctctgcctcccaggt

SEQ ID NO: 185154 - DNA, 20 bp, Artificial Sequence
  Description of Artificial Sequence: Synthetic oligonucleotide
  Target: ATXN1; (-) strand; PAM type: YTN; PAM sequence: CTC
ggctcaaaacctctgcctcc

SEQ ID NO: 185155 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctc

SEQ ID NO: 185156 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 185157 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtgcag

SEQ ID NO: 185158 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggagtgca

SEQ ID NO: 185159 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctggagtg

SEQ ID NO: 185160 - DNA, 20 bp, Artificial Sequence
  Description of Artificial Sequence: Synthetic oligonucleotide
  Target: ATXN1; (-) strand; PAM type: YTN; PAM sequence: TTG
ctcttgttgcccaggctgga

SEQ ID NO: 185161 - DNA, 20 bp, Artificial Sequence
  Description of Artificial Sequence: Synthetic oligonucleotide
  Target: ATXN1; (-) strand; PAM type: YTN; PAM sequence: TTT
gctcttgttgcccaggctgg

SEQ ID NO: 185162 - DNA, 20 bp, Artificial Sequence
  Description of Artificial Sequence: Synthetic oligonucleotide
  Target: ATXN1; (-) strand; PAM type: YTN; PAM sequence: TTT
tgctcttgttgcccaggctg

SEQ ID NO: 185163 - DNA, 20 bp, Artificial Sequence
  Description of Artificial Sequence: Synthetic oligonucleotide
  Target: ATXN1; (-) strand; PAM type: YTN; PAM sequence: TTG
agacagagttttgctcttgt

SEQ ID NO: 185164 - DNA, 20 bp, Artificial Sequence
  Description of Artificial Sequence: Synthetic oligonucleotide
  Target: ATXN1; (-) strand; PAM type: YTN; PAM sequence: TTT
gagacagagttttgctcttg

SEQ ID NO: 185165 - DNA, 20 bp, Artificial Sequence
  Description of Artificial Sequence: Synthetic oligonucleotide
  Target: ATXN1; (-) strand; PAM type: YTN; PAM sequence: TTT
tgagacagagttttgctctt

SEQ ID NO: 185166 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagttttgctct

SEQ ID NO: 185167 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagttttgctc

SEQ ID NO: 185168 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagttttgct

SEQ ID NO: 185169 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagttttgc

SEQ ID NO: 185170 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagttttg

SEQ ID NO: 185171 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtttt

SEQ ID NO: 185172 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagttt

SEQ ID NO: 185173 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtt

SEQ ID NO: 185174 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 185175 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 185176 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttgagacaga

SEQ ID NO: 185177 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttgagaca

SEQ ID NO: 185178 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttgagac

SEQ ID NO: 185179 - DNA, 20 bp, Artificial Sequence
  Description of Artificial Sequence: Synthetic oligonucleotide
  Target: ATXN1; (-) strand; PAM type: YTN; PAM sequence: TTT
tcttttttttttttttgaga

SEQ ID NO: 185180 - DNA, 20 bp, Artificial Sequence
  Description of Artificial Sequence: Synthetic oligonucleotide
  Target: ATXN1; (-) strand; PAM type: YTN; PAM sequence: TTT
ttcttttttttttttttgag

SEQ ID NO: 185181 - DNA, 20 bp, Artificial Sequence
  Description of Artificial Sequence: Synthetic oligonucleotide
  Target: ATXN1; (-) strand; PAM type: YTN; PAM sequence: CTT
tttcttttttttttttttga

SEQ ID NO: 185182 - DNA, 20 bp, Artificial Sequence
  Description of Artificial Sequence: Synthetic oligonucleotide
  Target: ATXN1; (-) strand; PAM type: YTN; PAM sequence: CTC
tttttctttttttttttttt

SEQ ID NO: 185183 - DNA, 20 bp, Artificial Sequence
  Description of Artificial Sequence: Synthetic oligonucleotide
  Target: ATXN1; (-) strand; PAM type: YTN; PAM sequence: CTC
tctttttctttttttttttt

SEQ ID NO: 185184 - DNA, 20 bp, Artificial Sequence
  Description of Artificial Sequence: Synthetic oligonucleotide
  Target: ATXN1; (-) strand; PAM type: YTN; PAM sequence: CTC
tctctttttctttttttttt

SEQ ID NO: 185185 - DNA, 20 bp, Artificial Sequence
  Description of Artificial Sequence: Synthetic oligonucleotide
  Target: ATXN1; (-) strand; PAM type: YTN; PAM sequence: TTC
atcaactctctctttttctt

SEQ ID NO: 185186 - DNA, 20 bp, Artificial Sequence
  Description of Artificial Sequence: Synthetic oligonucleotide
  Target: ATXN1; (-) strand; PAM type: YTN; PAM sequence: TTG
aaaccattcatcaactctct

SEQ ID NO: 185187 - DNA, 20 bp, Artificial Sequence
  Description of Artificial Sequence: Synthetic oligonucleotide
  Target: ATXN1; (-) strand; PAM type: YTN; PAM sequence: TTT
gaaaccattcatcaactctc

SEQ ID NO: 185188 - DNA, 20 bp, Artificial Sequence
  Description of Artificial Sequence: Synthetic oligonucleotide
  Target: ATXN1; (-) strand; PAM type: YTN; PAM sequence: CTT
tgaaaccattcatcaactct

SEQ ID NO: 185189 - DNA, 20 bp, Artificial Sequence
  Description of Artificial Sequence: Synthetic oligonucleotide
  Target: ATXN1; (-) strand; PAM type: YTN; PAM sequence: CTC
tttgaaaccattcatcaact

SEQ ID NO: 185190 - DNA, 20 bp, Artificial Sequence
  Description of Artificial Sequence: Synthetic oligonucleotide
  Target: ATXN1; (-) strand; PAM type: YTN; PAM sequence: TTG
aaactctttgaaaccattca

SEQ ID NO: 185191 - DNA, 20 bp, Artificial Sequence
  Description of Artificial Sequence: Synthetic oligonucleotide
  Target: ATXN1; (-) strand; PAM type: YTN; PAM sequence: TTT
gaaactctttgaaaccattc

SEQ ID NO: 185192 - DNA, 20 bp, Artificial Sequence
  Description of Artificial Sequence: Synthetic oligonucleotide
  Target: ATXN1; (-) strand; PAM type: YTN; PAM sequence: CTT
tgaaactctttgaaaccatt

SEQ ID NO: 185193 - DNA, 20 bp, Artificial Sequence
  Description of Artificial Sequence: Synthetic oligonucleotide
  Target: ATXN1; (-) strand; PAM type: YTN; PAM sequence: CTC
tttgaaactctttgaaacca

SEQ ID NO: 185194 - DNA, 20 bp, Artificial Sequence
  Description of Artificial Sequence: Synthetic oligonucleotide
  Target: ATXN1; (-) strand; PAM type: YTN; PAM sequence: CTA
tggatatgagtgtgcaaata

SEQ ID NO: 185195 - DNA, 20 bp, Artificial Sequence
  Description of Artificial Sequence: Synthetic oligonucleotide
  Target: ATXN1; (-) strand; PAM type: YTN; PAM sequence: CTG
ctatggatatgagtgtgcaa

SEQ ID NO: 185196 - DNA, 20 bp, Artificial Sequence
  Description of Artificial Sequence: Synthetic oligonucleotide
  Target: ATXN1; (-) strand; PAM type: YTN; PAM sequence: TTA
ataatgctgctatggatatg

SEQ ID NO: 185197 - DNA, 20 bp, Artificial Sequence
  Description of Artificial Sequence: Synthetic oligonucleotide
  Target: ATXN1; (-) strand; PAM type: YTN; PAM sequence: TTG
ttaataatgctgctatggat

SEQ ID NO: 185198 - DNA, 20 bp, Artificial Sequence
  Description of Artificial Sequence: Synthetic oligonucleotide
  Target: ATXN1; (-) strand; PAM type: YTN; PAM sequence: TTA
ttgttaataatgctgctatg

SEQ ID NO: 185199 - DNA, 20 bp, Artificial Sequence
  Description of Artificial Sequence: Synthetic oligonucleotide
  Target: ATXN1; (-) strand; PAM type: YTN; PAM sequence: TTT
attgttaataatgctgctat

SEQ ID NO: 185200 - DNA, 20 bp, Artificial Sequence
  Description of Artificial Sequence: Synthetic oligonucleotide
  Target: ATXN1; (-) strand; PAM type: YTN; PAM sequence: TTA
gtttattgttaataatgctg

SEQ ID NO: 185201 - DNA, 20 bp, Artificial Sequence
  Description of Artificial Sequence: Synthetic oligonucleotide
  Target: ATXN1; (-) strand; PAM type: YTN; PAM sequence: TTT
agtttattgttaataatgct

SEQ ID NO: 185202 - DNA, 20 bp, Artificial Sequence
  Description of Artificial Sequence: Synthetic oligonucleotide
  Target: ATXN1; (-) strand; PAM type: YTN; PAM sequence: CTT
tagtttattgttaataatgc

SEQ ID NO: 185203 - DNA, 20 bp, Artificial Sequence
  Description of Artificial Sequence: Synthetic oligonucleotide
  Target: ATXN1; (-) strand; PAM type: YTN; PAM sequence: TTC
cacctttagtttattgttaa

SEQ ID NO: 185204 - DNA, 20 bp, Artificial Sequence
  Description of Artificial Sequence: Synthetic oligonucleotide
  Target: ATXN1; (-) strand; PAM type: YTN; PAM sequence: CTT
ccacctttagtttattgtta

SEQ ID NO: 185205 - DNA, 20 bp, Artificial Sequence
  Description of Artificial Sequence: Synthetic oligonucleotide
  Target: ATXN1; (-) strand; PAM type: YTN; PAM sequence: TTG
cttccacctttagtttattg

SEQ ID NO: 185206 - DNA, 20 bp, Artificial Sequence
  Description of Artificial Sequence: Synthetic oligonucleotide
  Target: ATXN1; (-) strand; PAM type: YTN; PAM sequence: TTG
ggttgcttccacctttagtt

SEQ ID NO: 185207 - DNA, 20 bp, Artificial Sequence
  Description of Artificial Sequence: Synthetic oligonucleotide
  Target: ATXN1; (-) strand; PAM type: YTN; PAM sequence: CTT
gggttgcttccacctttagt

SEQ ID NO: 185208 - DNA, 20 bp, Artificial Sequence
  Description of Artificial Sequence: Synthetic oligonucleotide
  Target: ATXN1; (-) strand; PAM type: YTN; PAM sequence: CTA
tcagtgggcacttgggttgc

SEQ ID NO: 185209 - DNA, 20 bp, Artificial Sequence
  Description of Artificial Sequence: Synthetic oligonucleotide
  Target: ATXN1; (-) strand; PAM type: YTN; PAM sequence: TTC
atctatcagtgggcacttgg

SEQ ID NO: 185210 - DNA, 20 bp, Artificial Sequence
  Description of Artificial Sequence: Synthetic oligonucleotide
  Target: ATXN1; (-) strand; PAM type: YTN; PAM sequence: CTT
catctatcagtgggcacttg

SEQ ID NO: 185211 - DNA, 20 bp, Artificial Sequence
  Description of Artificial Sequence: Synthetic oligonucleotide
  Target: ATXN1; (-) strand; PAM type: YTN; PAM sequence: TTA
tccttcatctatcagtgggc

SEQ ID NO: 185212 - DNA, 20 bp, Artificial Sequence
  Description of Artificial Sequence: Synthetic oligonucleotide
  Target: ATXN1; (-) strand; PAM type: YTN; PAM sequence: CTT
atccttcatctatcagtggg

SEQ ID NO: 185213 - DNA, 20 bp, Artificial Sequence
  Description of Artificial Sequence: Synthetic oligonucleotide
  Target: ATXN1; (-) strand; PAM type: YTN; PAM sequence: TTA
gcttatccttcatctatcag

SEQ ID NO: 185214 - DNA, 20 bp, Artificial Sequence
  Description of Artificial Sequence: Synthetic oligonucleotide
  Target: ATXN1; (-) strand; PAM type: YTN; PAM sequence: TTT
agcttatccttcatctatca

SEQ ID NO: 185215 - DNA, 20 bp, Artificial Sequence
  Description of Artificial Sequence: Synthetic oligonucleotide
  Target: ATXN1; (-) strand; PAM type: YTN; PAM sequence: TTG
tatgtgtagaccacatttag

SEQ ID NO: 185216 - DNA, 20 bp, Artificial Sequence
  Description of Artificial Sequence: Synthetic oligonucleotide
  Target: ATXN1; (-) strand; PAM type: YTN; PAM sequence: CTG
ttgtatgtgtagaccacatt

SEQ ID NO: 185217 - DNA, 20 bp, Artificial Sequence
  Description of Artificial Sequence: Synthetic oligonucleotide
  Target: ATXN1; (-) strand; PAM type: YTN; PAM sequence: TTC
tgttgtatgtgtagaccaca

SEQ ID NO: 185218 - DNA, 20 bp, Artificial Sequence
  Description of Artificial Sequence: Synthetic oligonucleotide
  Target: ATXN1; (-) strand; PAM type: YTN; PAM sequence: CTG
aataatattctgttgtatgt

SEQ ID NO: 185219 - DNA, 20 bp, Artificial Sequence
  Description of Artificial Sequence: Synthetic oligonucleotide
  Target: ATXN1; (-) strand; PAM type: YTN; PAM sequence: TTA
gactgaataatattctgttg

SEQ ID NO: 185220 - DNA, 20 bp, Artificial Sequence
  Description of Artificial Sequence: Synthetic oligonucleotide
  Target: ATXN1; (-) strand; PAM type: YTN; PAM sequence: TTT
agactgaataatattctgtt

SEQ ID NO: 185221 - DNA, 20 bp, Artificial Sequence
  Description of Artificial Sequence: Synthetic oligonucleotide
  Target: ATXN1; (-) strand; PAM type: YTN; PAM sequence: TTT
tagactgaataatattctgt

SEQ ID NO: 185222 - DNA, 20 bp, Artificial Sequence
  Description of Artificial Sequence: Synthetic oligonucleotide
  Target: ATXN1; (-) strand; PAM type: YTN; PAM sequence: TTT
ttagactgaataatattctg

SEQ ID NO: 185223 - DNA, 20 bp, Artificial Sequence
  Description of Artificial Sequence: Synthetic oligonucleotide
  Target: ATXN1; (-) strand; PAM type: YTN; PAM sequence: CTT
tttagactgaataatattct

SEQ ID NO: 185224 - DNA, 20 bp, Artificial Sequence
  Description of Artificial Sequence: Synthetic oligonucleotide
  Target: ATXN1; (-) strand; PAM type: YTN; PAM sequence: TTC
ctttttagactgaataatat

SEQ ID NO: 185225 - DNA, 20 bp, Artificial Sequence
  Description of Artificial Sequence: Synthetic oligonucleotide
  Target: ATXN1; (-) strand; PAM type: YTN; PAM sequence: CTT
cctttttagactgaataata

SEQ ID NO: 185226 - DNA, 20 bp, Artificial Sequence
  Description of Artificial Sequence: Synthetic oligonucleotide
  Target: ATXN1; (-) strand; PAM type: YTN; PAM sequence: TTC
cttcctttttagactgaata

SEQ ID NO: 185227 - DNA, 20 bp, Artificial Sequence
  Description of Artificial Sequence: Synthetic oligonucleotide
  Target: ATXN1; (-) strand; PAM type: YTN; PAM sequence: TTT
ccttcctttttagactgaat

SEQ ID NO: 185228 - DNA, 20 bp, Artificial Sequence
  Description of Artificial Sequence: Synthetic oligonucleotide
  Target: ATXN1; (-) strand; PAM type: YTN; PAM sequence: CTA
tagcatgtcagaatttcctt

SEQ ID NO: 185229 - DNA, 20 bp, Artificial Sequence
  Description of Artificial Sequence: Synthetic oligonucleotide
  Target: ATXN1; (-) strand; PAM type: YTN; PAM sequence: CTG
tgctatagcatgtcagaatt

SEQ ID NO: 185230 - DNA, 20 bp, Artificial Sequence
  Description of Artificial Sequence: Synthetic oligonucleotide
  Target: ATXN1; (-) strand; PAM type: YTN; PAM sequence: CTG
tctgtgctatagcatgtcag

SEQ ID NO: 185231 - DNA, 20 bp, Artificial Sequence
  Description of Artificial Sequence: Synthetic oligonucleotide
  Target: ATXN1; (-) strand; PAM type: YTN; PAM sequence: TTC
aggtctgtctgtgctatagc

SEQ ID NO: 185232 - DNA, 20 bp, Artificial Sequence
  Description of Artificial Sequence: Synthetic oligonucleotide
  Target: ATXN1; (-) strand; PAM type: YTN; PAM sequence: CTT
caggtctgtctgtgctatag

SEQ ID NO: 185233 - DNA, 20 bp, Artificial Sequence
  Description of Artificial Sequence: Synthetic oligonucleotide
  Target: ATXN1; (-) strand; PAM type: YTN; PAM sequence: CTG
agcataatgtccttcaggtc

SEQ ID NO: 185234 - DNA, 20 bp, Artificial Sequence
  Description of Artificial Sequence: Synthetic oligonucleotide
  Target: ATXN1; (-) strand; PAM type: YTN; PAM sequence: TTC
actgagcataatgtccttca

SEQ ID NO: 185235 - DNA, 20 bp, Artificial Sequence
  Description of Artificial Sequence: Synthetic oligonucleotide
  Target: ATXN1; (-) strand; PAM type: YTN; PAM sequence: TTT
cactgagcataatgtccttc

SEQ ID NO: 185236 - DNA, 20 bp, Artificial Sequence
  Description of Artificial Sequence: Synthetic oligonucleotide
  Target: ATXN1; (-) strand; PAM type: YTN; PAM sequence: CTC
atttcactgagcataatgtc

SEQ ID NO: 185237 - DNA, 20 bp, Artificial Sequence
  Description of Artificial Sequence: Synthetic oligonucleotide
  Target: ATXN1; (-) strand; PAM type: YTN; PAM sequence: CTG
gctcatttcactgagcataa

SEQ ID NO: 185238 - DNA, 20 bp, Artificial Sequence
  Description of Artificial Sequence: Synthetic oligonucleotide
  Target: ATXN1; (-) strand; PAM type: YTN; PAM sequence: TTG
tgcctggctcatttcactga

SEQ ID NO: 185239 - DNA, 20 bp, Artificial Sequence
  Description of Artificial Sequence: Synthetic oligonucleotide
  Target: ATXN1; (-) strand; PAM type: YTN; PAM sequence: TTT
gtgcctggctcatttcactg

SEQ ID NO: 185240 - DNA, 20 bp, Artificial Sequence
  Description of Artificial Sequence: Synthetic oligonucleotide
  Target: ATXN1; (-) strand; PAM type: YTN; PAM sequence: TTT
tgtgcctggctcatttcact

SEQ ID NO: 185241 - DNA, 20 bp, Artificial Sequence
  Description of Artificial Sequence: Synthetic oligonucleotide
  Target: ATXN1; (-) strand; PAM type: YTN; PAM sequence: CTT
ttgtgcctggctcatttcac

SEQ ID NO: 185242 - DNA, 20 bp, Artificial Sequence
  Description of Artificial Sequence: Synthetic oligonucleotide
  Target: ATXN1; (-) strand; PAM type: YTN; PAM sequence: TTG
tccttttgtgcctggctcat

SEQ ID NO: 185243 - DNA, 20 bp, Artificial Sequence
  Description of Artificial Sequence: Synthetic oligonucleotide
  Target: ATXN1; (-) strand; PAM type: YTN; PAM sequence: TTT
gtccttttgtgcctggctca

SEQ ID NO: 185244 - DNA, 20 bp, Artificial Sequence
  Description of Artificial Sequence: Synthetic oligonucleotide
  Target: ATXN1; (-) strand; PAM type: YTN; PAM sequence: CTC
atataagtggaatcatgtag

SEQ ID NO: 185245 - DNA, 20 bp, Artificial Sequence
  Description of Artificial Sequence: Synthetic oligonucleotide
  Target: ATXN1; (-) strand; PAM type: YTN; PAM sequence: CTG
taagtggctcatataagtgg

SEQ ID NO: 185246 - DNA, 20 bp, Artificial Sequence
  Description of Artificial Sequence: Synthetic oligonucleotide
  Target: ATXN1; (-) strand; PAM type: YTN; PAM sequence: CTA
ctgtaagtggctcatataag

SEQ ID NO: 185247 - DNA, 20 bp, Artificial Sequence
  Description of Artificial Sequence: Synthetic oligonucleotide
  Target: ATXN1; (-) strand; PAM type: YTN; PAM sequence: TTG
actactgtaagtggctcata

SEQ ID NO: 185248 - DNA, 20 bp, Artificial Sequence
  Description of Artificial Sequence: Synthetic oligonucleotide
  Target: ATXN1; (-) strand; PAM type: YTN; PAM sequence: TTT
gactactgtaagtggctcat

SEQ ID NO: 185249 - DNA, 20 bp, Artificial Sequence
  Description of Artificial Sequence: Synthetic oligonucleotide
  Target: ATXN1; (-) strand; PAM type: YTN; PAM sequence: TTT
tgactactgtaagtggctca

SEQ ID NO: 185250 - DNA, 20 bp, Artificial Sequence
  Description of Artificial Sequence: Synthetic oligonucleotide
  Target: ATXN1; (-) strand; PAM type: YTN; PAM sequence: TTA
ttttgactactgtaagtggc

SEQ ID NO: 185251 - DNA, 20 bp, Artificial Sequence
  Description of Artificial Sequence: Synthetic oligonucleotide
  Target: ATXN1; (-) strand; PAM type: YTN; PAM sequence: CTA
ttattttgactactgtaagt

SEQ ID NO: 185252 - DNA, 20 bp, Artificial Sequence
  Description of Artificial Sequence: Synthetic oligonucleotide
  Target: ATXN1; (-) strand; PAM type: YTN; PAM sequence: CTG
tctattattttgactactgt

SEQ ID NO: 185253 - DNA, 20 bp, Artificial Sequence
  Description of Artificial Sequence: Synthetic oligonucleotide
  Target: ATXN1; (-) strand; PAM type: YTN; PAM sequence: TTG
ctgtctattattttgactac

SEQ ID NO: 185254 - DNA, 20 bp, Artificial Sequence
  Description of Artificial Sequence: Synthetic oligonucleotide
  Target: ATXN1; (-) strand; PAM type: YTN; PAM sequence: CTT
gctgtctattattttgacta

SEQ ID NO: 185255 - DNA, 20 bp, Artificial Sequence
  Description of Artificial Sequence: Synthetic oligonucleotide
  Target: ATXN1; (-) strand; PAM type: YTN; PAM sequence: CTA
cttgctgtctattattttga

SEQ ID NO: 185256 - DNA, 20 bp, Artificial Sequence
  Description of Artificial Sequence: Synthetic oligonucleotide
  Target: ATXN1; (-) strand; PAM type: YTN; PAM sequence: TTC
tacttgctgtctattatttt

SEQ ID NO: 185257 - DNA, 20 bp, Artificial Sequence
  Description of Artificial Sequence: Synthetic oligonucleotide
  Target: ATXN1; (-) strand; PAM type: YTN; PAM sequence: CTA
gcccccggcagccaccattc

SEQ ID NO: 185258 - DNA, 20 bp, Artificial Sequence
  Description of Artificial Sequence: Synthetic oligonucleotide
  Target: ATXN1; (-) strand; PAM type: YTN; PAM sequence: CTC
caccctagcccccggcagcc

SEQ ID NO: 185259 - DNA, 20 bp, Artificial Sequence
  Description of Artificial Sequence: Synthetic oligonucleotide
  Target: ATXN1; (-) strand; PAM type: YTN; PAM sequence: CTA
ccctccaccctagcccccgg

SEQ ID NO: 185260 - DNA, 20 bp, Artificial Sequence
  Description of Artificial Sequence: Synthetic oligonucleotide
  Target: ATXN1; (-) strand; PAM type: YTN; PAM sequence: CTC
taccctccaccctagccccc

SEQ ID NO: 185261 - DNA, 20 bp, Artificial Sequence
  Description of Artificial Sequence: Synthetic oligonucleotide
  Target: ATXN1; (-) strand; PAM type: YTN; PAM sequence: CTA
atgctctaccctccacccta

SEQ ID NO: 185262 - DNA, 20 bp, Artificial Sequence
  Description of Artificial Sequence: Synthetic oligonucleotide
  Target: ATXN1; (-) strand; PAM type: YTN; PAM sequence: CTA
gacccataaaatactaatgc

SEQ ID NO: 185263 - DNA, 20 bp, Artificial Sequence
  Description of Artificial Sequence: Synthetic oligonucleotide
  Target: ATXN1; (-) strand; PAM type: YTN; PAM sequence: CTG
aatctagacccataaaatac

SEQ ID NO: 185264 - DNA, 20 bp, Artificial Sequence
  Description of Artificial Sequence: Synthetic oligonucleotide
  Target: ATXN1; (-) strand; PAM type: YTN; PAM sequence: CTG
gcaaaactgaatctagaccc

SEQ ID NO: 185265 - DNA, 20 bp, Artificial Sequence
  Description of Artificial Sequence: Synthetic oligonucleotide
  Target: ATXN1; (-) strand; PAM type: YTN; PAM sequence: TTC
tggcaaaactgaatctagac

SEQ ID NO: 185266 - DNA, 20 bp, Artificial Sequence
  Description of Artificial Sequence: Synthetic oligonucleotide
  Target: ATXN1; (-) strand; PAM type: YTN; PAM sequence: TTT
ctggcaaaactgaatctaga

SEQ ID NO: 185267 - DNA, 20 bp, Artificial Sequence
  Description of Artificial Sequence: Synthetic oligonucleotide
  Target: ATXN1; (-) strand; PAM type: YTN; PAM sequence: TTT
tctggcaaaactgaatctag

SEQ ID NO: 185268 - DNA, 20 bp, Artificial Sequence
  Description of Artificial Sequence: Synthetic oligonucleotide
  Target: ATXN1; (-) strand; PAM type: YTN; PAM sequence: TTT
ttctggcaaaactgaatcta

SEQ ID NO: 185269 - DNA, 20 bp, Artificial Sequence
  Description of Artificial Sequence: Synthetic oligonucleotide
  Target: ATXN1; (-) strand; PAM type: YTN; PAM sequence: TTT
tttctggcaaaactgaatct

SEQ ID NO: 185270 - DNA, 20 bp, Artificial Sequence
  Description of Artificial Sequence: Synthetic oligonucleotide
  Target: ATXN1; (-) strand; PAM type: YTN; PAM sequence: TTT
ttttctggcaaaactgaatc

SEQ ID NO: 185271 - DNA, 20 bp, Artificial Sequence
  Description of Artificial Sequence: Synthetic oligonucleotide
  Target: ATXN1; (-) strand; PAM type: YTN; PAM sequence: CTT
tttttctggcaaaactgaat

SEQ ID NO: 185272 - DNA, 20 bp, Artificial Sequence
  Description of Artificial Sequence: Synthetic oligonucleotide
  Target: ATXN1; (-) strand; PAM type: YTN; PAM sequence: CTC
tttttttctggcaaaactga

SEQ ID NO: 185273 - DNA, 20 bp, Artificial Sequence
  Description of Artificial Sequence: Synthetic oligonucleotide
  Target: ATXN1; (-) strand; PAM type: YTN; PAM sequence: TTC
acacctctttttttctggca

SEQ ID NO: 185274 - DNA, 20 bp, Artificial Sequence
  Description of Artificial Sequence: Synthetic oligonucleotide
  Target: ATXN1; (-) strand; PAM type: YTN; PAM sequence: CTT
cacacctctttttttctggc

SEQ ID NO: 185275 - DNA, 20 bp, Artificial Sequence
  Description of Artificial Sequence: Synthetic oligonucleotide
  Target: ATXN1; (-) strand; PAM type: YTN; PAM sequence: TTG
tcttcacacctctttttttc

SEQ ID NO: 185276 - DNA, 20 bp, Artificial Sequence
  Description of Artificial Sequence: Synthetic oligonucleotide
  Target: ATXN1; (-) strand; PAM type: YTN; PAM sequence: CTT
gtcttcacacctcttttttt

SEQ ID NO: 185277 - DNA, 20 bp, Artificial Sequence
  Description of Artificial Sequence: Synthetic oligonucleotide
  Target: ATXN1; (-) strand; PAM type: YTN; PAM sequence: TTG
tcttgtcttcacacctcttt

SEQ ID NO: 185278 - DNA, 20 bp, Artificial Sequence
  Description of Artificial Sequence: Synthetic oligonucleotide
  Target: ATXN1; (-) strand; PAM type: YTN; PAM sequence: CTC
cattgtcttgtcttcacacc

SEQ ID NO: 185279 - DNA, 20 bp, Artificial Sequence
  Description of Artificial Sequence: Synthetic oligonucleotide
  Target: ATXN1; (-) strand; PAM type: YTN; PAM sequence: TTG
atgtgaagccatctccattg

SEQ ID NO: 185280 - DNA, 20 bp, Artificial Sequence
  Description of Artificial Sequence: Synthetic oligonucleotide
  Target: ATXN1; (-) strand; PAM type: YTN; PAM sequence: TTC
atattgatgtgaagccatct

SEQ ID NO: 185281 - DNA, 20 bp, Artificial Sequence
  Description of Artificial Sequence: Synthetic oligonucleotide
  Target: ATXN1; (-) strand; PAM type: YTN; PAM sequence: TTG
tacattcatattgatgtgaa

SEQ ID NO: 185282 - DNA, 20 bp, Artificial Sequence
  Description of Artificial Sequence: Synthetic oligonucleotide
  Target: ATXN1; (-) strand; PAM type: YTN; PAM sequence: TTA
agtgtatagttgtacattca

SEQ ID NO: 185283 - DNA, 20 bp, Artificial Sequence
  Description of Artificial Sequence: Synthetic oligonucleotide
  Target: ATXN1; (-) strand; PAM type: YTN; PAM sequence: TTT
aagtgtatagttgtacattc

SEQ ID NO: 185284 - DNA, 20 bp, Artificial Sequence
  Description of Artificial Sequence: Synthetic oligonucleotide
  Target: ATXN1; (-) strand; PAM type: YTN; PAM sequence: TTT
taagtgtatagttgtacatt

SEQ ID NO: 185285 - DNA, 20 bp, Artificial Sequence
  Description of Artificial Sequence: Synthetic oligonucleotide
  Target: ATXN1; (-) strand; PAM type: YTN; PAM sequence: TTT
ttaagtgtatagttgtacat

SEQ ID NO: 185286 - DNA, 20 bp, Artificial Sequence
  Description of Artificial Sequence: Synthetic oligonucleotide
  Target: ATXN1; (-) strand; PAM type: YTN; PAM sequence: TTA
gccatttttaagtgtatagt

SEQ ID NO: 185287 - DNA, 20 bp, Artificial Sequence
  Description of Artificial Sequence: Synthetic oligonucleotide
  Target: ATXN1; (-) strand; PAM type: YTN; PAM sequence: CTT
agccatttttaagtgtatag

SEQ ID NO: 185288 - DNA, 20 bp, Artificial Sequence
  Description of Artificial Sequence: Synthetic oligonucleotide
  Target: ATXN1; (-) strand; PAM type: YTN; PAM sequence: CTG
tcttagccatttttaagtgt

SEQ ID NO: 185289 - DNA, 20 bp, Artificial Sequence
  Description of Artificial Sequence: Synthetic oligonucleotide
  Target: ATXN1; (-) strand; PAM type: YTN; PAM sequence: TTA
ctgtcttagccatttttaag

SEQ ID NO: 185290 - DNA, 20 bp, Artificial Sequence
  Description of Artificial Sequence: Synthetic oligonucleotide
  Target: ATXN1; (-) strand; PAM type: YTN; PAM sequence: TTT
actgtcttagccatttttaa

SEQ ID NO: 185291 - DNA, 20 bp, Artificial Sequence
  Description of Artificial Sequence: Synthetic oligonucleotide
  Target: ATXN1; (-) strand; PAM type: YTN; PAM sequence: TTA
tagtaaagtacacataacat

SEQ ID NO: 185292 - DNA, 20 bp, Artificial Sequence
  Description of Artificial Sequence: Synthetic oligonucleotide
  Target: ATXN1; (-) strand; PAM type: YTN; PAM sequence: TTA
ttatagtaaagtacacataa

SEQ ID NO: 185293 - DNA, 20 bp, Artificial Sequence
  Description of Artificial Sequence: Synthetic oligonucleotide
  Target: ATXN1; (-) strand; PAM type: YTN; PAM sequence: TTT
attatagtaaagtacacata

SEQ ID NO: 185294 - DNA, 20 bp, Artificial Sequence
  Description of Artificial Sequence: Synthetic oligonucleotide
  Target: ATXN1; (-) strand; PAM type: YTN; PAM sequence: TTT
tattatagtaaagtacacat

SEQ ID NO: 185295 - DNA, 20 bp, Artificial Sequence
  Description of Artificial Sequence: Synthetic oligonucleotide
  Target: ATXN1; (-) strand; PAM type: YTN; PAM sequence: TTT
ttattatagtaaagtacaca

SEQ ID NO: 185296 - DNA, 20 bp, Artificial Sequence
  Description of Artificial Sequence: Synthetic oligonucleotide
  Target: ATXN1; (-) strand; PAM type: YTN; PAM sequence: TTT
tttattatagtaaagtacac

SEQ ID NO: 185297 - DNA, 20 bp, Artificial Sequence
  Description of Artificial Sequence: Synthetic oligonucleotide
  Target: ATXN1; (-) strand; PAM type: YTN; PAM sequence: TTT
ttttattatagtaaagtaca

SEQ ID NO: 185298 - DNA, 20 bp, Artificial Sequence
  Description of Artificial Sequence: Synthetic oligonucleotide
  Target: ATXN1; (-) strand; PAM type: YTN; PAM sequence: TTT
tttttattatagtaaagtac

SEQ ID NO: 185299 - DNA, 20 bp, Artificial Sequence
  Description of Artificial Sequence: Synthetic oligonucleotide
  Target: ATXN1; (-) strand; PAM type: YTN; PAM sequence: TTC
cagttttttttattatagta

SEQ ID NO: 185300 - DNA, 20 bp, Artificial Sequence
  Description of Artificial Sequence: Synthetic oligonucleotide
  Target: ATXN1; (-) strand; PAM type: YTN; PAM sequence: TTT
ccagttttttttattatagt

SEQ ID NO: 185301 - DNA, 20 bp, Artificial Sequence
  Description of Artificial Sequence: Synthetic oligonucleotide
  Target: ATXN1; (-) strand; PAM type: YTN; PAM sequence: TTT
tccagttttttttattatag

SEQ ID NO: 185302 - DNA, 20 bp, Artificial Sequence
  Description of Artificial Sequence: Synthetic oligonucleotide
  Target: ATXN1; (-) strand; PAM type: YTN; PAM sequence: TTC
accaacataattttccagtt

SEQ ID NO: 185303 - DNA, 20 bp, Artificial Sequence
  Description of Artificial Sequence: Synthetic oligonucleotide
  Target: ATXN1; (-) strand; PAM type: YTN; PAM sequence: CTA
tggtatagttcaccaacata

SEQ ID NO: 185304 - DNA, 20 bp, Artificial Sequence
  Description of Artificial Sequence: Synthetic oligonucleotide
  Target: ATXN1; (-) strand; PAM type: YTN; PAM sequence: TTC
aaagctatggtatagttcac

SEQ ID NO: 185305 - DNA, 20 bp, Artificial Sequence
  Description of Artificial Sequence: Synthetic oligonucleotide
  Target: ATXN1; (-) strand; PAM type: YTN; PAM sequence: TTT
caaagctatggtatagttca

SEQ ID NO: 185306 - DNA, 20 bp, Artificial Sequence
  Description of Artificial Sequence: Synthetic oligonucleotide
  Target: ATXN1; (-) strand; PAM type: YTN; PAM sequence: TTG
catgtaagtttcaaagctat

SEQ ID NO: 185307 - DNA, 20 bp, Artificial Sequence
  Description of Artificial Sequence: Synthetic oligonucleotide
  Target: ATXN1; (-) strand; PAM type: YTN; PAM sequence: TTT
gcatgtaagtttcaaagcta

SEQ ID NO: 185308 - DNA, 20 bp, Artificial Sequence
  Description of Artificial Sequence: Synthetic oligonucleotide
  Target: ATXN1; (-) strand; PAM type: YTN; PAM sequence: CTT
tgcatgtaagtttcaaagct

SEQ ID NO: 185309 - DNA, 20 bp, Artificial Sequence
  Description of Artificial Sequence: Synthetic oligonucleotide
  Target: ATXN1; (-) strand; PAM type: YTN; PAM sequence: CTA
acataataataatcagataa

SEQ ID NO: 185310 - DNA, 20 bp, Artificial Sequence
  Description of Artificial Sequence: Synthetic oligonucleotide
  Target: ATXN1; (-) strand; PAM type: YTN; PAM sequence: TTC
catataaaatagctaacata

SEQ ID NO: 185311 - DNA, 20 bp, Artificial Sequence
  Description of Artificial Sequence: Synthetic oligonucleotide
  Target: ATXN1; (-) strand; PAM type: YTN; PAM sequence: TTT
ccatataaaatagctaacat

SEQ ID NO: 185312 - DNA, 20 bp, Artificial Sequence
  Description of Artificial Sequence: Synthetic oligonucleotide
  Target: ATXN1; (-) strand; PAM type: YTN; PAM sequence: CTT
tccatataaaatagctaaca

SEQ ID NO: 185313 - DNA, 20 bp, Artificial Sequence
  Description of Artificial Sequence: Synthetic oligonucleotide
  Target: ATXN1; (-) strand; PAM type: YTN; PAM sequence: CTG
tccaataactttccatataa

SEQ ID NO: 185314 - DNA, 20 bp, Artificial Sequence
  Description of Artificial Sequence: Synthetic oligonucleotide
  Target: ATXN1; (-) strand; PAM type: YTN; PAM sequence: TTC
tgtccaataactttccatat

SEQ ID NO: 185315 - DNA, 20 bp, Artificial Sequence
  Description of Artificial Sequence: Synthetic oligonucleotide
  Target: ATXN1; (-) strand; PAM type: YTN; PAM sequence: CTT
ctgtccaataactttccata

SEQ ID NO: 185316 - DNA, 20 bp, Artificial Sequence
  Description of Artificial Sequence: Synthetic oligonucleotide
  Target: ATXN1; (-) strand; PAM type: YTN; PAM sequence: CTG
acttctgtccaataactttc

SEQ ID NO: 185317 - DNA, 20 bp, Artificial Sequence
  Description of Artificial Sequence: Synthetic oligonucleotide
  Target: ATXN1; (-) strand; PAM type: YTN; PAM sequence: TTC
tgacttctgtccaataactt

SEQ ID NO: 185318 - DNA, 20 bp, Artificial Sequence
  Description of Artificial Sequence: Synthetic oligonucleotide
  Target: ATXN1; (-) strand; PAM type: YTN; PAM sequence: CTA
cccattctgacttctgtcca

SEQ ID NO: 185319 - DNA, 20 bp, Artificial Sequence
  Description of Artificial Sequence: Synthetic oligonucleotide
  Target: ATXN1; (-) strand; PAM type: YTN; PAM sequence: CTA
aactacccattctgacttct

SEQ ID NO: 185320 - DNA, 20 bp, Artificial Sequence
  Description of Artificial Sequence: Synthetic oligonucleotide
  Target: ATXN1; (-) strand; PAM type: YTN; PAM sequence: CTA
atcagtctaaactacccatt

SEQ ID NO: 185321 - DNA, 20 bp, Artificial Sequence
  Description of Artificial Sequence: Synthetic oligonucleotide
  Target: ATXN1; (-) strand; PAM type: YTN; PAM sequence: CTA
cctaatcagtctaaactacc

SEQ ID NO: 185322 - DNA, 20 bp, Artificial Sequence
  Description of Artificial Sequence: Synthetic oligonucleotide
  Target: ATXN1; (-) strand; PAM type: YTN; PAM sequence: CTG
tctacctaatcagtctaaac

SEQ ID NO: 185323 - DNA, 20 bp, Artificial Sequence
  Description of Artificial Sequence: Synthetic oligonucleotide
  Target: ATXN1; (-) strand; PAM type: YTN; PAM sequence: TTA
ggaagcaagcagctgtctac

SEQ ID NO: 185324 - DNA, 20 bp, Artificial Sequence
  Description of Artificial Sequence: Synthetic oligonucleotide
  Target: ATXN1; (-) strand; PAM type: YTN; PAM sequence: TTC
aaacagattaggaagcaagc

SEQ ID NO: 185325 - DNA, 20 bp, Artificial Sequence
  Description of Artificial Sequence: Synthetic oligonucleotide
  Target: ATXN1; (-) strand; PAM type: YTN; PAM sequence: TTT
caaacagattaggaagcaag

SEQ ID NO: 185326 - DNA, 20 bp, Artificial Sequence
  Description of Artificial Sequence: Synthetic oligonucleotide
  Target: ATXN1; (-) strand; PAM type: YTN; PAM sequence: TTT
tcaaacagattaggaagcaa

SEQ ID NO: 185327 - DNA, 20 bp, Artificial Sequence
  Description of Artificial Sequence: Synthetic oligonucleotide
  Target: ATXN1; (-) strand; PAM type: YTN; PAM sequence: TTT
ttcaaacagattaggaagca

SEQ ID NO: 185328 - DNA, 20 bp, Artificial Sequence
  Description of Artificial Sequence: Synthetic oligonucleotide
  Target: ATXN1; (-) strand; PAM type: YTN; PAM sequence: TTG
ggtgtcatttttcaaacaga

SEQ ID NO: 185329 - DNA, 20 bp, Artificial Sequence
  Description of Artificial Sequence: Synthetic oligonucleotide
  Target: ATXN1; (-) strand; PAM type: YTN; PAM sequence: TTT
gggtgtcatttttcaaacag

SEQ ID NO: 185330 - DNA, 20 bp, Artificial Sequence
  Description of Artificial Sequence: Synthetic oligonucleotide
  Target: ATXN1; (-) strand; PAM type: YTN; PAM sequence: TTT
tgggtgtcatttttcaaaca

SEQ ID NO: 185331 - DNA, 20 bp, Artificial Sequence
  Description of Artificial Sequence: Synthetic oligonucleotide
  Target: ATXN1; (-) strand; PAM type: YTN; PAM sequence: CTT
ttgggtgtcatttttcaaac

SEQ ID NO: 185332 - DNA, 20 bp, Artificial Sequence
  Description of Artificial Sequence: Synthetic oligonucleotide
  Target: ATXN1; (-) strand; PAM type: YTN; PAM sequence: CTG
atcccaggggagatcttttg

SEQ ID NO: 185333 - DNA, 20 bp, Artificial Sequence
  Description of Artificial Sequence: Synthetic oligonucleotide
  Target: ATXN1; (-) strand; PAM type: YTN; PAM sequence: TTC
agctgatcccaggggagatc

SEQ ID NO: 185334 - DNA, 20 bp, Artificial Sequence
  Description of Artificial Sequence: Synthetic oligonucleotide
  Target: ATXN1; (-) strand; PAM type: YTN; PAM sequence: TTT
cagctgatcccaggggagat

SEQ ID NO: 185335 - DNA, 20 bp, Artificial Sequence
  Description of Artificial Sequence: Synthetic oligonucleotide
  Target: ATXN1; (-) strand; PAM type: YTN; PAM sequence: TTA
atggtgatttcagctgatcc

SEQ ID NO: 185336 - DNA, 20 bp, Artificial Sequence
  Description of Artificial Sequence: Synthetic oligonucleotide
  Target: ATXN1; (-) strand; PAM type: YTN; PAM sequence: TTT
aatggtgatttcagctgatc

SEQ ID NO: 185337 - DNA, 20 bp, Artificial Sequence
  Description of Artificial Sequence: Synthetic oligonucleotide
  Target: ATXN1; (-) strand; PAM type: YTN; PAM sequence: TTT
taatggtgatttcagctgat

SEQ ID NO: 185338 - DNA, 20 bp, Artificial Sequence
  Description of Artificial Sequence: Synthetic oligonucleotide
  Target: ATXN1; (-) strand; PAM type: YTN; PAM sequence: TTT
ttaatggtgatttcagctga

SEQ ID NO: 185339 - DNA, 20 bp, Artificial Sequence
  Description of Artificial Sequence: Synthetic oligonucleotide
  Target: ATXN1; (-) strand; PAM type: YTN; PAM sequence: TTT
tttaatggtgatttcagctg

SEQ ID NO: 185340 - DNA, 20 bp, Artificial Sequence
  Description of Artificial Sequence: Synthetic oligonucleotide
  Target: ATXN1; (-) strand; PAM type: YTN; PAM sequence: TTT
ttttaatggtgatttcagct

SEQ ID NO: 185341 - DNA, 20 bp, Artificial Sequence
  Description of Artificial Sequence: Synthetic oligonucleotide
  Target: ATXN1; (-) strand; PAM type: YTN; PAM sequence: CTG
aatttttttaatggtgattt

SEQ ID NO: 185342 - DNA, 20 bp, Artificial Sequence
  Description of Artificial Sequence: Synthetic oligonucleotide
  Target: ATXN1; (-) strand; PAM type: YTN; PAM sequence: TTA
caagcatggcctgaattttt

SEQ ID NO: 185343 - DNA, 20 bp, Artificial Sequence
  Description of Artificial Sequence: Synthetic oligonucleotide
  Target: ATXN1; (-) strand; PAM type: YTN; PAM sequence: CTG
aaattacaagcatggcctga

SEQ ID NO: 185344 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgaaattacaa

SEQ ID NO: 185345 - DNA, 20 bp, Artificial Sequence
  Description of Artificial Sequence: Synthetic oligonucleotide
  Target: ATXN1; (-) strand; PAM type: YTN; PAM sequence: TTG
acctcccaaagtgctgaaat

SEQ ID NO: 185346 - DNA, 20 bp, Artificial Sequence
  Description of Artificial Sequence: Synthetic oligonucleotide
  Target: ATXN1; (-) strand; PAM type: YTN; PAM sequence: CTT
gacctcccaaagtgctgaaa

SEQ ID NO: 185347 - DNA, 20 bp, Artificial Sequence
  Description of Artificial Sequence: Synthetic oligonucleotide
  Target: ATXN1; (-) strand; PAM type: YTN; PAM sequence: CTG
tcttgacctcccaaagtgct

SEQ ID NO: 185348 - DNA, 20 bp, Artificial Sequence
  Description of Artificial Sequence: Synthetic oligonucleotide
  Target: ATXN1; (-) strand; PAM type: YTN; PAM sequence: CTC
ctgtcttgacctcccaaagt

SEQ ID NO: 185349 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcctgtcttga

SEQ ID NO: 185350 - DNA, 20 bp, Artificial Sequence
  Description of Artificial Sequence: Synthetic oligonucleotide
  Target: ATXN1; (-) strand; PAM type: YTN; PAM sequence: CTG
gcctcaagtgatcctcctgt

SEQ ID NO: 185351 - DNA, 20 bp, Artificial Sequence
  Description of Artificial Sequence: Synthetic oligonucleotide
  Target: ATXN1; (-) strand; PAM type: YTN; PAM sequence: CTC
cctggcctcaagtgatcctc

SEQ ID NO: 185352 - DNA, 20 bp, Artificial Sequence
  Description of Artificial Sequence: Synthetic oligonucleotide
  Target: ATXN1; (-) strand; PAM type: YTN; PAM sequence: CTC
acactccctggcctcaagtg

SEQ ID NO: 185353 - DNA, 20 bp, Artificial Sequence
  Description of Artificial Sequence: Synthetic oligonucleotide
  Target: ATXN1; (-) strand; PAM type: YTN; PAM sequence: CTG
gactcacactccctggcctc

SEQ ID NO: 185354 - DNA, 20 bp, Artificial Sequence
  Description of Artificial Sequence: Synthetic oligonucleotide
  Target: ATXN1; (-) strand; PAM type: YTN; PAM sequence: TTG
cccaggctggactcacactc

SEQ ID NO: 185355 - DNA, 20 bp, Artificial Sequence
  Description of Artificial Sequence: Synthetic oligonucleotide
  Target: ATXN1; (-) strand; PAM type: YTN; PAM sequence: CTA
tgttgcccaggctggactca

SEQ ID NO: 185356 - DNA, 20 bp, Artificial Sequence
  Description of Artificial Sequence: Synthetic oligonucleotide
  Target: ATXN1; (-) strand; PAM type: YTN; PAM sequence: CTC
actatgttgcccaggctgga

SEQ ID NO: 185357 - DNA, 20 bp, Artificial Sequence
  Description of Artificial Sequence: Synthetic oligonucleotide
  Target: ATXN1; (-) strand; PAM type: YTN; PAM sequence: TTA
tagagatgaagtctcactat

SEQ ID NO: 185358 - DNA, 20 bp, Artificial Sequence
  Description of Artificial Sequence: Synthetic oligonucleotide
  Target: ATXN1; (-) strand; PAM type: YTN; PAM sequence: TTT
atagagatgaagtctcacta

SEQ ID NO: 185359 - DNA, 20 bp, Artificial Sequence
  Description of Artificial Sequence: Synthetic oligonucleotide
  Target: ATXN1; (-) strand; PAM type: YTN; PAM sequence: TTT
tatagagatgaagtctcact

SEQ ID NO: 185360 - DNA, 20 bp, Artificial Sequence
  Description of Artificial Sequence: Synthetic oligonucleotide
  Target: ATXN1; (-) strand; PAM type: YTN; PAM sequence: TTT
ttatagagatgaagtctcac

SEQ ID NO: 185361 - DNA, 20 bp, Artificial Sequence
  Description of Artificial Sequence: Synthetic oligonucleotide
  Target: ATXN1; (-) strand; PAM type: YTN; PAM sequence: TTT
tttatagagatgaagtctca

SEQ ID NO: 185362 - DNA, 20 bp, Artificial Sequence
  Description of Artificial Sequence: Synthetic oligonucleotide
  Target: ATXN1; (-) strand; PAM type: YTN; PAM sequence: TTA
ttttttatagagatgaagtc

SEQ ID NO: 185363 - DNA, 20 bp, Artificial Sequence
  Description of Artificial Sequence: Synthetic oligonucleotide
  Target: ATXN1; (-) strand; PAM type: YTN; PAM sequence: TTA
attattttttatagagatga

SEQ ID NO: 185364 - DNA, 20 bp, Artificial Sequence
  Description of Artificial Sequence: Synthetic oligonucleotide
  Target: ATXN1; (-) strand; PAM type: YTN; PAM sequence: CTT
aattattttttatagagatg

SEQ ID NO: 185365 - DNA, 20 bp, Artificial Sequence
  Description of Artificial Sequence: Synthetic oligonucleotide
  Target: ATXN1; (-) strand; PAM type: YTN; PAM sequence: CTC
ttaattattttttatagaga

SEQ ID NO: 185366 - DNA, 20 bp, Artificial Sequence
  Description of Artificial Sequence: Synthetic oligonucleotide
  Target: ATXN1; (-) strand; PAM type: YTN; PAM sequence: TTC
tcttaattattttttataga

SEQ ID NO: 185367 - DNA, 20 bp, Artificial Sequence
  Description of Artificial Sequence: Synthetic oligonucleotide
  Target: ATXN1; (-) strand; PAM type: YTN; PAM sequence: TTT
ctcttaattattttttatag

SEQ ID NO: 185368 - DNA, 20 bp, Artificial Sequence
  Description of Artificial Sequence: Synthetic oligonucleotide
  Target: ATXN1; (-) strand; PAM type: YTN; PAM sequence: TTT
tctcttaattattttttata

SEQ ID NO: 185369 - DNA, 20 bp, Artificial Sequence
  Description of Artificial Sequence: Synthetic oligonucleotide
  Target: ATXN1; (-) strand; PAM type: YTN; PAM sequence: TTT
ttctcttaattattttttat

SEQ ID NO: 185370 - DNA, 20 bp, Artificial Sequence
  Description of Artificial Sequence: Synthetic oligonucleotide
  Target: ATXN1; (-) strand; PAM type: YTN; PAM sequence: TTA
atttttctcttaattatttt

SEQ ID NO: 185371 - DNA, 20 bp, Artificial Sequence
  Description of Artificial Sequence: Synthetic oligonucleotide
  Target: ATXN1; (-) strand; PAM type: YTN; PAM sequence: TTT
aatttttctcttaattattt

SEQ ID NO: 185372 - DNA, 20 bp, Artificial Sequence
  Description of Artificial Sequence: Synthetic oligonucleotide
  Target: ATXN1; (-) strand; PAM type: YTN; PAM sequence: TTG
gaaggatttaatttttctct

SEQ ID NO: 185373 - DNA, 20 bp, Artificial Sequence
  Description of Artificial Sequence: Synthetic oligonucleotide
  Target: ATXN1; (-) strand; PAM type: YTN; PAM sequence: CTA
agggttggaaggatttaatt

SEQ ID NO: 185374 - DNA, 20 bp, Artificial Sequence
  Description of Artificial Sequence: Synthetic oligonucleotide
  Target: ATXN1; (-) strand; PAM type: YTN; PAM sequence: TTC
aaaggctaagggttggaagg

SEQ ID NO: 185375 - DNA, 20 bp, Artificial Sequence
  Description of Artificial Sequence: Synthetic oligonucleotide
  Target: ATXN1; (-) strand; PAM type: YTN; PAM sequence: TTT
caaaggctaagggttggaag

SEQ ID NO: 185376 - DNA, 20 bp, Artificial Sequence
  Description of Artificial Sequence: Synthetic oligonucleotide
  Target: ATXN1; (-) strand; PAM type: YTN; PAM sequence: TTT
tcaaaggctaagggttggaa

SEQ ID NO: 185377 - DNA, 20 bp, Artificial Sequence
  Description of Artificial Sequence: Synthetic oligonucleotide
  Target: ATXN1; (-) strand; PAM type: YTN; PAM sequence: TTT
ttcaaaggctaagggttgga

SEQ ID NO: 185378 - DNA, 20 bp, Artificial Sequence
  Description of Artificial Sequence: Synthetic oligonucleotide
  Target: ATXN1; (-) strand; PAM type: YTN; PAM sequence: TTG
catttttcaaaggctaaggg

SEQ ID NO: 185379 - DNA, 20 bp, Artificial Sequence
  Description of Artificial Sequence: Synthetic oligonucleotide
  Target: ATXN1; (-) strand; PAM type: YTN; PAM sequence: CTA
ggataattgcatttttcaaa

SEQ ID NO: 185380 - DNA, 20 bp, Artificial Sequence
  Description of Artificial Sequence: Synthetic oligonucleotide
  Target: ATXN1; (-) strand; PAM type: YTN; PAM sequence: TTG
gctaggataattgcattttt

SEQ ID NO: 185381 - DNA, 20 bp, Artificial Sequence
  Description of Artificial Sequence: Synthetic oligonucleotide
  Target: ATXN1; (-) strand; PAM type: YTN; PAM sequence: CTT
ggctaggataattgcatttt

SEQ ID NO: 185382 - DNA, 20 bp, Artificial Sequence
  Description of Artificial Sequence: Synthetic oligonucleotide
  Target: ATXN1; (-) strand; PAM type: YTN; PAM sequence: CTG
atagagaccttggctaggat

SEQ ID NO: 185383 - DNA, 20 bp, Artificial Sequence
  Description of Artificial Sequence: Synthetic oligonucleotide
  Target: ATXN1; (-) strand; PAM type: YTN; PAM sequence: TTA
agctgatagagaccttggct

SEQ ID NO: 185384 - DNA, 20 bp, Artificial Sequence
  Description of Artificial Sequence: Synthetic oligonucleotide
  Target: ATXN1; (-) strand; PAM type: YTN; PAM sequence: CTC
acattaagctgatagagacc

SEQ ID NO: 185385 - DNA, 20 bp, Artificial Sequence
  Description of Artificial Sequence: Synthetic oligonucleotide
  Target: ATXN1; (-) strand; PAM type: YTN; PAM sequence: TTG
agacactcacattaagctga

SEQ ID NO: 185386 - DNA, 20 bp, Artificial Sequence
  Description of Artificial Sequence: Synthetic oligonucleotide
  Target: ATXN1; (-) strand; PAM type: YTN; PAM sequence: TTG
ttgagacactcacattaagc

SEQ ID NO: 185387 - DNA, 20 bp, Artificial Sequence
  Description of Artificial Sequence: Synthetic oligonucleotide
  Target: ATXN1; (-) strand; PAM type: YTN; PAM sequence: CTT
gttgagacactcacattaag

SEQ ID NO: 185388 - DNA, 20 bp, Artificial Sequence
  Description of Artificial Sequence: Synthetic oligonucleotide
  Target: ATXN1; (-) strand; PAM type: YTN; PAM sequence: CTG
tggagaaaaacagtcttgtt

SEQ ID NO: 185389 - DNA, 20 bp, Artificial Sequence
  Description of Artificial Sequence: Synthetic oligonucleotide
  Target: ATXN1; (-) strand; PAM type: YTN; PAM sequence: TTG
gcctgtggagaaaaacagtc

SEQ ID NO: 185390 - DNA, 20 bp, Artificial Sequence
  Description of Artificial Sequence: Synthetic oligonucleotide
  Target: ATXN1; (-) strand; PAM type: YTN; PAM sequence: TTG
gttggcctgtggagaaaaac

SEQ ID NO: 185391 - DNA, 20 bp, Artificial Sequence
  Description of Artificial Sequence: Synthetic oligonucleotide
  Target: ATXN1; (-) strand; PAM type: YTN; PAM sequence: CTT
ggttggcctgtggagaaaaa

SEQ ID NO: 185392 - DNA, 20 bp, Artificial Sequence
  Description of Artificial Sequence: Synthetic oligonucleotide
  Target: ATXN1; (-) strand; PAM type: YTN; PAM sequence: CTA
ggtaccttggttggcctgtg

SEQ ID NO: 185393 - DNA, 20 bp, Artificial Sequence
  Description of Artificial Sequence: Synthetic oligonucleotide
  Target: ATXN1; (-) strand; PAM type: YTN; PAM sequence: CTC
acatcagtctaggtaccttg

SEQ ID NO: 185394 - DNA, 20 bp, Artificial Sequence
  Description of Artificial Sequence: Synthetic oligonucleotide
  Target: ATXN1; (-) strand; PAM type: YTN; PAM sequence: TTC
caaatgcctcacatcagtct

SEQ ID NO: 185395 - DNA, 20 bp, Artificial Sequence
  Description of Artificial Sequence: Synthetic oligonucleotide
  Target: ATXN1; (-) strand; PAM type: YTN; PAM sequence: CTT
ccaaatgcctcacatcagtc

SEQ ID NO: 185396 - DNA, 20 bp, Artificial Sequence
  Description of Artificial Sequence: Synthetic oligonucleotide
  Target: ATXN1; (-) strand; PAM type: YTN; PAM sequence: CTC
ttccaaatgcctcacatcag

SEQ ID NO: 185397 - DNA, 20 bp, Artificial Sequence
  Description of Artificial Sequence: Synthetic oligonucleotide
  Target: ATXN1; (-) strand; PAM type: YTN; PAM sequence: TTC
ccctcttccaaatgcctcac

SEQ ID NO: 185398 - DNA, 20 bp, Artificial Sequence
  Description of Artificial Sequence: Synthetic oligonucleotide
  Target: ATXN1; (-) strand; PAM type: YTN; PAM sequence: TTT
cccctcttccaaatgcctca

SEQ ID NO: 185399 - DNA, 20 bp, Artificial Sequence
  Description of Artificial Sequence: Synthetic oligonucleotide
  Target: ATXN1; (-) strand; PAM type: YTN; PAM sequence: CTT
tcccctcttccaaatgcctc

SEQ ID NO: 185400 - DNA, 20 bp, Artificial Sequence
  Description of Artificial Sequence: Synthetic oligonucleotide
  Target: ATXN1; (-) strand; PAM type: YTN; PAM sequence: TTC
cagacgaatctttcccctct

SEQ ID NO: 185401 - DNA, 20 bp, Artificial Sequence
  Description of Artificial Sequence: Synthetic oligonucleotide
  Target: ATXN1; (-) strand; PAM type: YTN; PAM sequence: TTT
ccagacgaatctttcccctc

SEQ ID NO: 185402 - DNA, 20 bp, Artificial Sequence
  Description of Artificial Sequence: Synthetic oligonucleotide
  Target: ATXN1; (-) strand; PAM type: YTN; PAM sequence: CTT
tccagacgaatctttcccct

SEQ ID NO: 185403 - DNA, 20 bp, Artificial Sequence
  Description of Artificial Sequence: Synthetic oligonucleotide
  Target: ATXN1; (-) strand; PAM type: YTN; PAM sequence: TTC
cctttccagacgaatctttc

SEQ ID NO: 185404 - DNA, 20 bp, Artificial Sequence
  Description of Artificial Sequence: Synthetic oligonucleotide
  Target: ATXN1; (-) strand; PAM type: YTN; PAM sequence: CTG
ttccctttccagacgaatct

SEQ ID NO: 185405 - DNA, 20 bp, Artificial Sequence
  Description of Artificial Sequence: Synthetic oligonucleotide
  Target: ATXN1; (-) strand; PAM type: YTN; PAM sequence: CTC
tgttccctttccagacgaat

SEQ ID NO: 185406 - DNA, 20 bp, Artificial Sequence
  Description of Artificial Sequence: Synthetic oligonucleotide
  Target: ATXN1; (-) strand; PAM type: YTN; PAM sequence: CTC
tctgttccctttccagacga

SEQ ID NO: 185407 - DNA, 20 bp, Artificial Sequence
  Description of Artificial Sequence: Synthetic oligonucleotide
  Target: ATXN1; (-) strand; PAM type: YTN; PAM sequence: CTG
gtcactctctgttccctttc

SEQ ID NO: 185408 - DNA, 20 bp, Artificial Sequence
  Description of Artificial Sequence: Synthetic oligonucleotide
  Target: ATXN1; (-) strand; PAM type: YTN; PAM sequence: TTC
agtggctggtcactctctgt

SEQ ID NO: 185409 - DNA, 20 bp, Artificial Sequence
  Description of Artificial Sequence: Synthetic oligonucleotide
  Target: ATXN1; (-) strand; PAM type: YTN; PAM sequence: TTT
cagtggctggtcactctctg

SEQ ID NO: 185410 - DNA, 20 bp, Artificial Sequence
  Description of Artificial Sequence: Synthetic oligonucleotide
  Target: ATXN1; (-) strand; PAM type: YTN; PAM sequence: CTT
tcagtggctggtcactctct

SEQ ID NO: 185411 - DNA, 20 bp, Artificial Sequence
  Description of Artificial Sequence: Synthetic oligonucleotide
  Target: ATXN1; (-) strand; PAM type: YTN; PAM sequence: CTG
tcctttcagtggctggtcac

SEQ ID NO: 185412 - DNA, 20 bp, Artificial Sequence
  Description of Artificial Sequence: Synthetic oligonucleotide
  Target: ATXN1; (-) strand; PAM type: YTN; PAM sequence: CTG
cctgtcctttcagtggctgg

SEQ ID NO: 185413 - DNA, 20 bp, Artificial Sequence
  Description of Artificial Sequence: Synthetic oligonucleotide
  Target: ATXN1; (-) strand; PAM type: YTN; PAM sequence: TTC
ctgcctgtcctttcagtggc

SEQ ID NO: 185414 - DNA, 20 bp, Artificial Sequence
  Description of Artificial Sequence: Synthetic oligonucleotide
  Target: ATXN1; (-) strand; PAM type: YTN; PAM sequence: TTC
cagtggttcctgcctgtcct

SEQ ID NO: 185415 - DNA, 20 bp, Artificial Sequence
  Description of Artificial Sequence: Synthetic oligonucleotide
  Target: ATXN1; (-) strand; PAM type: YTN; PAM sequence: TTT
ccagtggttcctgcctgtcc

SEQ ID NO: 185416 - DNA, 20 bp, Artificial Sequence
  Description of Artificial Sequence: Synthetic oligonucleotide
  Target: ATXN1; (-) strand; PAM type: YTN; PAM sequence: TTG
tttccagtggttcctgcctg

SEQ ID NO: 185417 - DNA, 20 bp, Artificial Sequence
  Description of Artificial Sequence: Synthetic oligonucleotide
  Target: ATXN1; (-) strand; PAM type: YTN; PAM sequence: TTT
gtttccagtggttcctgcct

SEQ ID NO: 185418 - DNA, 20 bp, Artificial Sequence
  Description of Artificial Sequence: Synthetic oligonucleotide
  Target: ATXN1; (-) strand; PAM type: YTN; PAM sequence: TTC
aaagtaggcgcagtttgttt

SEQ ID NO: 185419 - DNA, 20 bp, Artificial Sequence
  Description of Artificial Sequence: Synthetic oligonucleotide
  Target: ATXN1; (-) strand; PAM type: YTN; PAM sequence: TTT
caaagtaggcgcagtttgtt

SEQ ID NO: 185420 - DNA, 20 bp, Artificial Sequence
  Description of Artificial Sequence: Synthetic oligonucleotide
  Target: ATXN1; (-) strand; PAM type: YTN; PAM sequence: CTG
tgggggaaatttcaaagtag

SEQ ID NO: 185421 - DNA, 20 bp, Artificial Sequence
  Description of Artificial Sequence: Synthetic oligonucleotide
  Target: ATXN1; (-) strand; PAM type: YTN; PAM sequence: CTG
tgctgtgggggaaatttcaa

SEQ ID NO: 185422 - DNA, 20 bp, Artificial Sequence
  Description of Artificial Sequence: Synthetic oligonucleotide
  Target: ATXN1; (-) strand; PAM type: YTN; PAM sequence: TTG
tggcaaaaggtcatctgtgc

SEQ ID NO: 185423 - DNA, 20 bp, Artificial Sequence
  Description of Artificial Sequence: Synthetic oligonucleotide
  Target: ATXN1; (-) strand; PAM type: YTN; PAM sequence: CTT
gtggcaaaaggtcatctgtg

SEQ ID NO: 185424 - DNA, 20 bp, Artificial Sequence
  Description of Artificial Sequence: Synthetic oligonucleotide
  Target: ATXN1; (-) strand; PAM type: YTN; PAM sequence: TTG
tatgaaaacttgtggcaaaa

SEQ ID NO: 185425 - DNA, 20 bp, Artificial Sequence
  Description of Artificial Sequence: Synthetic oligonucleotide
  Target: ATXN1; (-) strand; PAM type: YTN; PAM sequence: CTT
gtatgaaaacttgtggcaaa

SEQ ID NO: 185426 - DNA, 20 bp, Artificial Sequence
  Description of Artificial Sequence: Synthetic oligonucleotide
  Target: ATXN1; (-) strand; PAM type: YTN; PAM sequence: TTG
gaatgagaaagcaaagcttg

SEQ ID NO: 185427 - DNA, 20 bp, Artificial Sequence
  Description of Artificial Sequence: Synthetic oligonucleotide
  Target: ATXN1; (-) strand; PAM type: YTN; PAM sequence: TTA
ttggaatgagaaagcaaagc

SEQ ID NO: 185428 - DNA, 20 bp, Artificial Sequence
  Description of Artificial Sequence: Synthetic oligonucleotide
  Target: ATXN1; (-) strand; PAM type: YTN; PAM sequence: TTC
agatagcagggagattattg

SEQ ID NO: 185429 - DNA, 20 bp, Artificial Sequence
  Description of Artificial Sequence: Synthetic oligonucleotide
  Target: ATXN1; (-) strand; PAM type: YTN; PAM sequence: TTT
cagatagcagggagattatt

SEQ ID NO: 185430 - DNA, 20 bp, Artificial Sequence
  Description of Artificial Sequence: Synthetic oligonucleotide
  Target: ATXN1; (-) strand; PAM type: YTN; PAM sequence: CTT
tcagatagcagggagattat

SEQ ID NO: 185431 - DNA, 20 bp, Artificial Sequence
  Description of Artificial Sequence: Synthetic oligonucleotide
  Target: ATXN1; (-) strand; PAM type: YTN; PAM sequence: TTG
ccagaagtctttcagatagc

SEQ ID NO: 185432 - DNA, 20 bp, Artificial Sequence
  Description of Artificial Sequence: Synthetic oligonucleotide
  Target: ATXN1; (-) strand; PAM type: YTN; PAM sequence: TTA
attgccagaagtctttcaga

SEQ ID NO: 185433 - DNA, 20 bp, Artificial Sequence
  Description of Artificial Sequence: Synthetic oligonucleotide
  Target: ATXN1; (-) strand; PAM type: YTN; PAM sequence: TTT
aattgccagaagtctttcag

SEQ ID NO: 185434 - DNA, 20 bp, Artificial Sequence
  Description of Artificial Sequence: Synthetic oligonucleotide
  Target: ATXN1; (-) strand; PAM type: YTN; PAM sequence: TTT
taattgccagaagtctttca

SEQ ID NO: 185435 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgtgtgtgtgtgtg

SEQ ID NO: 185436 - DNA, 20 bp, Artificial Sequence
  Description of Artificial Sequence: Synthetic oligonucleotide
  Target: ATXN1; (-) strand; PAM type: YTN; PAM sequence: TTG
aattgtgtgtgtgtgtgtgt

SEQ ID NO: 185437 - DNA, 20 bp, Artificial Sequence
  Description of Artificial Sequence: Synthetic oligonucleotide
  Target: ATXN1; (-) strand; PAM type: YTN; PAM sequence: TTT
gaattgtgtgtgtgtgtgtg

SEQ ID NO: 185438 - DNA, 20 bp, Artificial Sequence
  Description of Artificial Sequence: Synthetic oligonucleotide
  Target: ATXN1; (-) strand; PAM type: YTN; PAM sequence: TTT
tgaattgtgtgtgtgtgtgt

SEQ ID NO: 185439 - DNA, 20 bp, Artificial Sequence
  Description of Artificial Sequence: Synthetic oligonucleotide
  Target: ATXN1; (-) strand; PAM type: YTN; PAM sequence: TTC
aagttttgaattgtgtgtgt

SEQ ID NO: 185440 - DNA, 20 bp, Artificial Sequence
  Description of Artificial Sequence: Synthetic oligonucleotide
  Target: ATXN1; (-) strand; PAM type: YTN; PAM sequence: TTT
caagttttgaattgtgtgtg

SEQ ID NO: 185441 - DNA, 20 bp, Artificial Sequence
  Description of Artificial Sequence: Synthetic oligonucleotide
  Target: ATXN1; (-) strand; PAM type: YTN; PAM sequence: TTT
tcaagttttgaattgtgtgt

SEQ ID NO: 185442 - DNA, 20 bp, Artificial Sequence
  Description of Artificial Sequence: Synthetic oligonucleotide
  Target: ATXN1; (-) strand; PAM type: YTN; PAM sequence: CTT
ttcaagttttgaattgtgtg

SEQ ID NO: 185443 - DNA, 20 bp, Artificial Sequence
  Description of Artificial Sequence: Synthetic oligonucleotide
  Target: ATXN1; (-) strand; PAM type: YTN; PAM sequence: CTG
atgaagcccttttcaagttt

SEQ ID NO: 185444 - DNA, 20 bp, Artificial Sequence
  Description of Artificial Sequence: Synthetic oligonucleotide
  Target: ATXN1; (-) strand; PAM type: YTN; PAM sequence: TTC
tgatgaagcccttttcaagt

SEQ ID NO: 185445 - DNA, 20 bp, Artificial Sequence
  Description of Artificial Sequence: Synthetic oligonucleotide
  Target: ATXN1; (-) strand; PAM type: YTN; PAM sequence: CTT
ctgatgaagcccttttcaag

SEQ ID NO: 185446 - DNA, 20 bp, Artificial Sequence
  Description of Artificial Sequence: Synthetic oligonucleotide
  Target: ATXN1; (-) strand; PAM type: YTN; PAM sequence: TTC
atcttctgatgaagcccttt

SEQ ID NO: 185447 - DNA, 20 bp, Artificial Sequence
  Description of Artificial Sequence: Synthetic oligonucleotide
  Target: ATXN1; (-) strand; PAM type: YTN; PAM sequence: CTG
ttcatcttctgatgaagccc

SEQ ID NO: 185448 - DNA, 20 bp, Artificial Sequence
  Description of Artificial Sequence: Synthetic oligonucleotide
  Target: ATXN1; (-) strand; PAM type: YTN; PAM sequence: TTC
gcagaagacctgttcatctt

SEQ ID NO: 185449 - DNA, 20 bp, Artificial Sequence
  Description of Artificial Sequence: Synthetic oligonucleotide
  Target: ATXN1; (-) strand; PAM type: YTN; PAM sequence: TTT
cgcagaagacctgttcatct

SEQ ID NO: 185450 - DNA, 20 bp, Artificial Sequence
  Description of Artificial Sequence: Synthetic oligonucleotide
  Target: ATXN1; (-) strand; PAM type: YTN; PAM sequence: TTA
tttcgcagaagacctgttca

SEQ ID NO: 185451 - DNA, 20 bp, Artificial Sequence
  Description of Artificial Sequence: Synthetic oligonucleotide
  Target: ATXN1; (-) strand; PAM type: YTN; PAM sequence: TTG
ggaattatttcgcagaagac

SEQ ID NO: 185452 - DNA, 20 bp, Artificial Sequence
  Description of Artificial Sequence: Synthetic oligonucleotide
  Target: ATXN1; (-) strand; PAM type: YTN; PAM sequence: TTG
tgatggttgggaattatttc

SEQ ID NO: 185453 - DNA, 20 bp, Artificial Sequence
  Description of Artificial Sequence: Synthetic oligonucleotide
  Target: ATXN1; (-) strand; PAM type: YTN; PAM sequence: TTA
cattgtgatggttgggaatt

SEQ ID NO: 185454 - DNA, 20 bp, Artificial Sequence
  Description of Artificial Sequence: Synthetic oligonucleotide
  Target: ATXN1; (-) strand; PAM type: YTN; PAM sequence: CTT
acattgtgatggttgggaat

SEQ ID NO: 185455 - DNA, 20 bp, Artificial Sequence
  Description of Artificial Sequence: Synthetic oligonucleotide
  Target: ATXN1; (-) strand; PAM type: YTN; PAM sequence: TTA
acttacattgtgatggttgg

SEQ ID NO: 185456 - DNA, 20 bp, Artificial Sequence
  Description of Artificial Sequence: Synthetic oligonucleotide
  Target: ATXN1; (-) strand; PAM type: YTN; PAM sequence: CTG
tgattaacttacattgtgat

SEQ ID NO: 185457 - DNA, 20 bp, Artificial Sequence
  Description of Artificial Sequence: Synthetic oligonucleotide
  Target: ATXN1; (-) strand; PAM type: YTN; PAM sequence: TTC
ctgtgattaacttacattgt

SEQ ID NO: 185458 - DNA, 20 bp, Artificial Sequence
  Description of Artificial Sequence: Synthetic oligonucleotide
  Target: ATXN1; (-) strand; PAM type: YTN; PAM sequence: CTT
cctgtgattaacttacattg

SEQ ID NO: 185459 - DNA, 20 bp, Artificial Sequence
  Description of Artificial Sequence: Synthetic oligonucleotide
  Target: ATXN1; (-) strand; PAM type: YTN; PAM sequence: TTA
cttcctgtgattaacttaca

SEQ ID NO: 185460 - DNA, 20 bp, Artificial Sequence
  Description of Artificial Sequence: Synthetic oligonucleotide
  Target: ATXN1; (-) strand; PAM type: YTN; PAM sequence: TTC
aaaattacttcctgtgatta

SEQ ID NO: 185461 - DNA, 20 bp, Artificial Sequence
  Description of Artificial Sequence: Synthetic oligonucleotide
  Target: ATXN1; (-) strand; PAM type: YTN; PAM sequence: CTG
aaaattcaaaattacttcct

SEQ ID NO: 185462 - DNA, 20 bp, Artificial Sequence
  Description of Artificial Sequence: Synthetic oligonucleotide
  Target: ATXN1; (-) strand; PAM type: YTN; PAM sequence: TTC
aggatgacactgaaaattca

SEQ ID NO: 185463 - DNA, 20 bp, Artificial Sequence
  Description of Artificial Sequence: Synthetic oligonucleotide
  Target: ATXN1; (-) strand; PAM type: YTN; PAM sequence: TTT
caggatgacactgaaaattc

SEQ ID NO: 185464 - DNA, 20 bp, Artificial Sequence
  Description of Artificial Sequence: Synthetic oligonucleotide
  Target: ATXN1; (-) strand; PAM type: YTN; PAM sequence: TTC
agtttcaggatgacactgaa

SEQ ID NO: 185465 - DNA, 20 bp, Artificial Sequence
  Description of Artificial Sequence: Synthetic oligonucleotide
  Target: ATXN1; (-) strand; PAM type: YTN; PAM sequence: CTA
accatagttcagtttcagga

SEQ ID NO: 185466 - DNA, 20 bp, Artificial Sequence
  Description of Artificial Sequence: Synthetic oligonucleotide
  Target: ATXN1; (-) strand; PAM type: YTN; PAM sequence: TTA
ctaaccatagttcagtttca

SEQ ID NO: 185467 - DNA, 20 bp, Artificial Sequence
  Description of Artificial Sequence: Synthetic oligonucleotide
  Target: ATXN1; (-) strand; PAM type: YTN; PAM sequence: CTC
aaattactaaccatagttca

SEQ ID NO: 185468 - DNA, 20 bp, Artificial Sequence
  Description of Artificial Sequence: Synthetic oligonucleotide
  Target: ATXN1; (-) strand; PAM type: YTN; PAM sequence: CTC
aatctcaaattactaaccat

SEQ ID NO: 185469 - DNA, 20 bp, Artificial Sequence
  Description of Artificial Sequence: Synthetic oligonucleotide
  Target: ATXN1; (-) strand; PAM type: YTN; PAM sequence: TTC
atctcaatctcaaattacta

SEQ ID NO: 185470 - DNA, 20 bp, Artificial Sequence
  Description of Artificial Sequence: Synthetic oligonucleotide
  Target: ATXN1; (-) strand; PAM type: YTN; PAM sequence: TTC
gttcatctcaatctcaaatt

SEQ ID NO: 185471 - DNA, 20 bp, Artificial Sequence
  Description of Artificial Sequence: Synthetic oligonucleotide
  Target: ATXN1; (-) strand; PAM type: YTN; PAM sequence: CTT
cgttcatctcaatctcaaat

SEQ ID NO: 185472 - DNA, 20 bp, Artificial Sequence
  Description of Artificial Sequence: Synthetic oligonucleotide
  Target: ATXN1; (-) strand; PAM type: YTN; PAM sequence: TTA
cttcgttcatctcaatctca

SEQ ID NO: 185473 - DNA, 20 bp, Artificial Sequence
  Description of Artificial Sequence: Synthetic oligonucleotide
  Target: ATXN1; (-) strand; PAM type: YTN; PAM sequence: TTT
acttcgttcatctcaatctc

SEQ ID NO: 185474 - DNA, 20 bp, Artificial Sequence
  Description of Artificial Sequence: Synthetic oligonucleotide
  Target: ATXN1; (-) strand; PAM type: YTN; PAM sequence: CTC
catttacttcgttcatctca

SEQ ID NO: 185475 - DNA, 20 bp, Artificial Sequence
  Description of Artificial Sequence: Synthetic oligonucleotide
  Target: ATXN1; (-) strand; PAM type: YTN; PAM sequence: CTA
aggcatctccatttacttcg

SEQ ID NO: 185476 - DNA, 20 bp, Artificial Sequence
  Description of Artificial Sequence: Synthetic oligonucleotide
  Target: ATXN1; (-) strand; PAM type: YTN; PAM sequence: CTC
taaggcatctccatttactt

SEQ ID NO: 185477 - DNA, 20 bp, Artificial Sequence
  Description of Artificial Sequence: Synthetic oligonucleotide
  Target: ATXN1; (-) strand; PAM type: YTN; PAM sequence: CTC
aggaatgccgagctctaagg

SEQ ID NO: 185478 - DNA, 20 bp, Artificial Sequence
  Description of Artificial Sequence: Synthetic oligonucleotide
  Target: ATXN1; (-) strand; PAM type: YTN; PAM sequence: TTG
cagcaaactcaggaatgccg

SEQ ID NO: 185479 - DNA, 20 bp, Artificial Sequence
  Description of Artificial Sequence: Synthetic oligonucleotide
  Target: ATXN1; (-) strand; PAM type: YTN; PAM sequence: CTC
attgcagcaaactcaggaat

SEQ ID NO: 185480 - DNA, 20 bp, Artificial Sequence
  Description of Artificial Sequence: Synthetic oligonucleotide
  Target: ATXN1; (-) strand; PAM type: YTN; PAM sequence: CTA
ctcattgcagcaaactcagg

SEQ ID NO: 185481 - DNA, 20 bp, Artificial Sequence
  Description of Artificial Sequence: Synthetic oligonucleotide
  Target: ATXN1; (-) strand; PAM type: YTN; PAM sequence: TTA
actactcattgcagcaaact

SEQ ID NO: 185482 - DNA, 20 bp, Artificial Sequence
  Description of Artificial Sequence: Synthetic oligonucleotide
  Target: ATXN1; (-) strand; PAM type: YTN; PAM sequence: CTT
aactactcattgcagcaaac

SEQ ID NO: 185483 - DNA, 20 bp, Artificial Sequence
  Description of Artificial Sequence: Synthetic oligonucleotide
  Target: ATXN1; (-) strand; PAM type: YTN; PAM sequence: TTC
aaacttaactactcattgca

SEQ ID NO: 185484 - DNA, 20 bp, Artificial Sequence
  Description of Artificial Sequence: Synthetic oligonucleotide
  Target: ATXN1; (-) strand; PAM type: YTN; PAM sequence: CTT
caaacttaactactcattgc

SEQ ID NO: 185485 - DNA, 20 bp, Artificial Sequence
  Description of Artificial Sequence: Synthetic oligonucleotide
  Target: ATXN1; (-) strand; PAM type: YTN; PAM sequence: TTC
ttcaaacttaactactcatt

SEQ ID NO: 185486 - DNA, 20 bp, Artificial Sequence
  Description of Artificial Sequence: Synthetic oligonucleotide
  Target: ATXN1; (-) strand; PAM type: YTN; PAM sequence: CTA
gattcttcaaacttaactac

SEQ ID NO: 185487 - DNA, 20 bp, Artificial Sequence
  Description of Artificial Sequence: Synthetic oligonucleotide
  Target: ATXN1; (-) strand; PAM type: YTN; PAM sequence: TTC
acatatctagattcttcaaa

SEQ ID NO: 185488 - DNA, 20 bp, Artificial Sequence
  Description of Artificial Sequence: Synthetic oligonucleotide
  Target: ATXN1; (-) strand; PAM type: YTN; PAM sequence: TTA
catcattcacatatctagat

SEQ ID NO: 185489 - DNA, 20 bp, Artificial Sequence
  Description of Artificial Sequence: Synthetic oligonucleotide
  Target: ATXN1; (-) strand; PAM type: YTN; PAM sequence: CTA
ttacatcattcacatatcta

SEQ ID NO: 185490 - DNA, 20 bp, Artificial Sequence
  Description of Artificial Sequence: Synthetic oligonucleotide
  Target: ATXN1; (-) strand; PAM type: YTN; PAM sequence: TTA
tctattacatcattcacata

SEQ ID NO: 185491 - DNA, 20 bp, Artificial Sequence
  Description of Artificial Sequence: Synthetic oligonucleotide
  Target: ATXN1; (-) strand; PAM type: YTN; PAM sequence: CTT
atctattacatcattcacat

SEQ ID NO: 185492 - DNA, 20 bp, Artificial Sequence
  Description of Artificial Sequence: Synthetic oligonucleotide
  Target: ATXN1; (-) strand; PAM type: YTN; PAM sequence: CTG
ccttatctattacatcattc

SEQ ID NO: 185493 - DNA, 20 bp, Artificial Sequence
  Description of Artificial Sequence: Synthetic oligonucleotide
  Target: ATXN1; (-) strand; PAM type: YTN; PAM sequence: CTG
tctgccttatctattacatc

SEQ ID NO: 185494 - DNA, 20 bp, Artificial Sequence
  Description of Artificial Sequence: Synthetic oligonucleotide
  Target: ATXN1; (-) strand; PAM type: YTN; PAM sequence: CTG
atccaatctgtctgccttat

SEQ ID NO: 185495 - DNA, 20 bp, Artificial Sequence
  Description of Artificial Sequence: Synthetic oligonucleotide
  Target: ATXN1; (-) strand; PAM type: YTN; PAM sequence: CTC
tgatccaatctgtctgcctt

SEQ ID NO: 185496 - DNA, 20 bp, Artificial Sequence
  Description of Artificial Sequence: Synthetic oligonucleotide
  Target: ATXN1; (-) strand; PAM type: YTN; PAM sequence: TTA
aaacccctctgatccaatct

SEQ ID NO: 185497 - DNA, 20 bp, Artificial Sequence
  Description of Artificial Sequence: Synthetic oligonucleotide
  Target: ATXN1; (-) strand; PAM type: YTN; PAM sequence: TTA
atattaaaacccctctgatc

SEQ ID NO: 185498 - DNA, 20 bp, Artificial Sequence
  Description of Artificial Sequence: Synthetic oligonucleotide
  Target: ATXN1; (-) strand; PAM type: YTN; PAM sequence: CTT
aatattaaaacccctctgat

SEQ ID NO: 185499 - DNA, 20 bp, Artificial Sequence
  Description of Artificial Sequence: Synthetic oligonucleotide
  Target: ATXN1; (-) strand; PAM type: YTN; PAM sequence: TTA
tcttaatattaaaacccctc

SEQ ID NO: 185500 - DNA, 20 bp, Artificial Sequence
  Description of Artificial Sequence: Synthetic oligonucleotide
  Target: ATXN1; (-) strand; PAM type: YTN; PAM sequence: CTT
atcttaatattaaaacccct

SEQ ID NO: 185501 - DNA, 20 bp, Artificial Sequence
  Description of Artificial Sequence: Synthetic oligonucleotide
  Target: ATXN1; (-) strand; PAM type: YTN; PAM sequence: TTG
tcacttatcttaatattaaa

SEQ ID NO: 185502 - DNA, 20 bp, Artificial Sequence
  Description of Artificial Sequence: Synthetic oligonucleotide
  Target: ATXN1; (-) strand; PAM type: YTN; PAM sequence: CTA
tcattgtcacttatcttaat

SEQ ID NO: 185503 - DNA, 20 bp, Artificial Sequence
  Description of Artificial Sequence: Synthetic oligonucleotide
  Target: ATXN1; (-) strand; PAM type: YTN; PAM sequence: CTG
tgagctatcattgtcactta

SEQ ID NO: 185504 - DNA, 20 bp, Artificial Sequence
  Description of Artificial Sequence: Synthetic oligonucleotide
  Target: ATXN1; (-) strand; PAM type: YTN; PAM sequence: CTA
tgatataggcataaggtcat

SEQ ID NO: 185505 - DNA, 20 bp, Artificial Sequence
  Description of Artificial Sequence: Synthetic oligonucleotide
  Target: ATXN1; (-) strand; PAM type: YTN; PAM sequence: CTC
tatgatataggcataaggtc

SEQ ID NO: 185506 - DNA, 20 bp, Artificial Sequence
  Description of Artificial Sequence: Synthetic oligonucleotide
  Target: ATXN1; (-) strand; PAM type: YTN; PAM sequence: CTA
gtgtcactctatgatatagg

SEQ ID NO: 185507 - DNA, 20 bp, Artificial Sequence
  Description of Artificial Sequence: Synthetic oligonucleotide
  Target: ATXN1; (-) strand; PAM type: YTN; PAM sequence: CTG
tctagtgtcactctatgata

SEQ ID NO: 185508 - DNA, 20 bp, Artificial Sequence
  Description of Artificial Sequence: Synthetic oligonucleotide
  Target: ATXN1; (-) strand; PAM type: YTN; PAM sequence: CTG
gctgtctagtgtcactctat

SEQ ID NO: 185509 - DNA, 20 bp, Artificial Sequence
  Description of Artificial Sequence: Synthetic oligonucleotide
  Target: ATXN1; (-) strand; PAM type: YTN; PAM sequence: TTC
actggctgtctagtgtcact

SEQ ID NO: 185510 - DNA, 20 bp, Artificial Sequence
  Description of Artificial Sequence: Synthetic oligonucleotide
  Target: ATXN1; (-) strand; PAM type: YTN; PAM sequence: TTT
cactggctgtctagtgtcac

SEQ ID NO: 185511 - DNA, 20 bp, Artificial Sequence
  Description of Artificial Sequence: Synthetic oligonucleotide
  Target: ATXN1; (-) strand; PAM type: YTN; PAM sequence: TTG
catttcactggctgtctagt

SEQ ID NO: 185512 - DNA, 20 bp, Artificial Sequence
  Description of Artificial Sequence: Synthetic oligonucleotide
  Target: ATXN1; (-) strand; PAM type: YTN; PAM sequence: TTT
gcatttcactggctgtctag

SEQ ID NO: 185513 - DNA, 20 bp, Artificial Sequence
  Description of Artificial Sequence: Synthetic oligonucleotide
  Target: ATXN1; (-) strand; PAM type: YTN; PAM sequence: CTT
tgcatttcactggctgtcta

SEQ ID NO: 185514 - DNA, 20 bp, Artificial Sequence
  Description of Artificial Sequence: Synthetic oligonucleotide
  Target: ATXN1; (-) strand; PAM type: YTN; PAM sequence: CTG
ctttgcatttcactggctgt

SEQ ID NO: 185515 - DNA, 20 bp, Artificial Sequence
  Description of Artificial Sequence: Synthetic oligonucleotide
  Target: ATXN1; (-) strand; PAM type: YTN; PAM sequence: CTA
atccagggcacatggctgct

SEQ ID NO: 185516 - DNA, 20 bp, Artificial Sequence
  Description of Artificial Sequence: Synthetic oligonucleotide
  Target: ATXN1; (-) strand; PAM type: YTN; PAM sequence: CTA
cagagaggtgcgaatctaat

SEQ ID NO: 185517 - DNA, 20 bp, Artificial Sequence
  Description of Artificial Sequence: Synthetic oligonucleotide
  Target: ATXN1; (-) strand; PAM type: YTN; PAM sequence: CTG
cccagctacagagaggtgcg

SEQ ID NO: 185518 - DNA, 20 bp, Artificial Sequence
  Description of Artificial Sequence: Synthetic oligonucleotide
  Target: ATXN1; (-) strand; PAM type: YTN; PAM sequence: CTG
aaagctgcccagctacagag

SEQ ID NO: 185519 - DNA, 20 bp, Artificial Sequence
  Description of Artificial Sequence: Synthetic oligonucleotide
  Target: ATXN1; (-) strand; PAM type: YTN; PAM sequence: CTA
ctgaaagctgcccagctaca

SEQ ID NO: 185520 - DNA, 20 bp, Artificial Sequence
  Description of Artificial Sequence: Synthetic oligonucleotide
  Target: ATXN1; (-) strand; PAM type: YTN; PAM sequence: CTC
tactgaaagctgcccagcta

SEQ ID NO: 185521 - DNA, 20 bp, Artificial Sequence
  Description of Artificial Sequence: Synthetic oligonucleotide
  Target: ATXN1; (-) strand; PAM type: YTN; PAM sequence: CTG
acatgctctactgaaagctg

SEQ ID NO: 185522 - DNA, 20 bp, Artificial Sequence
  Description of Artificial Sequence: Synthetic oligonucleotide
  Target: ATXN1; (-) strand; PAM type: YTN; PAM sequence: CTC
ctgacatgctctactgaaag

SEQ ID NO: 185523 - DNA, 20 bp, Artificial Sequence
  Description of Artificial Sequence: Synthetic oligonucleotide
  Target: ATXN1; (-) strand; PAM type: YTN; PAM sequence: CTC
acacacacacacacacacac

SEQ ID NO: 185524 - DNA, 20 bp, Artificial Sequence
  Description of Artificial Sequence: Synthetic oligonucleotide
  Target: ATXN1; (-) strand; PAM type: YTN; PAM sequence: CTG
tctcacacacacacacacac

SEQ ID NO: 185525 - DNA, 20 bp, Artificial Sequence
  Description of Artificial Sequence: Synthetic oligonucleotide
  Target: ATXN1; (-) strand; PAM type: YTN; PAM sequence: TTC
tgtctcacacacacacacac

SEQ ID NO: 185526 - DNA, 20 bp, Artificial Sequence
  Description of Artificial Sequence: Synthetic oligonucleotide
  Target: ATXN1; (-) strand; PAM type: YTN; PAM sequence: TTT
ctgtctcacacacacacaca

SEQ ID NO: 185527 - DNA, 20 bp, Artificial Sequence
  Description of Artificial Sequence: Synthetic oligonucleotide
  Target: ATXN1; (-) strand; PAM type: YTN; PAM sequence: CTT
tctgtctcacacacacacac

SEQ ID NO: 185528 - DNA, 20 bp, Artificial Sequence
  Description of Artificial Sequence: Synthetic oligonucleotide
  Target: ATXN1; (-) strand; PAM type: YTN; PAM sequence: CTC
tttctgtctcacacacacac

SEQ ID NO: 185529 - DNA, 20 bp, Artificial Sequence
  Description of Artificial Sequence: Synthetic oligonucleotide
  Target: ATXN1; (-) strand; PAM type: YTN; PAM sequence: CTC
tctttctgtctcacacacac

SEQ ID NO: 185530 - DNA, 20 bp, Artificial Sequence
  Description of Artificial Sequence: Synthetic oligonucleotide
  Target: ATXN1; (-) strand; PAM type: YTN; PAM sequence: CTC
tctctttctgtctcacacac

SEQ ID NO: 185531 - DNA, 20 bp, Artificial Sequence
  Description of Artificial Sequence: Synthetic oligonucleotide
  Target: ATXN1; (-) strand; PAM type: YTN; PAM sequence: CTC
tctctctttctgtctcacac

SEQ ID NO: 185532 - DNA, 20 bp, Artificial Sequence
  Description of Artificial Sequence: Synthetic oligonucleotide
  Target: ATXN1; (-) strand; PAM type: YTN; PAM sequence: TTA
caatgacagactctctctct

SEQ ID NO: 185533 - DNA, 20 bp, Artificial Sequence
  Description of Artificial Sequence: Synthetic oligonucleotide
  Target: ATXN1; (-) strand; PAM type: YTN; PAM sequence: CTG
tatattacaatgacagactc

SEQ ID NO: 185534 - DNA, 20 bp, Artificial Sequence
  Description of Artificial Sequence: Synthetic oligonucleotide
  Target: ATXN1; (-) strand; PAM type: YTN; PAM sequence: CTC
cctgtatattacaatgacag

SEQ ID NO: 185535 - DNA, 20 bp, Artificial Sequence
  Description of Artificial Sequence: Synthetic oligonucleotide
  Target: ATXN1; (-) strand; PAM type: YTN; PAM sequence: TTA
tgtaaactccctgtatatta

SEQ ID NO: 185536 - DNA, 20 bp, Artificial Sequence
  Description of Artificial Sequence: Synthetic oligonucleotide
  Target: ATXN1; (-) strand; PAM type: YTN; PAM sequence: CTT
atgtaaactccctgtatatt

SEQ ID NO: 185537 - DNA, 20 bp, Artificial Sequence
  Description of Artificial Sequence: Synthetic oligonucleotide
  Target: ATXN1; (-) strand; PAM type: YTN; PAM sequence: CTC
ttatgtaaactccctgtata

SEQ ID NO: 185538 - DNA, 20 bp, Artificial Sequence
  Description of Artificial Sequence: Synthetic oligonucleotide
  Target: ATXN1; (-) strand; PAM type: YTN; PAM sequence: TTC
tcttatgtaaactccctgta

SEQ ID NO: 185539 - DNA, 20 bp, Artificial Sequence
  Description of Artificial Sequence: Synthetic oligonucleotide
  Target: ATXN1; (-) strand; PAM type: YTN; PAM sequence: CTT
ctcttatgtaaactccctgt

SEQ ID NO: 185540 - DNA, 20 bp, Artificial Sequence
  Description of Artificial Sequence: Synthetic oligonucleotide
  Target: ATXN1; (-) strand; PAM type: YTN; PAM sequence: TTC
caaccttctcttatgtaaac

SEQ ID NO: 185541 - DNA, 20 bp, Artificial Sequence
  Description of Artificial Sequence: Synthetic oligonucleotide
  Target: ATXN1; (-) strand; PAM type: YTN; PAM sequence: CTT
ccaaccttctcttatgtaaa

SEQ ID NO: 185542 - DNA, 20 bp, Artificial Sequence
  Description of Artificial Sequence: Synthetic oligonucleotide
  Target: ATXN1; (-) strand; PAM type: YTN; PAM sequence: CTC
ttccaaccttctcttatgta

SEQ ID NO: 185543 - DNA, 20 bp, Artificial Sequence
  Description of Artificial Sequence: Synthetic oligonucleotide
  Target: ATXN1; (-) strand; PAM type: YTN; PAM sequence: TTG
ctcttccaaccttctcttat

SEQ ID NO: 185544 - DNA, 20 bp, Artificial Sequence
  Description of Artificial Sequence: Synthetic oligonucleotide
  Target: ATXN1; (-) strand; PAM type: YTN; PAM sequence: TTG
ttgctcttccaaccttctct

SEQ ID NO: 185545 - DNA, 20 bp, Artificial Sequence
  Description of Artificial Sequence: Synthetic oligonucleotide
  Target: ATXN1; (-) strand; PAM type: YTN; PAM sequence: TTG
ttgttgctcttccaaccttc

SEQ ID NO: 185546 - DNA, 20 bp, Artificial Sequence
  Description of Artificial Sequence: Synthetic oligonucleotide
  Target: ATXN1; (-) strand; PAM type: YTN; PAM sequence: TTC
aaattgttgttgctcttcca

SEQ ID NO: 185547 - DNA, 20 bp, Artificial Sequence
  Description of Artificial Sequence: Synthetic oligonucleotide
  Target: ATXN1; (-) strand; PAM type: YTN; PAM sequence: TTA
attcaaattgttgttgctct

SEQ ID NO: 185548 - DNA, 20 bp, Artificial Sequence
  Description of Artificial Sequence: Synthetic oligonucleotide
  Target: ATXN1; (-) strand; PAM type: YTN; PAM sequence: CTT
aattcaaattgttgttgctc

SEQ ID NO: 185549 - DNA, 20 bp, Artificial Sequence
  Description of Artificial Sequence: Synthetic oligonucleotide
  Target: ATXN1; (-) strand; PAM type: YTN; PAM sequence: CTA
ccttaattcaaattgttgtt

SEQ ID NO: 185550 - DNA, 20 bp, Artificial Sequence
  Description of Artificial Sequence: Synthetic oligonucleotide
  Target: ATXN1; (-) strand; PAM type: YTN; PAM sequence: TTA
taaagaaaaataggctacct

SEQ ID NO: 185551 - DNA, 20 bp, Artificial Sequence
  Description of Artificial Sequence: Synthetic oligonucleotide
  Target: ATXN1; (-) strand; PAM type: YTN; PAM sequence: CTT
ataaagaaaaataggctacc

SEQ ID NO: 185552 - DNA, 20 bp, Artificial Sequence
  Description of Artificial Sequence: Synthetic oligonucleotide
  Target: ATXN1; (-) strand; PAM type: YTN; PAM sequence: TTC
cgagtgtcttataaagaaaa

SEQ ID NO: 185553 - DNA, 20 bp, Artificial Sequence
  Description of Artificial Sequence: Synthetic oligonucleotide
  Target: ATXN1; (-) strand; PAM type: YTN; PAM sequence: TTA
ggtattccgagtgtcttata

SEQ ID NO: 185554 - DNA, 20 bp, Artificial Sequence
  Description of Artificial Sequence: Synthetic oligonucleotide
  Target: ATXN1; (-) strand; PAM type: YTN; PAM sequence: CTG
ttaggtattccgagtgtctt

SEQ ID NO: 185555 - DNA, 20 bp, Artificial Sequence
  Description of Artificial Sequence: Synthetic oligonucleotide
  Target: ATXN1; (-) strand; PAM type: YTN; PAM sequence: TTA
aggcctgttaggtattccga

SEQ ID NO: 185556 - DNA, 20 bp, Artificial Sequence
  Description of Artificial Sequence: Synthetic oligonucleotide
  Target: ATXN1; (-) strand; PAM type: YTN; PAM sequence: TTG
atgaagttaaggcctgttag

SEQ ID NO: 185557 - DNA, 20 bp, Artificial Sequence
  Description of Artificial Sequence: Synthetic oligonucleotide
  Target: ATXN1; (-) strand; PAM type: YTN; PAM sequence: CTG
acagatggtgcggagattga

SEQ ID NO: 185558 - DNA, 20 bp, Artificial Sequence
  Description of Artificial Sequence: Synthetic oligonucleotide
  Target: ATXN1; (-) strand; PAM type: YTN; PAM sequence: CTA
aggtctgacagatggtgcgg

SEQ ID NO: 185559 - DNA, 20 bp, Artificial Sequence
  Description of Artificial Sequence: Synthetic oligonucleotide
  Target: ATXN1; (-) strand; PAM type: YTN; PAM sequence: CTG
taacctaaggtctgacagat

SEQ ID NO: 185560 - DNA, 20 bp, Artificial Sequence
  Description of Artificial Sequence: Synthetic oligonucleotide
  Target: ATXN1; (-) strand; PAM type: YTN; PAM sequence: TTA
atgcatgggggtggtcactg

SEQ ID NO: 185561 - DNA, 20 bp, Artificial Sequence
  Description of Artificial Sequence: Synthetic oligonucleotide
  Target: ATXN1; (-) strand; PAM type: YTN; PAM sequence: TTG
attaatgcatgggggtggtc

SEQ ID NO: 185562 - DNA, 20 bp, Artificial Sequence
  Description of Artificial Sequence: Synthetic oligonucleotide
  Target: ATXN1; (-) strand; PAM type: YTN; PAM sequence: CTT
gattaatgcatgggggtggt

SEQ ID NO: 185563 - DNA, 20 bp, Artificial Sequence
  Description of Artificial Sequence: Synthetic oligonucleotide
  Target: ATXN1; (-) strand; PAM type: YTN; PAM sequence: TTC
ttgattaatgcatgggggtg

SEQ ID NO: 185564 - DNA, 20 bp, Artificial Sequence
  Description of Artificial Sequence: Synthetic oligonucleotide
  Target: ATXN1; (-) strand; PAM type: YTN; PAM sequence: CTT
cttgattaatgcatgggggt

SEQ ID NO: 185565 - DNA, 20 bp, Artificial Sequence
  Description of Artificial Sequence: Synthetic oligonucleotide
  Target: ATXN1; (-) strand; PAM type: YTN; PAM sequence: CTC
ttcttgattaatgcatgggg

SEQ ID NO: 185566 - DNA, 20 bp, Artificial Sequence
  Description of Artificial Sequence: Synthetic oligonucleotide
  Target: ATXN1; (-) strand; PAM type: YTN; PAM sequence: TTG
cctcttcttgattaatgcat

SEQ ID NO: 185567 - DNA, 20 bp, Artificial Sequence
  Description of Artificial Sequence: Synthetic oligonucleotide
  Target: ATXN1; (-) strand; PAM type: YTN; PAM sequence: TTG
gttgcctcttcttgattaat

SEQ ID NO: 185568 - DNA, 20 bp, Artificial Sequence
  Description of Artificial Sequence: Synthetic oligonucleotide
  Target: ATXN1; (-) strand; PAM type: YTN; PAM sequence: CTT
ggttgcctcttcttgattaa

SEQ ID NO: 185569 - DNA, 20 bp, Artificial Sequence
  Description of Artificial Sequence: Synthetic oligonucleotide
  Target: ATXN1; (-) strand; PAM type: YTN; PAM sequence: CTA
cacacttggttgcctcttct

SEQ ID NO: 185570 - DNA, 20 bp, Artificial Sequence
  Description of Artificial Sequence: Synthetic oligonucleotide
  Target: ATXN1; (-) strand; PAM type: YTN; PAM sequence: CTC
aaagctacacacttggttgc

SEQ ID NO: 185571 - DNA, 20 bp, Artificial Sequence
  Description of Artificial Sequence: Synthetic oligonucleotide
  Target: ATXN1; (-) strand; PAM type: YTN; PAM sequence: TTC
tcaaagctacacacttggtt

SEQ ID NO: 185572 - DNA, 20 bp, Artificial Sequence
  Description of Artificial Sequence: Synthetic oligonucleotide
  Target: ATXN1; (-) strand; PAM type: YTN; PAM sequence: TTT
ctcaaagctacacacttggt

SEQ ID NO: 185573 - DNA, 20 bp, Artificial Sequence
  Description of Artificial Sequence: Synthetic oligonucleotide
  Target: ATXN1; (-) strand; PAM type: YTN; PAM sequence: TTT
tctcaaagctacacacttgg

SEQ ID NO: 185574 - DNA, 20 bp, Artificial Sequence
  Description of Artificial Sequence: Synthetic oligonucleotide
  Target: ATXN1; (-) strand; PAM type: YTN; PAM sequence: CTT
ttctcaaagctacacacttg

SEQ ID NO: 185575 - DNA, 20 bp, Artificial Sequence
  Description of Artificial Sequence: Synthetic oligonucleotide
  Target: ATXN1; (-) strand; PAM type: YTN; PAM sequence: CTG
aaagagcagaacttttctca

SEQ ID NO: 185576 - DNA, 20 bp, Artificial Sequence
  Description of Artificial Sequence: Synthetic oligonucleotide
  Target: ATXN1; (-) strand; PAM type: YTN; PAM sequence: TTA
ataatacagtcaagtctgaa

SEQ ID NO: 185577 - DNA, 20 bp, Artificial Sequence
  Description of Artificial Sequence: Synthetic oligonucleotide
  Target: ATXN1; (-) strand; PAM type: YTN; PAM sequence: TTT
aataatacagtcaagtctga

SEQ ID NO: 185578 - DNA, 20 bp, Artificial Sequence
  Description of Artificial Sequence: Synthetic oligonucleotide
  Target: ATXN1; (-) strand; PAM type: YTN; PAM sequence: TTT
taataatacagtcaagtctg

SEQ ID NO: 185579 - DNA, 20 bp, Artificial Sequence
  Description of Artificial Sequence: Synthetic oligonucleotide
  Target: ATXN1; (-) strand; PAM type: YTN; PAM sequence: TTA
gaaattttaataatacagtc

SEQ ID NO: 185580 - DNA, 20 bp, Artificial Sequence
  Description of Artificial Sequence: Synthetic oligonucleotide
  Target: ATXN1; (-) strand; PAM type: YTN; PAM sequence: TTT
agaaattttaataatacagt

SEQ ID NO: 185581 - DNA, 20 bp, Artificial Sequence
  Description of Artificial Sequence: Synthetic oligonucleotide
  Target: ATXN1; (-) strand; PAM type: YTN; PAM sequence: TTT
tagaaattttaataatacag

SEQ ID NO: 185582 - DNA, 20 bp, Artificial Sequence
  Description of Artificial Sequence: Synthetic oligonucleotide
  Target: ATXN1; (-) strand; PAM type: YTN; PAM sequence: TTT
ttagaaattttaataataca

SEQ ID NO: 185583 - DNA, 20 bp, Artificial Sequence
  Description of Artificial Sequence: Synthetic oligonucleotide
  Target: ATXN1; (-) strand; PAM type: YTN; PAM sequence: CTT
tttagaaattttaataatac

SEQ ID NO: 185584 - DNA, 20 bp, Artificial Sequence
  Description of Artificial Sequence: Synthetic oligonucleotide
  Target: ATXN1; (-) strand; PAM type: YTN; PAM sequence: TTA
cctttttagaaattttaata

SEQ ID NO: 185585 - DNA, 20 bp, Artificial Sequence
  Description of Artificial Sequence: Synthetic oligonucleotide
  Target: ATXN1; (-) strand; PAM type: YTN; PAM sequence: TTT
acctttttagaaattttaat

SEQ ID NO: 185586 - DNA, 20 bp, Artificial Sequence
  Description of Artificial Sequence: Synthetic oligonucleotide
  Target: ATXN1; (-) strand; PAM type: YTN; PAM sequence: TTG
tttacctttttagaaatttt

SEQ ID NO: 185587 - DNA, 20 bp, Artificial Sequence
  Description of Artificial Sequence: Synthetic oligonucleotide
  Target: ATXN1; (-) strand; PAM type: YTN; PAM sequence: CTG
ttgtttacctttttagaaat

SEQ ID NO: 185588 - DNA, 20 bp, Artificial Sequence
  Description of Artificial Sequence: Synthetic oligonucleotide
  Target: ATXN1; (-) strand; PAM type: YTN; PAM sequence: CTC
ctgttgtttacctttttaga

SEQ ID NO: 185589 - DNA, 20 bp, Artificial Sequence
  Description of Artificial Sequence: Synthetic oligonucleotide
  Target: ATXN1; (-) strand; PAM type: YTN; PAM sequence: TTA
aaaccacctcctgttgttta

SEQ ID NO: 185590 - DNA, 20 bp, Artificial Sequence
  Description of Artificial Sequence: Synthetic oligonucleotide
  Target: ATXN1; (-) strand; PAM type: YTN; PAM sequence: CTG
tgattaaaaccacctcctgt

SEQ ID NO: 185591 - DNA, 20 bp, Artificial Sequence
  Description of Artificial Sequence: Synthetic oligonucleotide
  Target: ATXN1; (-) strand; PAM type: YTN; PAM sequence: CTG
ccagggacatgggtatgcaa

SEQ ID NO: 185592 - DNA, 20 bp, Artificial Sequence
  Description of Artificial Sequence: Synthetic oligonucleotide
  Target: ATXN1; (-) strand; PAM type: YTN; PAM sequence: CTA
agctgccagggacatgggta

SEQ ID NO: 185593 - DNA, 20 bp, Artificial Sequence
  Description of Artificial Sequence: Synthetic oligonucleotide
  Target: ATXN1; (-) strand; PAM type: YTN; PAM sequence: TTC
taagctgccagggacatggg

SEQ ID NO: 185594 - DNA, 20 bp, Artificial Sequence
  Description of Artificial Sequence: Synthetic oligonucleotide
  Target: ATXN1; (-) strand; PAM type: YTN; PAM sequence: CTG
taaccattctaagctgccag

SEQ ID NO: 185595 - DNA, 20 bp, Artificial Sequence
  Description of Artificial Sequence: Synthetic oligonucleotide
  Target: ATXN1; (-) strand; PAM type: YTN; PAM sequence: TTA
agcgctgtaaccattctaag

SEQ ID NO: 185596 - DNA, 20 bp, Artificial Sequence
  Description of Artificial Sequence: Synthetic oligonucleotide
  Target: ATXN1; (-) strand; PAM type: YTN; PAM sequence: CTT
aagcgctgtaaccattctaa

SEQ ID NO: 185597 - DNA, 20 bp, Artificial Sequence
  Description of Artificial Sequence: Synthetic oligonucleotide
  Target: ATXN1; (-) strand; PAM type: YTN; PAM sequence: TTA
ccttaagcgctgtaaccatt

SEQ ID NO: 185598 - DNA, 20 bp, Artificial Sequence
  Description of Artificial Sequence: Synthetic oligonucleotide
  Target: ATXN1; (-) strand; PAM type: YTN; PAM sequence: TTG
tatgttaccttaagcgctgt

SEQ ID NO: 185599 - DNA, 20 bp, Artificial Sequence
  Description of Artificial Sequence: Synthetic oligonucleotide
  Target: ATXN1; (-) strand; PAM type: YTN; PAM sequence: TTT
gtatgttaccttaagcgctg

SEQ ID NO: 185600 - DNA, 20 bp, Artificial Sequence
  Description of Artificial Sequence: Synthetic oligonucleotide
  Target: ATXN1; (-) strand; PAM type: YTN; PAM sequence: CTT
tgtatgttaccttaagcgct

SEQ ID NO: 185601 - DNA, 20 bp, Artificial Sequence
  Description of Artificial Sequence: Synthetic oligonucleotide
  Target: ATXN1; (-) strand; PAM type: YTN; PAM sequence: CTG
cactttgtatgttaccttaa

SEQ ID NO: 185602 - DNA, 20 bp, Artificial Sequence
  Description of Artificial Sequence: Synthetic oligonucleotide
  Target: ATXN1; (-) strand; PAM type: YTN; PAM sequence: CTC
atctgcactttgtatgttac

SEQ ID NO: 185603 - DNA, 20 bp, Artificial Sequence
  Description of Artificial Sequence: Synthetic oligonucleotide
  Target: ATXN1; (-) strand; PAM type: YTN; PAM sequence: TTA
ctcatctgcactttgtatgt

SEQ ID NO: 185604 - DNA, 20 bp, Artificial Sequence
  Description of Artificial Sequence: Synthetic oligonucleotide
  Target: ATXN1; (-) strand; PAM type: YTN; PAM sequence: CTT
actcatctgcactttgtatg

SEQ ID NO: 185605 - DNA, 20 bp, Artificial Sequence
  Description of Artificial Sequence: Synthetic oligonucleotide
  Target: ATXN1; (-) strand; PAM type: YTN; PAM sequence: TTC
ttactcatctgcactttgta

SEQ ID NO: 185606 - DNA, 20 bp, Artificial Sequence
  Description of Artificial Sequence: Synthetic oligonucleotide
  Target: ATXN1; (-) strand; PAM type: YTN; PAM sequence: TTT
cttactcatctgcactttgt

SEQ ID NO: 185607 - DNA, 20 bp, Artificial Sequence
  Description of Artificial Sequence: Synthetic oligonucleotide
  Target: ATXN1; (-) strand; PAM type: YTN; PAM sequence: TTT
tcttactcatctgcactttg

SEQ ID NO: 185608 - DNA, 20 bp, Artificial Sequence
  Description of Artificial Sequence: Synthetic oligonucleotide
  Target: ATXN1; (-) strand; PAM type: YTN; PAM sequence: CTT
ttcttactcatctgcacttt

SEQ ID NO: 185609 - DNA, 20 bp, Artificial Sequence
  Description of Artificial Sequence: Synthetic oligonucleotide
  Target: ATXN1; (-) strand; PAM type: YTN; PAM sequence: TTC
ttttcttactcatctgcact

SEQ ID NO: 185610 - DNA, 20 bp, Artificial Sequence
  Description of Artificial Sequence: Synthetic oligonucleotide
  Target: ATXN1; (-) strand; PAM type: YTN; PAM sequence: TTG
tcaggttcttttcttactca

SEQ ID NO: 185611 - DNA, 20 bp, Artificial Sequence
  Description of Artificial Sequence: Synthetic oligonucleotide
  Target: ATXN1; (-) strand; PAM type: YTN; PAM sequence: TTT
gtcaggttcttttcttactc

SEQ ID NO: 185612 - DNA, 20 bp, Artificial Sequence
  Description of Artificial Sequence: Synthetic oligonucleotide
  Target: ATXN1; (-) strand; PAM type: YTN; PAM sequence: TTT
tgtcaggttcttttcttact

SEQ ID NO: 185613 - DNA, 20 bp, Artificial Sequence
  Description of Artificial Sequence: Synthetic oligonucleotide
  Target: ATXN1; (-) strand; PAM type: YTN; PAM sequence: CTG
agttttgtcaggttcttttc

SEQ ID NO: 185614 - DNA, 20 bp, Artificial Sequence
  Description of Artificial Sequence: Synthetic oligonucleotide
  Target: ATXN1; (-) strand; PAM type: YTN; PAM sequence: TTC
actgagttttgtcaggttct

SEQ ID NO: 185615 - DNA, 20 bp, Artificial Sequence
  Description of Artificial Sequence: Synthetic oligonucleotide
  Target: ATXN1; (-) strand; PAM type: YTN; PAM sequence: TTT
cactgagttttgtcaggttc

SEQ ID NO: 185616 - DNA, 20 bp, Artificial Sequence
  Description of Artificial Sequence: Synthetic oligonucleotide
  Target: ATXN1; (-) strand; PAM type: YTN; PAM sequence: TTA
tttcactgagttttgtcagg

SEQ ID NO: 185617 - DNA, 20 bp, Artificial Sequence
  Description of Artificial Sequence: Synthetic oligonucleotide
  Target: ATXN1; (-) strand; PAM type: YTN; PAM sequence: CTG
cgtgttatttcactgagttt

SEQ ID NO: 185618 - DNA, 20 bp, Artificial Sequence
  Description of Artificial Sequence: Synthetic oligonucleotide
  Target: ATXN1; (-) strand; PAM type: YTN; PAM sequence: CTG
ccacctgcgtgttatttcac

SEQ ID NO: 185619 - DNA, 20 bp, Artificial Sequence
  Description of Artificial Sequence: Synthetic oligonucleotide
  Target: ATXN1; (-) strand; PAM type: YTN; PAM sequence: TTG
gaagtggggtgaagacgcag

SEQ ID NO: 185620 - DNA, 20 bp, Artificial Sequence
  Description of Artificial Sequence: Synthetic oligonucleotide
  Target: ATXN1; (-) strand; PAM type: YTN; PAM sequence: TTT
ggaagtggggtgaagacgca

SEQ ID NO: 185621 - DNA, 20 bp, Artificial Sequence
  Description of Artificial Sequence: Synthetic oligonucleotide
  Target: ATXN1; (-) strand; PAM type: YTN; PAM sequence: TTT
tggaagtggggtgaagacgc

SEQ ID NO: 185622 - DNA, 20 bp, Artificial Sequence
  Description of Artificial Sequence: Synthetic oligonucleotide
  Target: ATXN1; (-) strand; PAM type: YTN; PAM sequence: TTT
ttggaagtggggtgaagacg

SEQ ID NO: 185623 - DNA, 20 bp, Artificial Sequence
  Description of Artificial Sequence: Synthetic oligonucleotide
  Target: ATXN1; (-) strand; PAM type: YTN; PAM sequence: TTA
tttttggaagtggggtgaag

SEQ ID NO: 185624 - DNA, 20 bp, Artificial Sequence
  Description of Artificial Sequence: Synthetic oligonucleotide
  Target: ATXN1; (-) strand; PAM type: YTN; PAM sequence: CTT
atttttggaagtggggtgaa

SEQ ID NO: 185625 - DNA, 20 bp, Artificial Sequence
  Description of Artificial Sequence: Synthetic oligonucleotide
  Target: ATXN1; (-) strand; PAM type: YTN; PAM sequence: TTC
ttatttttggaagtggggtg

SEQ ID NO: 185626 - DNA, 20 bp, Artificial Sequence
  Description of Artificial Sequence: Synthetic oligonucleotide
  Target: ATXN1; (-) strand; PAM type: YTN; PAM sequence: CTT
cttatttttggaagtggggt

SEQ ID NO: 185627 - DNA, 20 bp, Artificial Sequence
  Description of Artificial Sequence: Synthetic oligonucleotide
  Target: ATXN1; (-) strand; PAM type: YTN; PAM sequence: CTA
gagtgtatggagtagacagt

SEQ ID NO: 185628 - DNA, 20 bp, Artificial Sequence
  Description of Artificial Sequence: Synthetic oligonucleotide
  Target: ATXN1; (-) strand; PAM type: YTN; PAM sequence: TTC
tagagtgtatggagtagaca

SEQ ID NO: 185629 - DNA, 20 bp, Artificial Sequence
  Description of Artificial Sequence: Synthetic oligonucleotide
  Target: ATXN1; (-) strand; PAM type: YTN; PAM sequence: CTG
ttctagagtgtatggagtag

SEQ ID NO: 185630 - DNA, 20 bp, Artificial Sequence
  Description of Artificial Sequence: Synthetic oligonucleotide
  Target: ATXN1; (-) strand; PAM type: YTN; PAM sequence: TTA
taaatatgtatgtaatctgt

SEQ ID NO: 185631 - DNA, 20 bp, Artificial Sequence
  Description of Artificial Sequence: Synthetic oligonucleotide
  Target: ATXN1; (-) strand; PAM type: YTN; PAM sequence: TTT
ataaatatgtatgtaatctg

SEQ ID NO: 185632 - DNA, 20 bp, Artificial Sequence
  Description of Artificial Sequence: Synthetic oligonucleotide
  Target: ATXN1; (-) strand; PAM type: YTN; PAM sequence: CTT
tataaatatgtatgtaatct

SEQ ID NO: 185633 - DNA, 20 bp, Artificial Sequence
  Description of Artificial Sequence: Synthetic oligonucleotide
  Target: ATXN1; (-) strand; PAM type: YTN; PAM sequence: CTC
tttataaatatgtatgtaat

SEQ ID NO: 185634 - DNA, 20 bp, Artificial Sequence
  Description of Artificial Sequence: Synthetic oligonucleotide
  Target: ATXN1; (-) strand; PAM type: YTN; PAM sequence: TTC
tctttataaatatgtatgta

SEQ ID NO: 185635 - DNA, 20 bp, Artificial Sequence
  Description of Artificial Sequence: Synthetic oligonucleotide
  Target: ATXN1; (-) strand; PAM type: YTN; PAM sequence: TTT
ctctttataaatatgtatgt

SEQ ID NO: 185636 - DNA, 20 bp, Artificial Sequence
  Description of Artificial Sequence: Synthetic oligonucleotide
  Target: ATXN1; (-) strand; PAM type: YTN; PAM sequence: TTG
aaacaatacatttctcttta

SEQ ID NO: 185637 - DNA, 20 bp, Artificial Sequence
  Description of Artificial Sequence: Synthetic oligonucleotide
  Target: ATXN1; (-) strand; PAM type: YTN; PAM sequence: TTG
cataaaatattgaaacaata

SEQ ID NO: 185638 - DNA, 20 bp, Artificial Sequence
  Description of Artificial Sequence: Synthetic oligonucleotide
  Target: ATXN1; (-) strand; PAM type: YTN; PAM sequence: TTT
gcataaaatattgaaacaat

SEQ ID NO: 185639 - DNA, 20 bp, Artificial Sequence
  Description of Artificial Sequence: Synthetic oligonucleotide
  Target: ATXN1; (-) strand; PAM type: YTN; PAM sequence: TTT
tgcataaaatattgaaacaa

SEQ ID NO: 185640 - DNA, 20 bp, Artificial Sequence
  Description of Artificial Sequence: Synthetic oligonucleotide
  Target: ATXN1; (-) strand; PAM type: YTN; PAM sequence: TTA
catgaagttttgcataaaat

SEQ ID NO: 185641 - DNA, 20 bp, Artificial Sequence
  Description of Artificial Sequence: Synthetic oligonucleotide
  Target: ATXN1; (-) strand; PAM type: YTN; PAM sequence: CTT
acatgaagttttgcataaaa

SEQ ID NO: 185642 - DNA, 20 bp, Artificial Sequence
  Description of Artificial Sequence: Synthetic oligonucleotide
  Target: ATXN1; (-) strand; PAM type: YTN; PAM sequence: CTG
tacaaacacatgaccttaca

SEQ ID NO: 185643 - DNA, 20 bp, Artificial Sequence
  Description of Artificial Sequence: Synthetic oligonucleotide
  Target: ATXN1; (-) strand; PAM type: YTN; PAM sequence: TTG
tgctgtacaaacacatgacc

SEQ ID NO: 185644 - DNA, 20 bp, Artificial Sequence
  Description of Artificial Sequence: Synthetic oligonucleotide
  Target: ATXN1; (-) strand; PAM type: YTN; PAM sequence: TTT
gtgctgtacaaacacatgac

SEQ ID NO: 185645 - DNA, 20 bp, Artificial Sequence
  Description of Artificial Sequence: Synthetic oligonucleotide
  Target: ATXN1; (-) strand; PAM type: YTN; PAM sequence: TTT
tgtgctgtacaaacacatga

SEQ ID NO: 185646 - DNA, 20 bp, Artificial Sequence
  Description of Artificial Sequence: Synthetic oligonucleotide
  Target: ATXN1; (-) strand; PAM type: YTN; PAM sequence: TTC
catgttttgtgctgtacaaa

SEQ ID NO: 185647 - DNA, 20 bp, Artificial Sequence
  Description of Artificial Sequence: Synthetic oligonucleotide
  Target: ATXN1; (-) strand; PAM type: YTN; PAM sequence: CTG
gagagatacccaattccatg

SEQ ID NO: 185648 - DNA, 20 bp, Artificial Sequence
  Description of Artificial Sequence: Synthetic oligonucleotide
  Target: ATXN1; (-) strand; PAM type: YTN; PAM sequence: TTA
taggtgactggagagatacc

SEQ ID NO: 185649 - DNA, 20 bp, Artificial Sequence
  Description of Artificial Sequence: Synthetic oligonucleotide
  Target: ATXN1; (-) strand; PAM type: YTN; PAM sequence: TTT
ataggtgactggagagatac

SEQ ID NO: 185650 - DNA, 20 bp, Artificial Sequence
  Description of Artificial Sequence: Synthetic oligonucleotide
  Target: ATXN1; (-) strand; PAM type: YTN; PAM sequence: CTT
tataggtgactggagagata

SEQ ID NO: 185651 - DNA, 20 bp, Artificial Sequence
  Description of Artificial Sequence: Synthetic oligonucleotide
  Target: ATXN1; (-) strand; PAM type: YTN; PAM sequence: CTC
agctttataggtgactggag

SEQ ID NO: 185652 - DNA, 20 bp, Artificial Sequence
  Description of Artificial Sequence: Synthetic oligonucleotide
  Target: ATXN1; (-) strand; PAM type: YTN; PAM sequence: TTC
cagaacacagtatagaacaa

SEQ ID NO: 185653 - DNA, 20 bp, Artificial Sequence
  Description of Artificial Sequence: Synthetic oligonucleotide
  Target: ATXN1; (-) strand; PAM type: YTN; PAM sequence: CTT
ccagaacacagtatagaaca

SEQ ID NO: 185654 - DNA, 20 bp, Artificial Sequence
  Description of Artificial Sequence: Synthetic oligonucleotide
  Target: ATXN1; (-) strand; PAM type: YTN; PAM sequence: CTG
gcttccagaacacagtatag

SEQ ID NO: 185655 - DNA, 20 bp, Artificial Sequence
  Description of Artificial Sequence: Synthetic oligonucleotide
  Target: ATXN1; (-) strand; PAM type: YTN; PAM sequence: CTG
gtctggcttccagaacacag

SEQ ID NO: 185656 - DNA, 20 bp, Artificial Sequence
  Description of Artificial Sequence: Synthetic oligonucleotide
  Target: ATXN1; (-) strand; PAM type: YTN; PAM sequence: TTC
aatctggtctggcttccaga

SEQ ID NO: 185657 - DNA, 20 bp, Artificial Sequence
  Description of Artificial Sequence: Synthetic oligonucleotide
  Target: ATXN1; (-) strand; PAM type: YTN; PAM sequence: CTG
tgttcaatctggtctggctt

SEQ ID NO: 185658 - DNA, 20 bp, Artificial Sequence
  Description of Artificial Sequence: Synthetic oligonucleotide
  Target: ATXN1; (-) strand; PAM type: YTN; PAM sequence: TTG
ctgtgttcaatctggtctgg

SEQ ID NO: 185659 - DNA, 20 bp, Artificial Sequence
  Description of Artificial Sequence: Synthetic oligonucleotide
  Target: ATXN1; (-) strand; PAM type: YTN; PAM sequence: TTT
gctgtgttcaatctggtctg

SEQ ID NO: 185660 - DNA, 20 bp, Artificial Sequence
  Description of Artificial Sequence: Synthetic oligonucleotide
  Target: ATXN1; (-) strand; PAM type: YTN; PAM sequence: CTG
aaaggaagatatggtttgct

SEQ ID NO: 185661 - DNA, 20 bp, Artificial Sequence
  Description of Artificial Sequence: Synthetic oligonucleotide
  Target: ATXN1; (-) strand; PAM type: YTN; PAM sequence: CTA
tactgaaaggaagatatggt

SEQ ID NO: 185662 - DNA, 20 bp, Artificial Sequence
  Description of Artificial Sequence: Synthetic oligonucleotide
  Target: ATXN1; (-) strand; PAM type: YTN; PAM sequence: TTC
tatactgaaaggaagatatg

SEQ ID NO: 185663 - DNA, 20 bp, Artificial Sequence
  Description of Artificial Sequence: Synthetic oligonucleotide
  Target: ATXN1; (-) strand; PAM type: YTN; PAM sequence: TTG
cattctatactgaaaggaag

SEQ ID NO: 185664 - DNA, 20 bp, Artificial Sequence
  Description of Artificial Sequence: Synthetic oligonucleotide
  Target: ATXN1; (-) strand; PAM type: YTN; PAM sequence: CTC
attgcattctatactgaaag

SEQ ID NO: 185665 - DNA, 20 bp, Artificial Sequence
  Description of Artificial Sequence: Synthetic oligonucleotide
  Target: ATXN1; (-) strand; PAM type: YTN; PAM sequence: CTG
actcattgcattctatactg

SEQ ID NO: 185666 - DNA, 20 bp, Artificial Sequence
  Description of Artificial Sequence: Synthetic oligonucleotide
  Target: ATXN1; (-) strand; PAM type: YTN; PAM sequence: TTG
cataaacactgactcattgc

SEQ ID NO: 185667 - DNA, 20 bp, Artificial Sequence
  Description of Artificial Sequence: Synthetic oligonucleotide
  Target: ATXN1; (-) strand; PAM type: YTN; PAM sequence: TTA
atagcagatcattgcataaa

SEQ ID NO: 185668 - DNA, 20 bp, Artificial Sequence
  Description of Artificial Sequence: Synthetic oligonucleotide
  Target: ATXN1; (-) strand; PAM type: YTN; PAM sequence: TTT
aatagcagatcattgcataa

SEQ ID NO: 185669 - DNA, 20 bp, Artificial Sequence
  Description of Artificial Sequence: Synthetic oligonucleotide
  Target: ATXN1; (-) strand; PAM type: YTN; PAM sequence: CTT
taatagcagatcattgcata

SEQ ID NO: 185670 - DNA, 20 bp, Artificial Sequence
  Description of Artificial Sequence: Synthetic oligonucleotide
  Target: ATXN1; (-) strand; PAM type: YTN; PAM sequence: TTG
ctttaatagcagatcattgc

SEQ ID NO: 185671 - DNA, 20 bp, Artificial Sequence
  Description of Artificial Sequence: Synthetic oligonucleotide
  Target: ATXN1; (-) strand; PAM type: YTN; PAM sequence: TTT
gctttaatagcagatcattg

SEQ ID NO: 185672 - DNA, 20 bp, Artificial Sequence
  Description of Artificial Sequence: Synthetic oligonucleotide
  Target: ATXN1; (-) strand; PAM type: YTN; PAM sequence: TTA
tttgctttaatagcagatca

SEQ ID NO: 185673 - DNA, 20 bp, Artificial Sequence
  Description of Artificial Sequence: Synthetic oligonucleotide
  Target: ATXN1; (-) strand; PAM type: YTN; PAM sequence: CTT
atttgctttaatagcagatc

SEQ ID NO: 185674 - DNA, 20 bp, Artificial Sequence
  Description of Artificial Sequence: Synthetic oligonucleotide
  Target: ATXN1; (-) strand; PAM type: YTN; PAM sequence: CTG
cttatttgctttaatagcag

SEQ ID NO: 185675 - DNA, 20 bp, Artificial Sequence
  Description of Artificial Sequence: Synthetic oligonucleotide
  Target: ATXN1; (-) strand; PAM type: YTN; PAM sequence: TTC
tgcttatttgctttaatagc

SEQ ID NO: 185676 - DNA, 20 bp, Artificial Sequence
  Description of Artificial Sequence: Synthetic oligonucleotide
  Target: ATXN1; (-) strand; PAM type: YTN; PAM sequence: CTG
attctgcttatttgctttaa

SEQ ID NO: 185677 - DNA, 20 bp, Artificial Sequence
  Description of Artificial Sequence: Synthetic oligonucleotide
  Target: ATXN1; (-) strand; PAM type: YTN; PAM sequence: TTC
ctgattctgcttatttgctt

SEQ ID NO: 185678 - DNA, 20 bp, Artificial Sequence
  Description of Artificial Sequence: Synthetic oligonucleotide
  Target: ATXN1; (-) strand; PAM type: YTN; PAM sequence: TTG
gaattcctgattctgcttat

SEQ ID NO: 185679 - DNA, 20 bp, Artificial Sequence
  Description of Artificial Sequence: Synthetic oligonucleotide
  Target: ATXN1; (-) strand; PAM type: YTN; PAM sequence: TTT
ggaattcctgattctgctta

SEQ ID NO: 185680 - DNA, 20 bp, Artificial Sequence
  Description of Artificial Sequence: Synthetic oligonucleotide
  Target: ATXN1; (-) strand; PAM type: YTN; PAM sequence: TTT
tggaattcctgattctgctt

SEQ ID NO: 185681 - DNA, 20 bp, Artificial Sequence
  Description of Artificial Sequence: Synthetic oligonucleotide
  Target: ATXN1; (-) strand; PAM type: YTN; PAM sequence: CTC
atgtgaaatggaaatgaaaa

SEQ ID NO: 185682 - DNA, 20 bp, Artificial Sequence
  Description of Artificial Sequence: Synthetic oligonucleotide
  Target: ATXN1; (-) strand; PAM type: YTN; PAM sequence: TTA
tactcatgtgaaatggaaat

SEQ ID NO: 185683 - DNA, 20 bp, Artificial Sequence
  Description of Artificial Sequence: Synthetic oligonucleotide
  Target: ATXN1; (-) strand; PAM type: YTN; PAM sequence: TTT
atactcatgtgaaatggaaa

SEQ ID NO: 185684 - DNA, 20 bp, Artificial Sequence
  Description of Artificial Sequence: Synthetic oligonucleotide
  Target: ATXN1; (-) strand; PAM type: YTN; PAM sequence: CTT
tatactcatgtgaaatggaa

SEQ ID NO: 185685 - DNA, 20 bp, Artificial Sequence
  Description of Artificial Sequence: Synthetic oligonucleotide
  Target: ATXN1; (-) strand; PAM type: YTN; PAM sequence: TTG
gtgagctttatactcatgtg

SEQ ID NO: 185686 - DNA, 20 bp, Artificial Sequence
  Description of Artificial Sequence: Synthetic oligonucleotide
  Target: ATXN1; (-) strand; PAM type: YTN; PAM sequence: TTT
ggtgagctttatactcatgt

SEQ ID NO: 185687 - DNA, 20 bp, Artificial Sequence
  Description of Artificial Sequence: Synthetic oligonucleotide
  Target: ATXN1; (-) strand; PAM type: YTN; PAM sequence: TTA
aagtgcccaaatttggtgag

SEQ ID NO: 185688 - DNA, 20 bp, Artificial Sequence
  Description of Artificial Sequence: Synthetic oligonucleotide
  Target: ATXN1; (-) strand; PAM type: YTN; PAM sequence: TTT
aaagtgcccaaatttggtga

SEQ ID NO: 185689 - DNA, 20 bp, Artificial Sequence
  Description of Artificial Sequence: Synthetic oligonucleotide
  Target: ATXN1; (-) strand; PAM type: YTN; PAM sequence: TTC
ataatttaaagtgcccaaat

SEQ ID NO: 185690 - DNA, 20 bp, Artificial Sequence
  Description of Artificial Sequence: Synthetic oligonucleotide
  Target: ATXN1; (-) strand; PAM type: YTN; PAM sequence: CTT
cataatttaaagtgcccaaa

SEQ ID NO: 185691 - DNA, 20 bp, Artificial Sequence
  Description of Artificial Sequence: Synthetic oligonucleotide
  Target: ATXN1; (-) strand; PAM type: YTN; PAM sequence: CTG
ataaagaagtgtgtgatagg

SEQ ID NO: 185692 - DNA, 20 bp, Artificial Sequence
  Description of Artificial Sequence: Synthetic oligonucleotide
  Target: ATXN1; (-) strand; PAM type: YTN; PAM sequence: TTA
tgtggaggactgataaagaa

SEQ ID NO: 185693 - DNA, 20 bp, Artificial Sequence
  Description of Artificial Sequence: Synthetic oligonucleotide
  Target: ATXN1; (-) strand; PAM type: YTN; PAM sequence: TTA
aacaattatgtggaggactg

SEQ ID NO: 185694 - DNA, 20 bp, Artificial Sequence
  Description of Artificial Sequence: Synthetic oligonucleotide
  Target: ATXN1; (-) strand; PAM type: YTN; PAM sequence: TTA
gttaaacaattatgtggagg

SEQ ID NO: 185695 - DNA, 20 bp, Artificial Sequence
  Description of Artificial Sequence: Synthetic oligonucleotide
  Target: ATXN1; (-) strand; PAM type: YTN; PAM sequence: CTT
agttaaacaattatgtggag

SEQ ID NO: 185696 - DNA, 20 bp, Artificial Sequence
  Description of Artificial Sequence: Synthetic oligonucleotide
  Target: ATXN1; (-) strand; PAM type: YTN; PAM sequence: TTA
tcagagtcttagttaaacaa

SEQ ID NO: 185697 - DNA, 20 bp, Artificial Sequence
  Description of Artificial Sequence: Synthetic oligonucleotide
  Target: ATXN1; (-) strand; PAM type: YTN; PAM sequence: TTT
atcagagtcttagttaaaca

SEQ ID NO: 185698 - DNA, 20 bp, Artificial Sequence
  Description of Artificial Sequence: Synthetic oligonucleotide
  Target: ATXN1; (-) strand; PAM type: YTN; PAM sequence: TTT
tatcagagtcttagttaaac

SEQ ID NO: 185699 - DNA, 20 bp, Artificial Sequence
  Description of Artificial Sequence: Synthetic oligonucleotide
  Target: ATXN1; (-) strand; PAM type: YTN; PAM sequence: TTT
ttatcagagtcttagttaaa

SEQ ID NO: 185700 - DNA, 20 bp, Artificial Sequence
  Description of Artificial Sequence: Synthetic oligonucleotide
  Target: ATXN1; (-) strand; PAM type: YTN; PAM sequence: TTG
acatttttatcagagtctta

SEQ ID NO: 185701 - DNA, 20 bp, Artificial Sequence
  Description of Artificial Sequence: Synthetic oligonucleotide
  Target: ATXN1; (-) strand; PAM type: YTN; PAM sequence: TTT
gacatttttatcagagtctt

SEQ ID NO: 185702 - DNA, 20 bp, Artificial Sequence
  Description of Artificial Sequence: Synthetic oligonucleotide
  Target: ATXN1; (-) strand; PAM type: YTN; PAM sequence: TTT
tgacatttttatcagagtct

SEQ ID NO: 185703 - DNA, 20 bp, Artificial Sequence
  Description of Artificial Sequence: Synthetic oligonucleotide
  Target: ATXN1; (-) strand; PAM type: YTN; PAM sequence: TTT
ttgacatttttatcagagtc

SEQ ID NO: 185704 - DNA, 20 bp, Artificial Sequence
  Description of Artificial Sequence: Synthetic oligonucleotide
  Target: ATXN1; (-) strand; PAM type: YTN; PAM sequence: CTG
agaaccatggcaagcatttt

SEQ ID NO: 185705 - DNA, 20 bp, Artificial Sequence
  Description of Artificial Sequence: Synthetic oligonucleotide
  Target: ATXN1; (-) strand; PAM type: YTN; PAM sequence: CTG
ctgagaaccatggcaagcat

SEQ ID NO: 185706 - DNA, 20 bp, Artificial Sequence
  Description of Artificial Sequence: Synthetic oligonucleotide
  Target: ATXN1; (-) strand; PAM type: YTN; PAM sequence: TTG
ctgctgagaaccatggcaag

SEQ ID NO: 185707 - DNA, 20 bp, Artificial Sequence
  Description of Artificial Sequence: Synthetic oligonucleotide
  Target: ATXN1; (-) strand; PAM type: YTN; PAM sequence: TTT
gctgctgagaaccatggcaa

SEQ ID NO: 185708 - DNA, 20 bp, Artificial Sequence
  Description of Artificial Sequence: Synthetic oligonucleotide
  Target: ATXN1; (-) strand; PAM type: YTN; PAM sequence: TTG
tttgctgctgagaaccatgg

SEQ ID NO: 185709 - DNA, 20 bp, Artificial Sequence
  Description of Artificial Sequence: Synthetic oligonucleotide
  Target: ATXN1; (-) strand; PAM type: YTN; PAM sequence: TTT
gtttgctgctgagaaccatg

SEQ ID NO: 185710 - DNA, 20 bp, Artificial Sequence
  Description of Artificial Sequence: Synthetic oligonucleotide
  Target: ATXN1; (-) strand; PAM type: YTN; PAM sequence: CTG
caggcatttgtttgctgctg

SEQ ID NO: 185711 - DNA, 20 bp, Artificial Sequence
  Description of Artificial Sequence: Synthetic oligonucleotide
  Target: ATXN1; (-) strand; PAM type: YTN; PAM sequence: CTC
ggagcctgcaggcatttgtt

SEQ ID NO: 185712 - DNA, 20 bp, Artificial Sequence
  Description of Artificial Sequence: Synthetic oligonucleotide
  Target: ATXN1; (-) strand; PAM type: YTN; PAM sequence: TTG
aaaaaccccagggcatgctc

SEQ ID NO: 185713 - DNA, 20 bp, Artificial Sequence
  Description of Artificial Sequence: Synthetic oligonucleotide
  Target: ATXN1; (-) strand; PAM type: YTN; PAM sequence: TTT
gaaaaaccccagggcatgct

SEQ ID NO: 185714 - DNA, 20 bp, Artificial Sequence
  Description of Artificial Sequence: Synthetic oligonucleotide
  Target: ATXN1; (-) strand; PAM type: YTN; PAM sequence: TTC
aaagacaggagagggtttga

SEQ ID NO: 185715 - DNA, 20 bp, Artificial Sequence
  Description of Artificial Sequence: Synthetic oligonucleotide
  Target: ATXN1; (-) strand; PAM type: YTN; PAM sequence: TTT
caaagacaggagagggtttg

SEQ ID NO: 185716 - DNA, 20 bp, Artificial Sequence
  Description of Artificial Sequence: Synthetic oligonucleotide
  Target: ATXN1; (-) strand; PAM type: YTN; PAM sequence: TTT
tcaaagacaggagagggttt

SEQ ID NO: 185717 - DNA, 20 bp, Artificial Sequence
  Description of Artificial Sequence: Synthetic oligonucleotide
  Target: ATXN1; (-) strand; PAM type: YTN; PAM sequence: CTG
aatgggatgcattttcaaag

SEQ ID NO: 185718 - DNA, 20 bp, Artificial Sequence
  Description of Artificial Sequence: Synthetic oligonucleotide
  Target: ATXN1; (-) strand; PAM type: YTN; PAM sequence: CTA
actgaatgggatgcattttc

SEQ ID NO: 185719 - DNA, 20 bp, Artificial Sequence
  Description of Artificial Sequence: Synthetic oligonucleotide
  Target: ATXN1; (-) strand; PAM type: YTN; PAM sequence: CTG
ctaactgaatgggatgcatt

SEQ ID NO: 185720 - DNA, 20 bp, Artificial Sequence
  Description of Artificial Sequence: Synthetic oligonucleotide
  Target: ATXN1; (-) strand; PAM type: YTN; PAM sequence: TTA
tcaccagcactgctaactga

SEQ ID NO: 185721 - DNA, 20 bp, Artificial Sequence
  Description of Artificial Sequence: Synthetic oligonucleotide
  Target: ATXN1; (-) strand; PAM type: YTN; PAM sequence: CTT
atcaccagcactgctaactg

SEQ ID NO: 185722 - DNA, 20 bp, Artificial Sequence
  Description of Artificial Sequence: Synthetic oligonucleotide
  Target: ATXN1; (-) strand; PAM type: YTN; PAM sequence: CTG
cgtgccatgtcttatcacca

SEQ ID NO: 185723 - DNA, 20 bp, Artificial Sequence
  Description of Artificial Sequence: Synthetic oligonucleotide
  Target: ATXN1; (-) strand; PAM type: YTN; PAM sequence: CTC
tgcgtgccatgtcttatcac

SEQ ID NO: 185724 - DNA, 20 bp, Artificial Sequence
  Description of Artificial Sequence: Synthetic oligonucleotide
  Target: ATXN1; (-) strand; PAM type: YTN; PAM sequence: TTA
gaccctctgcgtgccatgtc

SEQ ID NO: 185725 - DNA, 20 bp, Artificial Sequence
  Description of Artificial Sequence: Synthetic oligonucleotide
  Target: ATXN1; (-) strand; PAM type: YTN; PAM sequence: TTT
agaccctctgcgtgccatgt

SEQ ID NO: 185726 - DNA, 20 bp, Artificial Sequence
  Description of Artificial Sequence: Synthetic oligonucleotide
  Target: ATXN1; (-) strand; PAM type: YTN; PAM sequence: TTA
ggggtggtggtttagaccct

SEQ ID NO: 185727 - DNA, 20 bp, Artificial Sequence
  Description of Artificial Sequence: Synthetic oligonucleotide
  Target: ATXN1; (-) strand; PAM type: YTN; PAM sequence: TTT
aggggtggtggtttagaccc

SEQ ID NO: 185728 - DNA, 20 bp, Artificial Sequence
  Description of Artificial Sequence: Synthetic oligonucleotide
  Target: ATXN1; (-) strand; PAM type: YTN; PAM sequence: CTT
taggggtggtggtttagacc

SEQ ID NO: 185729 - DNA, 20 bp, Artificial Sequence
  Description of Artificial Sequence: Synthetic oligonucleotide
  Target: ATXN1; (-) strand; PAM type: YTN; PAM sequence: CTG
gcacctttaggggtggtggt

SEQ ID NO: 185730 - DNA, 20 bp, Artificial Sequence
  Description of Artificial Sequence: Synthetic oligonucleotide
  Target: ATXN1; (-) strand; PAM type: YTN; PAM sequence: CTC
tggcacctttaggggtggtg

SEQ ID NO: 185731 - DNA, 20 bp, Artificial Sequence
  Description of Artificial Sequence: Synthetic oligonucleotide
  Target: ATXN1; (-) strand; PAM type: YTN; PAM sequence: CTG
ctctggcacctttaggggtg

SEQ ID NO: 185732 - DNA, 20 bp, Artificial Sequence
  Description of Artificial Sequence: Synthetic oligonucleotide
  Target: ATXN1; (-) strand; PAM type: YTN; PAM sequence: TTC
tgctctggcacctttagggg

SEQ ID NO: 185733 - DNA, 20 bp, Artificial Sequence
  Description of Artificial Sequence: Synthetic oligonucleotide
  Target: ATXN1; (-) strand; PAM type: YTN; PAM sequence: CTC
aatgcagggttctgctctgg

SEQ ID NO: 185734 - DNA, 20 bp, Artificial Sequence
  Description of Artificial Sequence: Synthetic oligonucleotide
  Target: ATXN1; (-) strand; PAM type: YTN; PAM sequence: TTA
aactcaatgcagggttctgc

SEQ ID NO: 185735 - DNA, 20 bp, Artificial Sequence
  Description of Artificial Sequence: Synthetic oligonucleotide
  Target: ATXN1; (-) strand; PAM type: YTN; PAM sequence: CTG
tcagcattaaactcaatgca

SEQ ID NO: 185736 - DNA, 20 bp, Artificial Sequence
  Description of Artificial Sequence: Synthetic oligonucleotide
  Target: ATXN1; (-) strand; PAM type: YTN; PAM sequence: CTC
tgtcagcattaaactcaatg

SEQ ID NO: 185737 - DNA, 20 bp, Artificial Sequence
  Description of Artificial Sequence: Synthetic oligonucleotide
  Target: ATXN1; (-) strand; PAM type: YTN; PAM sequence: TTG
gagtgctctgtcagcattaa

SEQ ID NO: 185738 - DNA, 20 bp, Artificial Sequence
  Description of Artificial Sequence: Synthetic oligonucleotide
  Target: ATXN1; (-) strand; PAM type: YTN; PAM sequence: CTG
attggagtgctctgtcagca

SEQ ID NO: 185739 - DNA, 20 bp, Artificial Sequence
  Description of Artificial Sequence: Synthetic oligonucleotide
  Target: ATXN1; (-) strand; PAM type: YTN; PAM sequence: CTG
actgattggagtgctctgtc

SEQ ID NO: 185740 - DNA, 20 bp, Artificial Sequence
  Description of Artificial Sequence: Synthetic oligonucleotide
  Target: ATXN1; (-) strand; PAM type: YTN; PAM sequence: TTC
gaacagactgactgattgga

SEQ ID NO: 185741 - DNA, 20 bp, Artificial Sequence
  Description of Artificial Sequence: Synthetic oligonucleotide
  Target: ATXN1; (-) strand; PAM type: YTN; PAM sequence: CTC
caatcaaagagttcgaacag

SEQ ID NO: 185742 - DNA, 20 bp, Artificial Sequence
  Description of Artificial Sequence: Synthetic oligonucleotide
  Target: ATXN1; (-) strand; PAM type: YTN; PAM sequence: TTC
tccaatcaaagagttcgaac

SEQ ID NO: 185743 - DNA, 20 bp, Artificial Sequence
  Description of Artificial Sequence: Synthetic oligonucleotide
  Target: ATXN1; (-) strand; PAM type: YTN; PAM sequence: TTT
ctccaatcaaagagttcgaa

SEQ ID NO: 185744 - DNA, 20 bp, Artificial Sequence
  Description of Artificial Sequence: Synthetic oligonucleotide
  Target: ATXN1; (-) strand; PAM type: YTN; PAM sequence: TTT
tctccaatcaaagagttcga

SEQ ID NO: 185745 - DNA, 20 bp, Artificial Sequence
  Description of Artificial Sequence: Synthetic oligonucleotide
  Target: ATXN1; (-) strand; PAM type: YTN; PAM sequence: CTT
ttctccaatcaaagagttcg

SEQ ID NO: 185746 - DNA, 20 bp, Artificial Sequence
  Description of Artificial Sequence: Synthetic oligonucleotide
  Target: ATXN1; (-) strand; PAM type: YTN; PAM sequence: CTG
accttttctccaatcaaaga

SEQ ID NO: 185747 - DNA, 20 bp, Artificial Sequence
  Description of Artificial Sequence: Synthetic oligonucleotide
  Target: ATXN1; (-) strand; PAM type: YTN; PAM sequence: TTC
tgaccttttctccaatcaaa

SEQ ID NO: 185748 - DNA, 20 bp, Artificial Sequence
  Description of Artificial Sequence: Synthetic oligonucleotide
  Target: ATXN1; (-) strand; PAM type: YTN; PAM sequence: CTC
agattctgaccttttctcca

SEQ ID NO: 185749 - DNA, 20 bp, Artificial Sequence
  Description of Artificial Sequence: Synthetic oligonucleotide
  Target: ATXN1; (-) strand; PAM type: YTN; PAM sequence: TTG
tagctcagattctgaccttt

SEQ ID NO: 185750 - DNA, 20 bp, Artificial Sequence
  Description of Artificial Sequence: Synthetic oligonucleotide
  Target: ATXN1; (-) strand; PAM type: YTN; PAM sequence: TTT
gtagctcagattctgacctt

SEQ ID NO: 185751 - DNA, 20 bp, Artificial Sequence
  Description of Artificial Sequence: Synthetic oligonucleotide
  Target: ATXN1; (-) strand; PAM type: YTN; PAM sequence: TTT
tgtagctcagattctgacct

SEQ ID NO: 185752 - DNA, 20 bp, Artificial Sequence
  Description of Artificial Sequence: Synthetic oligonucleotide
  Target: ATXN1; (-) strand; PAM type: YTN; PAM sequence: CTT
ttgtagctcagattctgacc

SEQ ID NO: 185753 - DNA, 20 bp, Artificial Sequence
  Description of Artificial Sequence: Synthetic oligonucleotide
  Target: ATXN1; (-) strand; PAM type: YTN; PAM sequence: TTC
caggggcaggcaggccactt

SEQ ID NO: 185754 - DNA, 20 bp, Artificial Sequence
  Description of Artificial Sequence: Synthetic oligonucleotide
  Target: ATXN1; (-) strand; PAM type: YTN; PAM sequence: CTT
ccaggggcaggcaggccact

SEQ ID NO: 185755 - DNA, 20 bp, Artificial Sequence
  Description of Artificial Sequence: Synthetic oligonucleotide
  Target: ATXN1; (-) strand; PAM type: YTN; PAM sequence: CTA
atcttccaggggcaggcagg

SEQ ID NO: 185756 - DNA, 20 bp, Artificial Sequence
  Description of Artificial Sequence: Synthetic oligonucleotide
  Target: ATXN1; (-) strand; PAM type: YTN; PAM sequence: CTA
aaaacccaggacctaatctt

SEQ ID NO: 185757 - DNA, 20 bp, Artificial Sequence
  Description of Artificial Sequence: Synthetic oligonucleotide
  Target: ATXN1; (-) strand; PAM type: YTN; PAM sequence: TTG
tgggaacagaggaagacaag

SEQ ID NO: 185758 - DNA, 20 bp, Artificial Sequence
  Description of Artificial Sequence: Synthetic oligonucleotide
  Target: ATXN1; (-) strand; PAM type: YTN; PAM sequence: TTG
aaaataaatgggaattgtgg

SEQ ID NO: 185759 - DNA, 20 bp, Artificial Sequence
  Description of Artificial Sequence: Synthetic oligonucleotide
  Target: ATXN1; (-) strand; PAM type: YTN; PAM sequence: CTA
accaaataattgaaaataaa

SEQ ID NO: 185760 - DNA, 20 bp, Artificial Sequence
  Description of Artificial Sequence: Synthetic oligonucleotide
  Target: ATXN1; (-) strand; PAM type: YTN; PAM sequence: TTC
cctaaccaaataattgaaaa

SEQ ID NO: 185761 - DNA, 20 bp, Artificial Sequence
  Description of Artificial Sequence: Synthetic oligonucleotide
  Target: ATXN1; (-) strand; PAM type: YTN; PAM sequence: CTT
ccctaaccaaataattgaaa

SEQ ID NO: 185762 - DNA, 20 bp, Artificial Sequence
  Description of Artificial Sequence: Synthetic oligonucleotide
  Target: ATXN1; (-) strand; PAM type: YTN; PAM sequence: TTG
agggacaccttccctaacca

SEQ ID NO: 185763 - DNA, 20 bp, Artificial Sequence
  Description of Artificial Sequence: Synthetic oligonucleotide
  Target: ATXN1; (-) strand; PAM type: YTN; PAM sequence: CTT
gagggacaccttccctaacc

SEQ ID NO: 185764 - DNA, 20 bp, Artificial Sequence
  Description of Artificial Sequence: Synthetic oligonucleotide
  Target: ATXN1; (-) strand; PAM type: YTN; PAM sequence: TTC
cttgagggacaccttcccta

SEQ ID NO: 185765 - DNA, 20 bp, Artificial Sequence
  Description of Artificial Sequence: Synthetic oligonucleotide
  Target: ATXN1; (-) strand; PAM type: YTN; PAM sequence: TTT
ccttgagggacaccttccct

SEQ ID NO: 185766 - DNA, 20 bp, Artificial Sequence
  Description of Artificial Sequence: Synthetic oligonucleotide
  Target: ATXN1; (-) strand; PAM type: YTN; PAM sequence: TTT
tccttgagggacaccttccc

SEQ ID NO: 185767 - DNA, 20 bp, Artificial Sequence
  Description of Artificial Sequence: Synthetic oligonucleotide
  Target: ATXN1; (-) strand; PAM type: YTN; PAM sequence: CTT
ttccttgagggacaccttcc

SEQ ID NO: 185768 - DNA, 20 bp, Artificial Sequence
  Description of Artificial Sequence: Synthetic oligonucleotide
  Target: ATXN1; (-) strand; PAM type: YTN; PAM sequence: CTC
ttttccttgagggacacctt

SEQ ID NO: 185769 - DNA, 20 bp, Artificial Sequence
  Description of Artificial Sequence: Synthetic oligonucleotide
  Target: ATXN1; (-) strand; PAM type: YTN; PAM sequence: CTA
tgctcttttccttgagggac

SEQ ID NO: 185770 - DNA, 20 bp, Artificial Sequence
  Description of Artificial Sequence: Synthetic oligonucleotide
  Target: ATXN1; (-) strand; PAM type: YTN; PAM sequence: TTC
ctatgctcttttccttgagg

SEQ ID NO: 185771 - DNA, 20 bp, Artificial Sequence
  Description of Artificial Sequence: Synthetic oligonucleotide
  Target: ATXN1; (-) strand; PAM type: YTN; PAM sequence: TTC
attcctatgctcttttcctt

SEQ ID NO: 185772 - DNA, 20 bp, Artificial Sequence
  Description of Artificial Sequence: Synthetic oligonucleotide
  Target: ATXN1; (-) strand; PAM type: YTN; PAM sequence: CTT
cattcctatgctcttttcct

SEQ ID NO: 185773 - DNA, 20 bp, Artificial Sequence
  Description of Artificial Sequence: Synthetic oligonucleotide
  Target: ATXN1; (-) strand; PAM type: YTN; PAM sequence: CTA
caagtagggcaggcagcctt

SEQ ID NO: 185774 - DNA, 20 bp, Artificial Sequence
  Description of Artificial Sequence: Synthetic oligonucleotide
  Target: ATXN1; (-) strand; PAM type: YTN; PAM sequence: TTA
aaaaagaacatacagaagag

SEQ ID NO: 185775 - DNA, 20 bp, Artificial Sequence
  Description of Artificial Sequence: Synthetic oligonucleotide
  Target: ATXN1; (-) strand; PAM type: YTN; PAM sequence: TTC
attaaaaaagaacatacaga

SEQ ID NO: 185776 - DNA, 20 bp, Artificial Sequence
  Description of Artificial Sequence: Synthetic oligonucleotide
  Target: ATXN1; (-) strand; PAM type: YTN; PAM sequence: TTT
cattaaaaaagaacatacag

SEQ ID NO: 185777 - DNA, 20 bp, Artificial Sequence
  Description of Artificial Sequence: Synthetic oligonucleotide
  Target: ATXN1; (-) strand; PAM type: YTN; PAM sequence: TTT
tcattaaaaaagaacataca

SEQ ID NO: 185778 - DNA, 20 bp, Artificial Sequence
  Description of Artificial Sequence: Synthetic oligonucleotide
  Target: ATXN1; (-) strand; PAM type: YTN; PAM sequence: TTT
ttcattaaaaaagaacatac

SEQ ID NO: 185779 - DNA, 20 bp, Artificial Sequence
  Description of Artificial Sequence: Synthetic oligonucleotide
  Target: ATXN1; (-) strand; PAM type: YTN; PAM sequence: TTT
tttcattaaaaaagaacata

SEQ ID NO: 185780 - DNA, 20 bp, Artificial Sequence
  Description of Artificial Sequence: Synthetic oligonucleotide
  Target: ATXN1; (-) strand; PAM type: YTN; PAM sequence: TTT
ttttcattaaaaaagaacat

SEQ ID NO: 185781 - DNA, 20 bp, Artificial Sequence
  Description of Artificial Sequence: Synthetic oligonucleotide
  Target: ATXN1; (-) strand; PAM type: YTN; PAM sequence: CTA
atttttttcattaaaaaaga

SEQ ID NO: 185782 - DNA, 20 bp, Artificial Sequence
  Description of Artificial Sequence: Synthetic oligonucleotide
  Target: ATXN1; (-) strand; PAM type: YTN; PAM sequence: TTC
taatttttttcattaaaaaa

SEQ ID NO: 185783 - DNA, 20 bp, Artificial Sequence
  Description of Artificial Sequence: Synthetic oligonucleotide
  Target: ATXN1; (-) strand; PAM type: YTN; PAM sequence: TTT
ctaatttttttcattaaaaa

SEQ ID NO: 185784 - DNA, 20 bp, Artificial Sequence
  Description of Artificial Sequence: Synthetic oligonucleotide
  Target: ATXN1; (-) strand; PAM type: YTN; PAM sequence: TTT
tctaatttttttcattaaaa

SEQ ID NO: 185785 - DNA, 20 bp, Artificial Sequence
  Description of Artificial Sequence: Synthetic oligonucleotide
  Target: ATXN1; (-) strand; PAM type: YTN; PAM sequence: TTG
ccaagttttctaattttttt

SEQ ID NO: 185786 - DNA, 20 bp, Artificial Sequence
  Description of Artificial Sequence: Synthetic oligonucleotide
  Target: ATXN1; (-) strand; PAM type: YTN; PAM sequence: TTT
gccaagttttctaatttttt

SEQ ID NO: 185787 - DNA, 20 bp, Artificial Sequence
  Description of Artificial Sequence: Synthetic oligonucleotide
  Target: ATXN1; (-) strand; PAM type: YTN; PAM sequence: TTG
agggaggggagcatcaaaat

SEQ ID NO: 185788 - DNA, 20 bp, Artificial Sequence
  Description of Artificial Sequence: Synthetic oligonucleotide
  Target: ATXN1; (-) strand; PAM type: YTN; PAM sequence: TTA
taggtaaaattgagggaggg

SEQ ID NO: 185789 - DNA, 20 bp, Artificial Sequence
  Description of Artificial Sequence: Synthetic oligonucleotide
  Target: ATXN1; (-) strand; PAM type: YTN; PAM sequence: TTT
ataggtaaaattgagggagg

SEQ ID NO: 185790 - DNA, 20 bp, Artificial Sequence
  Description of Artificial Sequence: Synthetic oligonucleotide
  Target: ATXN1; (-) strand; PAM type: YTN; PAM sequence: TTT
tataggtaaaattgagggag

SEQ ID NO: 185791 - DNA, 20 bp, Artificial Sequence
  Description of Artificial Sequence: Synthetic oligonucleotide
  Target: ATXN1; (-) strand; PAM type: YTN; PAM sequence: CTT
ttataggtaaaattgaggga

SEQ ID NO: 185792 - DNA, 20 bp, Artificial Sequence
  Description of Artificial Sequence: Synthetic oligonucleotide
  Target: ATXN1; (-) strand; PAM type: YTN; PAM sequence: TTG
gaagtggtatcttttatagg

SEQ ID NO: 185793 - DNA, 20 bp, Artificial Sequence
  Description of Artificial Sequence: Synthetic oligonucleotide
  Target: ATXN1; (-) strand; PAM type: YTN; PAM sequence: CTC
aaatgttggaagtggtatct

SEQ ID NO: 185794 - DNA, 20 bp, Artificial Sequence
  Description of Artificial Sequence: Synthetic oligonucleotide
  Target: ATXN1; (-) strand; PAM type: YTN; PAM sequence: TTA
taactcaaatgttggaagtg

SEQ ID NO: 185795 - DNA, 20 bp, Artificial Sequence
  Description of Artificial Sequence: Synthetic oligonucleotide
  Target: ATXN1; (-) strand; PAM type: YTN; PAM sequence: TTG
gggttataactcaaatgttg

SEQ ID NO: 185796 - DNA, 20 bp, Artificial Sequence
  Description of Artificial Sequence: Synthetic oligonucleotide
  Target: ATXN1; (-) strand; PAM type: YTN; PAM sequence: CTT
ggggttataactcaaatgtt

SEQ ID NO: 185797 - DNA, 20 bp, Artificial Sequence
  Description of Artificial Sequence: Synthetic oligonucleotide
  Target: ATXN1; (-) strand; PAM type: YTN; PAM sequence: TTC
agtccttggggttataactc

SEQ ID NO: 185798 - DNA, 20 bp, Artificial Sequence
  Description of Artificial Sequence: Synthetic oligonucleotide
  Target: ATXN1; (-) strand; PAM type: YTN; PAM sequence: TTT
cagtccttggggttataact

SEQ ID NO: 185799 - DNA, 20 bp, Artificial Sequence
  Description of Artificial Sequence: Synthetic oligonucleotide
  Target: ATXN1; (-) strand; PAM type: YTN; PAM sequence: TTT
tcagtccttggggttataac

SEQ ID NO: 185800 - DNA, 20 bp, Artificial Sequence
  Description of Artificial Sequence: Synthetic oligonucleotide
  Target: ATXN1; (-) strand; PAM type: YTN; PAM sequence: TTT
ttcagtccttggggttataa

SEQ ID NO: 185801 - DNA, 20 bp, Artificial Sequence
  Description of Artificial Sequence: Synthetic oligonucleotide
  Target: ATXN1; (-) strand; PAM type: YTN; PAM sequence: CTG
ggtatttttcagtccttggg

SEQ ID NO: 185802 - DNA, 20 bp, Artificial Sequence
  Description of Artificial Sequence: Synthetic oligonucleotide
  Target: ATXN1; (-) strand; PAM type: YTN; PAM sequence: CTG
atatcgggtcggagtggctg

SEQ ID NO: 185803 - DNA, 20 bp, Artificial Sequence
  Description of Artificial Sequence: Synthetic oligonucleotide
  Target: ATXN1; (-) strand; PAM type: YTN; PAM sequence: CTG
cctgatatcgggtcggagtg

SEQ ID NO: 185804 - DNA, 20 bp, Artificial Sequence
  Description of Artificial Sequence: Synthetic oligonucleotide
  Target: ATXN1; (-) strand; PAM type: YTN; PAM sequence: CTG
aaactgcctgatatcgggtc

SEQ ID NO: 185805 - DNA, 20 bp, Artificial Sequence
  Description of Artificial Sequence: Synthetic oligonucleotide
  Target: ATXN1; (-) strand; PAM type: YTN; PAM sequence: TTG
tcactgaaactgcctgatat

SEQ ID NO: 185806 - DNA, 20 bp, Artificial Sequence
  Description of Artificial Sequence: Synthetic oligonucleotide
  Target: ATXN1; (-) strand; PAM type: YTN; PAM sequence: TTG
ttgtcactgaaactgcctga

SEQ ID NO: 185807 - DNA, 20 bp, Artificial Sequence
  Description of Artificial Sequence: Synthetic oligonucleotide
  Target: ATXN1; (-) strand; PAM type: YTN; PAM sequence: TTT
gttgtcactgaaactgcctg

SEQ ID NO: 185808 - DNA, 20 bp, Artificial Sequence
  Description of Artificial Sequence: Synthetic oligonucleotide
  Target: ATXN1; (-) strand; PAM type: YTN; PAM sequence: TTG
gggaccagtttgttgtcact

SEQ ID NO: 185809 - DNA, 20 bp, Artificial Sequence
  Description of Artificial Sequence: Synthetic oligonucleotide
  Target: ATXN1; (-) strand; PAM type: YTN; PAM sequence: TTT
ggggaccagtttgttgtcac

SEQ ID NO: 185810 - DNA, 20 bp, Artificial Sequence
  Description of Artificial Sequence: Synthetic oligonucleotide
  Target: ATXN1; (-) strand; PAM type: YTN; PAM sequence: TTC
accggtacgtttggggacca

SEQ ID NO: 185811 - DNA, 20 bp, Artificial Sequence
  Description of Artificial Sequence: Synthetic oligonucleotide
  Target: ATXN1; (-) strand; PAM type: YTN; PAM sequence: TTT
caccggtacgtttggggacc

SEQ ID NO: 185812 - DNA, 20 bp, Artificial Sequence
  Description of Artificial Sequence: Synthetic oligonucleotide
  Target: ATXN1; (-) strand; PAM type: YTN; PAM sequence: TTT
tcaccggtacgtttggggac

SEQ ID NO: 185813 - DNA, 20 bp, Artificial Sequence
  Description of Artificial Sequence: Synthetic oligonucleotide
  Target: ATXN1; (-) strand; PAM type: YTN; PAM sequence: TTC
aagtcgccaagagtgagaac

SEQ ID NO: 185814 - DNA, 20 bp, Artificial Sequence
  Description of Artificial Sequence: Synthetic oligonucleotide
  Target: ATXN1; (-) strand; PAM type: YTN; PAM sequence: TTC
accaaattcaagtcgccaag

SEQ ID NO: 185815 - DNA, 20 bp, Artificial Sequence
  Description of Artificial Sequence: Synthetic oligonucleotide
  Target: ATXN1; (-) strand; PAM type: YTN; PAM sequence: TTT
caccaaattcaagtcgccaa

SEQ ID NO: 185816 - DNA, 20 bp, Artificial Sequence
  Description of Artificial Sequence: Synthetic oligonucleotide
  Target: ATXN1; (-) strand; PAM type: YTN; PAM sequence: TTC
atttcaccaaattcaagtcg

SEQ ID NO: 185817 - DNA, 20 bp, Artificial Sequence
  Description of Artificial Sequence: Synthetic oligonucleotide
  Target: ATXN1; (-) strand; PAM type: YTN; PAM sequence: TTT
catttcaccaaattcaagtc

SEQ ID NO: 185818 - DNA, 20 bp, Artificial Sequence
  Description of Artificial Sequence: Synthetic oligonucleotide
  Target: ATXN1; (-) strand; PAM type: YTN; PAM sequence: CTG
tttcatttcaccaaattcaa

SEQ ID NO: 185819 - DNA, 20 bp, Artificial Sequence
  Description of Artificial Sequence: Synthetic oligonucleotide
  Target: ATXN1; (-) strand; PAM type: YTN; PAM sequence: TTC
aaaaggcaaaaatagaaatg

SEQ ID NO: 185820 - DNA, 20 bp, Artificial Sequence
  Description of Artificial Sequence: Synthetic oligonucleotide
  Target: ATXN1; (-) strand; PAM type: YTN; PAM sequence: TTT
caaaaggcaaaaatagaaat

SEQ ID NO: 185821 - DNA, 20 bp, Artificial Sequence
  Description of Artificial Sequence: Synthetic oligonucleotide
  Target: ATXN1; (-) strand; PAM type: YTN; PAM sequence: CTT
tcaaaaggcaaaaatagaaa

SEQ ID NO: 185822 - DNA, 20 bp, Artificial Sequence
  Description of Artificial Sequence: Synthetic oligonucleotide
  Target: ATXN1; (-) strand; PAM type: YTN; PAM sequence: CTC
tttcaaaaggcaaaaataga

SEQ ID NO: 185823 - DNA, 20 bp, Artificial Sequence
  Description of Artificial Sequence: Synthetic oligonucleotide
  Target: ATXN1; (-) strand; PAM type: YTN; PAM sequence: TTA
agcataactctttcaaaagg

SEQ ID NO: 185824 - DNA, 20 bp, Artificial Sequence
  Description of Artificial Sequence: Synthetic oligonucleotide
  Target: ATXN1; (-) strand; PAM type: YTN; PAM sequence: TTT
aagcataactctttcaaaag

SEQ ID NO: 185825 - DNA, 20 bp, Artificial Sequence
  Description of Artificial Sequence: Synthetic oligonucleotide
  Target: ATXN1; (-) strand; PAM type: YTN; PAM sequence: CTT
taagcataactctttcaaaa

SEQ ID NO: 185826 - DNA, 20 bp, Artificial Sequence
  Description of Artificial Sequence: Synthetic oligonucleotide
  Target: ATXN1; (-) strand; PAM type: YTN; PAM sequence: CTA
cacctttaagcataactctt

SEQ ID NO: 185827 - DNA, 20 bp, Artificial Sequence
  Description of Artificial Sequence: Synthetic oligonucleotide
  Target: ATXN1; (-) strand; PAM type: YTN; PAM sequence: TTC
actacacctttaagcataac

SEQ ID NO: 185828 - DNA, 20 bp, Artificial Sequence
  Description of Artificial Sequence: Synthetic oligonucleotide
  Target: ATXN1; (-) strand; PAM type: YTN; PAM sequence: TTT
cactacacctttaagcataa

SEQ ID NO: 185829 - DNA, 20 bp, Artificial Sequence
  Description of Artificial Sequence: Synthetic oligonucleotide
  Target: ATXN1; (-) strand; PAM type: YTN; PAM sequence: TTT
tcactacacctttaagcata

SEQ ID NO: 185830 - DNA, 20 bp, Artificial Sequence
  Description of Artificial Sequence: Synthetic oligonucleotide
  Target: ATXN1; (-) strand; PAM type: YTN; PAM sequence: CTT
ttcactacacctttaagcat

SEQ ID NO: 185831 - DNA, 20 bp, Artificial Sequence
  Description of Artificial Sequence: Synthetic oligonucleotide
  Target: ATXN1; (-) strand; PAM type: YTN; PAM sequence: CTG
accttttcactacaccttta

SEQ ID NO: 185832 - DNA, 20 bp, Artificial Sequence
  Description of Artificial Sequence: Synthetic oligonucleotide
  Target: ATXN1; (-) strand; PAM type: YTN; PAM sequence: TTC
cagatctgaccttttcacta

SEQ ID NO: 185833 - DNA, 20 bp, Artificial Sequence
  Description of Artificial Sequence: Synthetic oligonucleotide
  Target: ATXN1; (-) strand; PAM type: YTN; PAM sequence: TTT
ccagatctgaccttttcact

SEQ ID NO: 185834 - DNA, 20 bp, Artificial Sequence
  Description of Artificial Sequence: Synthetic oligonucleotide
  Target: ATXN1; (-) strand; PAM type: YTN; PAM sequence: TTA
atttccagatctgacctttt

SEQ ID NO: 185835 - DNA, 20 bp, Artificial Sequence
  Description of Artificial Sequence: Synthetic oligonucleotide
  Target: ATXN1; (-) strand; PAM type: YTN; PAM sequence: TTA
cccattaatttccagatctg

SEQ ID NO: 185836 - DNA, 20 bp, Artificial Sequence
  Description of Artificial Sequence: Synthetic oligonucleotide
  Target: ATXN1; (-) strand; PAM type: YTN; PAM sequence: CTT
acccattaatttccagatct

SEQ ID NO: 185837 - DNA, 20 bp, Artificial Sequence
  Description of Artificial Sequence: Synthetic oligonucleotide
  Target: ATXN1; (-) strand; PAM type: YTN; PAM sequence: CTC
ggataggaccatgcttaccc

SEQ ID NO: 185838 - DNA, 20 bp, Artificial Sequence
  Description of Artificial Sequence: Synthetic oligonucleotide
  Target: ATXN1; (-) strand; PAM type: YTN; PAM sequence: CTG
acctcggataggaccatgct

SEQ ID NO: 185839 - DNA, 20 bp, Artificial Sequence
  Description of Artificial Sequence: Synthetic oligonucleotide
  Target: ATXN1; (-) strand; PAM type: YTN; PAM sequence: CTC
tgacctcggataggaccatg

SEQ ID NO: 185840 - DNA, 20 bp, Artificial Sequence
  Description of Artificial Sequence: Synthetic oligonucleotide
  Target: ATXN1; (-) strand; PAM type: YTN; PAM sequence: TTC
tctgacctcggataggacca

SEQ ID NO: 185841 - DNA, 20 bp, Artificial Sequence
  Description of Artificial Sequence: Synthetic oligonucleotide
  Target: ATXN1; (-) strand; PAM type: YTN; PAM sequence: CTT
ctctgacctcggataggacc

SEQ ID NO: 185842 - DNA, 20 bp, Artificial Sequence
  Description of Artificial Sequence: Synthetic oligonucleotide
  Target: ATXN1; (-) strand; PAM type: YTN; PAM sequence: CTC
aaaatgcttctctgacctcg

SEQ ID NO: 185843 - DNA, 20 bp, Artificial Sequence
  Description of Artificial Sequence: Synthetic oligonucleotide
  Target: ATXN1; (-) strand; PAM type: YTN; PAM sequence: CTC
tcaaaatgcttctctgacct

SEQ ID NO: 185844 - DNA, 20 bp, Artificial Sequence
  Description of Artificial Sequence: Synthetic oligonucleotide
  Target: ATXN1; (-) strand; PAM type: YTN; PAM sequence: CTG
gggcactctcaaaatgcttc

SEQ ID NO: 185845 - DNA, 20 bp, Artificial Sequence
  Description of Artificial Sequence: Synthetic oligonucleotide
  Target: ATXN1; (-) strand; PAM type: YTN; PAM sequence: CTC
tggggcactctcaaaatgct

SEQ ID NO: 185846 - DNA, 20 bp, Artificial Sequence
  Description of Artificial Sequence: Synthetic oligonucleotide
  Target: ATXN1; (-) strand; PAM type: YTN; PAM sequence: CTA
aaggctctggggcactctca

SEQ ID NO: 185847 - DNA, 20 bp, Artificial Sequence
  Description of Artificial Sequence: Synthetic oligonucleotide
  Target: ATXN1; (-) strand; PAM type: YTN; PAM sequence: TTC
taaaggctctggggcactct

SEQ ID NO: 185848 - DNA, 20 bp, Artificial Sequence
  Description of Artificial Sequence: Synthetic oligonucleotide
  Target: ATXN1; (-) strand; PAM type: YTN; PAM sequence: CTC
aaaataaacaatgtgttcta

SEQ ID NO: 185849 - DNA, 20 bp, Artificial Sequence
  Description of Artificial Sequence: Synthetic oligonucleotide
  Target: ATXN1; (-) strand; PAM type: YTN; PAM sequence: TTG
acctcaaaataaacaatgtg

SEQ ID NO: 185850 - DNA, 20 bp, Artificial Sequence
  Description of Artificial Sequence: Synthetic oligonucleotide
  Target: ATXN1; (-) strand; PAM type: YTN; PAM sequence: TTT
gacctcaaaataaacaatgt

SEQ ID NO: 185851 - DNA, 20 bp, Artificial Sequence
  Description of Artificial Sequence: Synthetic oligonucleotide
  Target: ATXN1; (-) strand; PAM type: YTN; PAM sequence: CTT
tgacctcaaaataaacaatg

SEQ ID NO: 185852 - DNA, 20 bp, Artificial Sequence
  Description of Artificial Sequence: Synthetic oligonucleotide
  Target: ATXN1; (-) strand; PAM type: YTN; PAM sequence: TTC
cctttgacctcaaaataaac

SEQ ID NO: 185853 - DNA, 20 bp, Artificial Sequence
  Description of Artificial Sequence: Synthetic oligonucleotide
  Target: ATXN1; (-) strand; PAM type: YTN; PAM sequence: TTT
ccctttgacctcaaaataaa

SEQ ID NO: 185854 - DNA, 20 bp, Artificial Sequence
  Description of Artificial Sequence: Synthetic oligonucleotide
  Target: ATXN1; (-) strand; PAM type: YTN; PAM sequence: TTT
tccctttgacctcaaaataa

SEQ ID NO: 185855 - DNA, 20 bp, Artificial Sequence
  Description of Artificial Sequence: Synthetic oligonucleotide
  Target: ATXN1; (-) strand; PAM type: YTN; PAM sequence: TTT
ttccctttgacctcaaaata

SEQ ID NO: 185856 - DNA, 20 bp, Artificial Sequence
  Description of Artificial Sequence: Synthetic oligonucleotide
  Target: ATXN1; (-) strand; PAM type: YTN; PAM sequence: TTC
caacatgtttttccctttga

SEQ ID NO: 185857 - DNA, 20 bp, Artificial Sequence
  Description of Artificial Sequence: Synthetic oligonucleotide
  Target: ATXN1; (-) strand; PAM type: YTN; PAM sequence: CTT
ccaacatgtttttccctttg

SEQ ID NO: 185858 - DNA, 20 bp, Artificial Sequence
  Description of Artificial Sequence: Synthetic oligonucleotide
  Target: ATXN1; (-) strand; PAM type: YTN; PAM sequence: TTC
cttccaacatgtttttccct

SEQ ID NO: 185859 - DNA, 20 bp, Artificial Sequence
  Description of Artificial Sequence: Synthetic oligonucleotide
  Target: ATXN1; (-) strand; PAM type: YTN; PAM sequence: TTT
ccttccaacatgtttttccc

SEQ ID NO: 185860 - DNA, 20 bp, Artificial Sequence
  Description of Artificial Sequence: Synthetic oligonucleotide
  Target: ATXN1; (-) strand; PAM type: YTN; PAM sequence: TTT
tccttccaacatgtttttcc

SEQ ID NO: 185861 - DNA, 20 bp, Artificial Sequence
  Description of Artificial Sequence: Synthetic oligonucleotide
  Target: ATXN1; (-) strand; PAM type: YTN; PAM sequence: CTT
ttccttccaacatgtttttc

SEQ ID NO: 185862 - DNA, 20 bp, Artificial Sequence
  Description of Artificial Sequence: Synthetic oligonucleotide
  Target: ATXN1; (-) strand; PAM type: YTN; PAM sequence: CTC
ttttccttccaacatgtttt

SEQ ID NO: 185863 - DNA, 20 bp, Artificial Sequence
  Description of Artificial Sequence: Synthetic oligonucleotide
  Target: ATXN1; (-) strand; PAM type: YTN; PAM sequence: TTG
tcatcacccagccaaagact

SEQ ID NO: 185864 - DNA, 20 bp, Artificial Sequence
  Description of Artificial Sequence: Synthetic oligonucleotide
  Target: ATXN1; (-) strand; PAM type: YTN; PAM sequence: TTG
tcattgtcatcacccagcca

SEQ ID NO: 185865 - DNA, 20 bp, Artificial Sequence
  Description of Artificial Sequence: Synthetic oligonucleotide
  Target: ATXN1; (-) strand; PAM type: YTN; PAM sequence: CTT
gtcattgtcatcacccagcc

SEQ ID NO: 185866 - DNA, 20 bp, Artificial Sequence
  Description of Artificial Sequence: Synthetic oligonucleotide
  Target: ATXN1; (-) strand; PAM type: YTN; PAM sequence: TTC
ttgtcattgtcatcacccag

SEQ ID NO: 185867 - DNA, 20 bp, Artificial Sequence
  Description of Artificial Sequence: Synthetic oligonucleotide
  Target: ATXN1; (-) strand; PAM type: YTN; PAM sequence: CTT
cttgtcattgtcatcaccca

SEQ ID NO: 185868 - DNA, 20 bp, Artificial Sequence
  Description of Artificial Sequence: Synthetic oligonucleotide
  Target: ATXN1; (-) strand; PAM type: YTN; PAM sequence: CTG
gaagtgtcttcttgtcattg

SEQ ID NO: 185869 - DNA, 20 bp, Artificial Sequence
  Description of Artificial Sequence: Synthetic oligonucleotide
  Target: ATXN1; (-) strand; PAM type: YTN; PAM sequence: CTC
tggaagtgtcttcttgtcat

SEQ ID NO: 185870 - DNA, 20 bp, Artificial Sequence
  Description of Artificial Sequence: Synthetic oligonucleotide
  Target: ATXN1; (-) strand; PAM type: YTN; PAM sequence: TTC
cagtctctggaagtgtcttc

SEQ ID NO: 185871 - DNA, 20 bp, Artificial Sequence
  Description of Artificial Sequence: Synthetic oligonucleotide
  Target: ATXN1; (-) strand; PAM type: YTN; PAM sequence: CTG
agtcaaagagattccagtct

SEQ ID NO: 185872 - DNA, 20 bp, Artificial Sequence
  Description of Artificial Sequence: Synthetic oligonucleotide
  Target: ATXN1; (-) strand; PAM type: YTN; PAM sequence: CTA
ccaaggggctgagtcaaaga

SEQ ID NO: 185873 - DNA, 20 bp, Artificial Sequence
  Description of Artificial Sequence: Synthetic oligonucleotide
  Target: ATXN1; (-) strand; PAM type: YTN; PAM sequence: CTA
aataaacacctaccaagggg

SEQ ID NO: 185874 - DNA, 20 bp, Artificial Sequence
  Description of Artificial Sequence: Synthetic oligonucleotide
  Target: ATXN1; (-) strand; PAM type: YTN; PAM sequence: TTC
taaataaacacctaccaagg

SEQ ID NO: 185875 - DNA, 20 bp, Artificial Sequence
  Description of Artificial Sequence: Synthetic oligonucleotide
  Target: ATXN1; (-) strand; PAM type: YTN; PAM sequence: TTG
ggttctaaataaacacctac

SEQ ID NO: 185876 - DNA, 20 bp, Artificial Sequence
  Description of Artificial Sequence: Synthetic oligonucleotide
  Target: ATXN1; (-) strand; PAM type: YTN; PAM sequence: CTT
gggttctaaataaacaccta

SEQ ID NO: 185877 - DNA, 20 bp, Artificial Sequence
  Description of Artificial Sequence: Synthetic oligonucleotide
  Target: ATXN1; (-) strand; PAM type: YTN; PAM sequence: CTC
caatgtccttgggttctaaa

SEQ ID NO: 185878 - DNA, 20 bp, Artificial Sequence
  Description of Artificial Sequence: Synthetic oligonucleotide
  Target: ATXN1; (-) strand; PAM type: YTN; PAM sequence: CTG
ccagactccaatgtccttgg

SEQ ID NO: 185879 - DNA, 20 bp, Artificial Sequence
  Description of Artificial Sequence: Synthetic oligonucleotide
  Target: ATXN1; (-) strand; PAM type: YTN; PAM sequence: TTG
tgggatcctgccagactcca

SEQ ID NO: 185880 - DNA, 20 bp, Artificial Sequence
  Description of Artificial Sequence: Synthetic oligonucleotide
  Target: ATXN1; (-) strand; PAM type: YTN; PAM sequence: TTT
gtgggatcctgccagactcc

SEQ ID NO: 185881 - DNA, 20 bp, Artificial Sequence
  Description of Artificial Sequence: Synthetic oligonucleotide
  Target: ATXN1; (-) strand; PAM type: YTN; PAM sequence: CTT
tgtgggatcctgccagactc

SEQ ID NO: 185882 - DNA, 20 bp, Artificial Sequence
  Description of Artificial Sequence: Synthetic oligonucleotide
  Target: ATXN1; (-) strand; PAM type: YTN; PAM sequence: CTC
ctttgtgggatcctgccaga

SEQ ID NO: 185883 - DNA, 20 bp, Artificial Sequence
  Description of Artificial Sequence: Synthetic oligonucleotide
  Target: ATXN1; (-) strand; PAM type: YTN; PAM sequence: CTC
gctcctttgtgggatcctgc

SEQ ID NO: 185884 - DNA, 20 bp, Artificial Sequence
  Description of Artificial Sequence: Synthetic oligonucleotide
  Target: ATXN1; (-) strand; PAM type: YTN; PAM sequence: CTC
acctcgctcctttgtgggat

SEQ ID NO: 185885 - DNA, 20 bp, Artificial Sequence
  Description of Artificial Sequence: Synthetic oligonucleotide
  Target: ATXN1; (-) strand; PAM type: YTN; PAM sequence: TTC
ctcacctcgctcctttgtgg

SEQ ID NO: 185886 - DNA, 20 bp, Artificial Sequence
  Description of Artificial Sequence: Synthetic oligonucleotide
  Target: ATXN1; (-) strand; PAM type: YTN; PAM sequence: CTC
caccagtgttcctcacctcg

SEQ ID NO: 185887 - DNA, 20 bp, Artificial Sequence
  Description of Artificial Sequence: Synthetic oligonucleotide
  Target: ATXN1; (-) strand; PAM type: YTN; PAM sequence: CTG
gtgggagaactccaccagtg

SEQ ID NO: 185888 - DNA, 20 bp, Artificial Sequence
  Description of Artificial Sequence: Synthetic oligonucleotide
  Target: ATXN1; (-) strand; PAM type: YTN; PAM sequence: CTC
aggtcatcagcaatatccgt

SEQ ID NO: 185889 - DNA, 20 bp, Artificial Sequence
  Description of Artificial Sequence: Synthetic oligonucleotide
  Target: ATXN1; (-) strand; PAM type: YTN; PAM sequence: TTC
aaggtagagcagaaaagaca

SEQ ID NO: 185890 - DNA, 20 bp, Artificial Sequence
  Description of Artificial Sequence: Synthetic oligonucleotide
  Target: ATXN1; (-) strand; PAM type: YTN; PAM sequence: CTT
caaggtagagcagaaaagac

SEQ ID NO: 185891 - DNA, 20 bp, Artificial Sequence
  Description of Artificial Sequence: Synthetic oligonucleotide
  Target: ATXN1; (-) strand; PAM type: YTN; PAM sequence: TTG
gaggcccttcaaggtagagc

SEQ ID NO: 185892 - DNA, 20 bp, Artificial Sequence
  Description of Artificial Sequence: Synthetic oligonucleotide
  Target: ATXN1; (-) strand; PAM type: YTN; PAM sequence: TTC
agaacaatgtgaccagaaaa

SEQ ID NO: 185893 - DNA, 20 bp, Artificial Sequence
  Description of Artificial Sequence: Synthetic oligonucleotide
  Target: ATXN1; (-) strand; PAM type: YTN; PAM sequence: TTT
cagaacaatgtgaccagaaa

SEQ ID NO: 185894 - DNA, 20 bp, Artificial Sequence
  Description of Artificial Sequence: Synthetic oligonucleotide
  Target: ATXN1; (-) strand; PAM type: YTN; PAM sequence: CTT
tcagaacaatgtgaccagaa

SEQ ID NO: 185895 - DNA, 20 bp, Artificial Sequence
  Description of Artificial Sequence: Synthetic oligonucleotide
  Target: ATXN1; (-) strand; PAM type: YTN; PAM sequence: CTG
acgtgtactttcagaacaat

SEQ ID NO: 185896 - DNA, 20 bp, Artificial Sequence
  Description of Artificial Sequence: Synthetic oligonucleotide
  Target: ATXN1; (-) strand; PAM type: YTN; PAM sequence: CTC
aaagctgacgtgtactttca

SEQ ID NO: 185897 - DNA, 20 bp, Artificial Sequence
  Description of Artificial Sequence: Synthetic oligonucleotide
  Target: ATXN1; (-) strand; PAM type: YTN; PAM sequence: CTG
agaggtggctcaaagctgac

SEQ ID NO: 185898 - DNA, 20 bp, Artificial Sequence
  Description of Artificial Sequence: Synthetic oligonucleotide
  Target: ATXN1; (-) strand; PAM type: YTN; PAM sequence: TTG
actgagaggtggctcaaagc

SEQ ID NO: 185899 - DNA, 20 bp, Artificial Sequence
  Description of Artificial Sequence: Synthetic oligonucleotide
  Target: ATXN1; (-) strand; PAM type: YTN; PAM sequence: CTT
gactgagaggtggctcaaag

SEQ ID NO: 185900 - DNA, 20 bp, Artificial Sequence
  Description of Artificial Sequence: Synthetic oligonucleotide
  Target: ATXN1; (-) strand; PAM type: YTN; PAM sequence: TTC
caaagagatgacccagggat

SEQ ID NO: 185901 - DNA, 20 bp, Artificial Sequence
  Description of Artificial Sequence: Synthetic oligonucleotide
  Target: ATXN1; (-) strand; PAM type: YTN; PAM sequence: TTT
ccaaagagatgacccaggga

SEQ ID NO: 185902 - DNA, 20 bp, Artificial Sequence
  Description of Artificial Sequence: Synthetic oligonucleotide
  Target: ATXN1; (-) strand; PAM type: YTN; PAM sequence: TTC
aggaagtttccaaagagatg

SEQ ID NO: 185903 - DNA, 20 bp, Artificial Sequence
  Description of Artificial Sequence: Synthetic oligonucleotide
  Target: ATXN1; (-) strand; PAM type: YTN; PAM sequence: CTA
gacaattcaggaagtttcca

SEQ ID NO: 185904 - DNA, 20 bp, Artificial Sequence
  Description of Artificial Sequence: Synthetic oligonucleotide
  Target: ATXN1; (-) strand; PAM type: YTN; PAM sequence: TTA
gcctagacaattcaggaagt

SEQ ID NO: 185905 - DNA, 20 bp, Artificial Sequence
  Description of Artificial Sequence: Synthetic oligonucleotide
  Target: ATXN1; (-) strand; PAM type: YTN; PAM sequence: CTC
gttagcctagacaattcagg

SEQ ID NO: 185906 - DNA, 20 bp, Artificial Sequence
  Description of Artificial Sequence: Synthetic oligonucleotide
  Target: ATXN1; (-) strand; PAM type: YTN; PAM sequence: CTA
aaaacactcgttagcctaga

SEQ ID NO: 185907 - DNA, 20 bp, Artificial Sequence
  Description of Artificial Sequence: Synthetic oligonucleotide
  Target: ATXN1; (-) strand; PAM type: YTN; PAM sequence: TTA
ggtggtagaagcctaaaaac

SEQ ID NO: 185908 - DNA, 20 bp, Artificial Sequence
  Description of Artificial Sequence: Synthetic oligonucleotide
  Target: ATXN1; (-) strand; PAM type: YTN; PAM sequence: TTG
acatgatcaatgagatgtgt

SEQ ID NO: 185909 - DNA, 20 bp, Artificial Sequence
  Description of Artificial Sequence: Synthetic oligonucleotide
  Target: ATXN1; (-) strand; PAM type: YTN; PAM sequence: TTA
agcaggatgttgacatgatc

SEQ ID NO: 185910 - DNA, 20 bp, Artificial Sequence
  Description of Artificial Sequence: Synthetic oligonucleotide
  Target: ATXN1; (-) strand; PAM type: YTN; PAM sequence: TTT
aagcaggatgttgacatgat

SEQ ID NO: 185911 - DNA, 20 bp, Artificial Sequence
  Description of Artificial Sequence: Synthetic oligonucleotide
  Target: ATXN1; (-) strand; PAM type: YTN; PAM sequence: TTG
aaagagtttaagcaggatgt

SEQ ID NO: 185912 - DNA, 20 bp, Artificial Sequence
  Description of Artificial Sequence: Synthetic oligonucleotide
  Target: ATXN1; (-) strand; PAM type: YTN; PAM sequence: TTG
aagacaggggagtggtcatt

SEQ ID NO: 185913 - DNA, 20 bp, Artificial Sequence
  Description of Artificial Sequence: Synthetic oligonucleotide
  Target: ATXN1; (-) strand; PAM type: YTN; PAM sequence: CTT
gaagacaggggagtggtcat

SEQ ID NO: 185914 - DNA, 20 bp, Artificial Sequence
  Description of Artificial Sequence: Synthetic oligonucleotide
  Target: ATXN1; (-) strand; PAM type: YTN; PAM sequence: TTA
tcttgaagacaggggagtgg

SEQ ID NO: 185915 - DNA, 20 bp, Artificial Sequence
  Description of Artificial Sequence: Synthetic oligonucleotide
  Target: ATXN1; (-) strand; PAM type: YTN; PAM sequence: TTT
atcttgaagacaggggagtg

SEQ ID NO: 185916 - DNA, 20 bp, Artificial Sequence
  Description of Artificial Sequence: Synthetic oligonucleotide
  Target: ATXN1; (-) strand; PAM type: YTN; PAM sequence: TTA
gagtttatcttgaagacagg

SEQ ID NO: 185917 - DNA, 20 bp, Artificial Sequence
  Description of Artificial Sequence: Synthetic oligonucleotide
  Target: ATXN1; (-) strand; PAM type: YTN; PAM sequence: TTT
agagtttatcttgaagacag

SEQ ID NO: 185918 - DNA, 20 bp, Artificial Sequence
  Description of Artificial Sequence: Synthetic oligonucleotide
  Target: ATXN1; (-) strand; PAM type: YTN; PAM sequence: CTG
aggagtttagagtttatctt

SEQ ID NO: 185919 - DNA, 20 bp, Artificial Sequence
  Description of Artificial Sequence: Synthetic oligonucleotide
  Target: ATXN1; (-) strand; PAM type: YTN; PAM sequence: CTG
ctgaggagtttagagtttat

SEQ ID NO: 185920 - DNA, 20 bp, Artificial Sequence
  Description of Artificial Sequence: Synthetic oligonucleotide
  Target: ATXN1; (-) strand; PAM type: YTN; PAM sequence: TTC
tgctgaggagtttagagttt

SEQ ID NO: 185921 - DNA, 20 bp, Artificial Sequence
  Description of Artificial Sequence: Synthetic oligonucleotide
  Target: ATXN1; (-) strand; PAM type: YTN; PAM sequence: TTC
agtaagttctgctgaggagt

SEQ ID NO: 185922 - DNA, 20 bp, Artificial Sequence
  Description of Artificial Sequence: Synthetic oligonucleotide
  Target: ATXN1; (-) strand; PAM type: YTN; PAM sequence: TTT
cagtaagttctgctgaggag

SEQ ID NO: 185923 - DNA, 20 bp, Artificial Sequence
  Description of Artificial Sequence: Synthetic oligonucleotide
  Target: ATXN1; (-) strand; PAM type: YTN; PAM sequence: TTT
tcagtaagttctgctgagga

SEQ ID NO: 185924 - DNA, 20 bp, Artificial Sequence
  Description of Artificial Sequence: Synthetic oligonucleotide
  Target: ATXN1; (-) strand; PAM type: YTN; PAM sequence: CTT
ttcagtaagttctgctgagg

SEQ ID NO: 185925 - DNA, 20 bp, Artificial Sequence
  Description of Artificial Sequence: Synthetic oligonucleotide
  Target: ATXN1; (-) strand; PAM type: YTN; PAM sequence: CTC
atgaagaaaaagccagatca

SEQ ID NO: 185926 - DNA, 20 bp, Artificial Sequence
  Description of Artificial Sequence: Synthetic oligonucleotide
  Target: ATXN1; (-) strand; PAM type: YTN; PAM sequence: CTG
gagtcaggcatatgtgaagt

SEQ ID NO: 185927 - DNA, 20 bp, Artificial Sequence
  Description of Artificial Sequence: Synthetic oligonucleotide
  Target: ATXN1; (-) strand; PAM type: YTN; PAM sequence: TTG
gagtggctggagtcaggcat

SEQ ID NO: 185928 - DNA, 20 bp, Artificial Sequence
  Description of Artificial Sequence: Synthetic oligonucleotide
  Target: ATXN1; (-) strand; PAM type: YTN; PAM sequence: TTT
ggagtggctggagtcaggca

SEQ ID NO: 185929 - DNA, 20 bp, Artificial Sequence
  Description of Artificial Sequence: Synthetic oligonucleotide
  Target: ATXN1; (-) strand; PAM type: YTN; PAM sequence: TTG
gaagacagcaagtagtttgg

SEQ ID NO: 185930 - DNA, 20 bp, Artificial Sequence
  Description of Artificial Sequence: Synthetic oligonucleotide
  Target: ATXN1; (-) strand; PAM type: YTN; PAM sequence: CTC
aaaggtaagagagaacatgg

SEQ ID NO: 185931 - DNA, 20 bp, Artificial Sequence
  Description of Artificial Sequence: Synthetic oligonucleotide
  Target: ATXN1; (-) strand; PAM type: YTN; PAM sequence: CTA
gtcacatgaggacaacatga

SEQ ID NO: 185932 - DNA, 20 bp, Artificial Sequence
  Description of Artificial Sequence: Synthetic oligonucleotide
  Target: ATXN1; (-) strand; PAM type: YTN; PAM sequence: CTC
tagtcacatgaggacaacat

SEQ ID NO: 185933 - DNA, 20 bp, Artificial Sequence
  Description of Artificial Sequence: Synthetic oligonucleotide
  Target: ATXN1; (-) strand; PAM type: YTN; PAM sequence: CTC
cagctctagtcacatgagga

SEQ ID NO: 185934 - DNA, 20 bp, Artificial Sequence
  Description of Artificial Sequence: Synthetic oligonucleotide
  Target: ATXN1; (-) strand; PAM type: YTN; PAM sequence: TTC
aaaggatggggaaactccag

SEQ ID NO: 185935 - DNA, 20 bp, Artificial Sequence
  Description of Artificial Sequence: Synthetic oligonucleotide
  Target: ATXN1; (-) strand; PAM type: YTN; PAM sequence: TTC
agttcaaaggatggggaaac

SEQ ID NO: 185936 - DNA, 20 bp, Artificial Sequence
  Description of Artificial Sequence: Synthetic oligonucleotide
  Target: ATXN1; (-) strand; PAM type: YTN; PAM sequence: TTG
ttcagttcaaaggatgggga

SEQ ID NO: 185937 - DNA, 20 bp, Artificial Sequence
  Description of Artificial Sequence: Synthetic oligonucleotide
  Target: ATXN1; (-) strand; PAM type: YTN; PAM sequence: TTT
gttcagttcaaaggatgggg

SEQ ID NO: 185938 - DNA, 20 bp, Artificial Sequence
  Description of Artificial Sequence: Synthetic oligonucleotide
  Target: ATXN1; (-) strand; PAM type: YTN; PAM sequence: TTA
atttgttcagttcaaaggat

SEQ ID NO: 185939 - DNA, 20 bp, Artificial Sequence
  Description of Artificial Sequence: Synthetic oligonucleotide
  Target: ATXN1; (-) strand; PAM type: YTN; PAM sequence: CTT
aatttgttcagttcaaagga

SEQ ID NO: 185940 - DNA, 20 bp, Artificial Sequence
  Description of Artificial Sequence: Synthetic oligonucleotide
  Target: ATXN1; (-) strand; PAM type: YTN; PAM sequence: TTA
cttaatttgttcagttcaaa

SEQ ID NO: 185941 - DNA, 20 bp, Artificial Sequence
  Description of Artificial Sequence: Synthetic oligonucleotide
  Target: ATXN1; (-) strand; PAM type: YTN; PAM sequence: TTA
accaaagcaaattacttaat

SEQ ID NO: 185942 - DNA, 20 bp, Artificial Sequence
  Description of Artificial Sequence: Synthetic oligonucleotide
  Target: ATXN1; (-) strand; PAM type: YTN; PAM sequence: TTT
aaccaaagcaaattacttaa

SEQ ID NO: 185943 - DNA, 20 bp, Artificial Sequence
  Description of Artificial Sequence: Synthetic oligonucleotide
  Target: ATXN1; (-) strand; PAM type: YTN; PAM sequence: CTT
taaccaaagcaaattactta

SEQ ID NO: 185944 - DNA, 20 bp, Artificial Sequence
  Description of Artificial Sequence: Synthetic oligonucleotide
  Target: ATXN1; (-) strand; PAM type: YTN; PAM sequence: TTC
cctttaaccaaagcaaatta

SEQ ID NO: 185945 - DNA, 20 bp, Artificial Sequence
  Description of Artificial Sequence: Synthetic oligonucleotide
  Target: ATXN1; (-) strand; PAM type: YTN; PAM sequence: TTT
ccctttaaccaaagcaaatt

SEQ ID NO: 185946 - DNA, 20 bp, Artificial Sequence
  Description of Artificial Sequence: Synthetic oligonucleotide
  Target: ATXN1; (-) strand; PAM type: YTN; PAM sequence: CTA
atttccctttaaccaaagca

SEQ ID NO: 185947 - DNA, 20 bp, Artificial Sequence
  Description of Artificial Sequence: Synthetic oligonucleotide
  Target: ATXN1; (-) strand; PAM type: YTN; PAM sequence: TTG
ctaatttccctttaaccaaa

SEQ ID NO: 185948 - DNA, 20 bp, Artificial Sequence
  Description of Artificial Sequence: Synthetic oligonucleotide
  Target: ATXN1; (-) strand; PAM type: YTN; PAM sequence: CTT
gctaatttccctttaaccaa

SEQ ID NO: 185949 - DNA, 20 bp, Artificial Sequence
  Description of Artificial Sequence: Synthetic oligonucleotide
  Target: ATXN1; (-) strand; PAM type: YTN; PAM sequence: TTC
aagatgcttgctaatttccc

SEQ ID NO: 185950 - DNA, 20 bp, Artificial Sequence
  Description of Artificial Sequence: Synthetic oligonucleotide
  Target: ATXN1; (-) strand; PAM type: YTN; PAM sequence: CTT
caagatgcttgctaatttcc

SEQ ID NO: 185951 - DNA, 20 bp, Artificial Sequence
  Description of Artificial Sequence: Synthetic oligonucleotide
  Target: ATXN1; (-) strand; PAM type: YTN; PAM sequence: CTG
cttcaagatgcttgctaatt

SEQ ID NO: 185952 - DNA, 20 bp, Artificial Sequence
  Description of Artificial Sequence: Synthetic oligonucleotide
  Target: ATXN1; (-) strand; PAM type: YTN; PAM sequence: CTC
tgcttcaagatgcttgctaa

SEQ ID NO: 185953 - DNA, 20 bp, Artificial Sequence
  Description of Artificial Sequence: Synthetic oligonucleotide
  Target: ATXN1; (-) strand; PAM type: YTN; PAM sequence: TTC
aagctctgcttcaagatgct

SEQ ID NO: 185954 - DNA, 20 bp, Artificial Sequence
  Description of Artificial Sequence: Synthetic oligonucleotide
  Target: ATXN1; (-) strand; PAM type: YTN; PAM sequence: TTT
caagctctgcttcaagatgc

SEQ ID NO: 185955 - DNA, 20 bp, Artificial Sequence
  Description of Artificial Sequence: Synthetic oligonucleotide
  Target: ATXN1; (-) strand; PAM type: YTN; PAM sequence: TTT
tcaagctctgcttcaagatg

SEQ ID NO: 185956 - DNA, 20 bp, Artificial Sequence
  Description of Artificial Sequence: Synthetic oligonucleotide
  Target: ATXN1; (-) strand; PAM type: YTN; PAM sequence: CTT
ttcaagctctgcttcaagat

SEQ ID NO: 185957 - DNA, 20 bp, Artificial Sequence
  Description of Artificial Sequence: Synthetic oligonucleotide
  Target: ATXN1; (-) strand; PAM type: YTN; PAM sequence: TTC
ccaaaagcagcaagaaaggg

SEQ ID NO: 185958 - DNA, 20 bp, Artificial Sequence
  Description of Artificial Sequence: Synthetic oligonucleotide
  Target: ATXN1; (-) strand; PAM type: YTN; PAM sequence: CTA
agggttcccaaaagcagcaa

SEQ ID NO: 185959 - DNA, 20 bp, Artificial Sequence
  Description of Artificial Sequence: Synthetic oligonucleotide
  Target: ATXN1; (-) strand; PAM type: YTN; PAM sequence: TTG
caggctaagggttcccaaaa

SEQ ID NO: 185960 - DNA, 20 bp, Artificial Sequence
  Description of Artificial Sequence: Synthetic oligonucleotide
  Target: ATXN1; (-) strand; PAM type: YTN; PAM sequence: TTT
gcaggctaagggttcccaaa

SEQ ID NO: 185961 - DNA, 20 bp, Artificial Sequence
  Description of Artificial Sequence: Synthetic oligonucleotide
  Target: ATXN1; (-) strand; PAM type: YTN; PAM sequence: CTT
tgcaggctaagggttcccaa

SEQ ID NO: 185962 - DNA, 20 bp, Artificial Sequence
  Description of Artificial Sequence: Synthetic oligonucleotide
  Target: ATXN1; (-) strand; PAM type: YTN; PAM sequence: TTC
actttgcaggctaagggttc

SEQ ID NO: 185963 - DNA, 20 bp, Artificial Sequence
  Description of Artificial Sequence: Synthetic oligonucleotide
  Target: ATXN1; (-) strand; PAM type: YTN; PAM sequence: CTT
cactttgcaggctaagggtt

SEQ ID NO: 185964 - DNA, 20 bp, Artificial Sequence
  Description of Artificial Sequence: Synthetic oligonucleotide
  Target: ATXN1; (-) strand; PAM type: YTN; PAM sequence: TTC
ttcactttgcaggctaaggg

SEQ ID NO: 185965 - DNA, 20 bp, Artificial Sequence
  Description of Artificial Sequence: Synthetic oligonucleotide
  Target: ATXN1; (-) strand; PAM type: YTN; PAM sequence: CTT
cttcactttgcaggctaagg

SEQ ID NO: 185966 - DNA, 20 bp, Artificial Sequence
  Description of Artificial Sequence: Synthetic oligonucleotide
  Target: ATXN1; (-) strand; PAM type: YTN; PAM sequence: CTG
agcttcttcactttgcaggc

SEQ ID NO: 185967 - DNA, 20 bp, Artificial Sequence
  Description of Artificial Sequence: Synthetic oligonucleotide
  Target: ATXN1; (-) strand; PAM type: YTN; PAM sequence: CTA
gtctgagcttcttcactttg

SEQ ID NO: 185968 - DNA, 20 bp, Artificial Sequence
  Description of Artificial Sequence: Synthetic oligonucleotide
  Target: ATXN1; (-) strand; PAM type: YTN; PAM sequence: CTC
cagtagactagtctgagctt

SEQ ID NO: 185969 - DNA, 20 bp, Artificial Sequence
  Description of Artificial Sequence: Synthetic oligonucleotide
  Target: ATXN1; (-) strand; PAM type: YTN; PAM sequence: CTC
atcctccagtagactagtct

SEQ ID NO: 185970 - DNA, 20 bp, Artificial Sequence
  Description of Artificial Sequence: Synthetic oligonucleotide
  Target: ATXN1; (-) strand; PAM type: YTN; PAM sequence: CTC
tcatcctccagtagactagt

SEQ ID NO: 185971 - DNA, 20 bp, Artificial Sequence
  Description of Artificial Sequence: Synthetic oligonucleotide
  Target: ATXN1; (-) strand; PAM type: YTN; PAM sequence: TTC
aggtggcctctcatcctcca

SEQ ID NO: 185972 - DNA, 20 bp, Artificial Sequence
  Description of Artificial Sequence: Synthetic oligonucleotide
  Target: ATXN1; (-) strand; PAM type: YTN; PAM sequence: CTT
caggtggcctctcatcctcc

SEQ ID NO: 185973 - DNA, 20 bp, Artificial Sequence
  Description of Artificial Sequence: Synthetic oligonucleotide
  Target: ATXN1; (-) strand; PAM type: YTN; PAM sequence: CTG
cttcaggtggcctctcatcc

SEQ ID NO: 185974 - DNA, 20 bp, Artificial Sequence
  Description of Artificial Sequence: Synthetic oligonucleotide
  Target: ATXN1; (-) strand; PAM type: YTN; PAM sequence: CTC
tgcttcaggtggcctctcat

SEQ ID NO: 185975 - DNA, 20 bp, Artificial Sequence
  Description of Artificial Sequence: Synthetic oligonucleotide
  Target: ATXN1; (-) strand; PAM type: YTN; PAM sequence: TTG
tctctgcttcaggtggcctc

SEQ ID NO: 185976 - DNA, 20 bp, Artificial Sequence
  Description of Artificial Sequence: Synthetic oligonucleotide
  Target: ATXN1; (-) strand; PAM type: YTN; PAM sequence: CTT
gtctctgcttcaggtggcct

SEQ ID NO: 185977 - DNA, 20 bp, Artificial Sequence
  Description of Artificial Sequence: Synthetic oligonucleotide
  Target: ATXN1; (-) strand; PAM type: YTN; PAM sequence: CTG
ggacagcttgtctctgcttc

SEQ ID NO: 185978 - DNA, 20 bp, Artificial Sequence
  Description of Artificial Sequence: Synthetic oligonucleotide
  Target: ATXN1; (-) strand; PAM type: YTN; PAM sequence: TTC
agctgggacagcttgtctct

SEQ ID NO: 185979 - DNA, 20 bp, Artificial Sequence
  Description of Artificial Sequence: Synthetic oligonucleotide
  Target: ATXN1; (-) strand; PAM type: YTN; PAM sequence: CTT
cagctgggacagcttgtctc

SEQ ID NO: 185980 - DNA, 20 bp, Artificial Sequence
  Description of Artificial Sequence: Synthetic oligonucleotide
  Target: ATXN1; (-) strand; PAM type: YTN; PAM sequence: CTG
agagatgggtgatcttcagc

SEQ ID NO: 185981 - DNA, 20 bp, Artificial Sequence
  Description of Artificial Sequence: Synthetic oligonucleotide
  Target: ATXN1; (-) strand; PAM type: YTN; PAM sequence: TTG
cctgagagatgggtgatctt

SEQ ID NO: 185982 - DNA, 20 bp, Artificial Sequence
  Description of Artificial Sequence: Synthetic oligonucleotide
  Target: ATXN1; (-) strand; PAM type: YTN; PAM sequence: TTT
gcctgagagatgggtgatct

SEQ ID NO: 185983 - DNA, 20 bp, Artificial Sequence
  Description of Artificial Sequence: Synthetic oligonucleotide
  Target: ATXN1; (-) strand; PAM type: YTN; PAM sequence: CTG
gtttgcctgagagatgggtg

SEQ ID NO: 185984 - DNA, 20 bp, Artificial Sequence
  Description of Artificial Sequence: Synthetic oligonucleotide
  Target: ATXN1; (-) strand; PAM type: YTN; PAM sequence: CTA
gaaggctggtttgcctgaga

SEQ ID NO: 185985 - DNA, 20 bp, Artificial Sequence
  Description of Artificial Sequence: Synthetic oligonucleotide
  Target: ATXN1; (-) strand; PAM type: YTN; PAM sequence: CTA
ctagaaggctggtttgcctg

SEQ ID NO: 185986 - DNA, 20 bp, Artificial Sequence
  Description of Artificial Sequence: Synthetic oligonucleotide
  Target: ATXN1; (-) strand; PAM type: YTN; PAM sequence: CTC
acatagctactagaaggctg

SEQ ID NO: 185987 - DNA, 20 bp, Artificial Sequence
  Description of Artificial Sequence: Synthetic oligonucleotide
  Target: ATXN1; (-) strand; PAM type: YTN; PAM sequence: CTC
actcacatagctactagaag

SEQ ID NO: 185988 - DNA, 20 bp, Artificial Sequence
  Description of Artificial Sequence: Synthetic oligonucleotide
  Target: ATXN1; (-) strand; PAM type: YTN; PAM sequence: TTA
atccagcatggtctcactca

SEQ ID NO: 185989 - DNA, 20 bp, Artificial Sequence
  Description of Artificial Sequence: Synthetic oligonucleotide
  Target: ATXN1; (-) strand; PAM type: YTN; PAM sequence: CTG
gttaatccagcatggtctca

SEQ ID NO: 185990 - DNA, 20 bp, Artificial Sequence
  Description of Artificial Sequence: Synthetic oligonucleotide
  Target: ATXN1; (-) strand; PAM type: YTN; PAM sequence: CTG
ggactggttaatccagcatg

SEQ ID NO: 185991 - DNA, 20 bp, Artificial Sequence
  Description of Artificial Sequence: Synthetic oligonucleotide
  Target: ATXN1; (-) strand; PAM type: YTN; PAM sequence: TTG
gctgggactggttaatccag

SEQ ID NO: 185992 - DNA, 20 bp, Artificial Sequence
  Description of Artificial Sequence: Synthetic oligonucleotide
  Target: ATXN1; (-) strand; PAM type: YTN; PAM sequence: CTT
ggctgggactggttaatcca

SEQ ID NO: 185993 - DNA, 20 bp, Artificial Sequence
  Description of Artificial Sequence: Synthetic oligonucleotide
  Target: ATXN1; (-) strand; PAM type: YTN; PAM sequence: CTG
ggccagcttggctgggactg

SEQ ID NO: 185994 - DNA, 20 bp, Artificial Sequence
  Description of Artificial Sequence: Synthetic oligonucleotide
  Target: ATXN1; (-) strand; PAM type: YTN; PAM sequence: TTA
gtctgggccagcttggctgg

SEQ ID NO: 185995 - DNA, 20 bp, Artificial Sequence
  Description of Artificial Sequence: Synthetic oligonucleotide
  Target: ATXN1; (-) strand; PAM type: YTN; PAM sequence: TTT
agtctgggccagcttggctg

SEQ ID NO: 185996 - DNA, 20 bp, Artificial Sequence
  Description of Artificial Sequence: Synthetic oligonucleotide
  Target: ATXN1; (-) strand; PAM type: YTN; PAM sequence: TTT
tagtctgggccagcttggct

SEQ ID NO: 185997 - DNA, 20 bp, Artificial Sequence
  Description of Artificial Sequence: Synthetic oligonucleotide
  Target: ATXN1; (-) strand; PAM type: YTN; PAM sequence: CTA
ttttagtctgggccagcttg

SEQ ID NO: 185998 - DNA, 20 bp, Artificial Sequence
  Description of Artificial Sequence: Synthetic oligonucleotide
  Target: ATXN1; (-) strand; PAM type: YTN; PAM sequence: CTG
gactattttagtctgggcca

SEQ ID NO: 185999 - DNA, 20 bp, Artificial Sequence
  Description of Artificial Sequence: Synthetic oligonucleotide
  Target: ATXN1; (-) strand; PAM type: YTN; PAM sequence: TTG
tgggtcacctggactatttt

SEQ ID NO: 186000 - DNA, 20 bp, Artificial Sequence
  Description of Artificial Sequence: Synthetic oligonucleotide
  Target: ATXN1; (-) strand; PAM type: YTN; PAM sequence: TTA
tgattgtgggtcacctggac

SEQ ID NO: 186001 - DNA, 20 bp, Artificial Sequence
  Description of Artificial Sequence: Synthetic oligonucleotide
  Target: ATXN1; (-) strand; PAM type: YTN; PAM sequence: CTT
atgattgtgggtcacctgga

SEQ ID NO: 186002 - DNA, 20 bp, Artificial Sequence
  Description of Artificial Sequence: Synthetic oligonucleotide
  Target: ATXN1; (-) strand; PAM type: YTN; PAM sequence: TTA
agggccaagaccacaatctt

SEQ ID NO: 186003 - DNA, 20 bp, Artificial Sequence
  Description of Artificial Sequence: Synthetic oligonucleotide
  Target: ATXN1; (-) strand; PAM type: YTN; PAM sequence: CTG
tgtaacaagccatcccaaca

SEQ ID NO: 186004 - DNA, 20 bp, Artificial Sequence
  Description of Artificial Sequence: Synthetic oligonucleotide
  Target: ATXN1; (-) strand; PAM type: YTN; PAM sequence: TTA
gcatatactgtgtaacaagc

SEQ ID NO: 186005 - DNA, 20 bp, Artificial Sequence
  Description of Artificial Sequence: Synthetic oligonucleotide
  Target: ATXN1; (-) strand; PAM type: YTN; PAM sequence: TTA
accagaaaacaaagtggatg

SEQ ID NO: 186006 - DNA, 20 bp, Artificial Sequence
  Description of Artificial Sequence: Synthetic oligonucleotide
  Target: ATXN1; (-) strand; PAM type: YTN; PAM sequence: TTG
aatgaggagtagatgttaac

SEQ ID NO: 186007 - DNA, 20 bp, Artificial Sequence
  Description of Artificial Sequence: Synthetic oligonucleotide
  Target: ATXN1; (-) strand; PAM type: YTN; PAM sequence: CTT
gaatgaggagtagatgttaa

SEQ ID NO: 186008 - DNA, 20 bp, Artificial Sequence
  Description of Artificial Sequence: Synthetic oligonucleotide
  Target: ATXN1; (-) strand; PAM type: YTN; PAM sequence: CTC
agacttgaatgaggagtaga

SEQ ID NO: 186009 - DNA, 20 bp, Artificial Sequence
  Description of Artificial Sequence: Synthetic oligonucleotide
  Target: ATXN1; (-) strand; PAM type: YTN; PAM sequence: TTC
atcctcagacttgaatgagg

SEQ ID NO: 186010 - DNA, 20 bp, Artificial Sequence
  Description of Artificial Sequence: Synthetic oligonucleotide
  Target: ATXN1; (-) strand; PAM type: YTN; PAM sequence: TTT
catcctcagacttgaatgag

SEQ ID NO: 186011 - DNA, 20 bp, Artificial Sequence
  Description of Artificial Sequence: Synthetic oligonucleotide
  Target: ATXN1; (-) strand; PAM type: YTN; PAM sequence: CTT
tcatcctcagacttgaatga

SEQ ID NO: 186012 - DNA, 20 bp, Artificial Sequence
  Description of Artificial Sequence: Synthetic oligonucleotide
  Target: ATXN1; (-) strand; PAM type: YTN; PAM sequence: CTG
ggatcagggaagctttcatc

SEQ ID NO: 186013 - DNA, 20 bp, Artificial Sequence
  Description of Artificial Sequence: Synthetic oligonucleotide
  Target: ATXN1; (-) strand; PAM type: YTN; PAM sequence: TTC
tgggatcagggaagctttca

SEQ ID NO: 186014 - DNA, 20 bp, Artificial Sequence
  Description of Artificial Sequence: Synthetic oligonucleotide
  Target: ATXN1; (-) strand; PAM type: YTN; PAM sequence: CTT
ctgggatcagggaagctttc

SEQ ID NO: 186015 - DNA, 20 bp, Artificial Sequence
  Description of Artificial Sequence: Synthetic oligonucleotide
  Target: ATXN1; (-) strand; PAM type: YTN; PAM sequence: TTG
ccatggatgcagaccagcat

SEQ ID NO: 186016 - DNA, 20 bp, Artificial Sequence
  Description of Artificial Sequence: Synthetic oligonucleotide
  Target: ATXN1; (-) strand; PAM type: YTN; PAM sequence: CTA
atggtacccacaggttgcca

SEQ ID NO: 186017 - DNA, 20 bp, Artificial Sequence
  Description of Artificial Sequence: Synthetic oligonucleotide
  Target: ATXN1; (-) strand; PAM type: YTN; PAM sequence: CTC
ctaatggtacccacaggttg

SEQ ID NO: 186018 - DNA, 20 bp, Artificial Sequence
  Description of Artificial Sequence: Synthetic oligonucleotide
  Target: ATXN1; (-) strand; PAM type: YTN; PAM sequence: CTC
tcctaatggtacccacaggt

SEQ ID NO: 186019 - DNA, 20 bp, Artificial Sequence
  Description of Artificial Sequence: Synthetic oligonucleotide
  Target: ATXN1; (-) strand; PAM type: YTN; PAM sequence: CTC
tctcctaatggtacccacag

SEQ ID NO: 186020 - DNA, 20 bp, Artificial Sequence
  Description of Artificial Sequence: Synthetic oligonucleotide
  Target: ATXN1; (-) strand; PAM type: YTN; PAM sequence: TTA
caccatgaccagctctctcc

SEQ ID NO: 186021 - DNA, 20 bp, Artificial Sequence
  Description of Artificial Sequence: Synthetic oligonucleotide
  Target: ATXN1; (-) strand; PAM type: YTN; PAM sequence: TTT
acaccatgaccagctctctc

SEQ ID NO: 186022 - DNA, 20 bp, Artificial Sequence
  Description of Artificial Sequence: Synthetic oligonucleotide
  Target: ATXN1; (-) strand; PAM type: YTN; PAM sequence: CTT
tacaccatgaccagctctct

SEQ ID NO: 186023 - DNA, 20 bp, Artificial Sequence
  Description of Artificial Sequence: Synthetic oligonucleotide
  Target: ATXN1; (-) strand; PAM type: YTN; PAM sequence: TTC
ctttacaccatgaccagctc

SEQ ID NO: 186024 - DNA, 20 bp, Artificial Sequence
  Description of Artificial Sequence: Synthetic oligonucleotide
  Target: ATXN1; (-) strand; PAM type: YTN; PAM sequence: CTG
gggaaagaaatgagaaaaca

SEQ ID NO: 186025 - DNA, 20 bp, Artificial Sequence
  Description of Artificial Sequence: Synthetic oligonucleotide
  Target: ATXN1; (-) strand; PAM type: YTN; PAM sequence: TTC
agtcactggggaaagaaatg

SEQ ID NO: 186026 - DNA, 20 bp, Artificial Sequence
  Description of Artificial Sequence: Synthetic oligonucleotide
  Target: ATXN1; (-) strand; PAM type: YTN; PAM sequence: TTT
cagtcactggggaaagaaat

SEQ ID NO: 186027 - DNA, 20 bp, Artificial Sequence
  Description of Artificial Sequence: Synthetic oligonucleotide
  Target: ATXN1; (-) strand; PAM type: YTN; PAM sequence: CTT
tcagtcactggggaaagaaa

SEQ ID NO: 186028 - DNA, 20 bp, Artificial Sequence
  Description of Artificial Sequence: Synthetic oligonucleotide
  Target: ATXN1; (-) strand; PAM type: YTN; PAM sequence: TTA
aaggagctttcagtcactgg

SEQ ID NO: 186029 - DNA, 20 bp, Artificial Sequence
  Description of Artificial Sequence: Synthetic oligonucleotide
  Target: ATXN1; (-) strand; PAM type: YTN; PAM sequence: CTA
cagtagttaaaggagctttc

SEQ ID NO: 186030 - DNA, 20 bp, Artificial Sequence
  Description of Artificial Sequence: Synthetic oligonucleotide
  Target: ATXN1; (-) strand; PAM type: YTN; PAM sequence: CTA
ggcacctacagtagttaaag

SEQ ID NO: 186031 - DNA, 20 bp, Artificial Sequence
  Description of Artificial Sequence: Synthetic oligonucleotide
  Target: ATXN1; (-) strand; PAM type: YTN; PAM sequence: CTA
caggctaggcacctacagta

SEQ ID NO: 186032 - DNA, 20 bp, Artificial Sequence
  Description of Artificial Sequence: Synthetic oligonucleotide
  Target: ATXN1; (-) strand; PAM type: YTN; PAM sequence: TTA
cagaaagagagagagagtgt

SEQ ID NO: 186033 - DNA, 20 bp, Artificial Sequence
  Description of Artificial Sequence: Synthetic oligonucleotide
  Target: ATXN1; (-) strand; PAM type: YTN; PAM sequence: TTT
acagaaagagagagagagtg

SEQ ID NO: 186034 - DNA, 20 bp, Artificial Sequence
  Description of Artificial Sequence: Synthetic oligonucleotide
  Target: ATXN1; (-) strand; PAM type: YTN; PAM sequence: TTC
agcaaatatttacagaaaga

SEQ ID NO: 186035 - DNA, 20 bp, Artificial Sequence
  Description of Artificial Sequence: Synthetic oligonucleotide
  Target: ATXN1; (-) strand; PAM type: YTN; PAM sequence: TTT
cagcaaatatttacagaaag

SEQ ID NO: 186036 - DNA, 20 bp, Artificial Sequence
  Description of Artificial Sequence: Synthetic oligonucleotide
  Target: ATXN1; (-) strand; PAM type: YTN; PAM sequence: CTT
tcagcaaatatttacagaaa

SEQ ID NO: 186037 - DNA, 20 bp, Artificial Sequence
  Description of Artificial Sequence: Synthetic oligonucleotide
  Target: ATXN1; (-) strand; PAM type: YTN; PAM sequence: TTC
tttcagcaaatatttacaga

SEQ ID NO: 186038 - DNA, 20 bp, Artificial Sequence
  Description of Artificial Sequence: Synthetic oligonucleotide
  Target: ATXN1; (-) strand; PAM type: YTN; PAM sequence: CTT
ctttcagcaaatatttacag

SEQ ID NO: 186039 - DNA, 20 bp, Artificial Sequence
  Description of Artificial Sequence: Synthetic oligonucleotide
  Target: ATXN1; (-) strand; PAM type: YTN; PAM sequence: TTG
tatcttctttcagcaaatat

SEQ ID NO: 186040 - DNA, 20 bp, Artificial Sequence
  Description of Artificial Sequence: Synthetic oligonucleotide
  Target: ATXN1; (-) strand; PAM type: YTN; PAM sequence: CTT
gtatcttctttcagcaaata

SEQ ID NO: 186041 - DNA, 20 bp, Artificial Sequence
  Description of Artificial Sequence: Synthetic oligonucleotide
  Target: ATXN1; (-) strand; PAM type: YTN; PAM sequence: TTC
ttgtatcttctttcagcaaa

SEQ ID NO: 186042 - DNA, 20 bp, Artificial Sequence
  Description of Artificial Sequence: Synthetic oligonucleotide
  Target: ATXN1; (-) strand; PAM type: YTN; PAM sequence: CTA
cattcttgtatcttctttca

SEQ ID NO: 186043 - DNA, 20 bp, Artificial Sequence
  Description of Artificial Sequence: Synthetic oligonucleotide
  Target: ATXN1; (-) strand; PAM type: YTN; PAM sequence: CTG
aagatggatatctacattct

SEQ ID NO: 186044 - DNA, 20 bp, Artificial Sequence
  Description of Artificial Sequence: Synthetic oligonucleotide
  Target: ATXN1; (-) strand; PAM type: YTN; PAM sequence: TTA
ggatagaagaaagcctgaag

SEQ ID NO: 186045 - DNA, 20 bp, Artificial Sequence
  Description of Artificial Sequence: Synthetic oligonucleotide
  Target: ATXN1; (-) strand; PAM type: YTN; PAM sequence: TTT
aggatagaagaaagcctgaa

SEQ ID NO: 186046 - DNA, 20 bp, Artificial Sequence
  Description of Artificial Sequence: Synthetic oligonucleotide
  Target: ATXN1; (-) strand; PAM type: YTN; PAM sequence: TTG
aaatttaggatagaagaaag

SEQ ID NO: 186047 - DNA, 20 bp, Artificial Sequence
  Description of Artificial Sequence: Synthetic oligonucleotide
  Target: ATXN1; (-) strand; PAM type: YTN; PAM sequence: TTT
gaaatttaggatagaagaaa

SEQ ID NO: 186048 - DNA, 20 bp, Artificial Sequence
  Description of Artificial Sequence: Synthetic oligonucleotide
  Target: ATXN1; (-) strand; PAM type: YTN; PAM sequence: CTT
tgaaatttaggatagaagaa

SEQ ID NO: 186049 - DNA, 20 bp, Artificial Sequence
  Description of Artificial Sequence: Synthetic oligonucleotide
  Target: ATXN1; (-) strand; PAM type: YTN; PAM sequence: TTC
tttgaaatttaggatagaag

SEQ ID NO: 186050 - DNA, 20 bp, Artificial Sequence
  Description of Artificial Sequence: Synthetic oligonucleotide
  Target: ATXN1; (-) strand; PAM type: YTN; PAM sequence: CTA
attctttgaaatttaggata

SEQ ID NO: 186051 - DNA, 20 bp, Artificial Sequence
  Description of Artificial Sequence: Synthetic oligonucleotide
  Target: ATXN1; (-) strand; PAM type: YTN; PAM sequence: CTA
gtctaattctttgaaattta

SEQ ID NO: 186052 - DNA, 20 bp, Artificial Sequence
  Description of Artificial Sequence: Synthetic oligonucleotide
  Target: ATXN1; (-) strand; PAM type: YTN; PAM sequence: CTA
ggtggtgataggtaaaaaca

SEQ ID NO: 186053 - DNA, 20 bp, Artificial Sequence
  Description of Artificial Sequence: Synthetic oligonucleotide
  Target: ATXN1; (-) strand; PAM type: YTN; PAM sequence: TTA
ccgtgtctaggtggtgatag

SEQ ID NO: 186054 - DNA, 20 bp, Artificial Sequence
  Description of Artificial Sequence: Synthetic oligonucleotide
  Target: ATXN1; (-) strand; PAM type: YTN; PAM sequence: TTG
atgtggttaccgtgtctagg

SEQ ID NO: 186055 - DNA, 20 bp, Artificial Sequence
  Description of Artificial Sequence: Synthetic oligonucleotide
  Target: ATXN1; (-) strand; PAM type: YTN; PAM sequence: TTT
gatgtggttaccgtgtctag

SEQ ID NO: 186056 - DNA, 20 bp, Artificial Sequence
  Description of Artificial Sequence: Synthetic oligonucleotide
  Target: ATXN1; (-) strand; PAM type: YTN; PAM sequence: TTT
tgatgtggttaccgtgtcta

SEQ ID NO: 186057 - DNA, 20 bp, Artificial Sequence
  Description of Artificial Sequence: Synthetic oligonucleotide
  Target: ATXN1; (-) strand; PAM type: YTN; PAM sequence: TTA
aaatacattttgatgtggtt

SEQ ID NO: 186058 - DNA, 20 bp, Artificial Sequence
  Description of Artificial Sequence: Synthetic oligonucleotide
  Target: ATXN1; (-) strand; PAM type: YTN; PAM sequence: CTG
aaaaagtaaaacattaaaat

SEQ ID NO: 186059 - DNA, 20 bp, Artificial Sequence
  Description of Artificial Sequence: Synthetic oligonucleotide
  Target: ATXN1; (-) strand; PAM type: YTN; PAM sequence: CTC
tgaaaaagtaaaacattaaa

SEQ ID NO: 186060 - DNA, 20 bp, Artificial Sequence
  Description of Artificial Sequence: Synthetic oligonucleotide
  Target: ATXN1; (-) strand; PAM type: YTN; PAM sequence: TTG
atatgagtagaactctgaaa

SEQ ID NO: 186061 - DNA, 20 bp, Artificial Sequence
  Description of Artificial Sequence: Synthetic oligonucleotide
  Target: ATXN1; (-) strand; PAM type: YTN; PAM sequence: CTG
ttgatatgagtagaactctg

SEQ ID NO: 186062 - DNA, 20 bp, Artificial Sequence
  Description of Artificial Sequence: Synthetic oligonucleotide
  Target: ATXN1; (-) strand; PAM type: YTN; PAM sequence: TTC
ccaaaggctgttgatatgag

SEQ ID NO: 186063 - DNA, 20 bp, Artificial Sequence
  Description of Artificial Sequence: Synthetic oligonucleotide
  Target: ATXN1; (-) strand; PAM type: YTN; PAM sequence: CTA
taaaaggagtagggagattc

SEQ ID NO: 186064 - DNA, 20 bp, Artificial Sequence
  Description of Artificial Sequence: Synthetic oligonucleotide
  Target: ATXN1; (-) strand; PAM type: YTN; PAM sequence: CTC
atctataaaaggagtaggga

SEQ ID NO: 186065 - DNA, 20 bp, Artificial Sequence
  Description of Artificial Sequence: Synthetic oligonucleotide
  Target: ATXN1; (-) strand; PAM type: YTN; PAM sequence: CTA
taatagtctcatctataaaa

SEQ ID NO: 186066 - DNA, 20 bp, Artificial Sequence
  Description of Artificial Sequence: Synthetic oligonucleotide
  Target: ATXN1; (-) strand; PAM type: YTN; PAM sequence: TTG
gaaactataatagtctcatc

SEQ ID NO: 186067 - DNA, 20 bp, Artificial Sequence
  Description of Artificial Sequence: Synthetic oligonucleotide
  Target: ATXN1; (-) strand; PAM type: YTN; PAM sequence: TTT
ggaaactataatagtctcat

SEQ ID NO: 186068 - DNA, 20 bp, Artificial Sequence
  Description of Artificial Sequence: Synthetic oligonucleotide
  Target: ATXN1; (-) strand; PAM type: YTN; PAM sequence: CTG
aaaggcacagtgagtttgga

SEQ ID NO: 186069 - DNA, 20 bp, Artificial Sequence
  Description of Artificial Sequence: Synthetic oligonucleotide
  Target: ATXN1; (-) strand; PAM type: YTN; PAM sequence: TTA
gtcaaactgaaaggcacagt

SEQ ID NO: 186070 - DNA, 20 bp, Artificial Sequence
  Description of Artificial Sequence: Synthetic oligonucleotide
  Target: ATXN1; (-) strand; PAM type: YTN; PAM sequence: TTA
tagtattagtcaaactgaaa

SEQ ID NO: 186071 - DNA, 20 bp, Artificial Sequence
  Description of Artificial Sequence: Synthetic oligonucleotide
  Target: ATXN1; (-) strand; PAM type: YTN; PAM sequence: TTT
atagtattagtcaaactgaa

SEQ ID NO: 186072 - DNA, 20 bp, Artificial Sequence
  Description of Artificial Sequence: Synthetic oligonucleotide
  Target: ATXN1; (-) strand; PAM type: YTN; PAM sequence: TTT
tatagtattagtcaaactga

SEQ ID NO: 186073 - DNA, 20 bp, Artificial Sequence
  Description of Artificial Sequence: Synthetic oligonucleotide
  Target: ATXN1; (-) strand; PAM type: YTN; PAM sequence: TTA
ggtgaattttatagtattag

SEQ ID NO: 186074 - DNA, 20 bp, Artificial Sequence
  Description of Artificial Sequence: Synthetic oligonucleotide
  Target: ATXN1; (-) strand; PAM type: YTN; PAM sequence: TTT
aggtgaattttatagtatta

SEQ ID NO: 186075 - DNA, 20 bp, Artificial Sequence
  Description of Artificial Sequence: Synthetic oligonucleotide
  Target: ATXN1; (-) strand; PAM type: YTN; PAM sequence: TTT
taggtgaattttatagtatt

SEQ ID NO: 186076 - DNA, 20 bp, Artificial Sequence
  Description of Artificial Sequence: Synthetic oligonucleotide
  Target: ATXN1; (-) strand; PAM type: YTN; PAM sequence: TTG
gaattttaggtgaattttat

SEQ ID NO: 186077 - DNA, 20 bp, Artificial Sequence
  Description of Artificial Sequence: Synthetic oligonucleotide
  Target: ATXN1; (-) strand; PAM type: YTN; PAM sequence: CTT
ggaattttaggtgaatttta

SEQ ID NO: 186078 - DNA, 20 bp, Artificial Sequence
  Description of Artificial Sequence: Synthetic oligonucleotide
  Target: ATXN1; (-) strand; PAM type: YTN; PAM sequence: CTG
agggcccttggaattttagg

SEQ ID NO: 186079 - DNA, 20 bp, Artificial Sequence
  Description of Artificial Sequence: Synthetic oligonucleotide
  Target: ATXN1; (-) strand; PAM type: YTN; PAM sequence: TTA
tccatgtgcatatgctgagg

SEQ ID NO: 186080 - DNA, 20 bp, Artificial Sequence
  Description of Artificial Sequence: Synthetic oligonucleotide
  Target: ATXN1; (-) strand; PAM type: YTN; PAM sequence: TTG
tcagaattatccatgtgcat

SEQ ID NO: 186081 - DNA, 20 bp, Artificial Sequence
  Description of Artificial Sequence: Synthetic oligonucleotide
  Target: ATXN1; (-) strand; PAM type: YTN; PAM sequence: TTT
gtcagaattatccatgtgca

SEQ ID NO: 186082 - DNA, 20 bp, Artificial Sequence
  Description of Artificial Sequence: Synthetic oligonucleotide
  Target: ATXN1; (-) strand; PAM type: YTN; PAM sequence: TTA
tgacagtgaaggtgacacat

SEQ ID NO: 186083 - DNA, 20 bp, Artificial Sequence
  Description of Artificial Sequence: Synthetic oligonucleotide
  Target: ATXN1; (-) strand; PAM type: YTN; PAM sequence: TTG
acatgtatatagtagaataa

SEQ ID NO: 186084 - DNA, 20 bp, Artificial Sequence
  Description of Artificial Sequence: Synthetic oligonucleotide
  Target: ATXN1; (-) strand; PAM type: YTN; PAM sequence: CTT
gacatgtatatagtagaata

SEQ ID NO: 186085 - DNA, 20 bp, Artificial Sequence
  Description of Artificial Sequence: Synthetic oligonucleotide
  Target: ATXN1; (-) strand; PAM type: YTN; PAM sequence: TTC
cttgacatgtatatagtaga

SEQ ID NO: 186086 - DNA, 20 bp, Artificial Sequence
  Description of Artificial Sequence: Synthetic oligonucleotide
  Target: ATXN1; (-) strand; PAM type: YTN; PAM sequence: CTT
ccttgacatgtatatagtag

SEQ ID NO: 186087 - DNA, 20 bp, Artificial Sequence
  Description of Artificial Sequence: Synthetic oligonucleotide
  Target: ATXN1; (-) strand; PAM type: YTN; PAM sequence: CTG
cttccttgacatgtatatag

SEQ ID NO: 186088 - DNA, 20 bp, Artificial Sequence
  Description of Artificial Sequence: Synthetic oligonucleotide
  Target: ATXN1; (-) strand; PAM type: YTN; PAM sequence: TTC
tgcttccttgacatgtatat

SEQ ID NO: 186089 - DNA, 20 bp, Artificial Sequence
  Description of Artificial Sequence: Synthetic oligonucleotide
  Target: ATXN1; (-) strand; PAM type: YTN; PAM sequence: CTT
ctgcttccttgacatgtata

SEQ ID NO: 186090 - DNA, 20 bp, Artificial Sequence
  Description of Artificial Sequence: Synthetic oligonucleotide
  Target: ATXN1; (-) strand; PAM type: YTN; PAM sequence: TTA
agaccttctgcttccttgac

SEQ ID NO: 186091 - DNA, 20 bp, Artificial Sequence
  Description of Artificial Sequence: Synthetic oligonucleotide
  Target: ATXN1; (-) strand; PAM type: YTN; PAM sequence: TTG
ttaagaccttctgcttcctt

SEQ ID NO: 186092 - DNA, 20 bp, Artificial Sequence
  Description of Artificial Sequence: Synthetic oligonucleotide
  Target: ATXN1; (-) strand; PAM type: YTN; PAM sequence: TTA
tgtattgttaagaccttctg

SEQ ID NO: 186093 - DNA, 20 bp, Artificial Sequence
  Description of Artificial Sequence: Synthetic oligonucleotide
  Target: ATXN1; (-) strand; PAM type: YTN; PAM sequence: TTC
ggttatgtattgttaagacc

SEQ ID NO: 186094 - DNA, 20 bp, Artificial Sequence
  Description of Artificial Sequence: Synthetic oligonucleotide
  Target: ATXN1; (-) strand; PAM type: YTN; PAM sequence: CTG
acagtgaattcggttatgta

SEQ ID NO: 186095 - DNA, 20 bp, Artificial Sequence
  Description of Artificial Sequence: Synthetic oligonucleotide
  Target: ATXN1; (-) strand; PAM type: YTN; PAM sequence: TTA
cactgacagtgaattcggtt

SEQ ID NO: 186096 - DNA, 20 bp, Artificial Sequence
  Description of Artificial Sequence: Synthetic oligonucleotide
  Target: ATXN1; (-) strand; PAM type: YTN; PAM sequence: TTG
tcattacactgacagtgaat

SEQ ID NO: 186097 - DNA, 20 bp, Artificial Sequence
  Description of Artificial Sequence: Synthetic oligonucleotide
  Target: ATXN1; (-) strand; PAM type: YTN; PAM sequence: CTG
tcattgtcattacactgaca

SEQ ID NO: 186098 - DNA, 20 bp, Artificial Sequence
  Description of Artificial Sequence: Synthetic oligonucleotide
  Target: ATXN1; (-) strand; PAM type: YTN; PAM sequence: TTA
actgtcattgtcattacact

SEQ ID NO: 186099 - DNA, 20 bp, Artificial Sequence
  Description of Artificial Sequence: Synthetic oligonucleotide
  Target: ATXN1; (-) strand; PAM type: YTN; PAM sequence: TTG
tcattaactgtcattgtcat

SEQ ID NO: 186100 - DNA, 20 bp, Artificial Sequence
  Description of Artificial Sequence: Synthetic oligonucleotide
  Target: ATXN1; (-) strand; PAM type: YTN; PAM sequence: CTA
taataggagttgtcattaac

SEQ ID NO: 186101 - DNA, 20 bp, Artificial Sequence
  Description of Artificial Sequence: Synthetic oligonucleotide
  Target: ATXN1; (-) strand; PAM type: YTN; PAM sequence: CTG
ctataataggagttgtcatt

SEQ ID NO: 186102 - DNA, 20 bp, Artificial Sequence
  Description of Artificial Sequence: Synthetic oligonucleotide
  Target: ATXN1; (-) strand; PAM type: YTN; PAM sequence: TTC
tgctataataggagttgtca

SEQ ID NO: 186103 - DNA, 20 bp, Artificial Sequence
  Description of Artificial Sequence: Synthetic oligonucleotide
  Target: ATXN1; (-) strand; PAM type: YTN; PAM sequence: TTT
ctgctataataggagttgtc

SEQ ID NO: 186104 - DNA, 20 bp, Artificial Sequence
  Description of Artificial Sequence: Synthetic oligonucleotide
  Target: ATXN1; (-) strand; PAM type: YTN; PAM sequence: TTG
tagagacatttctgctataa

SEQ ID NO: 186105 - DNA, 20 bp, Artificial Sequence
  Description of Artificial Sequence: Synthetic oligonucleotide
  Target: ATXN1; (-) strand; PAM type: YTN; PAM sequence: TTG
ttgtagagacatttctgcta

SEQ ID NO: 186106 - DNA, 20 bp, Artificial Sequence
  Description of Artificial Sequence: Synthetic oligonucleotide
  Target: ATXN1; (-) strand; PAM type: YTN; PAM sequence: TTT
gttgtagagacatttctgct

SEQ ID NO: 186107 - DNA, 20 bp, Artificial Sequence
  Description of Artificial Sequence: Synthetic oligonucleotide
  Target: ATXN1; (-) strand; PAM type: YTN; PAM sequence: CTT
tgttgtagagacatttctgc

SEQ ID NO: 186108 - DNA, 20 bp, Artificial Sequence
  Description of Artificial Sequence: Synthetic oligonucleotide
  Target: ATXN1; (-) strand; PAM type: YTN; PAM sequence: CTC
tttgttgtagagacatttct

SEQ ID NO: 186109 - DNA, 20 bp, Artificial Sequence
  Description of Artificial Sequence: Synthetic oligonucleotide
  Target: ATXN1; (-) strand; PAM type: YTN; PAM sequence: CTC
atctctttgttgtagagaca

SEQ ID NO: 186110 - DNA, 20 bp, Artificial Sequence
  Description of Artificial Sequence: Synthetic oligonucleotide
  Target: ATXN1; (-) strand; PAM type: YTN; PAM sequence: TTG
ctcatctctttgttgtagag

SEQ ID NO: 186111 - DNA, 20 bp, Artificial Sequence
  Description of Artificial Sequence: Synthetic oligonucleotide
  Target: ATXN1; (-) strand; PAM type: YTN; PAM sequence: CTT
gctcatctctttgttgtaga

SEQ ID NO: 186112 - DNA, 20 bp, Artificial Sequence
  Description of Artificial Sequence: Synthetic oligonucleotide
  Target: ATXN1; (-) strand; PAM type: YTN; PAM sequence: TTG
caacttgctcatctctttgt

SEQ ID NO: 186113 - DNA, 20 bp, Artificial Sequence
  Description of Artificial Sequence: Synthetic oligonucleotide
  Target: ATXN1; (-) strand; PAM type: YTN; PAM sequence: CTG
aagtgaacaggtgagcagtt

SEQ ID NO: 186114 - DNA, 20 bp, Artificial Sequence
  Description of Artificial Sequence: Synthetic oligonucleotide
  Target: ATXN1; (-) strand; PAM type: YTN; PAM sequence: TTG
ctgaagtgaacaggtgagca

SEQ ID NO: 186115 - DNA, 20 bp, Artificial Sequence
  Description of Artificial Sequence: Synthetic oligonucleotide
  Target: ATXN1; (-) strand; PAM type: YTN; PAM sequence: CTA
tcatgatgcgttgctgaagt

SEQ ID NO: 186116 - DNA, 20 bp, Artificial Sequence
  Description of Artificial Sequence: Synthetic oligonucleotide
  Target: ATXN1; (-) strand; PAM type: YTN; PAM sequence: TTC
acacaacaaaatctatcatg

SEQ ID NO: 186117 - DNA, 20 bp, Artificial Sequence
  Description of Artificial Sequence: Synthetic oligonucleotide
  Target: ATXN1; (-) strand; PAM type: YTN; PAM sequence: TTT
cacacaacaaaatctatcat

SEQ ID NO: 186118 - DNA, 20 bp, Artificial Sequence
  Description of Artificial Sequence: Synthetic oligonucleotide
  Target: ATXN1; (-) strand; PAM type: YTN; PAM sequence: TTA
tgataaatttcacacaacaa

SEQ ID NO: 186119 - DNA, 20 bp, Artificial Sequence
  Description of Artificial Sequence: Synthetic oligonucleotide
  Target: ATXN1; (-) strand; PAM type: YTN; PAM sequence: CTG
ttatgataaatttcacacaa

SEQ ID NO: 186120 - DNA, 20 bp, Artificial Sequence
  Description of Artificial Sequence: Synthetic oligonucleotide
  Target: ATXN1; (-) strand; PAM type: YTN; PAM sequence: CTG
tggcagccatgatgctgtta

SEQ ID NO: 186121 - DNA, 20 bp, Artificial Sequence
  Description of Artificial Sequence: Synthetic oligonucleotide
  Target: ATXN1; (-) strand; PAM type: YTN; PAM sequence: CTA
ataactgtggcagccatgat

SEQ ID NO: 186122 - DNA, 20 bp, Artificial Sequence
  Description of Artificial Sequence: Synthetic oligonucleotide
  Target: ATXN1; (-) strand; PAM type: YTN; PAM sequence: CTC
cctaataactgtggcagcca

SEQ ID NO: 186123 - DNA, 20 bp, Artificial Sequence
  Description of Artificial Sequence: Synthetic oligonucleotide
  Target: ATXN1; (-) strand; PAM type: YTN; PAM sequence: TTG
ctccctaataactgtggcag

SEQ ID NO: 186124 - DNA, 20 bp, Artificial Sequence
  Description of Artificial Sequence: Synthetic oligonucleotide
  Target: ATXN1; (-) strand; PAM type: YTN; PAM sequence: TTA
gcccagtgattgctccctaa

SEQ ID NO: 186125 - DNA, 20 bp, Artificial Sequence
  Description of Artificial Sequence: Synthetic oligonucleotide
  Target: ATXN1; (-) strand; PAM type: YTN; PAM sequence: TTT
agcccagtgattgctcccta

SEQ ID NO: 186126 - DNA, 20 bp, Artificial Sequence
  Description of Artificial Sequence: Synthetic oligonucleotide
  Target: ATXN1; (-) strand; PAM type: YTN; PAM sequence: TTT
tagcccagtgattgctccct

SEQ ID NO: 186127 - DNA, 20 bp, Artificial Sequence
  Description of Artificial Sequence: Synthetic oligonucleotide
  Target: ATXN1; (-) strand; PAM type: YTN; PAM sequence: TTT
ttagcccagtgattgctccc

SEQ ID NO: 186128 - DNA, 20 bp, Artificial Sequence
  Description of Artificial Sequence: Synthetic oligonucleotide
  Target: ATXN1; (-) strand; PAM type: YTN; PAM sequence: TTA
agtttttagcccagtgattg

SEQ ID NO: 186129 - DNA, 20 bp, Artificial Sequence
  Description of Artificial Sequence: Synthetic oligonucleotide
  Target: ATXN1; (-) strand; PAM type: YTN; PAM sequence: CTG
ttaagtttttagcccagtga

SEQ ID NO: 186130 - DNA, 20 bp, Artificial Sequence
  Description of Artificial Sequence: Synthetic oligonucleotide
  Target: ATXN1; (-) strand; PAM type: YTN; PAM sequence: TTA
aatgcgataaagtctgttaa

SEQ ID NO: 186131 - DNA, 20 bp, Artificial Sequence
  Description of Artificial Sequence: Synthetic oligonucleotide
  Target: ATXN1; (-) strand; PAM type: YTN; PAM sequence: TTA
agagagttaaatgcgataaa

SEQ ID NO: 186132 - DNA, 20 bp, Artificial Sequence
  Description of Artificial Sequence: Synthetic oligonucleotide
  Target: ATXN1; (-) strand; PAM type: YTN; PAM sequence: CTG
ttaagagagttaaatgcgat

SEQ ID NO: 186133 - DNA, 20 bp, Artificial Sequence
  Description of Artificial Sequence: Synthetic oligonucleotide
  Target: ATXN1; (-) strand; PAM type: YTN; PAM sequence: CTG
atgacctgttaagagagtta

SEQ ID NO: 186134 - DNA, 20 bp, Artificial Sequence
  Description of Artificial Sequence: Synthetic oligonucleotide
  Target: ATXN1; (-) strand; PAM type: YTN; PAM sequence: CTA
ccctgatgacctgttaagag

SEQ ID NO: 186135 - DNA, 20 bp, Artificial Sequence
  Description of Artificial Sequence: Synthetic oligonucleotide
  Target: ATXN1; (-) strand; PAM type: YTN; PAM sequence: CTG
accacacctaccctgatgac

SEQ ID NO: 186136 - DNA, 20 bp, Artificial Sequence
  Description of Artificial Sequence: Synthetic oligonucleotide
  Target: ATXN1; (-) strand; PAM type: YTN; PAM sequence: CTA
taaagaaggtctgaccacac

SEQ ID NO: 186137 - DNA, 20 bp, Artificial Sequence
  Description of Artificial Sequence: Synthetic oligonucleotide
  Target: ATXN1; (-) strand; PAM type: YTN; PAM sequence: TTC
atctataaagaaggtctgac

SEQ ID NO: 186138 - DNA, 20 bp, Artificial Sequence
  Description of Artificial Sequence: Synthetic oligonucleotide
  Target: ATXN1; (-) strand; PAM type: YTN; PAM sequence: CTT
catctataaagaaggtctga

SEQ ID NO: 186139 - DNA, 20 bp, Artificial Sequence
  Description of Artificial Sequence: Synthetic oligonucleotide
  Target: ATXN1; (-) strand; PAM type: YTN; PAM sequence: TTA
cttcatctataaagaaggtc

SEQ ID NO: 186140 - DNA, 20 bp, Artificial Sequence
  Description of Artificial Sequence: Synthetic oligonucleotide
  Target: ATXN1; (-) strand; PAM type: YTN; PAM sequence: TTT
acttcatctataaagaaggt

SEQ ID NO: 186141 - DNA, 20 bp, Artificial Sequence
  Description of Artificial Sequence: Synthetic oligonucleotide
  Target: ATXN1; (-) strand; PAM type: YTN; PAM sequence: TTA
tttacttcatctataaagaa

SEQ ID NO: 186142 - DNA, 20 bp, Artificial Sequence
  Description of Artificial Sequence: Synthetic oligonucleotide
  Target: ATXN1; (-) strand; PAM type: YTN; PAM sequence: CTT
atttacttcatctataaaga

SEQ ID NO: 186143 - DNA, 20 bp, Artificial Sequence
  Description of Artificial Sequence: Synthetic oligonucleotide
  Target: ATXN1; (-) strand; PAM type: YTN; PAM sequence: CTG
agccttatttacttcatcta

SEQ ID NO: 186144 - DNA, 20 bp, Artificial Sequence
  Description of Artificial Sequence: Synthetic oligonucleotide
  Target: ATXN1; (-) strand; PAM type: YTN; PAM sequence: CTC
tgagccttatttacttcatc

SEQ ID NO: 186145 - DNA, 20 bp, Artificial Sequence
  Description of Artificial Sequence: Synthetic oligonucleotide
  Target: ATXN1; (-) strand; PAM type: YTN; PAM sequence: TTC
tctgagccttatttacttca

SEQ ID NO: 186146 - DNA, 20 bp, Artificial Sequence
  Description of Artificial Sequence: Synthetic oligonucleotide
  Target: ATXN1; (-) strand; PAM type: YTN; PAM sequence: CTT
ctctgagccttatttacttc

SEQ ID NO: 186147 - DNA, 20 bp, Artificial Sequence
  Description of Artificial Sequence: Synthetic oligonucleotide
  Target: ATXN1; (-) strand; PAM type: YTN; PAM sequence: TTG
cccaacttctctgagcctta

SEQ ID NO: 186148 - DNA, 20 bp, Artificial Sequence
  Description of Artificial Sequence: Synthetic oligonucleotide
  Target: ATXN1; (-) strand; PAM type: YTN; PAM sequence: TTG
ggaaattgcccaacttctct

SEQ ID NO: 186149 - DNA, 20 bp, Artificial Sequence
  Description of Artificial Sequence: Synthetic oligonucleotide
  Target: ATXN1; (-) strand; PAM type: YTN; PAM sequence: TTT
gggaaattgcccaacttctc

SEQ ID NO: 186150 - DNA, 20 bp, Artificial Sequence
  Description of Artificial Sequence: Synthetic oligonucleotide
  Target: ATXN1; (-) strand; PAM type: YTN; PAM sequence: CTT
tgggaaattgcccaacttct

SEQ ID NO: 186151 - DNA, 20 bp, Artificial Sequence
  Description of Artificial Sequence: Synthetic oligonucleotide
  Target: ATXN1; (-) strand; PAM type: YTN; PAM sequence: CTG
tgtgtcctttgggaaattgc

SEQ ID NO: 186152 - DNA, 20 bp, Artificial Sequence
  Description of Artificial Sequence: Synthetic oligonucleotide
  Target: ATXN1; (-) strand; PAM type: YTN; PAM sequence: CTG
ccacccagtagctgtgtgtc

SEQ ID NO: 186153 - DNA, 20 bp, Artificial Sequence
  Description of Artificial Sequence: Synthetic oligonucleotide
  Target: ATXN1; (-) strand; PAM type: YTN; PAM sequence: TTC
agacctgccacccagtagct

SEQ ID NO: 186154 - DNA, 20 bp, Artificial Sequence
  Description of Artificial Sequence: Synthetic oligonucleotide
  Target: ATXN1; (-) strand; PAM type: YTN; PAM sequence: TTT
cagacctgccacccagtagc

SEQ ID NO: 186155 - DNA, 20 bp, Artificial Sequence
  Description of Artificial Sequence: Synthetic oligonucleotide
  Target: ATXN1; (-) strand; PAM type: YTN; PAM sequence: TTC
agatttcagacctgccaccc

SEQ ID NO: 186156 - DNA, 20 bp, Artificial Sequence
  Description of Artificial Sequence: Synthetic oligonucleotide
  Target: ATXN1; (-) strand; PAM type: YTN; PAM sequence: TTG
ggttcagatttcagacctgc

SEQ ID NO: 186157 - DNA, 20 bp, Artificial Sequence
  Description of Artificial Sequence: Synthetic oligonucleotide
  Target: ATXN1; (-) strand; PAM type: YTN; PAM sequence: TTT
gggttcagatttcagacctg

SEQ ID NO: 186158 - DNA, 20 bp, Artificial Sequence
  Description of Artificial Sequence: Synthetic oligonucleotide
  Target: ATXN1; (-) strand; PAM type: YTN; PAM sequence: TTG
aatcacatttgggttcagat

SEQ ID NO: 186159 - DNA, 20 bp, Artificial Sequence
  Description of Artificial Sequence: Synthetic oligonucleotide
  Target: ATXN1; (-) strand; PAM type: YTN; PAM sequence: TTT
gaatcacatttgggttcaga

SEQ ID NO: 186160 - DNA, 20 bp, Artificial Sequence
  Description of Artificial Sequence: Synthetic oligonucleotide
  Target: ATXN1; (-) strand; PAM type: YTN; PAM sequence: CTT
tgaatcacatttgggttcag

SEQ ID NO: 186161 - DNA, 20 bp, Artificial Sequence
  Description of Artificial Sequence: Synthetic oligonucleotide
  Target: ATXN1; (-) strand; PAM type: YTN; PAM sequence: CTC
tttgaatcacatttgggttc

SEQ ID NO: 186162 - DNA, 20 bp, Artificial Sequence
  Description of Artificial Sequence: Synthetic oligonucleotide
  Target: ATXN1; (-) strand; PAM type: YTN; PAM sequence: TTC
atataagagactctttgaat

SEQ ID NO: 186163 - DNA, 20 bp, Artificial Sequence
  Description of Artificial Sequence: Synthetic oligonucleotide
  Target: ATXN1; (-) strand; PAM type: YTN; PAM sequence: TTA
gttcatataagagactcttt

SEQ ID NO: 186164 - DNA, 20 bp, Artificial Sequence
  Description of Artificial Sequence: Synthetic oligonucleotide
  Target: ATXN1; (-) strand; PAM type: YTN; PAM sequence: TTA
aagtattagttcatataaga

SEQ ID NO: 186165 - DNA, 20 bp, Artificial Sequence
  Description of Artificial Sequence: Synthetic oligonucleotide
  Target: ATXN1; (-) strand; PAM type: YTN; PAM sequence: TTT
aaagtattagttcatataag

SEQ ID NO: 186166 - DNA, 20 bp, Artificial Sequence
  Description of Artificial Sequence: Synthetic oligonucleotide
  Target: ATXN1; (-) strand; PAM type: YTN; PAM sequence: TTA
acagcatcagatttaaagta

SEQ ID NO: 186167 - DNA, 20 bp, Artificial Sequence
  Description of Artificial Sequence: Synthetic oligonucleotide
  Target: ATXN1; (-) strand; PAM type: YTN; PAM sequence: CTT
aacagcatcagatttaaagt

SEQ ID NO: 186168 - DNA, 20 bp, Artificial Sequence
  Description of Artificial Sequence: Synthetic oligonucleotide
  Target: ATXN1; (-) strand; PAM type: YTN; PAM sequence: CTG
ccacttaacagcatcagatt

SEQ ID NO: 186169 - DNA, 20 bp, Artificial Sequence
  Description of Artificial Sequence: Synthetic oligonucleotide
  Target: ATXN1; (-) strand; PAM type: YTN; PAM sequence: TTA
tcactgccacttaacagcat

SEQ ID NO: 186170 - DNA, 20 bp, Artificial Sequence
  Description of Artificial Sequence: Synthetic oligonucleotide
  Target: ATXN1; (-) strand; PAM type: YTN; PAM sequence: TTC
caaaggaagatcattatcac

SEQ ID NO: 186171 - DNA, 20 bp, Artificial Sequence
  Description of Artificial Sequence: Synthetic oligonucleotide
  Target: ATXN1; (-) strand; PAM type: YTN; PAM sequence: CTT
ccaaaggaagatcattatca

SEQ ID NO: 186172 - DNA, 20 bp, Artificial Sequence
  Description of Artificial Sequence: Synthetic oligonucleotide
  Target: ATXN1; (-) strand; PAM type: YTN; PAM sequence: TTA
tcttccaaaggaagatcatt

SEQ ID NO: 186173 - DNA, 20 bp, Artificial Sequence
  Description of Artificial Sequence: Synthetic oligonucleotide
  Target: ATXN1; (-) strand; PAM type: YTN; PAM sequence: CTT
atcttccaaaggaagatcat

SEQ ID NO: 186174 - DNA, 20 bp, Artificial Sequence
  Description of Artificial Sequence: Synthetic oligonucleotide
  Target: ATXN1; (-) strand; PAM type: YTN; PAM sequence: TTC
cttatcttccaaaggaagat

SEQ ID NO: 186175 - DNA, 20 bp, Artificial Sequence
  Description of Artificial Sequence: Synthetic oligonucleotide
  Target: ATXN1; (-) strand; PAM type: YTN; PAM sequence: TTT
ccttatcttccaaaggaaga

SEQ ID NO: 186176 - DNA, 20 bp, Artificial Sequence
  Description of Artificial Sequence: Synthetic oligonucleotide
  Target: ATXN1; (-) strand; PAM type: YTN; PAM sequence: CTA
tttccttatcttccaaagga

SEQ ID NO: 186177 - DNA, 20 bp, Artificial Sequence
  Description of Artificial Sequence: Synthetic oligonucleotide
  Target: ATXN1; (-) strand; PAM type: YTN; PAM sequence: CTC
tatttccttatcttccaaag

SEQ ID NO: 186178 - DNA, 20 bp, Artificial Sequence
  Description of Artificial Sequence: Synthetic oligonucleotide
  Target: ATXN1; (-) strand; PAM type: YTN; PAM sequence: CTG
ggtgcctctatttccttatc

SEQ ID NO: 186179 - DNA, 20 bp, Artificial Sequence
  Description of Artificial Sequence: Synthetic oligonucleotide
  Target: ATXN1; (-) strand; PAM type: YTN; PAM sequence: CTA
tctgggtgcctctatttcct

SEQ ID NO: 186180 - DNA, 20 bp, Artificial Sequence
  Description of Artificial Sequence: Synthetic oligonucleotide
  Target: ATXN1; (-) strand; PAM type: YTN; PAM sequence: CTC
tatctgggtgcctctatttc

SEQ ID NO: 186181 - DNA, 20 bp, Artificial Sequence
  Description of Artificial Sequence: Synthetic oligonucleotide
  Target: ATXN1; (-) strand; PAM type: YTN; PAM sequence: CTC
tctatctgggtgcctctatt

SEQ ID NO: 186182 - DNA, 20 bp, Artificial Sequence
  Description of Artificial Sequence: Synthetic oligonucleotide
  Target: ATXN1; (-) strand; PAM type: YTN; PAM sequence: CTA
ctctctatctgggtgcctct

SEQ ID NO: 186183 - DNA, 20 bp, Artificial Sequence
  Description of Artificial Sequence: Synthetic oligonucleotide
  Target: ATXN1; (-) strand; PAM type: YTN; PAM sequence: TTA
gaccagtggcaagctactct

SEQ ID NO: 186184 - DNA, 20 bp, Artificial Sequence
  Description of Artificial Sequence: Synthetic oligonucleotide
  Target: ATXN1; (-) strand; PAM type: YTN; PAM sequence: TTT
agaccagtggcaagctactc

SEQ ID NO: 186185 - DNA, 20 bp, Artificial Sequence
  Description of Artificial Sequence: Synthetic oligonucleotide
  Target: ATXN1; (-) strand; PAM type: YTN; PAM sequence: TTT
tagaccagtggcaagctact

SEQ ID NO: 186186 - DNA, 20 bp, Artificial Sequence
  Description of Artificial Sequence: Synthetic oligonucleotide
  Target: ATXN1; (-) strand; PAM type: YTN; PAM sequence: CTT
ttagaccagtggcaagctac

SEQ ID NO: 186187 - DNA, 20 bp, Artificial Sequence
  Description of Artificial Sequence: Synthetic oligonucleotide
  Target: ATXN1; (-) strand; PAM type: YTN; PAM sequence: CTG
cccttttagaccagtggcaa

SEQ ID NO: 186188 - DNA, 20 bp, Artificial Sequence
  Description of Artificial Sequence: Synthetic oligonucleotide
  Target: ATXN1; (-) strand; PAM type: YTN; PAM sequence: TTC
ccatccctgcccttttagac

SEQ ID NO: 186189 - DNA, 20 bp, Artificial Sequence
  Description of Artificial Sequence: Synthetic oligonucleotide
  Target: ATXN1; (-) strand; PAM type: YTN; PAM sequence: CTT
cccatccctgcccttttaga

SEQ ID NO: 186190 - DNA, 20 bp, Artificial Sequence
  Description of Artificial Sequence: Synthetic oligonucleotide
  Target: ATXN1; (-) strand; PAM type: YTN; PAM sequence: CTC
ttcccatccctgccctttta

SEQ ID NO: 186191 - DNA, 20 bp, Artificial Sequence
  Description of Artificial Sequence: Synthetic oligonucleotide
  Target: ATXN1; (-) strand; PAM type: YTN; PAM sequence: TTC
tcttcccatccctgcccttt

SEQ ID NO: 186192 - DNA, 20 bp, Artificial Sequence
  Description of Artificial Sequence: Synthetic oligonucleotide
  Target: ATXN1; (-) strand; PAM type: YTN; PAM sequence: CTG
ggttctcttcccatccctgc

SEQ ID NO: 186193 - DNA, 20 bp, Artificial Sequence
  Description of Artificial Sequence: Synthetic oligonucleotide
  Target: ATXN1; (-) strand; PAM type: YTN; PAM sequence: CTA
agaagggacacctgggttct

SEQ ID NO: 186194 - DNA, 20 bp, Artificial Sequence
  Description of Artificial Sequence: Synthetic oligonucleotide
  Target: ATXN1; (-) strand; PAM type: YTN; PAM sequence: CTC
aggctaagaagggacacctg

SEQ ID NO: 186195 - DNA, 20 bp, Artificial Sequence
  Description of Artificial Sequence: Synthetic oligonucleotide
  Target: ATXN1; (-) strand; PAM type: YTN; PAM sequence: CTG
tccagtagcaggaacctcag

SEQ ID NO: 186196 - DNA, 20 bp, Artificial Sequence
  Description of Artificial Sequence: Synthetic oligonucleotide
  Target: ATXN1; (-) strand; PAM type: YTN; PAM sequence: CTC
tgtccagtagcaggaacctc

SEQ ID NO: 186197 - DNA, 20 bp, Artificial Sequence
  Description of Artificial Sequence: Synthetic oligonucleotide
  Target: ATXN1; (-) strand; PAM type: YTN; PAM sequence: TTG
ggctctgtccagtagcagga

SEQ ID NO: 186198 - DNA, 20 bp, Artificial Sequence
  Description of Artificial Sequence: Synthetic oligonucleotide
  Target: ATXN1; (-) strand; PAM type: YTN; PAM sequence: CTT
gggctctgtccagtagcagg

SEQ ID NO: 186199 - DNA, 20 bp, Artificial Sequence
  Description of Artificial Sequence: Synthetic oligonucleotide
  Target: ATXN1; (-) strand; PAM type: YTN; PAM sequence: CTA
aggagaagatagggacacct

SEQ ID NO: 186200 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaagtaa

SEQ ID NO: 186201 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaaaaa

SEQ ID NO: 186202 - DNA, 20 bp, Artificial Sequence
  Description of Artificial Sequence: Synthetic oligonucleotide
  Target: ATXN1; (-) strand; PAM type: YTN; PAM sequence: CTG
ggtaacagagtgagactcca

SEQ ID NO: 186203 - DNA, 20 bp, Artificial Sequence
  Description of Artificial Sequence: Synthetic oligonucleotide
  Target: ATXN1; (-) strand; PAM type: YTN; PAM sequence: CTC
cagtctgggtaacagagtga

SEQ ID NO: 186204 - DNA, 20 bp, Artificial Sequence
  Description of Artificial Sequence: Synthetic oligonucleotide
  Target: ATXN1; (-) strand; PAM type: YTN; PAM sequence: CTG
cactccagtctgggtaacag

SEQ ID NO: 186205 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcatgcc

SEQ ID NO: 186206 - DNA, 20 bp, Artificial Sequence
  Description of Artificial Sequence: Synthetic oligonucleotide
  Target: ATXN1; (-) strand; PAM type: YTN; PAM sequence: TTG
gacccgggaggtggaggttg

SEQ ID NO: 186207 - DNA, 20 bp, Artificial Sequence
  Description of Artificial Sequence: Synthetic oligonucleotide
  Target: ATXN1; (-) strand; PAM type: YTN; PAM sequence: CTT
ggacccgggaggtggaggtt

SEQ ID NO: 186208 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgga

SEQ ID NO: 186209 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 186210 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaggcagga

SEQ ID NO: 186211 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcgggag

SEQ ID NO: 186212 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggtgcatgcctg

SEQ ID NO: 186213 - DNA, 20 bp, Artificial Sequence
  Description of Artificial Sequence: Synthetic oligonucleotide
  Target: ATXN1; (-) strand; PAM type: YTN; PAM sequence: TTA
gctgggcatggtggtgcatg

SEQ ID NO: 186214 - DNA, 20 bp, Artificial Sequence
  Description of Artificial Sequence: Synthetic oligonucleotide
  Target: ATXN1; (-) strand; PAM type: YTN; PAM sequence: CTA
aaaatatatataaaattagc

SEQ ID NO: 186215 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatatatataaaatt

SEQ ID NO: 186216 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatatatataaaa

SEQ ID NO: 186217 - DNA, 20 bp, Artificial Sequence
  Description of Artificial Sequence: Synthetic oligonucleotide
  Target: ATXN1; (-) strand; PAM type: YTN; PAM sequence: TTA
tctctactaaaaatatatat

SEQ ID NO: 186218 - DNA, 20 bp, Artificial Sequence
  Description of Artificial Sequence: Synthetic oligonucleotide
  Target: ATXN1; (-) strand; PAM type: YTN; PAM sequence: CTT
atctctactaaaaatatata

SEQ ID NO: 186219 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacctta

SEQ ID NO: 186220 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggccaacat

SEQ ID NO: 186221 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcaagacca

SEQ ID NO: 186222 - DNA, 20 bp, Artificial Sequence
  Description of Artificial Sequence: Synthetic oligonucleotide
  Target: ATXN1; (-) strand; PAM type: YTN; PAM sequence: TTG
ggaagccaaggcgggtggat

SEQ ID NO: 186223 - DNA, 20 bp, Artificial Sequence
  Description of Artificial Sequence: Synthetic oligonucleotide
  Target: ATXN1; (-) strand; PAM type: YTN; PAM sequence: TTT
gggaagccaaggcgggtgga

SEQ ID NO: 186224 - DNA, 20 bp, Artificial Sequence
  Description of Artificial Sequence: Synthetic oligonucleotide
  Target: ATXN1; (-) strand; PAM type: YTN; PAM sequence: CTT
tgggaagccaaggcgggtgg

SEQ ID NO: 186225 - DNA, 20 bp, Artificial Sequence
  Description of Artificial Sequence: Synthetic oligonucleotide
  Target: ATXN1; (-) strand; PAM type: YTN; PAM sequence: TTC
cagcactttgggaagccaag

SEQ ID NO: 186226 - DNA, 20 bp, Artificial Sequence
  Description of Artificial Sequence: Synthetic oligonucleotide
  Target: ATXN1; (-) strand; PAM type: YTN; PAM sequence: CTA
ggccaggcacagtaattcca

SEQ ID NO: 186227 - DNA, 20 bp, Artificial Sequence
  Description of Artificial Sequence: Synthetic oligonucleotide
  Target: ATXN1; (-) strand; PAM type: YTN; PAM sequence: TTA
atgactaggccaggcacagt

SEQ ID NO: 186228 - DNA, 20 bp, Artificial Sequence
  Description of Artificial Sequence: Synthetic oligonucleotide
  Target: ATXN1; (-) strand; PAM type: YTN; PAM sequence: TTA
atcaaaatattaatgactag

SEQ ID NO: 186229 - DNA, 20 bp, Artificial Sequence
  Description of Artificial Sequence: Synthetic oligonucleotide
  Target: ATXN1; (-) strand; PAM type: YTN; PAM sequence: TTG
atcacaggggtaggcgttaa

SEQ ID NO: 186230 - DNA, 20 bp, Artificial Sequence
  Description of Artificial Sequence: Synthetic oligonucleotide
  Target: ATXN1; (-) strand; PAM type: YTN; PAM sequence: TTG
tcgttgatcacaggggtagg

SEQ ID NO: 186231 - DNA, 20 bp, Artificial Sequence
  Description of Artificial Sequence: Synthetic oligonucleotide
  Target: ATXN1; (-) strand; PAM type: YTN; PAM sequence: CTG
aataagttgtcgttgatcac

SEQ ID NO: 186232 - DNA, 20 bp, Artificial Sequence
  Description of Artificial Sequence: Synthetic oligonucleotide
  Target: ATXN1; (-) strand; PAM type: YTN; PAM sequence: TTC
ctgaataagttgtcgttgat

SEQ ID NO: 186233 - DNA, 20 bp, Artificial Sequence
  Description of Artificial Sequence: Synthetic oligonucleotide
  Target: ATXN1; (-) strand; PAM type: YTN; PAM sequence: CTT
cctgaataagttgtcgttga

SEQ ID NO: 186234 - DNA, 20 bp, Artificial Sequence
  Description of Artificial Sequence: Synthetic oligonucleotide
  Target: ATXN1; (-) strand; PAM type: YTN; PAM sequence: TTC
ttcctgaataagttgtcgtt

SEQ ID NO: 186235 - DNA, 20 bp, Artificial Sequence
  Description of Artificial Sequence: Synthetic oligonucleotide
  Target: ATXN1; (-) strand; PAM type: YTN; PAM sequence: CTT
cttcctgaataagttgtcgt

SEQ ID NO: 186236 - DNA, 20 bp, Artificial Sequence
  Description of Artificial Sequence: Synthetic oligonucleotide
  Target: ATXN1; (-) strand; PAM type: YTN; PAM sequence: CTA
gagtagaaagaacccttctt

SEQ ID NO: 186237 - DNA, 20 bp, Artificial Sequence
  Description of Artificial Sequence: Synthetic oligonucleotide
  Target: ATXN1; (-) strand; PAM type: YTN; PAM sequence: CTG
gaagcatactagagtagaaa

SEQ ID NO: 186238 - DNA, 20 bp, Artificial Sequence
  Description of Artificial Sequence: Synthetic oligonucleotide
  Target: ATXN1; (-) strand; PAM type: YTN; PAM sequence: CTA
gatacacagtaaataactgg

SEQ ID NO: 186239 - DNA, 20 bp, Artificial Sequence
  Description of Artificial Sequence: Synthetic oligonucleotide
  Target: ATXN1; (-) strand; PAM type: YTN; PAM sequence: CTA
gctagatacacagtaaataa

SEQ ID NO: 186240 - DNA, 20 bp, Artificial Sequence
  Description of Artificial Sequence: Synthetic oligonucleotide
  Target: ATXN1; (-) strand; PAM type: YTN; PAM sequence: TTC
acaacctagctagatacaca

SEQ ID NO: 186241 - DNA, 20 bp, Artificial Sequence
  Description of Artificial Sequence: Synthetic oligonucleotide
  Target: ATXN1; (-) strand; PAM type: YTN; PAM sequence: TTT
cacaacctagctagatacac

SEQ ID NO: 186242 - DNA, 20 bp, Artificial Sequence
  Description of Artificial Sequence: Synthetic oligonucleotide
  Target: ATXN1; (-) strand; PAM type: YTN; PAM sequence: TTT
tcacaacctagctagataca

SEQ ID NO: 186243 - DNA, 20 bp, Artificial Sequence
  Description of Artificial Sequence: Synthetic oligonucleotide
  Target: ATXN1; (-) strand; PAM type: YTN; PAM sequence: CTT
ttcacaacctagctagatac

SEQ ID NO: 186244 - DNA, 20 bp, Artificial Sequence
  Description of Artificial Sequence: Synthetic oligonucleotide
  Target: ATXN1; (-) strand; PAM type: YTN; PAM sequence: TTC
ttttcacaacctagctagat

SEQ ID NO: 186245 - DNA, 20 bp, Artificial Sequence
  Description of Artificial Sequence: Synthetic oligonucleotide
  Target: ATXN1; (-) strand; PAM type: YTN; PAM sequence: TTT
cttttcacaacctagctaga

SEQ ID NO: 186246 - DNA, 20 bp, Artificial Sequence
  Description of Artificial Sequence: Synthetic oligonucleotide
  Target: ATXN1; (-) strand; PAM type: YTN; PAM sequence: TTT
tcttttcacaacctagctag

SEQ ID NO: 186247 - DNA, 20 bp, Artificial Sequence
  Description of Artificial Sequence: Synthetic oligonucleotide
  Target: ATXN1; (-) strand; PAM type: YTN; PAM sequence: CTT
ttcttttcacaacctagcta

SEQ ID NO: 186248 - DNA, 20 bp, Artificial Sequence
  Description of Artificial Sequence: Synthetic oligonucleotide
  Target: ATXN1; (-) strand; PAM type: YTN; PAM sequence: TTC
ttttcttttcacaacctagc

SEQ ID NO: 186249 - DNA, 20 bp, Artificial Sequence
  Description of Artificial Sequence: Synthetic oligonucleotide
  Target: ATXN1; (-) strand; PAM type: YTN; PAM sequence: TTC
atattcttttcttttcacaa

SEQ ID NO: 186250 - DNA, 20 bp, Artificial Sequence
  Description of Artificial Sequence: Synthetic oligonucleotide
  Target: ATXN1; (-) strand; PAM type: YTN; PAM sequence: CTT
catattcttttcttttcaca

SEQ ID NO: 186251 - DNA, 20 bp, Artificial Sequence
  Description of Artificial Sequence: Synthetic oligonucleotide
  Target: ATXN1; (-) strand; PAM type: YTN; PAM sequence: TTC
gtgcttcatattcttttctt

SEQ ID NO: 186252 - DNA, 20 bp, Artificial Sequence
  Description of Artificial Sequence: Synthetic oligonucleotide
  Target: ATXN1; (-) strand; PAM type: YTN; PAM sequence: CTT
cgtgcttcatattcttttct

SEQ ID NO: 186253 - DNA, 20 bp, Artificial Sequence
  Description of Artificial Sequence: Synthetic oligonucleotide
  Target: ATXN1; (-) strand; PAM type: YTN; PAM sequence: TTC
atgaacttcgtgcttcatat

SEQ ID NO: 186254 - DNA, 20 bp, Artificial Sequence
  Description of Artificial Sequence: Synthetic oligonucleotide
  Target: ATXN1; (-) strand; PAM type: YTN; PAM sequence: TTT
catgaacttcgtgcttcata

SEQ ID NO: 186255 - DNA, 20 bp, Artificial Sequence
  Description of Artificial Sequence: Synthetic oligonucleotide
  Target: ATXN1; (-) strand; PAM type: YTN; PAM sequence: TTA
ggtttcatgaacttcgtgct

SEQ ID NO: 186256 - DNA, 20 bp, Artificial Sequence
  Description of Artificial Sequence: Synthetic oligonucleotide
  Target: ATXN1; (-) strand; PAM type: YTN; PAM sequence: TTG
gtaaagtagatgatagacca

SEQ ID NO: 186257 - DNA, 20 bp, Artificial Sequence
  Description of Artificial Sequence: Synthetic oligonucleotide
  Target: ATXN1; (-) strand; PAM type: YTN; PAM sequence: TTT
ggtaaagtagatgatagacc

SEQ ID NO: 186258 - DNA, 20 bp, Artificial Sequence
  Description of Artificial Sequence: Synthetic oligonucleotide
  Target: ATXN1; (-) strand; PAM type: YTN; PAM sequence: TTA
gaagaaatttggtaaagtag

SEQ ID NO: 186259 - DNA, 20 bp, Artificial Sequence
  Description of Artificial Sequence: Synthetic oligonucleotide
  Target: ATXN1; (-) strand; PAM type: YTN; PAM sequence: TTT
agaagaaatttggtaaagta

SEQ ID NO: 186260 - DNA, 20 bp, Artificial Sequence
  Description of Artificial Sequence: Synthetic oligonucleotide
  Target: ATXN1; (-) strand; PAM type: YTN; PAM sequence: TTT
tagaagaaatttggtaaagt

SEQ ID NO: 186261 - DNA, 20 bp, Artificial Sequence
  Description of Artificial Sequence: Synthetic oligonucleotide
  Target: ATXN1; (-) strand; PAM type: YTN; PAM sequence: TTT
ttagaagaaatttggtaaag

SEQ ID NO: 186262 - DNA, 20 bp, Artificial Sequence
  Description of Artificial Sequence: Synthetic oligonucleotide
  Target: ATXN1; (-) strand; PAM type: YTN; PAM sequence: TTT
tttagaagaaatttggtaaa

SEQ ID NO: 186263 - DNA, 20 bp, Artificial Sequence
  Description of Artificial Sequence: Synthetic oligonucleotide
  Target: ATXN1; (-) strand; PAM type: YTN; PAM sequence: CTT
ttttagaagaaatttggtaa

SEQ ID NO: 186264 - DNA, 20 bp, Artificial Sequence
  Description of Artificial Sequence: Synthetic oligonucleotide
  Target: ATXN1; (-) strand; PAM type: YTN; PAM sequence: TTG
cttttttagaagaaatttgg

SEQ ID NO: 186265 - DNA, 20 bp, Artificial Sequence
  Description of Artificial Sequence: Synthetic oligonucleotide
  Target: ATXN1; (-) strand; PAM type: YTN; PAM sequence: TTG
atggttgcttttttagaaga

SEQ ID NO: 186266 - DNA, 20 bp, Artificial Sequence
  Description of Artificial Sequence: Synthetic oligonucleotide
  Target: ATXN1; (-) strand; PAM type: YTN; PAM sequence: TTT
gatggttgcttttttagaag

SEQ ID NO: 186267 - DNA, 20 bp, Artificial Sequence
  Description of Artificial Sequence: Synthetic oligonucleotide
  Target: ATXN1; (-) strand; PAM type: YTN; PAM sequence: CTG
ggtttgatggttgctttttt

SEQ ID NO: 186268 - DNA, 20 bp, Artificial Sequence
  Description of Artificial Sequence: Synthetic oligonucleotide
  Target: ATXN1; (-) strand; PAM type: YTN; PAM sequence: CTC
tgggtttgatggttgctttt

SEQ ID NO: 186269 - DNA, 20 bp, Artificial Sequence
  Description of Artificial Sequence: Synthetic oligonucleotide
  Target: ATXN1; (-) strand; PAM type: YTN; PAM sequence: TTC
tctgggtttgatggttgctt

SEQ ID NO: 186270 - DNA, 20 bp, Artificial Sequence
  Description of Artificial Sequence: Synthetic oligonucleotide
  Target: ATXN1; (-) strand; PAM type: YTN; PAM sequence: CTT
ctctgggtttgatggttgct

SEQ ID NO: 186271 - DNA, 20 bp, Artificial Sequence
  Description of Artificial Sequence: Synthetic oligonucleotide
  Target: ATXN1; (-) strand; PAM type: YTN; PAM sequence: TTC
ttctctgggtttgatggttg

SEQ ID NO: 186272 - DNA, 20 bp, Artificial Sequence
  Description of Artificial Sequence: Synthetic oligonucleotide
  Target: ATXN1; (-) strand; PAM type: YTN; PAM sequence: TTC
aaattcttctctgggtttga

SEQ ID NO: 186273 - DNA, 20 bp, Artificial Sequence
  Description of Artificial Sequence: Synthetic oligonucleotide
  Target: ATXN1; (-) strand; PAM type: YTN; PAM sequence: CTT
caaattcttctctgggtttg

SEQ ID NO: 186274 - DNA, 20 bp, Artificial Sequence
  Description of Artificial Sequence: Synthetic oligonucleotide
  Target: ATXN1; (-) strand; PAM type: YTN; PAM sequence: TTA
gaagcttcaaattcttctct

SEQ ID NO: 186275 - DNA, 20 bp, Artificial Sequence
  Description of Artificial Sequence: Synthetic oligonucleotide
  Target: ATXN1; (-) strand; PAM type: YTN; PAM sequence: TTA
aagttagaagcttcaaattc

SEQ ID NO: 186276 - DNA, 20 bp, Artificial Sequence
  Description of Artificial Sequence: Synthetic oligonucleotide
  Target: ATXN1; (-) strand; PAM type: YTN; PAM sequence: CTA
atgtgaatggcattaaagtt

SEQ ID NO: 186277 - DNA, 20 bp, Artificial Sequence
  Description of Artificial Sequence: Synthetic oligonucleotide
  Target: ATXN1; (-) strand; PAM type: YTN; PAM sequence: CTC
atatgaataagaaatacaac

SEQ ID NO: 186278 - DNA, 20 bp, Artificial Sequence
  Description of Artificial Sequence: Synthetic oligonucleotide
  Target: ATXN1; (-) strand; PAM type: YTN; PAM sequence: CTC
tcatatgaataagaaataca

SEQ ID NO: 186279 - DNA, 20 bp, Artificial Sequence
  Description of Artificial Sequence: Synthetic oligonucleotide
  Target: ATXN1; (-) strand; PAM type: YTN; PAM sequence: TTC
tctcatatgaataagaaata

SEQ ID NO: 186280 - DNA, 20 bp, Artificial Sequence
  Description of Artificial Sequence: Synthetic oligonucleotide
  Target: ATXN1; (-) strand; PAM type: YTN; PAM sequence: TTA
tagtgcacaggtcataaaga

SEQ ID NO: 186281 - DNA, 20 bp, Artificial Sequence
  Description of Artificial Sequence: Synthetic oligonucleotide
  Target: ATXN1; (-) strand; PAM type: YTN; PAM sequence: TTT
atagtgcacaggtcataaag

SEQ ID NO: 186282 - DNA, 20 bp, Artificial Sequence
  Description of Artificial Sequence: Synthetic oligonucleotide
  Target: ATXN1; (-) strand; PAM type: YTN; PAM sequence: CTT
tatagtgcacaggtcataaa

SEQ ID NO: 186283 - DNA, 20 bp, Artificial Sequence
  Description of Artificial Sequence: Synthetic oligonucleotide
  Target: ATXN1; (-) strand; PAM type: YTN; PAM sequence: TTC
tttatagtgcacaggtcata

SEQ ID NO: 186284 - DNA, 20 bp, Artificial Sequence
  Description of Artificial Sequence: Synthetic oligonucleotide
  Target: ATXN1; (-) strand; PAM type: YTN; PAM sequence: CTC
atcattctttatagtgcaca

SEQ ID NO: 186285 - DNA, 20 bp, Artificial Sequence
  Description of Artificial Sequence: Synthetic oligonucleotide
  Target: ATXN1; (-) strand; PAM type: YTN; PAM sequence: TTA
aatactcatcattctttata

SEQ ID NO: 186286 - DNA, 20 bp, Artificial Sequence
  Description of Artificial Sequence: Synthetic oligonucleotide
  Target: ATXN1; (-) strand; PAM type: YTN; PAM sequence: TTT
aaatactcatcattctttat

SEQ ID NO: 186287 - DNA, 20 bp, Artificial Sequence
  Description of Artificial Sequence: Synthetic oligonucleotide
  Target: ATXN1; (-) strand; PAM type: YTN; PAM sequence: TTA
gtgtttaaatactcatcatt

SEQ ID NO: 186288 - DNA, 20 bp, Artificial Sequence
  Description of Artificial Sequence: Synthetic oligonucleotide
  Target: ATXN1; (-) strand; PAM type: YTN; PAM sequence: CTT
agtgtttaaatactcatcat

SEQ ID NO: 186289 - DNA, 20 bp, Artificial Sequence
  Description of Artificial Sequence: Synthetic oligonucleotide
  Target: ATXN1; (-) strand; PAM type: YTN; PAM sequence: TTC
aacacttagtgtttaaatac

SEQ ID NO: 186290 - DNA, 20 bp, Artificial Sequence
  Description of Artificial Sequence: Synthetic oligonucleotide
  Target: ATXN1; (-) strand; PAM type: YTN; PAM sequence: TTA
attcaacacttagtgtttaa

SEQ ID NO: 186291 - DNA, 20 bp, Artificial Sequence
  Description of Artificial Sequence: Synthetic oligonucleotide
  Target: ATXN1; (-) strand; PAM type: YTN; PAM sequence: CTG
ttaattcaacacttagtgtt

SEQ ID NO: 186292 - DNA, 20 bp, Artificial Sequence
  Description of Artificial Sequence: Synthetic oligonucleotide
  Target: ATXN1; (-) strand; PAM type: YTN; PAM sequence: TTA
tataactgttaattcaacac

SEQ ID NO: 186293 - DNA, 20 bp, Artificial Sequence
  Description of Artificial Sequence: Synthetic oligonucleotide
  Target: ATXN1; (-) strand; PAM type: YTN; PAM sequence: TTA
ttatataactgttaattcaa

SEQ ID NO: 186294 - DNA, 20 bp, Artificial Sequence
  Description of Artificial Sequence: Synthetic oligonucleotide
  Target: ATXN1; (-) strand; PAM type: YTN; PAM sequence: TTG
gattattatataactgttaa

SEQ ID NO: 186295 - DNA, 20 bp, Artificial Sequence
  Description of Artificial Sequence: Synthetic oligonucleotide
  Target: ATXN1; (-) strand; PAM type: YTN; PAM sequence: TTT
ggattattatataactgtta

SEQ ID NO: 186296 - DNA, 20 bp, Artificial Sequence
  Description of Artificial Sequence: Synthetic oligonucleotide
  Target: ATXN1; (-) strand; PAM type: YTN; PAM sequence: TTT
tggattattatataactgtt

SEQ ID NO: 186297 - DNA, 20 bp, Artificial Sequence
  Description of Artificial Sequence: Synthetic oligonucleotide
  Target: ATXN1; (-) strand; PAM type: YTN; PAM sequence: TTT
ttggattattatataactgt

SEQ ID NO: 186298 - DNA, 20 bp, Artificial Sequence
  Description of Artificial Sequence: Synthetic oligonucleotide
  Target: ATXN1; (-) strand; PAM type: YTN; PAM sequence: TTT
tttggattattatataactg

SEQ ID NO: 186299 - DNA, 20 bp, Artificial Sequence
  Description of Artificial Sequence: Synthetic oligonucleotide
  Target: ATXN1; (-) strand; PAM type: YTN; PAM sequence: TTT
ttttggattattatataact

SEQ ID NO: 186300 - DNA, 20 bp, Artificial Sequence
  Description of Artificial Sequence: Synthetic oligonucleotide
  Target: ATXN1; (-) strand; PAM type: YTN; PAM sequence: TTT
tttttggattattatataac

SEQ ID NO: 186301 - DNA, 20 bp, Artificial Sequence
  Description of Artificial Sequence: Synthetic oligonucleotide
  Target: ATXN1; (-) strand; PAM type: YTN; PAM sequence: TTT
ttttttggattattatataa

SEQ ID NO: 186302 - DNA, 20 bp, Artificial Sequence
  Description of Artificial Sequence: Synthetic oligonucleotide
  Target: ATXN1; (-) strand; PAM type: YTN; PAM sequence: TTT
tttttttggattattatata

SEQ ID NO: 186303 - DNA, 20 bp, Artificial Sequence
  Description of Artificial Sequence: Synthetic oligonucleotide
  Target: ATXN1; (-) strand; PAM type: YTN; PAM sequence: TTT
ttttttttggattattatat

SEQ ID NO: 186304 - DNA, 20 bp, Artificial Sequence
  Description of Artificial Sequence: Synthetic oligonucleotide
  Target: ATXN1; (-) strand; PAM type: YTN; PAM sequence: TTG
tttttttttttggattatta

SEQ ID NO: 186305 - DNA, 20 bp, Artificial Sequence
  Description of Artificial Sequence: Synthetic oligonucleotide
  Target: ATXN1; (-) strand; PAM type: YTN; PAM sequence: TTT
gtttttttttttggattatt

SEQ ID NO: 186306 - DNA, 20 bp, Artificial Sequence
  Description of Artificial Sequence: Synthetic oligonucleotide
  Target: ATXN1; (-) strand; PAM type: YTN; PAM sequence: TTT
tgtttttttttttggattat

SEQ ID NO: 186307 - DNA, 20 bp, Artificial Sequence
  Description of Artificial Sequence: Synthetic oligonucleotide
  Target: ATXN1; (-) strand; PAM type: YTN; PAM sequence: TTT
ttgtttttttttttggatta

SEQ ID NO: 186308 - DNA, 20 bp, Artificial Sequence
  Description of Artificial Sequence: Synthetic oligonucleotide
  Target: ATXN1; (-) strand; PAM type: YTN; PAM sequence: TTT
tttgtttttttttttggatt

SEQ ID NO: 186309 - DNA, 20 bp, Artificial Sequence
  Description of Artificial Sequence: Synthetic oligonucleotide
  Target: ATXN1; (-) strand; PAM type: YTN; PAM sequence: TTG
ttttttgtttttttttttgg

SEQ ID NO: 186310 - DNA, 20 bp, Artificial Sequence
  Description of Artificial Sequence: Synthetic oligonucleotide
  Target: ATXN1; (-) strand; PAM type: YTN; PAM sequence: TTT
gttttttgtttttttttttg

SEQ ID NO: 186311 - DNA, 20 bp, Artificial Sequence
  Description of Artificial Sequence: Synthetic oligonucleotide
  Target: ATXN1; (-) strand; PAM type: YTN; PAM sequence: TTT
tgttttttgttttttttttt

SEQ ID NO: 186312 - DNA, 20 bp, Artificial Sequence
  Description of Artificial Sequence: Synthetic oligonucleotide
  Target: ATXN1; (-) strand; PAM type: YTN; PAM sequence: TTT
ttgttttttgtttttttttt

SEQ ID NO: 186313 - DNA, 20 bp, Artificial Sequence
  Description of Artificial Sequence: Synthetic oligonucleotide
  Target: ATXN1; (-) strand; PAM type: YTN; PAM sequence: TTG
atacagtggagaagtacagt

SEQ ID NO: 186314 - DNA, 20 bp, Artificial Sequence
  Description of Artificial Sequence: Synthetic oligonucleotide
  Target: ATXN1; (-) strand; PAM type: YTN; PAM sequence: TTT
gatacagtggagaagtacag

SEQ ID NO: 186315 - DNA, 20 bp, Artificial Sequence
  Description of Artificial Sequence: Synthetic oligonucleotide
  Target: ATXN1; (-) strand; PAM type: YTN; PAM sequence: TTT
tgatacagtggagaagtaca

SEQ ID NO: 186316 - DNA, 20 bp, Artificial Sequence
  Description of Artificial Sequence: Synthetic oligonucleotide
  Target: ATXN1; (-) strand; PAM type: YTN; PAM sequence: TTA
agtacattttgatacagtgg

SEQ ID NO: 186317 - DNA, 20 bp, Artificial Sequence
  Description of Artificial Sequence: Synthetic oligonucleotide
  Target: ATXN1; (-) strand; PAM type: YTN; PAM sequence: CTA
ttaagtacattttgatacag

SEQ ID NO: 186318 - DNA, 20 bp, Artificial Sequence
  Description of Artificial Sequence: Synthetic oligonucleotide
  Target: ATXN1; (-) strand; PAM type: YTN; PAM sequence: CTG
aaacaataaatacctattaa

SEQ ID NO: 186319 - DNA, 20 bp, Artificial Sequence
  Description of Artificial Sequence: Synthetic oligonucleotide
  Target: ATXN1; (-) strand; PAM type: YTN; PAM sequence: TTC
ctgaaacaataaatacctat

SEQ ID NO: 186320 - DNA, 20 bp, Artificial Sequence
  Description of Artificial Sequence: Synthetic oligonucleotide
  Target: ATXN1; (-) strand; PAM type: YTN; PAM sequence: TTG
tatattcctgaaacaataaa

SEQ ID NO: 186321 - DNA, 20 bp, Artificial Sequence
  Description of Artificial Sequence: Synthetic oligonucleotide
  Target: ATXN1; (-) strand; PAM type: YTN; PAM sequence: TTA
aatgatagaagacattgtat

SEQ ID NO: 186322 - DNA, 20 bp, Artificial Sequence
  Description of Artificial Sequence: Synthetic oligonucleotide
  Target: ATXN1; (-) strand; PAM type: YTN; PAM sequence: TTT
aaatgatagaagacattgta

SEQ ID NO: 186323 - DNA, 20 bp, Artificial Sequence
  Description of Artificial Sequence: Synthetic oligonucleotide
  Target: ATXN1; (-) strand; PAM type: YTN; PAM sequence: TTG
acaaaatgatttaaatgata

SEQ ID NO: 186324 - DNA, 20 bp, Artificial Sequence
  Description of Artificial Sequence: Synthetic oligonucleotide
  Target: ATXN1; (-) strand; PAM type: YTN; PAM sequence: TTA
aattgacaaaatgatttaaa

SEQ ID NO: 186325 - DNA, 20 bp, Artificial Sequence
  Description of Artificial Sequence: Synthetic oligonucleotide
  Target: ATXN1; (-) strand; PAM type: YTN; PAM sequence: TTT
aaattgacaaaatgatttaa

SEQ ID NO: 186326 - DNA, 20 bp, Artificial Sequence
  Description of Artificial Sequence: Synthetic oligonucleotide
  Target: ATXN1; (-) strand; PAM type: YTN; PAM sequence: TTT
taaattgacaaaatgattta

SEQ ID NO: 186327 - DNA, 20 bp, Artificial Sequence
  Description of Artificial Sequence: Synthetic oligonucleotide
  Target: ATXN1; (-) strand; PAM type: YTN; PAM sequence: TTA
ttttaaattgacaaaatgat

SEQ ID NO: 186328 - DNA, 20 bp, Artificial Sequence
  Description of Artificial Sequence: Synthetic oligonucleotide
  Target: ATXN1; (-) strand; PAM type: YTN; PAM sequence: TTG
acagggtgtagtgtgcccag

SEQ ID NO: 186329 - DNA, 20 bp, Artificial Sequence
  Description of Artificial Sequence: Synthetic oligonucleotide
  Target: ATXN1; (-) strand; PAM type: YTN; PAM sequence: TTT
gacagggtgtagtgtgccca

SEQ ID NO: 186330 - DNA, 20 bp, Artificial Sequence
  Description of Artificial Sequence: Synthetic oligonucleotide
  Target: ATXN1; (-) strand; PAM type: YTN; PAM sequence: TTG
tttgacagggtgtagtgtgc

SEQ ID NO: 186331 - DNA, 20 bp, Artificial Sequence
  Description of Artificial Sequence: Synthetic oligonucleotide
  Target: ATXN1; (-) strand; PAM type: YTN; PAM sequence: TTT
gtttgacagggtgtagtgtg

SEQ ID NO: 186332 - DNA, 20 bp, Artificial Sequence
  Description of Artificial Sequence: Synthetic oligonucleotide
  Target: ATXN1; (-) strand; PAM type: YTN; PAM sequence: TTT
tgtttgacagggtgtagtgt

SEQ ID NO: 186333 - DNA, 20 bp, Artificial Sequence
  Description of Artificial Sequence: Synthetic oligonucleotide
  Target: ATXN1; (-) strand; PAM type: YTN; PAM sequence: TTG
tatgagataaagtaaatcag

SEQ ID NO: 186334 - DNA, 20 bp, Artificial Sequence
  Description of Artificial Sequence: Synthetic oligonucleotide
  Target: ATXN1; (-) strand; PAM type: YTN; PAM sequence: TTT
gtatgagataaagtaaatca

SEQ ID NO: 186335 - DNA, 20 bp, Artificial Sequence
  Description of Artificial Sequence: Synthetic oligonucleotide
  Target: ATXN1; (-) strand; PAM type: YTN; PAM sequence: TTT
tgtatgagataaagtaaatc

SEQ ID NO: 186336 - DNA, 20 bp, Artificial Sequence
  Description of Artificial Sequence: Synthetic oligonucleotide
  Target: ATXN1; (-) strand; PAM type: YTN; PAM sequence: TTC
aggatgttttgtatgagata

SEQ ID NO: 186337 - DNA, 20 bp, Artificial Sequence
  Description of Artificial Sequence: Synthetic oligonucleotide
  Target: ATXN1; (-) strand; PAM type: YTN; PAM sequence: TTT
caggatgttttgtatgagat

SEQ ID NO: 186338 - DNA, 20 bp, Artificial Sequence
  Description of Artificial Sequence: Synthetic oligonucleotide
  Target: ATXN1; (-) strand; PAM type: YTN; PAM sequence: TTT
tcaggatgttttgtatgaga

SEQ ID NO: 186339 - DNA, 20 bp, Artificial Sequence
  Description of Artificial Sequence: Synthetic oligonucleotide
  Target: ATXN1; (-) strand; PAM type: YTN; PAM sequence: TTC
agagcatcccatattttcag

SEQ ID NO: 186340 - DNA, 20 bp, Artificial Sequence
  Description of Artificial Sequence: Synthetic oligonucleotide
  Target: ATXN1; (-) strand; PAM type: YTN; PAM sequence: TTT
cagagcatcccatattttca

SEQ ID NO: 186341 - DNA, 20 bp, Artificial Sequence
  Description of Artificial Sequence: Synthetic oligonucleotide
  Target: ATXN1; (-) strand; PAM type: YTN; PAM sequence: CTT
tcagagcatcccatattttc

SEQ ID NO: 186342 - DNA, 20 bp, Artificial Sequence
  Description of Artificial Sequence: Synthetic oligonucleotide
  Target: ATXN1; (-) strand; PAM type: YTN; PAM sequence: TTG
gcactttcagagcatcccat

SEQ ID NO: 186343 - DNA, 20 bp, Artificial Sequence
  Description of Artificial Sequence: Synthetic oligonucleotide
  Target: ATXN1; (-) strand; PAM type: YTN; PAM sequence: CTG
ttggcactttcagagcatcc

SEQ ID NO: 186344 - DNA, 20 bp, Artificial Sequence
  Description of Artificial Sequence: Synthetic oligonucleotide
  Target: ATXN1; (-) strand; PAM type: YTN; PAM sequence: CTC
caagggtagctgttggcact

SEQ ID NO: 186345 - DNA, 20 bp, Artificial Sequence
  Description of Artificial Sequence: Synthetic oligonucleotide
  Target: ATXN1; (-) strand; PAM type: YTN; PAM sequence: TTG
gaaaaagaaaaactccaagg

SEQ ID NO: 186346 - DNA, 20 bp, Artificial Sequence
  Description of Artificial Sequence: Synthetic oligonucleotide
  Target: ATXN1; (-) strand; PAM type: YTN; PAM sequence: TTT
ggaaaaagaaaaactccaag

SEQ ID NO: 186347 - DNA, 20 bp, Artificial Sequence
  Description of Artificial Sequence: Synthetic oligonucleotide
  Target: ATXN1; (-) strand; PAM type: YTN; PAM sequence: TTT
tggaaaaagaaaaactccaa

SEQ ID NO: 186348 - DNA, 20 bp, Artificial Sequence
  Description of Artificial Sequence: Synthetic oligonucleotide
  Target: ATXN1; (-) strand; PAM type: YTN; PAM sequence: TTT
ttggaaaaagaaaaactcca

SEQ ID NO: 186349 - DNA, 20 bp, Artificial Sequence
  Description of Artificial Sequence: Synthetic oligonucleotide
  Target: ATXN1; (-) strand; PAM type: YTN; PAM sequence: TTG
aaagaaataatttttggaaa

SEQ ID NO: 186350 - DNA, 20 bp, Artificial Sequence
  Description of Artificial Sequence: Synthetic oligonucleotide
  Target: ATXN1; (-) strand; PAM type: YTN; PAM sequence: CTG
gaattgaaagaaataatttt

SEQ ID NO: 186351 - DNA, 20 bp, Artificial Sequence
  Description of Artificial Sequence: Synthetic oligonucleotide
  Target: ATXN1; (-) strand; PAM type: YTN; PAM sequence: CTG
ggactggaattgaaagaaat

SEQ ID NO: 186352 - DNA, 20 bp, Artificial Sequence
  Description of Artificial Sequence: Synthetic oligonucleotide
  Target: ATXN1; (-) strand; PAM type: YTN; PAM sequence: CTG
gtagtgaagatctgggactg

SEQ ID NO: 186353 - DNA, 20 bp, Artificial Sequence
  Description of Artificial Sequence: Synthetic oligonucleotide
  Target: ATXN1; (-) strand; PAM type: YTN; PAM sequence: CTG
aaataagggctggtagtgaa

SEQ ID NO: 186354 - DNA, 20 bp, Artificial Sequence
  Description of Artificial Sequence: Synthetic oligonucleotide
  Target: ATXN1; (-) strand; PAM type: YTN; PAM sequence: CTA
ccatagctgaaataagggct

SEQ ID NO: 186355 - DNA, 20 bp, Artificial Sequence
  Description of Artificial Sequence: Synthetic oligonucleotide
  Target: ATXN1; (-) strand; PAM type: YTN; PAM sequence: TTC
taccatagctgaaataaggg

SEQ ID NO: 186356 - DNA, 20 bp, Artificial Sequence
  Description of Artificial Sequence: Synthetic oligonucleotide
  Target: ATXN1; (-) strand; PAM type: YTN; PAM sequence: CTT
ctaccatagctgaaataagg

SEQ ID NO: 186357 - DNA, 20 bp, Artificial Sequence
  Description of Artificial Sequence: Synthetic oligonucleotide
  Target: ATXN1; (-) strand; PAM type: YTN; PAM sequence: CTC
cttctaccatagctgaaata

SEQ ID NO: 186358 - DNA, 20 bp, Artificial Sequence
  Description of Artificial Sequence: Synthetic oligonucleotide
  Target: ATXN1; (-) strand; PAM type: YTN; PAM sequence: TTC
actccttctaccatagctga

SEQ ID NO: 186359 - DNA, 20 bp, Artificial Sequence
  Description of Artificial Sequence: Synthetic oligonucleotide
  Target: ATXN1; (-) strand; PAM type: YTN; PAM sequence: CTC
aacagaaggtatattcactc

SEQ ID NO: 186360 - DNA, 20 bp, Artificial Sequence
  Description of Artificial Sequence: Synthetic oligonucleotide
  Target: ATXN1; (-) strand; PAM type: YTN; PAM sequence: TTG
tatactcaacagaaggtata

SEQ ID NO: 186361 - DNA, 20 bp, Artificial Sequence
  Description of Artificial Sequence: Synthetic oligonucleotide
  Target: ATXN1; (-) strand; PAM type: YTN; PAM sequence: TTT
gtatactcaacagaaggtat

SEQ ID NO: 186362 - DNA, 20 bp, Artificial Sequence
  Description of Artificial Sequence: Synthetic oligonucleotide
  Target: ATXN1; (-) strand; PAM type: YTN; PAM sequence: TTT
tgtatactcaacagaaggta

SEQ ID NO: 186363 - DNA, 20 bp, Artificial Sequence
  Description of Artificial Sequence: Synthetic oligonucleotide
  Target: ATXN1; (-) strand; PAM type: YTN; PAM sequence: CTA
gcacgttttgtatactcaac

SEQ ID NO: 186364 - DNA, 20 bp, Artificial Sequence
  Description of Artificial Sequence: Synthetic oligonucleotide
  Target: ATXN1; (-) strand; PAM type: YTN; PAM sequence: TTC
tagcacgttttgtatactca

SEQ ID NO: 186365 - DNA, 20 bp, Artificial Sequence
  Description of Artificial Sequence: Synthetic oligonucleotide
  Target: ATXN1; (-) strand; PAM type: YTN; PAM sequence: TTT
ctagcacgttttgtatactc

SEQ ID NO: 186366 - DNA, 20 bp, Artificial Sequence
  Description of Artificial Sequence: Synthetic oligonucleotide
  Target: ATXN1; (-) strand; PAM type: YTN; PAM sequence: CTG
accatttctagcacgttttg

SEQ ID NO: 186367 - DNA, 20 bp, Artificial Sequence
  Description of Artificial Sequence: Synthetic oligonucleotide
  Target: ATXN1; (-) strand; PAM type: YTN; PAM sequence: TTA
gggtgtaactgaccatttct

SEQ ID NO: 186368 - DNA, 20 bp, Artificial Sequence
  Description of Artificial Sequence: Synthetic oligonucleotide
  Target: ATXN1; (-) strand; PAM type: YTN; PAM sequence: TTT
agggtgtaactgaccatttc

SEQ ID NO: 186369 - DNA, 20 bp, Artificial Sequence
  Description of Artificial Sequence: Synthetic oligonucleotide
  Target: ATXN1; (-) strand; PAM type: YTN; PAM sequence: TTA
tgatgggaaagacatttagg

SEQ ID NO: 186370 - DNA, 20 bp, Artificial Sequence
  Description of Artificial Sequence: Synthetic oligonucleotide
  Target: ATXN1; (-) strand; PAM type: YTN; PAM sequence: CTT
atgatgggaaagacatttag

SEQ ID NO: 186371 - DNA, 20 bp, Artificial Sequence
  Description of Artificial Sequence: Synthetic oligonucleotide
  Target: ATXN1; (-) strand; PAM type: YTN; PAM sequence: CTG
tgtgcttatgatgggaaaga

SEQ ID NO: 186372 - DNA, 20 bp, Artificial Sequence
  Description of Artificial Sequence: Synthetic oligonucleotide
  Target: ATXN1; (-) strand; PAM type: YTN; PAM sequence: TTG
catgaaactgtgtgcttatg

SEQ ID NO: 186373 - DNA, 20 bp, Artificial Sequence
  Description of Artificial Sequence: Synthetic oligonucleotide
  Target: ATXN1; (-) strand; PAM type: YTN; PAM sequence: CTC
aagtcgagataattgcatga

SEQ ID NO: 186374 - DNA, 20 bp, Artificial Sequence
  Description of Artificial Sequence: Synthetic oligonucleotide
  Target: ATXN1; (-) strand; PAM type: YTN; PAM sequence: CTG
aatgaccacactcaagtcga

SEQ ID NO: 186375 - DNA, 20 bp, Artificial Sequence
  Description of Artificial Sequence: Synthetic oligonucleotide
  Target: ATXN1; (-) strand; PAM type: YTN; PAM sequence: TTC
cactgaatgaccacactcaa

SEQ ID NO: 186376 - DNA, 20 bp, Artificial Sequence
  Description of Artificial Sequence: Synthetic oligonucleotide
  Target: ATXN1; (-) strand; PAM type: YTN; PAM sequence: TTG
ttccactgaatgaccacact

SEQ ID NO: 186377 - DNA, 20 bp, Artificial Sequence
  Description of Artificial Sequence: Synthetic oligonucleotide
  Target: ATXN1; (-) strand; PAM type: YTN; PAM sequence: TTT
gttccactgaatgaccacac

SEQ ID NO: 186378 - DNA, 20 bp, Artificial Sequence
  Description of Artificial Sequence: Synthetic oligonucleotide
  Target: ATXN1; (-) strand; PAM type: YTN; PAM sequence: TTG
tcatttgttccactgaatga

SEQ ID NO: 186379 - DNA, 20 bp, Artificial Sequence
  Description of Artificial Sequence: Synthetic oligonucleotide
  Target: ATXN1; (-) strand; PAM type: YTN; PAM sequence: CTC
aatgaccgttgtcatttgtt

SEQ ID NO: 186380 - DNA, 20 bp, Artificial Sequence
  Description of Artificial Sequence: Synthetic oligonucleotide
  Target: ATXN1; (-) strand; PAM type: YTN; PAM sequence: TTG
tagtctcaatgaccgttgtc

SEQ ID NO: 186381 - DNA, 20 bp, Artificial Sequence
  Description of Artificial Sequence: Synthetic oligonucleotide
  Target: ATXN1; (-) strand; PAM type: YTN; PAM sequence: TTT
gtagtctcaatgaccgttgt

SEQ ID NO: 186382 - DNA, 20 bp, Artificial Sequence
  Description of Artificial Sequence: Synthetic oligonucleotide
  Target: ATXN1; (-) strand; PAM type: YTN; PAM sequence: TTT
tgtagtctcaatgaccgttg

SEQ ID NO: 186383 - DNA, 20 bp, Artificial Sequence
  Description of Artificial Sequence: Synthetic oligonucleotide
  Target: ATXN1; (-) strand; PAM type: YTN; PAM sequence: TTT
ttgtagtctcaatgaccgtt

SEQ ID NO: 186384 - DNA, 20 bp, Artificial Sequence
  Description of Artificial Sequence: Synthetic oligonucleotide
  Target: ATXN1; (-) strand; PAM type: YTN; PAM sequence: CTA
aaagagtttttgtagtctca

SEQ ID NO: 186385 - DNA, 20 bp, Artificial Sequence
  Description of Artificial Sequence: Synthetic oligonucleotide
  Target: ATXN1; (-) strand; PAM type: YTN; PAM sequence: TTC
acgactaaaagagtttttgt

SEQ ID NO: 186386 - DNA, 20 bp, Artificial Sequence
  Description of Artificial Sequence: Synthetic oligonucleotide
  Target: ATXN1; (-) strand; PAM type: YTN; PAM sequence: CTT
cacgactaaaagagtttttg

SEQ ID NO: 186387 - DNA, 20 bp, Artificial Sequence
  Description of Artificial Sequence: Synthetic oligonucleotide
  Target: ATXN1; (-) strand; PAM type: YTN; PAM sequence: TTC
ccttcacgactaaaagagtt

SEQ ID NO: 186388 - DNA, 20 bp, Artificial Sequence
  Description of Artificial Sequence: Synthetic oligonucleotide
  Target: ATXN1; (-) strand; PAM type: YTN; PAM sequence: TTT
cccttcacgactaaaagagt

SEQ ID NO: 186389 - DNA, 20 bp, Artificial Sequence
  Description of Artificial Sequence: Synthetic oligonucleotide
  Target: ATXN1; (-) strand; PAM type: YTN; PAM sequence: CTT
tcccttcacgactaaaagag

SEQ ID NO: 186390 - DNA, 20 bp, Artificial Sequence
  Description of Artificial Sequence: Synthetic oligonucleotide
  Target: ATXN1; (-) strand; PAM type: YTN; PAM sequence: TTG
cctttcccttcacgactaaa

SEQ ID NO: 186391 - DNA, 20 bp, Artificial Sequence
  Description of Artificial Sequence: Synthetic oligonucleotide
  Target: ATXN1; (-) strand; PAM type: YTN; PAM sequence: TTG
ttgcctttcccttcacgact

SEQ ID NO: 186392 - DNA, 20 bp, Artificial Sequence
  Description of Artificial Sequence: Synthetic oligonucleotide
  Target: ATXN1; (-) strand; PAM type: YTN; PAM sequence: TTG
aagacccacagatgacagga

SEQ ID NO: 186393 - DNA, 20 bp, Artificial Sequence
  Description of Artificial Sequence: Synthetic oligonucleotide
  Target: ATXN1; (-) strand; PAM type: YTN; PAM sequence: CTG
atgaaagggtgtccccagag

SEQ ID NO: 186394 - DNA, 20 bp, Artificial Sequence
  Description of Artificial Sequence: Synthetic oligonucleotide
  Target: ATXN1; (-) strand; PAM type: YTN; PAM sequence: TTG
caaggaaatggggaacaagg

SEQ ID NO: 186395 - DNA, 20 bp, Artificial Sequence
  Description of Artificial Sequence: Synthetic oligonucleotide
  Target: ATXN1; (-) strand; PAM type: YTN; PAM sequence: TTT
gcaaggaaatggggaacaag

SEQ ID NO: 186396 - DNA, 20 bp, Artificial Sequence
  Description of Artificial Sequence: Synthetic oligonucleotide
  Target: ATXN1; (-) strand; PAM type: YTN; PAM sequence: CTT
tgcaaggaaatggggaacaa

SEQ ID NO: 186397 - DNA, 20 bp, Artificial Sequence
  Description of Artificial Sequence: Synthetic oligonucleotide
  Target: ATXN1; (-) strand; PAM type: YTN; PAM sequence: CTC
aaggtgggtctttgcaagga

SEQ ID NO: 186398 - DNA, 20 bp, Artificial Sequence
  Description of Artificial Sequence: Synthetic oligonucleotide
  Target: ATXN1; (-) strand; PAM type: YTN; PAM sequence: TTC
acgaagaaagagactcaagg

SEQ ID NO: 186399 - DNA, 20 bp, Artificial Sequence
  Description of Artificial Sequence: Synthetic oligonucleotide
  Target: ATXN1; (-) strand; PAM type: YTN; PAM sequence: TTT
cacgaagaaagagactcaag

SEQ ID NO: 186400 - DNA, 20 bp, Artificial Sequence
  Description of Artificial Sequence: Synthetic oligonucleotide
  Target: ATXN1; (-) strand; PAM type: YTN; PAM sequence: TTT
tcacgaagaaagagactcaa

SEQ ID NO: 186401 - DNA, 20 bp, Artificial Sequence
  Description of Artificial Sequence: Synthetic oligonucleotide
  Target: ATXN1; (-) strand; PAM type: YTN; PAM sequence: TTT
ttcacgaagaaagagactca

SEQ ID NO: 186402 - DNA, 20 bp, Artificial Sequence
  Description of Artificial Sequence: Synthetic oligonucleotide
  Target: ATXN1; (-) strand; PAM type: YTN; PAM sequence: CTG
gagatgccaagacatttttc

SEQ ID NO: 186403 - DNA, 20 bp, Artificial Sequence
  Description of Artificial Sequence: Synthetic oligonucleotide
  Target: ATXN1; (-) strand; PAM type: YTN; PAM sequence: CTG
tgtggccctggagatgccaa

SEQ ID NO: 186404 - DNA, 20 bp, Artificial Sequence
  Description of Artificial Sequence: Synthetic oligonucleotide
  Target: ATXN1; (-) strand; PAM type: YTN; PAM sequence: TTC
gtctgtgtggccctggagat

SEQ ID NO: 186405 - DNA, 20 bp, Artificial Sequence
  Description of Artificial Sequence: Synthetic oligonucleotide
  Target: ATXN1; (-) strand; PAM type: YTN; PAM sequence: CTT
cgtctgtgtggccctggaga

SEQ ID NO: 186406 - DNA, 20 bp, Artificial Sequence
  Description of Artificial Sequence: Synthetic oligonucleotide
  Target: ATXN1; (-) strand; PAM type: YTN; PAM sequence: CTG
agagtgcttcgtctgtgtgg

SEQ ID NO: 186407 - DNA, 20 bp, Artificial Sequence
  Description of Artificial Sequence: Synthetic oligonucleotide
  Target: ATXN1; (-) strand; PAM type: YTN; PAM sequence: CTC
ctgagagtgcttcgtctgtg

SEQ ID NO: 186408 - DNA, 20 bp, Artificial Sequence
  Description of Artificial Sequence: Synthetic oligonucleotide
  Target: ATXN1; (-) strand; PAM type: YTN; PAM sequence: TTC
tcctgagagtgcttcgtctg

SEQ ID NO: 186409 - DNA, 20 bp, Artificial Sequence
  Description of Artificial Sequence: Synthetic oligonucleotide
  Target: ATXN1; (-) strand; PAM type: YTN; PAM sequence: TTT
ctcctgagagtgcttcgtct

SEQ ID NO: 186410 - DNA, 20 bp, Artificial Sequence
  Description of Artificial Sequence: Synthetic oligonucleotide
  Target: ATXN1; (-) strand; PAM type: YTN; PAM sequence: TTT
tctcctgagagtgcttcgtc

SEQ ID NO: 186411 - DNA, 20 bp, Artificial Sequence
  Description of Artificial Sequence: Synthetic oligonucleotide
  Target: ATXN1; (-) strand; PAM type: YTN; PAM sequence: TTG
ggtgacattttctcctgaga

SEQ ID NO: 186412 - DNA, 20 bp, Artificial Sequence
  Description of Artificial Sequence: Synthetic oligonucleotide
  Target: ATXN1; (-) strand; PAM type: YTN; PAM sequence: TTT
gggtgacattttctcctgag

SEQ ID NO: 186413 - DNA, 20 bp, Artificial Sequence
  Description of Artificial Sequence: Synthetic oligonucleotide
  Target: ATXN1; (-) strand; PAM type: YTN; PAM sequence: CTA
ggcaatgggtttgggtgaca

SEQ ID NO: 186414 - DNA, 20 bp, Artificial Sequence
  Description of Artificial Sequence: Synthetic oligonucleotide
  Target: ATXN1; (-) strand; PAM type: YTN; PAM sequence: CTG
tggaagcccctaggcaatgg

SEQ ID NO: 186415 - DNA, 20 bp, Artificial Sequence
  Description of Artificial Sequence: Synthetic oligonucleotide
  Target: ATXN1; (-) strand; PAM type: YTN; PAM sequence: CTC
tgtggaagcccctaggcaat

SEQ ID NO: 186416 - DNA, 20 bp, Artificial Sequence
  Description of Artificial Sequence: Synthetic oligonucleotide
  Target: ATXN1; (-) strand; PAM type: YTN; PAM sequence: TTC
tctgtggaagcccctaggca

SEQ ID NO: 186417 - DNA, 20 bp, Artificial Sequence
  Description of Artificial Sequence: Synthetic oligonucleotide
  Target: ATXN1; (-) strand; PAM type: YTN; PAM sequence: CTT
ctctgtggaagcccctaggc

SEQ ID NO: 186418 - DNA, 20 bp, Artificial Sequence
  Description of Artificial Sequence: Synthetic oligonucleotide
  Target: ATXN1; (-) strand; PAM type: YTN; PAM sequence: CTC
catggccacttctctgtgga

SEQ ID NO: 186419 - DNA, 20 bp, Artificial Sequence
  Description of Artificial Sequence: Synthetic oligonucleotide
  Target: ATXN1; (-) strand; PAM type: YTN; PAM sequence: TTC
cctccatggccacttctctg

SEQ ID NO: 186420 - DNA, 20 bp, Artificial Sequence
  Description of Artificial Sequence: Synthetic oligonucleotide
  Target: ATXN1; (-) strand; PAM type: YTN; PAM sequence: CTT
ccctccatggccacttctct

SEQ ID NO: 186421 - DNA, 20 bp, Artificial Sequence
  Description of Artificial Sequence: Synthetic oligonucleotide
  Target: ATXN1; (-) strand; PAM type: YTN; PAM sequence: CTG
ggggcttccctccatggcca

SEQ ID NO: 186422 - DNA, 20 bp, Artificial Sequence
  Description of Artificial Sequence: Synthetic oligonucleotide
  Target: ATXN1; (-) strand; PAM type: YTN; PAM sequence: TTG
gcagagctgggggcttccct

SEQ ID NO: 186423 - DNA, 20 bp, Artificial Sequence
  Description of Artificial Sequence: Synthetic oligonucleotide
  Target: ATXN1; (-) strand; PAM type: YTN; PAM sequence: CTA
aaatggacagtcaagtgaca

SEQ ID NO: 186424 - DNA, 20 bp, Artificial Sequence
  Description of Artificial Sequence: Synthetic oligonucleotide
  Target: ATXN1; (-) strand; PAM type: YTN; PAM sequence: CTA
gatgaaatctaaaatggaca

SEQ ID NO: 186425 - DNA, 20 bp, Artificial Sequence
  Description of Artificial Sequence: Synthetic oligonucleotide
  Target: ATXN1; (-) strand; PAM type: YTN; PAM sequence: TTG
cctagatgaaatctaaaatg

SEQ ID NO: 186426 - DNA, 20 bp, Artificial Sequence
  Description of Artificial Sequence: Synthetic oligonucleotide
  Target: ATXN1; (-) strand; PAM type: YTN; PAM sequence: CTT
gcctagatgaaatctaaaat

SEQ ID NO: 186427 - DNA, 20 bp, Artificial Sequence
  Description of Artificial Sequence: Synthetic oligonucleotide
  Target: ATXN1; (-) strand; PAM type: YTN; PAM sequence: CTG
tccaaagtggccttgcctag

SEQ ID NO: 186428 - DNA, 20 bp, Artificial Sequence
  Description of Artificial Sequence: Synthetic oligonucleotide
  Target: ATXN1; (-) strand; PAM type: YTN; PAM sequence: TTA
aagtccctgtccaaagtggc

SEQ ID NO: 186429 - DNA, 20 bp, Artificial Sequence
  Description of Artificial Sequence: Synthetic oligonucleotide
  Target: ATXN1; (-) strand; PAM type: YTN; PAM sequence: CTT
aaagtccctgtccaaagtgg

SEQ ID NO: 186430 - DNA, 20 bp, Artificial Sequence
  Description of Artificial Sequence: Synthetic oligonucleotide
  Target: ATXN1; (-) strand; PAM type: YTN; PAM sequence: TTG
tatcttaaagtccctgtcca

SEQ ID NO: 186431 - DNA, 20 bp, Artificial Sequence
  Description of Artificial Sequence: Synthetic oligonucleotide
  Target: ATXN1; (-) strand; PAM type: YTN; PAM sequence: CTG
tggattgtatcttaaagtcc

SEQ ID NO: 186432 - DNA, 20 bp, Artificial Sequence
  Description of Artificial Sequence: Synthetic oligonucleotide
  Target: ATXN1; (-) strand; PAM type: YTN; PAM sequence: TTG
gatccaaagaacatagaaat

SEQ ID NO: 186433 - DNA, 20 bp, Artificial Sequence
  Description of Artificial Sequence: Synthetic oligonucleotide
  Target: ATXN1; (-) strand; PAM type: YTN; PAM sequence: TTT
ggatccaaagaacatagaaa

SEQ ID NO: 186434 - DNA, 20 bp, Artificial Sequence
  Description of Artificial Sequence: Synthetic oligonucleotide
  Target: ATXN1; (-) strand; PAM type: YTN; PAM sequence: TTC
cgatttggatccaaagaaca

SEQ ID NO: 186435 - DNA, 20 bp, Artificial Sequence
  Description of Artificial Sequence: Synthetic oligonucleotide
  Target: ATXN1; (-) strand; PAM type: YTN; PAM sequence: TTT
ccgatttggatccaaagaac

SEQ ID NO: 186436 - DNA, 20 bp, Artificial Sequence
  Description of Artificial Sequence: Synthetic oligonucleotide
  Target: ATXN1; (-) strand; PAM type: YTN; PAM sequence: TTT
tccgatttggatccaaagaa

SEQ ID NO: 186437 - DNA, 20 bp, Artificial Sequence
  Description of Artificial Sequence: Synthetic oligonucleotide
  Target: ATXN1; (-) strand; PAM type: YTN; PAM sequence: CTG
ccattttccgatttggatcc

SEQ ID NO: 186438 - DNA, 20 bp, Artificial Sequence
  Description of Artificial Sequence: Synthetic oligonucleotide
  Target: ATXN1; (-) strand; PAM type: YTN; PAM sequence: TTC
tgccattttccgatttggat

SEQ ID NO: 186439 - DNA, 20 bp, Artificial Sequence
  Description of Artificial Sequence: Synthetic oligonucleotide
  Target: ATXN1; (-) strand; PAM type: YTN; PAM sequence: TTT
ctgccattttccgatttgga

SEQ ID NO: 186440 - DNA, 20 bp, Artificial Sequence
  Description of Artificial Sequence: Synthetic oligonucleotide
  Target: ATXN1; (-) strand; PAM type: YTN; PAM sequence: TTT
tctgccattttccgatttgg

SEQ ID NO: 186441 - DNA, 20 bp, Artificial Sequence
  Description of Artificial Sequence: Synthetic oligonucleotide
  Target: ATXN1; (-) strand; PAM type: YTN; PAM sequence: TTT
ttctgccattttccgatttg

SEQ ID NO: 186442 - DNA, 20 bp, Artificial Sequence
  Description of Artificial Sequence: Synthetic oligonucleotide
  Target: ATXN1; (-) strand; PAM type: YTN; PAM sequence: CTT
tttctgccattttccgattt

SEQ ID NO: 186443 - DNA, 20 bp, Artificial Sequence
  Description of Artificial Sequence: Synthetic oligonucleotide
  Target: ATXN1; (-) strand; PAM type: YTN; PAM sequence: CTA
aatgactttttctgccattt

SEQ ID NO: 186444 - DNA, 20 bp, Artificial Sequence
  Description of Artificial Sequence: Synthetic oligonucleotide
  Target: ATXN1; (-) strand; PAM type: YTN; PAM sequence: TTG
gcactaaatgactttttctg

SEQ ID NO: 186445 - DNA, 20 bp, Artificial Sequence
  Description of Artificial Sequence: Synthetic oligonucleotide
  Target: ATXN1; (-) strand; PAM type: YTN; PAM sequence: TTG
aattggcactaaatgacttt

SEQ ID NO: 186446 - DNA, 20 bp, Artificial Sequence
  Description of Artificial Sequence: Synthetic oligonucleotide
  Target: ATXN1; (-) strand; PAM type: YTN; PAM sequence: TTA
tgccacattgaattggcact

SEQ ID NO: 186447 - DNA, 20 bp, Artificial Sequence
  Description of Artificial Sequence: Synthetic oligonucleotide
  Target: ATXN1; (-) strand; PAM type: YTN; PAM sequence: CTC
attatgccacattgaattgg

SEQ ID NO: 186448 - DNA, 20 bp, Artificial Sequence
  Description of Artificial Sequence: Synthetic oligonucleotide
  Target: ATXN1; (-) strand; PAM type: YTN; PAM sequence: CTC
tcattatgccacattgaatt

SEQ ID NO: 186449 - DNA, 20 bp, Artificial Sequence
  Description of Artificial Sequence: Synthetic oligonucleotide
  Target: ATXN1; (-) strand; PAM type: YTN; PAM sequence: CTC
ctctcattatgccacattga

SEQ ID NO: 186450 - DNA, 20 bp, Artificial Sequence
  Description of Artificial Sequence: Synthetic oligonucleotide
  Target: ATXN1; (-) strand; PAM type: YTN; PAM sequence: CTC
tcctctcattatgccacatt

SEQ ID NO: 186451 - DNA, 20 bp, Artificial Sequence
  Description of Artificial Sequence: Synthetic oligonucleotide
  Target: ATXN1; (-) strand; PAM type: YTN; PAM sequence: TTG
ctctcctctcattatgccac

SEQ ID NO: 186452 - DNA, 20 bp, Artificial Sequence
  Description of Artificial Sequence: Synthetic oligonucleotide
  Target: ATXN1; (-) strand; PAM type: YTN; PAM sequence: TTA
attgctctcctctcattatg

SEQ ID NO: 186453 - DNA, 20 bp, Artificial Sequence
  Description of Artificial Sequence: Synthetic oligonucleotide
  Target: ATXN1; (-) strand; PAM type: YTN; PAM sequence: CTT
aattgctctcctctcattat

SEQ ID NO: 186454 - DNA, 20 bp, Artificial Sequence
  Description of Artificial Sequence: Synthetic oligonucleotide
  Target: ATXN1; (-) strand; PAM type: YTN; PAM sequence: TTC
ttaattgctctcctctcatt

SEQ ID NO: 186455 - DNA, 20 bp, Artificial Sequence
  Description of Artificial Sequence: Synthetic oligonucleotide
  Target: ATXN1; (-) strand; PAM type: YTN; PAM sequence: CTT
cttaattgctctcctctcat

SEQ ID NO: 186456 - DNA, 20 bp, Artificial Sequence
  Description of Artificial Sequence: Synthetic oligonucleotide
  Target: ATXN1; (-) strand; PAM type: YTN; PAM sequence: TTG
taatcttcttaattgctctc

SEQ ID NO: 186457 - DNA, 20 bp, Artificial Sequence
  Description of Artificial Sequence: Synthetic oligonucleotide
  Target: ATXN1; (-) strand; PAM type: YTN; PAM sequence: TTT
gtaatcttcttaattgctct

SEQ ID NO: 186458 - DNA, 20 bp, Artificial Sequence
  Description of Artificial Sequence: Synthetic oligonucleotide
  Target: ATXN1; (-) strand; PAM type: YTN; PAM sequence: CTT
tgtaatcttcttaattgctc

SEQ ID NO: 186459 - DNA, 20 bp, Artificial Sequence
  Description of Artificial Sequence: Synthetic oligonucleotide
  Target: ATXN1; (-) strand; PAM type: YTN; PAM sequence: CTC
actttgtaatcttcttaatt

SEQ ID NO: 186460 - DNA, 20 bp, Artificial Sequence
  Description of Artificial Sequence: Synthetic oligonucleotide
  Target: ATXN1; (-) strand; PAM type: YTN; PAM sequence: TTG
aagaggaatatggctcactt

SEQ ID NO: 186461 - DNA, 20 bp, Artificial Sequence
  Description of Artificial Sequence: Synthetic oligonucleotide
  Target: ATXN1; (-) strand; PAM type: YTN; PAM sequence: CTT
gaagaggaatatggctcact

SEQ ID NO: 186462 - DNA, 20 bp, Artificial Sequence
  Description of Artificial Sequence: Synthetic oligonucleotide
  Target: ATXN1; (-) strand; PAM type: YTN; PAM sequence: TTA
tccatgcacccagccttgaa

SEQ ID NO: 186463 - DNA, 20 bp, Artificial Sequence
  Description of Artificial Sequence: Synthetic oligonucleotide
  Target: ATXN1; (-) strand; PAM type: YTN; PAM sequence: TTT
atccatgcacccagccttga

SEQ ID NO: 186464 - DNA, 20 bp, Artificial Sequence
  Description of Artificial Sequence: Synthetic oligonucleotide
  Target: ATXN1; (-) strand; PAM type: YTN; PAM sequence: CTG
gtaatttatccatgcaccca

SEQ ID NO: 186465 - DNA, 20 bp, Artificial Sequence
  Description of Artificial Sequence: Synthetic oligonucleotide
  Target: ATXN1; (-) strand; PAM type: YTN; PAM sequence: CTC
tggtaatttatccatgcacc

SEQ ID NO: 186466 - DNA, 20 bp, Artificial Sequence
  Description of Artificial Sequence: Synthetic oligonucleotide
  Target: ATXN1; (-) strand; PAM type: YTN; PAM sequence: CTG
agctctggtaatttatccat

SEQ ID NO: 186467 - DNA, 20 bp, Artificial Sequence
  Description of Artificial Sequence: Synthetic oligonucleotide
  Target: ATXN1; (-) strand; PAM type: YTN; PAM sequence: TTA
ctgagctctggtaatttatc

SEQ ID NO: 186468 - DNA, 20 bp, Artificial Sequence
  Description of Artificial Sequence: Synthetic oligonucleotide
  Target: ATXN1; (-) strand; PAM type: YTN; PAM sequence: CTT
actgagctctggtaatttat

SEQ ID NO: 186469 - DNA, 20 bp, Artificial Sequence
  Description of Artificial Sequence: Synthetic oligonucleotide
  Target: ATXN1; (-) strand; PAM type: YTN; PAM sequence: TTC
ttactgagctctggtaattt

SEQ ID NO: 186470 - DNA, 20 bp, Artificial Sequence
  Description of Artificial Sequence: Synthetic oligonucleotide
  Target: ATXN1; (-) strand; PAM type: YTN; PAM sequence: CTT
cttactgagctctggtaatt

SEQ ID NO: 186471 - DNA, 20 bp, Artificial Sequence
  Description of Artificial Sequence: Synthetic oligonucleotide
  Target: ATXN1; (-) strand; PAM type: YTN; PAM sequence: CTG
aaagccatccagtgtaacga

SEQ ID NO: 186472 - DNA, 20 bp, Artificial Sequence
  Description of Artificial Sequence: Synthetic oligonucleotide
  Target: ATXN1; (-) strand; PAM type: YTN; PAM sequence: CTG
gcctgaaagccatccagtgt

SEQ ID NO: 186473 - DNA, 20 bp, Artificial Sequence
  Description of Artificial Sequence: Synthetic oligonucleotide
  Target: ATXN1; (-) strand; PAM type: YTN; PAM sequence: TTG
acaggtctggcctgaaagcc

SEQ ID NO: 186474 - DNA, 20 bp, Artificial Sequence
  Description of Artificial Sequence: Synthetic oligonucleotide
  Target: ATXN1; (-) strand; PAM type: YTN; PAM sequence: CTG
ttgacaggtctggcctgaaa

SEQ ID NO: 186475 - DNA, 20 bp, Artificial Sequence
  Description of Artificial Sequence: Synthetic oligonucleotide
  Target: ATXN1; (-) strand; PAM type: YTN; PAM sequence: TTC
ctgttgacaggtctggcctg

SEQ ID NO: 186476 - DNA, 20 bp, Artificial Sequence
  Description of Artificial Sequence: Synthetic oligonucleotide
  Target: ATXN1; (-) strand; PAM type: YTN; PAM sequence: TTT
cctgttgacaggtctggcct

SEQ ID NO: 186477 - DNA, 20 bp, Artificial Sequence
  Description of Artificial Sequence: Synthetic oligonucleotide
  Target: ATXN1; (-) strand; PAM type: YTN; PAM sequence: TTT
tcctgttgacaggtctggcc

SEQ ID NO: 186478 - DNA, 20 bp, Artificial Sequence
  Description of Artificial Sequence: Synthetic oligonucleotide
  Target: ATXN1; (-) strand; PAM type: YTN; PAM sequence: CTT
ttcctgttgacaggtctggc

SEQ ID NO: 186479 - DNA, 20 bp, Artificial Sequence
  Description of Artificial Sequence: Synthetic oligonucleotide
  Target: ATXN1; (-) strand; PAM type: YTN; PAM sequence: TTG
gccccttttcctgttgacag

SEQ ID NO: 186480 - DNA, 20 bp, Artificial Sequence
  Description of Artificial Sequence: Synthetic oligonucleotide
  Target: ATXN1; (-) strand; PAM type: YTN; PAM sequence: CTT
ggccccttttcctgttgaca

SEQ ID NO: 186481 - DNA, 20 bp, Artificial Sequence
  Description of Artificial Sequence: Synthetic oligonucleotide
  Target: ATXN1; (-) strand; PAM type: YTN; PAM sequence: CTC
ttggccccttttcctgttga

SEQ ID NO: 186482 - DNA, 20 bp, Artificial Sequence
  Description of Artificial Sequence: Synthetic oligonucleotide
  Target: ATXN1; (-) strand; PAM type: YTN; PAM sequence: TTG
ggaggaatcagaggtcaagg

SEQ ID NO: 186483 - DNA, 20 bp, Artificial Sequence
  Description of Artificial Sequence: Synthetic oligonucleotide
  Target: ATXN1; (-) strand; PAM type: YTN; PAM sequence: TTT
gggaggaatcagaggtcaag

SEQ ID NO: 186484 - DNA, 20 bp, Artificial Sequence
  Description of Artificial Sequence: Synthetic oligonucleotide
  Target: ATXN1; (-) strand; PAM type: YTN; PAM sequence: TTG
gagacatgagtagatgtttg

SEQ ID NO: 186485 - DNA, 20 bp, Artificial Sequence
  Description of Artificial Sequence: Synthetic oligonucleotide
  Target: ATXN1; (-) strand; PAM type: YTN; PAM sequence: CTG
gcatgcagagttggagacat

SEQ ID NO: 186486 - DNA, 20 bp, Artificial Sequence
  Description of Artificial Sequence: Synthetic oligonucleotide
  Target: ATXN1; (-) strand; PAM type: YTN; PAM sequence: TTA
tcagcactggcatgcagagt

SEQ ID NO: 186487 - DNA, 20 bp, Artificial Sequence
  Description of Artificial Sequence: Synthetic oligonucleotide
  Target: ATXN1; (-) strand; PAM type: YTN; PAM sequence: TTT
atcagcactggcatgcagag

SEQ ID NO: 186488 - DNA, 20 bp, Artificial Sequence
  Description of Artificial Sequence: Synthetic oligonucleotide
  Target: ATXN1; (-) strand; PAM type: YTN; PAM sequence: TTG
tttatcagcactggcatgca

SEQ ID NO: 186489 - DNA, 20 bp, Artificial Sequence
  Description of Artificial Sequence: Synthetic oligonucleotide
  Target: ATXN1; (-) strand; PAM type: YTN; PAM sequence: CTT
gtttatcagcactggcatgc

SEQ ID NO: 186490 - DNA, 20 bp, Artificial Sequence
  Description of Artificial Sequence: Synthetic oligonucleotide
  Target: ATXN1; (-) strand; PAM type: YTN; PAM sequence: TTG
cttgtttatcagcactggca

SEQ ID NO: 186491 - DNA, 20 bp, Artificial Sequence
  Description of Artificial Sequence: Synthetic oligonucleotide
  Target: ATXN1; (-) strand; PAM type: YTN; PAM sequence: TTT
gcttgtttatcagcactggc

SEQ ID NO: 186492 - DNA, 20 bp, Artificial Sequence
  Description of Artificial Sequence: Synthetic oligonucleotide
  Target: ATXN1; (-) strand; PAM type: YTN; PAM sequence: TTT
tgcttgtttatcagcactgg

SEQ ID NO: 186493 - DNA, 20 bp, Artificial Sequence
  Description of Artificial Sequence: Synthetic oligonucleotide
  Target: ATXN1; (-) strand; PAM type: YTN; PAM sequence: TTA
atgttttgcttgtttatcag

SEQ ID NO: 186494 - DNA, 20 bp, Artificial Sequence
  Description of Artificial Sequence: Synthetic oligonucleotide
  Target: ATXN1; (-) strand; PAM type: YTN; PAM sequence: TTA
ggttaatgttttgcttgttt

SEQ ID NO: 186495 - DNA, 20 bp, Artificial Sequence
  Description of Artificial Sequence: Synthetic oligonucleotide
  Target: ATXN1; (-) strand; PAM type: YTN; PAM sequence: TTG
tgaattaggttaatgttttg

SEQ ID NO: 186496 - DNA, 20 bp, Artificial Sequence
  Description of Artificial Sequence: Synthetic oligonucleotide
  Target: ATXN1; (-) strand; PAM type: YTN; PAM sequence: CTT
gtgaattaggttaatgtttt

SEQ ID NO: 186497 - DNA, 20 bp, Artificial Sequence
  Description of Artificial Sequence: Synthetic oligonucleotide
  Target: ATXN1; (-) strand; PAM type: YTN; PAM sequence: TTC
ttgtgaattaggttaatgtt

SEQ ID NO: 186498 - DNA, 20 bp, Artificial Sequence
  Description of Artificial Sequence: Synthetic oligonucleotide
  Target: ATXN1; (-) strand; PAM type: YTN; PAM sequence: TTT
cttgtgaattaggttaatgt

SEQ ID NO: 186499 - DNA, 20 bp, Artificial Sequence
  Description of Artificial Sequence: Synthetic oligonucleotide
  Target: ATXN1; (-) strand; PAM type: YTN; PAM sequence: TTT
tcttgtgaattaggttaatg

SEQ ID NO: 186500 - DNA, 20 bp, Artificial Sequence
  Description of Artificial Sequence: Synthetic oligonucleotide
  Target: ATXN1; (-) strand; PAM type: YTN; PAM sequence: TTT
ttcttgtgaattaggttaat

SEQ ID NO: 186501 - DNA, 20 bp, Artificial Sequence
  Description of Artificial Sequence: Synthetic oligonucleotide
  Target: ATXN1; (-) strand; PAM type: YTN; PAM sequence: CTG
atggtatcagtttttcttgt

SEQ ID NO: 186502 - DNA, 20 bp, Artificial Sequence
  Description of Artificial Sequence: Synthetic oligonucleotide
  Target: ATXN1; (-) strand; PAM type: YTN; PAM sequence: CTC
aaagcatctgatggtatcag

SEQ ID NO: 186503 - DNA, 20 bp, Artificial Sequence
  Description of Artificial Sequence: Synthetic oligonucleotide
  Target: ATXN1; (-) strand; PAM type: YTN; PAM sequence: TTA
ggcgatctcaaagcatctga

SEQ ID NO: 186504 - DNA, 20 bp, Artificial Sequence
  Description of Artificial Sequence: Synthetic oligonucleotide
  Target: ATXN1; (-) strand; PAM type: YTN; PAM sequence: CTG
ccgggccaagatgttaggcg

SEQ ID NO: 186505 - DNA, 20 bp, Artificial Sequence
  Description of Artificial Sequence: Synthetic oligonucleotide
  Target: ATXN1; (-) strand; PAM type: YTN; PAM sequence: TTA
atgggtagtccaggcagaat

SEQ ID NO: 186506 - DNA, 20 bp, Artificial Sequence
  Description of Artificial Sequence: Synthetic oligonucleotide
  Target: ATXN1; (-) strand; PAM type: YTN; PAM sequence: CTG
gtacagatagaatcccacgg

SEQ ID NO: 186507 - DNA, 20 bp, Artificial Sequence
  Description of Artificial Sequence: Synthetic oligonucleotide
  Target: ATXN1; (-) strand; PAM type: YTN; PAM sequence: TTC
tggtacagatagaatcccac

SEQ ID NO: 186508 - DNA, 20 bp, Artificial Sequence
  Description of Artificial Sequence: Synthetic oligonucleotide
  Target: ATXN1; (-) strand; PAM type: YTN; PAM sequence: TTT
ctggtacagatagaatccca

SEQ ID NO: 186509 - DNA, 20 bp, Artificial Sequence
  Description of Artificial Sequence: Synthetic oligonucleotide
  Target: ATXN1; (-) strand; PAM type: YTN; PAM sequence: CTT
tctggtacagatagaatccc

SEQ ID NO: 186510 - DNA, 20 bp, Artificial Sequence
  Description of Artificial Sequence: Synthetic oligonucleotide
  Target: ATXN1; (-) strand; PAM type: YTN; PAM sequence: CTA
aggatcatggaccacatggt

SEQ ID NO: 186511 - DNA, 20 bp, Artificial Sequence
  Description of Artificial Sequence: Synthetic oligonucleotide
  Target: ATXN1; (-) strand; PAM type: YTN; PAM sequence: TTA
ctaaggatcatggaccacat

SEQ ID NO: 186512 - DNA, 20 bp, Artificial Sequence
  Description of Artificial Sequence: Synthetic oligonucleotide
  Target: ATXN1; (-) strand; PAM type: YTN; PAM sequence: CTT
actaaggatcatggaccaca

SEQ ID NO: 186513 - DNA, 20 bp, Artificial Sequence
  Description of Artificial Sequence: Synthetic oligonucleotide
  Target: ATXN1; (-) strand; PAM type: YTN; PAM sequence: CTA
agtgtatcatgggagtgtca

SEQ ID NO: 186514 - DNA, 20 bp, Artificial Sequence
  Description of Artificial Sequence: Synthetic oligonucleotide
  Target: ATXN1; (-) strand; PAM type: YTN; PAM sequence: TTA
ctaagtgtatcatgggagtg

SEQ ID NO: 186515 - DNA, 20 bp, Artificial Sequence
  Description of Artificial Sequence: Synthetic oligonucleotide
  Target: ATXN1; (-) strand; PAM type: YTN; PAM sequence: CTT
actaagtgtatcatgggagt

SEQ ID NO: 186516 - DNA, 20 bp, Artificial Sequence
  Description of Artificial Sequence: Synthetic oligonucleotide
  Target: ATXN1; (-) strand; PAM type: YTN; PAM sequence: CTC
caggaggaaaacgtcactta

SEQ ID NO: 186517 - DNA, 20 bp, Artificial Sequence
  Description of Artificial Sequence: Synthetic oligonucleotide
  Target: ATXN1; (-) strand; PAM type: YTN; PAM sequence: CTG
ggcaggcctccaggaggaaa

SEQ ID NO: 186518 - DNA, 20 bp, Artificial Sequence
  Description of Artificial Sequence: Synthetic oligonucleotide
  Target: ATXN1; (-) strand; PAM type: YTN; PAM sequence: CTC
atctgggcaggcctccagga

SEQ ID NO: 186519 - DNA, 20 bp, Artificial Sequence
  Description of Artificial Sequence: Synthetic oligonucleotide
  Target: ATXN1; (-) strand; PAM type: YTN; PAM sequence: TTC
cctcatctgggcaggcctcc

SEQ ID NO: 186520 - DNA, 20 bp, Artificial Sequence
  Description of Artificial Sequence: Synthetic oligonucleotide
  Target: ATXN1; (-) strand; PAM type: YTN; PAM sequence: TTT
ccctcatctgggcaggcctc

SEQ ID NO: 186521 - DNA, 20 bp, Artificial Sequence
  Description of Artificial Sequence: Synthetic oligonucleotide
  Target: ATXN1; (-) strand; PAM type: YTN; PAM sequence: TTC
catttccctcatctgggcag

SEQ ID NO: 186522 - DNA, 20 bp, Artificial Sequence
  Description of Artificial Sequence: Synthetic oligonucleotide
  Target: ATXN1; (-) strand; PAM type: YTN; PAM sequence: TTT
ccatttccctcatctgggca

SEQ ID NO: 186523 - DNA, 20 bp, Artificial Sequence
  Description of Artificial Sequence: Synthetic oligonucleotide
  Target: ATXN1; (-) strand; PAM type: YTN; PAM sequence: TTT
tccatttccctcatctgggc

SEQ ID NO: 186524 - DNA, 20 bp, Artificial Sequence
  Description of Artificial Sequence: Synthetic oligonucleotide
  Target: ATXN1; (-) strand; PAM type: YTN; PAM sequence: CTC
aaagaggattttccatttcc

SEQ ID NO: 186525 - DNA, 20 bp, Artificial Sequence
  Description of Artificial Sequence: Synthetic oligonucleotide
  Target: ATXN1; (-) strand; PAM type: YTN; PAM sequence: TTG
ctcaaagaggattttccatt

SEQ ID NO: 186526 - DNA, 20 bp, Artificial Sequence
  Description of Artificial Sequence: Synthetic oligonucleotide
  Target: ATXN1; (-) strand; PAM type: YTN; PAM sequence: CTT
gctcaaagaggattttccat

SEQ ID NO: 186527 - DNA, 20 bp, Artificial Sequence
  Description of Artificial Sequence: Synthetic oligonucleotide
  Target: ATXN1; (-) strand; PAM type: YTN; PAM sequence: TTG
gcagtcaccttgctcaaaga

SEQ ID NO: 186528 - DNA, 20 bp, Artificial Sequence
  Description of Artificial Sequence: Synthetic oligonucleotide
  Target: ATXN1; (-) strand; PAM type: YTN; PAM sequence: CTC
gagagggtcagaagggagtt

SEQ ID NO: 186529 - DNA, 20 bp, Artificial Sequence
  Description of Artificial Sequence: Synthetic oligonucleotide
  Target: ATXN1; (-) strand; PAM type: YTN; PAM sequence: TTA
aaggcaagtaagggagtggt

SEQ ID NO: 186530 - DNA, 20 bp, Artificial Sequence
  Description of Artificial Sequence: Synthetic oligonucleotide
  Target: ATXN1; (-) strand; PAM type: YTN; PAM sequence: TTC
gttaaaggcaagtaagggag

SEQ ID NO: 186531 - DNA, 20 bp, Artificial Sequence
  Description of Artificial Sequence: Synthetic oligonucleotide
  Target: ATXN1; (-) strand; PAM type: YTN; PAM sequence: CTT
cgttaaaggcaagtaaggga

SEQ ID NO: 186532 - DNA, 20 bp, Artificial Sequence
  Description of Artificial Sequence: Synthetic oligonucleotide
  Target: ATXN1; (-) strand; PAM type: YTN; PAM sequence: CTG
gcacttcgttaaaggcaagt

SEQ ID NO: 186533 - DNA, 20 bp, Artificial Sequence
  Description of Artificial Sequence: Synthetic oligonucleotide
  Target: ATXN1; (-) strand; PAM type: YTN; PAM sequence: CTG
gctggcacttcgttaaaggc

SEQ ID NO: 186534 - DNA, 20 bp, Artificial Sequence
  Description of Artificial Sequence: Synthetic oligonucleotide
  Target: ATXN1; (-) strand; PAM type: YTN; PAM sequence: CTA
gcaacgtgctggctggcact

SEQ ID NO: 186535 - DNA, 20 bp, Artificial Sequence
  Description of Artificial Sequence: Synthetic oligonucleotide
  Target: ATXN1; (-) strand; PAM type: YTN; PAM sequence: TTG
tcctagcaacgtgctggctg

SEQ ID NO: 186536 - DNA, 20 bp, Artificial Sequence
  Description of Artificial Sequence: Synthetic oligonucleotide
  Target: ATXN1; (-) strand; PAM type: YTN; PAM sequence: CTC
cgcagtgacgccagttgtcc

SEQ ID NO: 186537 - DNA, 20 bp, Artificial Sequence
  Description of Artificial Sequence: Synthetic oligonucleotide
  Target: ATXN1; (-) strand; PAM type: YTN; PAM sequence: CTG
tgcctccgcagtgacgccag

SEQ ID NO: 186538 - DNA, 20 bp, Artificial Sequence
  Description of Artificial Sequence: Synthetic oligonucleotide
  Target: ATXN1; (-) strand; PAM type: YTN; PAM sequence: TTC
tgtgcctccgcagtgacgcc

SEQ ID NO: 186539 - DNA, 20 bp, Artificial Sequence
  Description of Artificial Sequence: Synthetic oligonucleotide
  Target: ATXN1; (-) strand; PAM type: YTN; PAM sequence: TTT
ctgtgcctccgcagtgacgc

SEQ ID NO: 186540 - DNA, 20 bp, Artificial Sequence
  Description of Artificial Sequence: Synthetic oligonucleotide
  Target: ATXN1; (-) strand; PAM type: YTN; PAM sequence: CTA
tttctgtgcctccgcagtga

SEQ ID NO: 186541 - DNA, 20 bp, Artificial Sequence
  Description of Artificial Sequence: Synthetic oligonucleotide
  Target: ATXN1; (-) strand; PAM type: YTN; PAM sequence: CTG
gtgatctatttctgtgcctc

SEQ ID NO: 186542 - DNA, 20 bp, Artificial Sequence
  Description of Artificial Sequence: Synthetic oligonucleotide
  Target: ATXN1; (-) strand; PAM type: YTN; PAM sequence: CTA
gccccactggtgatctattt

SEQ ID NO: 186543 - DNA, 20 bp, Artificial Sequence
  Description of Artificial Sequence: Synthetic oligonucleotide
  Target: ATXN1; (-) strand; PAM type: YTN; PAM sequence: TTC
ctagccccactggtgatcta

SEQ ID NO: 186544 - DNA, 20 bp, Artificial Sequence
  Description of Artificial Sequence: Synthetic oligonucleotide
  Target: ATXN1; (-) strand; PAM type: YTN; PAM sequence: TTA
taatccaggttcctagcccc

SEQ ID NO: 186545 - DNA, 20 bp, Artificial Sequence
  Description of Artificial Sequence: Synthetic oligonucleotide
  Target: ATXN1; (-) strand; PAM type: YTN; PAM sequence: TTT
ataatccaggttcctagccc

SEQ ID NO: 186546 - DNA, 20 bp, Artificial Sequence
  Description of Artificial Sequence: Synthetic oligonucleotide
  Target: ATXN1; (-) strand; PAM type: YTN; PAM sequence: TTG
gcgtttataatccaggttcc

SEQ ID NO: 186547 - DNA, 20 bp, Artificial Sequence
  Description of Artificial Sequence: Synthetic oligonucleotide
  Target: ATXN1; (-) strand; PAM type: YTN; PAM sequence: CTG
tcattggcgtttataatcca

SEQ ID NO: 186548 - DNA, 20 bp, Artificial Sequence
  Description of Artificial Sequence: Synthetic oligonucleotide
  Target: ATXN1; (-) strand; PAM type: YTN; PAM sequence: CTC
atcactgtcattggcgttta

SEQ ID NO: 186549 - DNA, 20 bp, Artificial Sequence
  Description of Artificial Sequence: Synthetic oligonucleotide
  Target: ATXN1; (-) strand; PAM type: YTN; PAM sequence: CTG
ccaatcagtatctcatcact

SEQ ID NO: 186550 - DNA, 20 bp, Artificial Sequence
  Description of Artificial Sequence: Synthetic oligonucleotide
  Target: ATXN1; (-) strand; PAM type: YTN; PAM sequence: TTA
gctgccaatcagtatctcat

SEQ ID NO: 186551 - DNA, 20 bp, Artificial Sequence
  Description of Artificial Sequence: Synthetic oligonucleotide
  Target: ATXN1; (-) strand; PAM type: YTN; PAM sequence: CTA
taggggacagattagctgcc

SEQ ID NO: 186552 - DNA, 20 bp, Artificial Sequence
  Description of Artificial Sequence: Synthetic oligonucleotide
  Target: ATXN1; (-) strand; PAM type: YTN; PAM sequence: TTG
ctataggggacagattagct

SEQ ID NO: 186553 - DNA, 20 bp, Artificial Sequence
  Description of Artificial Sequence: Synthetic oligonucleotide
  Target: ATXN1; (-) strand; PAM type: YTN; PAM sequence: CTT
gctataggggacagattagc

SEQ ID NO: 186554 - DNA, 20 bp, Artificial Sequence
  Description of Artificial Sequence: Synthetic oligonucleotide
  Target: ATXN1; (-) strand; PAM type: YTN; PAM sequence: CTC
ggtcacttgctataggggac

SEQ ID NO: 186555 - DNA, 20 bp, Artificial Sequence
  Description of Artificial Sequence: Synthetic oligonucleotide
  Target: ATXN1; (-) strand; PAM type: YTN; PAM sequence: TTA
ctcggtcacttgctataggg

SEQ ID NO: 186556 - DNA, 20 bp, Artificial Sequence
  Description of Artificial Sequence: Synthetic oligonucleotide
  Target: ATXN1; (-) strand; PAM type: YTN; PAM sequence: CTG
ggtagtgttactcggtcact

SEQ ID NO: 186557 - DNA, 20 bp, Artificial Sequence
  Description of Artificial Sequence: Synthetic oligonucleotide
  Target: ATXN1; (-) strand; PAM type: YTN; PAM sequence: CTG
cccactgggtagtgttactc

SEQ ID NO: 186558 - DNA, 20 bp, Artificial Sequence
  Description of Artificial Sequence: Synthetic oligonucleotide
  Target: ATXN1; (-) strand; PAM type: YTN; PAM sequence: CTA
ccacatcaagcacaaatgta

SEQ ID NO: 186559 - DNA, 20 bp, Artificial Sequence
  Description of Artificial Sequence: Synthetic oligonucleotide
  Target: ATXN1; (-) strand; PAM type: YTN; PAM sequence: CTC
agtcactaccacatcaagca

SEQ ID NO: 186560 - DNA, 20 bp, Artificial Sequence
  Description of Artificial Sequence: Synthetic oligonucleotide
  Target: ATXN1; (-) strand; PAM type: YTN; PAM sequence: TTC
tcagtcactaccacatcaag

SEQ ID NO: 186561 - DNA, 20 bp, Artificial Sequence
  Description of Artificial Sequence: Synthetic oligonucleotide
  Target: ATXN1; (-) strand; PAM type: YTN; PAM sequence: CTT
ctcagtcactaccacatcaa

SEQ ID NO: 186562 - DNA, 20 bp, Artificial Sequence
  Description of Artificial Sequence: Synthetic oligonucleotide
  Target: ATXN1; (-) strand; PAM type: YTN; PAM sequence: TTG
ccccttctcagtcactacca

SEQ ID NO: 186563 - DNA, 20 bp, Artificial Sequence
  Description of Artificial Sequence: Synthetic oligonucleotide
  Target: ATXN1; (-) strand; PAM type: YTN; PAM sequence: CTT
gccccttctcagtcactacc

SEQ ID NO: 186564 - DNA, 20 bp, Artificial Sequence
  Description of Artificial Sequence: Synthetic oligonucleotide
  Target: ATXN1; (-) strand; PAM type: YTN; PAM sequence: TTC
cttgccccttctcagtcact

SEQ ID NO: 186565 - DNA, 20 bp, Artificial Sequence
  Description of Artificial Sequence: Synthetic oligonucleotide
  Target: ATXN1; (-) strand; PAM type: YTN; PAM sequence: CTA
gttccttgccccttctcagt

SEQ ID NO: 186566 - DNA, 20 bp, Artificial Sequence
  Description of Artificial Sequence: Synthetic oligonucleotide
  Target: ATXN1; (-) strand; PAM type: YTN; PAM sequence: CTA
aagctagttccttgcccctt

SEQ ID NO: 186567 - DNA, 20 bp, Artificial Sequence
  Description of Artificial Sequence: Synthetic oligonucleotide
  Target: ATXN1; (-) strand; PAM type: YTN; PAM sequence: CTA
tctaaagctagttccttgcc

SEQ ID NO: 186568 - DNA, 20 bp, Artificial Sequence
  Description of Artificial Sequence: Synthetic oligonucleotide
  Target: ATXN1; (-) strand; PAM type: YTN; PAM sequence: CTC
ctatctaaagctagttcctt

SEQ ID NO: 186569 - DNA, 20 bp, Artificial Sequence
  Description of Artificial Sequence: Synthetic oligonucleotide
  Target: ATXN1; (-) strand; PAM type: YTN; PAM sequence: TTC
aaaacagagtcatgcagctc

SEQ ID NO: 186570 - DNA, 20 bp, Artificial Sequence
  Description of Artificial Sequence: Synthetic oligonucleotide
  Target: ATXN1; (-) strand; PAM type: YTN; PAM sequence: CTC
acataattcaaaacagagtc

SEQ ID NO: 186571 - DNA, 20 bp, Artificial Sequence
  Description of Artificial Sequence: Synthetic oligonucleotide
  Target: ATXN1; (-) strand; PAM type: YTN; PAM sequence: CTG
gctcacataattcaaaacag

SEQ ID NO: 186572 - DNA, 20 bp, Artificial Sequence
  Description of Artificial Sequence: Synthetic oligonucleotide
  Target: ATXN1; (-) strand; PAM type: YTN; PAM sequence: CTA
ctggctcacataattcaaaa

SEQ ID NO: 186573 - DNA, 20 bp, Artificial Sequence
  Description of Artificial Sequence: Synthetic oligonucleotide
  Target: ATXN1; (-) strand; PAM type: YTN; PAM sequence: CTA
catatctactggctcacata

SEQ ID NO: 186574 - DNA, 20 bp, Artificial Sequence
  Description of Artificial Sequence: Synthetic oligonucleotide
  Target: ATXN1; (-) strand; PAM type: YTN; PAM sequence: TTA
ctacatatctactggctcac

SEQ ID NO: 186575 - DNA, 20 bp, Artificial Sequence
  Description of Artificial Sequence: Synthetic oligonucleotide
  Target: ATXN1; (-) strand; PAM type: YTN; PAM sequence: TTA
aaggtgcaaatgtcaggtgg

SEQ ID NO: 186576 - DNA, 20 bp, Artificial Sequence
  Description of Artificial Sequence: Synthetic oligonucleotide
  Target: ATXN1; (-) strand; PAM type: YTN; PAM sequence: CTA
acaaattaaaggtgcaaatg

SEQ ID NO: 186577 - DNA, 20 bp, Artificial Sequence
  Description of Artificial Sequence: Synthetic oligonucleotide
  Target: ATXN1; (-) strand; PAM type: YTN; PAM sequence: TTC
aggaaactaacaaattaaag

SEQ ID NO: 186578 - DNA, 20 bp, Artificial Sequence
  Description of Artificial Sequence: Synthetic oligonucleotide
  Target: ATXN1; (-) strand; PAM type: YTN; PAM sequence: TTT
caggaaactaacaaattaaa

SEQ ID NO: 186579 - DNA, 20 bp, Artificial Sequence
  Description of Artificial Sequence: Synthetic oligonucleotide
  Target: ATXN1; (-) strand; PAM type: YTN; PAM sequence: TTT
tcaggaaactaacaaattaa

SEQ ID NO: 186580 - DNA, 20 bp, Artificial Sequence
  Description of Artificial Sequence: Synthetic oligonucleotide
  Target: ATXN1; (-) strand; PAM type: YTN; PAM sequence: CTA
attttcaggaaactaacaaa

SEQ ID NO: 186581 - DNA, 20 bp, Artificial Sequence
  Description of Artificial Sequence: Synthetic oligonucleotide
  Target: ATXN1; (-) strand; PAM type: YTN; PAM sequence: CTC
cctaattttcaggaaactaa

SEQ ID NO: 186582 - DNA, 20 bp, Artificial Sequence
  Description of Artificial Sequence: Synthetic oligonucleotide
  Target: ATXN1; (-) strand; PAM type: YTN; PAM sequence: TTC
ctccctaattttcaggaaac

SEQ ID NO: 186583 - DNA, 20 bp, Artificial Sequence
  Description of Artificial Sequence: Synthetic oligonucleotide
  Target: ATXN1; (-) strand; PAM type: YTN; PAM sequence: CTT
cctccctaattttcaggaaa

SEQ ID NO: 186584 - DNA, 20 bp, Artificial Sequence
  Description of Artificial Sequence: Synthetic oligonucleotide
  Target: ATXN1; (-) strand; PAM type: YTN; PAM sequence: TTG
tgaacagccttcctccctaa

SEQ ID NO: 186585 - DNA, 20 bp, Artificial Sequence
  Description of Artificial Sequence: Synthetic oligonucleotide
  Target: ATXN1; (-) strand; PAM type: YTN; PAM sequence: CTT
gtgaacagccttcctcccta

SEQ ID NO: 186586 - DNA, 20 bp, Artificial Sequence
  Description of Artificial Sequence: Synthetic oligonucleotide
  Target: ATXN1; (-) strand; PAM type: YTN; PAM sequence: TTC
ggcttgtgaacagccttcct

SEQ ID NO: 186587 - DNA, 20 bp, Artificial Sequence
  Description of Artificial Sequence: Synthetic oligonucleotide
  Target: ATXN1; (-) strand; PAM type: YTN; PAM sequence: CTT
cggcttgtgaacagccttcc

SEQ ID NO: 186588 - DNA, 20 bp, Artificial Sequence
  Description of Artificial Sequence: Synthetic oligonucleotide
  Target: ATXN1; (-) strand; PAM type: YTN; PAM sequence: CTG
tcatacttcggcttgtgaac

SEQ ID NO: 186589 - DNA, 20 bp, Artificial Sequence
  Description of Artificial Sequence: Synthetic oligonucleotide
  Target: ATXN1; (-) strand; PAM type: YTN; PAM sequence: CTG
gctgtcatacttcggcttgt

SEQ ID NO: 186590 - DNA, 20 bp, Artificial Sequence
  Description of Artificial Sequence: Synthetic oligonucleotide
  Target: ATXN1; (-) strand; PAM type: YTN; PAM sequence: TTC
tggctgtcatacttcggctt

SEQ ID NO: 186591 - DNA, 20 bp, Artificial Sequence
  Description of Artificial Sequence: Synthetic oligonucleotide
  Target: ATXN1; (-) strand; PAM type: YTN; PAM sequence: TTT
ctggctgtcatacttcggct

SEQ ID NO: 186592 - DNA, 20 bp, Artificial Sequence
  Description of Artificial Sequence: Synthetic oligonucleotide
  Target: ATXN1; (-) strand; PAM type: YTN; PAM sequence: CTG
tttctggctgtcatacttcg

SEQ ID NO: 186593 - DNA, 20 bp, Artificial Sequence
  Description of Artificial Sequence: Synthetic oligonucleotide
  Target: ATXN1; (-) strand; PAM type: YTN; PAM sequence: CTA
cctgtttctggctgtcatac

SEQ ID NO: 186594 - DNA, 20 bp, Artificial Sequence
  Description of Artificial Sequence: Synthetic oligonucleotide
  Target: ATXN1; (-) strand; PAM type: YTN; PAM sequence: CTC
tacctgtttctggctgtcat

SEQ ID NO: 186595 - DNA, 20 bp, Artificial Sequence
  Description of Artificial Sequence: Synthetic oligonucleotide
  Target: ATXN1; (-) strand; PAM type: YTN; PAM sequence: CTC
aatggctctacctgtttctg

SEQ ID NO: 186596 - DNA, 20 bp, Artificial Sequence
  Description of Artificial Sequence: Synthetic oligonucleotide
  Target: ATXN1; (-) strand; PAM type: YTN; PAM sequence: TTG
gcaacctcaatggctctacc

SEQ ID NO: 186597 - DNA, 20 bp, Artificial Sequence
  Description of Artificial Sequence: Synthetic oligonucleotide
  Target: ATXN1; (-) strand; PAM type: YTN; PAM sequence: TTT
ggcaacctcaatggctctac

SEQ ID NO: 186598 - DNA, 20 bp, Artificial Sequence
  Description of Artificial Sequence: Synthetic oligonucleotide
  Target: ATXN1; (-) strand; PAM type: YTN; PAM sequence: CTG
tttggcaacctcaatggctc

SEQ ID NO: 186599 - DNA, 20 bp, Artificial Sequence
  Description of Artificial Sequence: Synthetic oligonucleotide
  Target: ATXN1; (-) strand; PAM type: YTN; PAM sequence: TTC
tgtttggcaacctcaatggc

SEQ ID NO: 186600 - DNA, 20 bp, Artificial Sequence
  Description of Artificial Sequence: Synthetic oligonucleotide
  Target: ATXN1; (-) strand; PAM type: YTN; PAM sequence: CTT
ctgtttggcaacctcaatgg

SEQ ID NO: 186601 - DNA, 20 bp, Artificial Sequence
  Description of Artificial Sequence: Synthetic oligonucleotide
  Target: ATXN1; (-) strand; PAM type: YTN; PAM sequence: TTC
cttctgtttggcaacctcaa

SEQ ID NO: 186602 - DNA, 20 bp, Artificial Sequence
  Description of Artificial Sequence: Synthetic oligonucleotide
  Target: ATXN1; (-) strand; PAM type: YTN; PAM sequence: TTT
ccttctgtttggcaacctca

SEQ ID NO: 186603 - DNA, 20 bp, Artificial Sequence
  Description of Artificial Sequence: Synthetic oligonucleotide
  Target: ATXN1; (-) strand; PAM type: YTN; PAM sequence: TTT
tccttctgtttggcaacctc

SEQ ID NO: 186604 - DNA, 20 bp, Artificial Sequence
  Description of Artificial Sequence: Synthetic oligonucleotide
  Target: ATXN1; (-) strand; PAM type: YTN; PAM sequence: TTT
ttccttctgtttggcaacct

SEQ ID NO: 186605 - DNA, 20 bp, Artificial Sequence
  Description of Artificial Sequence: Synthetic oligonucleotide
  Target: ATXN1; (-) strand; PAM type: YTN; PAM sequence: TTT
tttccttctgtttggcaacc

SEQ ID NO: 186606 - DNA, 20 bp, Artificial Sequence
  Description of Artificial Sequence: Synthetic oligonucleotide
  Target: ATXN1; (-) strand; PAM type: YTN; PAM sequence: TTG
ttttttccttctgtttggca

SEQ ID NO: 186607 - DNA, 20 bp, Artificial Sequence
  Description of Artificial Sequence: Synthetic oligonucleotide
  Target: ATXN1; (-) strand; PAM type: YTN; PAM sequence: TTG
tccaaacagattgttttttc

SEQ ID NO: 186608 - DNA, 20 bp, Artificial Sequence
  Description of Artificial Sequence: Synthetic oligonucleotide
  Target: ATXN1; (-) strand; PAM type: YTN; PAM sequence: CTT
gtccaaacagattgtttttt

SEQ ID NO: 186609 - DNA, 20 bp, Artificial Sequence
  Description of Artificial Sequence: Synthetic oligonucleotide
  Target: ATXN1; (-) strand; PAM type: YTN; PAM sequence: TTG
cttgtccaaacagattgttt

SEQ ID NO: 186610 - DNA, 20 bp, Artificial Sequence
  Description of Artificial Sequence: Synthetic oligonucleotide
  Target: ATXN1; (-) strand; PAM type: YTN; PAM sequence: CTA
ttgcttgtccaaacagattg

SEQ ID NO: 186611 - DNA, 20 bp, Artificial Sequence
  Description of Artificial Sequence: Synthetic oligonucleotide
  Target: ATXN1; (-) strand; PAM type: YTN; PAM sequence: TTC
agaaaggagaaagctattgc

SEQ ID NO: 186612 - DNA, 20 bp, Artificial Sequence
  Description of Artificial Sequence: Synthetic oligonucleotide
  Target: ATXN1; (-) strand; PAM type: YTN; PAM sequence: TTG
ttcagaaaggagaaagctat

SEQ ID NO: 186613 - DNA, 20 bp, Artificial Sequence
  Description of Artificial Sequence: Synthetic oligonucleotide
  Target: ATXN1; (-) strand; PAM type: YTN; PAM sequence: CTA
ttgttcagaaaggagaaagc

SEQ ID NO: 186614 - DNA, 20 bp, Artificial Sequence
  Description of Artificial Sequence: Synthetic oligonucleotide
  Target: ATXN1; (-) strand; PAM type: YTN; PAM sequence: CTA
aaagaaggtagaagagtaga

SEQ ID NO: 186615 - DNA, 20 bp, Artificial Sequence
  Description of Artificial Sequence: Synthetic oligonucleotide
  Target: ATXN1; (-) strand; PAM type: YTN; PAM sequence: CTC
taaaagaaggtagaagagta

SEQ ID NO: 186616 - DNA, 20 bp, Artificial Sequence
  Description of Artificial Sequence: Synthetic oligonucleotide
  Target: ATXN1; (-) strand; PAM type: YTN; PAM sequence: TTG
atctctaaaagaaggtagaa

SEQ ID NO: 186617 - DNA, 20 bp, Artificial Sequence
  Description of Artificial Sequence: Synthetic oligonucleotide
  Target: ATXN1; (-) strand; PAM type: YTN; PAM sequence: TTT
gatctctaaaagaaggtaga

SEQ ID NO: 186618 - DNA, 20 bp, Artificial Sequence
  Description of Artificial Sequence: Synthetic oligonucleotide
  Target: ATXN1; (-) strand; PAM type: YTN; PAM sequence: CTT
tgatctctaaaagaaggtag

SEQ ID NO: 186619 - DNA, 20 bp, Artificial Sequence
  Description of Artificial Sequence: Synthetic oligonucleotide
  Target: ATXN1; (-) strand; PAM type: YTN; PAM sequence: TTC
tttgatctctaaaagaaggt

SEQ ID NO: 186620 - DNA, 20 bp, Artificial Sequence
  Description of Artificial Sequence: Synthetic oligonucleotide
  Target: ATXN1; (-) strand; PAM type: YTN; PAM sequence: CTT
ctttgatctctaaaagaagg

SEQ ID NO: 186621 - DNA, 20 bp, Artificial Sequence
  Description of Artificial Sequence: Synthetic oligonucleotide
  Target: ATXN1; (-) strand; PAM type: YTN; PAM sequence: TTC
cttctttgatctctaaaaga

SEQ ID NO: 186622 - DNA, 20 bp, Artificial Sequence
  Description of Artificial Sequence: Synthetic oligonucleotide
  Target: ATXN1; (-) strand; PAM type: YTN; PAM sequence: TTT
ccttctttgatctctaaaag

SEQ ID NO: 186623 - DNA, 20 bp, Artificial Sequence
  Description of Artificial Sequence: Synthetic oligonucleotide
  Target: ATXN1; (-) strand; PAM type: YTN; PAM sequence: TTT
tccttctttgatctctaaaa

SEQ ID NO: 186624 - DNA, 20 bp, Artificial Sequence
  Description of Artificial Sequence: Synthetic oligonucleotide
  Target: ATXN1; (-) strand; PAM type: YTN; PAM sequence: CTT
ttccttctttgatctctaaa

SEQ ID NO: 186625 - DNA, 20 bp, Artificial Sequence
  Description of Artificial Sequence: Synthetic oligonucleotide
  Target: ATXN1; (-) strand; PAM type: YTN; PAM sequence: TTG
ccttttccttctttgatctc

SEQ ID NO: 186626 - DNA, 20 bp, Artificial Sequence
  Description of Artificial Sequence: Synthetic oligonucleotide
  Target: ATXN1; (-) strand; PAM type: YTN; PAM sequence: TTT
gccttttccttctttgatct

SEQ ID NO: 186627 - DNA, 20 bp, Artificial Sequence
  Description of Artificial Sequence: Synthetic oligonucleotide
  Target: ATXN1; (-) strand; PAM type: YTN; PAM sequence: CTT
tgccttttccttctttgatc

SEQ ID NO: 186628 - DNA, 20 bp, Artificial Sequence
  Description of Artificial Sequence: Synthetic oligonucleotide
  Target: ATXN1; (-) strand; PAM type: YTN; PAM sequence: TTC
ctttgccttttccttctttg

SEQ ID NO: 186629 - DNA, 20 bp, Artificial Sequence
  Description of Artificial Sequence: Synthetic oligonucleotide
  Target: ATXN1; (-) strand; PAM type: YTN; PAM sequence: TTT
cctttgccttttccttcttt

SEQ ID NO: 186630 - DNA, 20 bp, Artificial Sequence
  Description of Artificial Sequence: Synthetic oligonucleotide
  Target: ATXN1; (-) strand; PAM type: YTN; PAM sequence: TTC
cggtttcctttgccttttcc

SEQ ID NO: 186631 - DNA, 20 bp, Artificial Sequence
  Description of Artificial Sequence: Synthetic oligonucleotide
  Target: ATXN1; (-) strand; PAM type: YTN; PAM sequence: TTT
ccggtttcctttgccttttc

SEQ ID NO: 186632 - DNA, 20 bp, Artificial Sequence
  Description of Artificial Sequence: Synthetic oligonucleotide
  Target: ATXN1; (-) strand; PAM type: YTN; PAM sequence: TTT
tccggtttcctttgcctttt

SEQ ID NO: 186633 - DNA, 20 bp, Artificial Sequence
  Description of Artificial Sequence: Synthetic oligonucleotide
  Target: ATXN1; (-) strand; PAM type: YTN; PAM sequence: CTA
gttttccggtttcctttgcc

SEQ ID NO: 186634 - DNA, 20 bp, Artificial Sequence
  Description of Artificial Sequence: Synthetic oligonucleotide
  Target: ATXN1; (-) strand; PAM type: YTN; PAM sequence: TTC
aaccatggcaagccctagtt

SEQ ID NO: 186635 - DNA, 20 bp, Artificial Sequence
  Description of Artificial Sequence: Synthetic oligonucleotide
  Target: ATXN1; (-) strand; PAM type: YTN; PAM sequence: CTT
caaccatggcaagccctagt

SEQ ID NO: 186636 - DNA, 20 bp, Artificial Sequence
  Description of Artificial Sequence: Synthetic oligonucleotide
  Target: ATXN1; (-) strand; PAM type: YTN; PAM sequence: TTC
ttcaaccatggcaagcccta

SEQ ID NO: 186637 - DNA, 20 bp, Artificial Sequence
  Description of Artificial Sequence: Synthetic oligonucleotide
  Target: ATXN1; (-) strand; PAM type: YTN; PAM sequence: CTT
cttcaaccatggcaagccct

SEQ ID NO: 186638 - DNA, 20 bp, Artificial Sequence
  Description of Artificial Sequence: Synthetic oligonucleotide
  Target: ATXN1; (-) strand; PAM type: YTN; PAM sequence: CTC
ttcttcaaccatggcaagcc

SEQ ID NO: 186639 - DNA, 20 bp, Artificial Sequence
  Description of Artificial Sequence: Synthetic oligonucleotide
  Target: ATXN1; (-) strand; PAM type: YTN; PAM sequence: TTC
tcttcttcaaccatggcaag

SEQ ID NO: 186640 - DNA, 20 bp, Artificial Sequence
  Description of Artificial Sequence: Synthetic oligonucleotide
  Target: ATXN1; (-) strand; PAM type: YTN; PAM sequence: TTA
ttctcttcttcaaccatggc

SEQ ID NO: 186641 - DNA, 20 bp, Artificial Sequence
  Description of Artificial Sequence: Synthetic oligonucleotide
  Target: ATXN1; (-) strand; PAM type: YTN; PAM sequence: CTG
ggcacaaagattattctctt

SEQ ID NO: 186642 - DNA, 20 bp, Artificial Sequence
  Description of Artificial Sequence: Synthetic oligonucleotide
  Target: ATXN1; (-) strand; PAM type: YTN; PAM sequence: CTG
cagaacaaagagaactgggc

SEQ ID NO: 186643 - DNA, 20 bp, Artificial Sequence
  Description of Artificial Sequence: Synthetic oligonucleotide
  Target: ATXN1; (-) strand; PAM type: YTN; PAM sequence: CTC
accctgcagaacaaagagaa

SEQ ID NO: 186644 - DNA, 20 bp, Artificial Sequence
  Description of Artificial Sequence: Synthetic oligonucleotide
  Target: ATXN1; (-) strand; PAM type: YTN; PAM sequence: TTG
taaaactcaccctgcagaac

SEQ ID NO: 186645 - DNA, 20 bp, Artificial Sequence
  Description of Artificial Sequence: Synthetic oligonucleotide
  Target: ATXN1; (-) strand; PAM type: YTN; PAM sequence: TTA
taagcattgtaaaactcacc

SEQ ID NO: 186646 - DNA, 20 bp, Artificial Sequence
  Description of Artificial Sequence: Synthetic oligonucleotide
  Target: ATXN1; (-) strand; PAM type: YTN; PAM sequence: CTA
cccgttataagcattgtaaa

SEQ ID NO: 186647 - DNA, 20 bp, Artificial Sequence
  Description of Artificial Sequence: Synthetic oligonucleotide
  Target: ATXN1; (-) strand; PAM type: YTN; PAM sequence: TTG
ctacccgttataagcattgt

SEQ ID NO: 186648 - DNA, 20 bp, Artificial Sequence
  Description of Artificial Sequence: Synthetic oligonucleotide
  Target: ATXN1; (-) strand; PAM type: YTN; PAM sequence: CTA
cgagttgctacccgttataa

SEQ ID NO: 186649 - DNA, 20 bp, Artificial Sequence
  Description of Artificial Sequence: Synthetic oligonucleotide
  Target: ATXN1; (-) strand; PAM type: YTN; PAM sequence: CTC
ctacgagttgctacccgtta

SEQ ID NO: 186650 - DNA, 20 bp, Artificial Sequence
  Description of Artificial Sequence: Synthetic oligonucleotide
  Target: ATXN1; (-) strand; PAM type: YTN; PAM sequence: TTA
atgcatggggctcctacgag

SEQ ID NO: 186651 - DNA, 20 bp, Artificial Sequence
  Description of Artificial Sequence: Synthetic oligonucleotide
  Target: ATXN1; (-) strand; PAM type: YTN; PAM sequence: CTT
aatgcatggggctcctacga

SEQ ID NO: 186652 - DNA, 20 bp, Artificial Sequence
  Description of Artificial Sequence: Synthetic oligonucleotide
  Target: ATXN1; (-) strand; PAM type: YTN; PAM sequence: TTG
ataggcagtcttaatgcatg

SEQ ID NO: 186653 - DNA, 20 bp, Artificial Sequence
  Description of Artificial Sequence: Synthetic oligonucleotide
  Target: ATXN1; (-) strand; PAM type: YTN; PAM sequence: TTT
gataggcagtcttaatgcat

SEQ ID NO: 186654 - DNA, 20 bp, Artificial Sequence
  Description of Artificial Sequence: Synthetic oligonucleotide
  Target: ATXN1; (-) strand; PAM type: YTN; PAM sequence: CTT
tgataggcagtcttaatgca

SEQ ID NO: 186655 - DNA, 20 bp, Artificial Sequence
  Description of Artificial Sequence: Synthetic oligonucleotide
  Target: ATXN1; (-) strand; PAM type: YTN; PAM sequence: CTA
aaatccaagactttgatagg

SEQ ID NO: 186656 - DNA, 20 bp, Artificial Sequence
  Description of Artificial Sequence: Synthetic oligonucleotide
  Target: ATXN1; (-) strand; PAM type: YTN; PAM sequence: CTC
cagggctaaaatccaagact

SEQ ID NO: 186657 - DNA, 20 bp, Artificial Sequence
  Description of Artificial Sequence: Synthetic oligonucleotide
  Target: ATXN1; (-) strand; PAM type: YTN; PAM sequence: TTC
tccagggctaaaatccaaga

SEQ ID NO: 186658 - DNA, 20 bp, Artificial Sequence
  Description of Artificial Sequence: Synthetic oligonucleotide
  Target: ATXN1; (-) strand; PAM type: YTN; PAM sequence: TTT
ctccagggctaaaatccaag

SEQ ID NO: 186659 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaaaatgtaatttct

SEQ ID NO: 186660 - DNA, 20 bp, Artificial Sequence
  Description of Artificial Sequence: Synthetic oligonucleotide
  Target: ATXN1; (-) strand; PAM type: YTN; PAM sequence: TTG
catagaattgaaaaaaaaaa

SEQ ID NO: 186661 - DNA, 20 bp, Artificial Sequence
  Description of Artificial Sequence: Synthetic oligonucleotide
  Target: ATXN1; (-) strand; PAM type: YTN; PAM sequence: CTT
gcatagaattgaaaaaaaaa

SEQ ID NO: 186662 - DNA, 20 bp, Artificial Sequence
  Description of Artificial Sequence: Synthetic oligonucleotide
  Target: ATXN1; (-) strand; PAM type: YTN; PAM sequence: TTG
tggcttgcatagaattgaaa

SEQ ID NO: 186663 - DNA, 20 bp, Artificial Sequence
  Description of Artificial Sequence: Synthetic oligonucleotide
  Target: ATXN1; (-) strand; PAM type: YTN; PAM sequence: TTT
gtggcttgcatagaattgaa

SEQ ID NO: 186664 - DNA, 20 bp, Artificial Sequence
  Description of Artificial Sequence: Synthetic oligonucleotide
  Target: ATXN1; (-) strand; PAM type: YTN; PAM sequence: CTT
tgtggcttgcatagaattga

SEQ ID NO: 186665 - DNA, 20 bp, Artificial Sequence
  Description of Artificial Sequence: Synthetic oligonucleotide
  Target: ATXN1; (-) strand; PAM type: YTN; PAM sequence: TTC
ccaagcctttgtggcttgca

SEQ ID NO: 186666 - DNA, 20 bp, Artificial Sequence
  Description of Artificial Sequence: Synthetic oligonucleotide
  Target: ATXN1; (-) strand; PAM type: YTN; PAM sequence: CTT
cccaagcctttgtggcttgc

SEQ ID NO: 186667 - DNA, 20 bp, Artificial Sequence
  Description of Artificial Sequence: Synthetic oligonucleotide
  Target: ATXN1; (-) strand; PAM type: YTN; PAM sequence: TTC
ttcccaagcctttgtggctt

SEQ ID NO: 186668 - DNA, 20 bp, Artificial Sequence
  Description of Artificial Sequence: Synthetic oligonucleotide
  Target: ATXN1; (-) strand; PAM type: YTN; PAM sequence: CTT
cttcccaagcctttgtggct

SEQ ID NO: 186669 - DNA, 20 bp, Artificial Sequence
  Description of Artificial Sequence: Synthetic oligonucleotide
  Target: ATXN1; (-) strand; PAM type: YTN; PAM sequence: TTC
ttcttcccaagcctttgtgg

SEQ ID NO: 186670 - DNA, 20 bp, Artificial Sequence
  Description of Artificial Sequence: Synthetic oligonucleotide
  Target: ATXN1; (-) strand; PAM type: YTN; PAM sequence: TTT
cttcttcccaagcctttgtg

SEQ ID NO: 186671 - DNA, 20 bp, Artificial Sequence
  Description of Artificial Sequence: Synthetic oligonucleotide
  Target: ATXN1; (-) strand; PAM type: YTN; PAM sequence: CTT
tcttcttcccaagcctttgt

SEQ ID NO: 186672 - DNA, 20 bp, Artificial Sequence
  Description of Artificial Sequence: Synthetic oligonucleotide
  Target: ATXN1; (-) strand; PAM type: YTN; PAM sequence: TTC
ctttcttcttcccaagcctt

SEQ ID NO: 186673 - DNA, 20 bp, Artificial Sequence
  Description of Artificial Sequence: Synthetic oligonucleotide
  Target: ATXN1; (-) strand; PAM type: YTN; PAM sequence: TTT
cctttcttcttcccaagcct

SEQ ID NO: 186674 - DNA, 20 bp, Artificial Sequence
  Description of Artificial Sequence: Synthetic oligonucleotide
  Target: ATXN1; (-) strand; PAM type: YTN; PAM sequence: TTT
tcctttcttcttcccaagcc

SEQ ID NO: 186675 - DNA, 20 bp, Artificial Sequence
  Description of Artificial Sequence: Synthetic oligonucleotide
  Target: ATXN1; (-) strand; PAM type: YTN; PAM sequence: TTT
ttcctttcttcttcccaagc

SEQ ID NO: 186676 - DNA, 20 bp, Artificial Sequence
  Description of Artificial Sequence: Synthetic oligonucleotide
  Target: ATXN1; (-) strand; PAM type: YTN; PAM sequence: TTC
atttttcctttcttcttccc

SEQ ID NO: 186677 - DNA, 20 bp, Artificial Sequence
  Description of Artificial Sequence: Synthetic oligonucleotide
  Target: ATXN1; (-) strand; PAM type: YTN; PAM sequence: TTT
catttttcctttcttcttcc

SEQ ID NO: 186678 - DNA, 20 bp, Artificial Sequence
  Description of Artificial Sequence: Synthetic oligonucleotide
  Target: ATXN1; (-) strand; PAM type: YTN; PAM sequence: TTC
atttcatttttcctttcttc

SEQ ID NO: 186679 - DNA, 20 bp, Artificial Sequence
  Description of Artificial Sequence: Synthetic oligonucleotide
  Target: ATXN1; (-) strand; PAM type: YTN; PAM sequence: CTT
catttcatttttcctttctt

SEQ ID NO: 186680 - DNA, 20 bp, Artificial Sequence
  Description of Artificial Sequence: Synthetic oligonucleotide
  Target: ATXN1; (-) strand; PAM type: YTN; PAM sequence: CTC
ttcatttcatttttcctttc

SEQ ID NO: 186681 - DNA, 20 bp, Artificial Sequence
  Description of Artificial Sequence: Synthetic oligonucleotide
  Target: ATXN1; (-) strand; PAM type: YTN; PAM sequence: TTG
ctcttcatttcatttttcct

SEQ ID NO: 186682 - DNA, 20 bp, Artificial Sequence
  Description of Artificial Sequence: Synthetic oligonucleotide
  Target: ATXN1; (-) strand; PAM type: YTN; PAM sequence: TTA
ggttgctcttcatttcattt

SEQ ID NO: 186683 - DNA, 20 bp, Artificial Sequence
  Description of Artificial Sequence: Synthetic oligonucleotide
  Target: ATXN1; (-) strand; PAM type: YTN; PAM sequence: TTC
cattaggttgctcttcattt

SEQ ID NO: 186684 - DNA, 20 bp, Artificial Sequence
  Description of Artificial Sequence: Synthetic oligonucleotide
  Target: ATXN1; (-) strand; PAM type: YTN; PAM sequence: TTT
ccattaggttgctcttcatt

SEQ ID NO: 186685 - DNA, 20 bp, Artificial Sequence
  Description of Artificial Sequence: Synthetic oligonucleotide
  Target: ATXN1; (-) strand; PAM type: YTN; PAM sequence: CTA
aagtttccattaggttgctc

SEQ ID NO: 186686 - DNA, 20 bp, Artificial Sequence
  Description of Artificial Sequence: Synthetic oligonucleotide
  Target: ATXN1; (-) strand; PAM type: YTN; PAM sequence: TTC
taaagtttccattaggttgc

SEQ ID NO: 186687 - DNA, 20 bp, Artificial Sequence
  Description of Artificial Sequence: Synthetic oligonucleotide
  Target: ATXN1; (-) strand; PAM type: YTN; PAM sequence: TTT
ctaaagtttccattaggttg

SEQ ID NO: 186688 - DNA, 20 bp, Artificial Sequence
  Description of Artificial Sequence: Synthetic oligonucleotide
  Target: ATXN1; (-) strand; PAM type: YTN; PAM sequence: TTT
tctaaagtttccattaggtt

SEQ ID NO: 186689 - DNA, 20 bp, Artificial Sequence
  Description of Artificial Sequence: Synthetic oligonucleotide
  Target: ATXN1; (-) strand; PAM type: YTN; PAM sequence: TTG
ataaaatggttttctaaagt

SEQ ID NO: 186690 - DNA, 20 bp, Artificial Sequence
  Description of Artificial Sequence: Synthetic oligonucleotide
  Target: ATXN1; (-) strand; PAM type: YTN; PAM sequence: CTT
gataaaatggttttctaaag

SEQ ID NO: 186691 - DNA, 20 bp, Artificial Sequence
  Description of Artificial Sequence: Synthetic oligonucleotide
  Target: ATXN1; (-) strand; PAM type: YTN; PAM sequence: CTC
ttgataaaatggttttctaa

SEQ ID NO: 186692 - DNA, 20 bp, Artificial Sequence
  Description of Artificial Sequence: Synthetic oligonucleotide
  Target: ATXN1; (-) strand; PAM type: YTN; PAM sequence: CTG
gaaataaaaatgctcttgat

SEQ ID NO: 186693 - DNA, 20 bp, Artificial Sequence
  Description of Artificial Sequence: Synthetic oligonucleotide
  Target: ATXN1; (-) strand; PAM type: YTN; PAM sequence: TTG
tgcatctggaaataaaaatg

SEQ ID NO: 186694 - DNA, 20 bp, Artificial Sequence
  Description of Artificial Sequence: Synthetic oligonucleotide
  Target: ATXN1; (-) strand; PAM type: YTN; PAM sequence: TTT
gtgcatctggaaataaaaat

SEQ ID NO: 186695 - DNA, 20 bp, Artificial Sequence
  Description of Artificial Sequence: Synthetic oligonucleotide
  Target: ATXN1; (-) strand; PAM type: YTN; PAM sequence: CTT
tgtgcatctggaaataaaaa

SEQ ID NO: 186696 - DNA, 20 bp, Artificial Sequence
  Description of Artificial Sequence: Synthetic oligonucleotide
  Target: ATXN1; (-) strand; PAM type: YTN; PAM sequence: TTC
ctttgtgcatctggaaataa

SEQ ID NO: 186697 - DNA, 20 bp, Artificial Sequence
  Description of Artificial Sequence: Synthetic oligonucleotide
  Target: ATXN1; (-) strand; PAM type: YTN; PAM sequence: CTT
cctttgtgcatctggaaata

SEQ ID NO: 186698 - DNA, 20 bp, Artificial Sequence
  Description of Artificial Sequence: Synthetic oligonucleotide
  Target: ATXN1; (-) strand; PAM type: YTN; PAM sequence: CTC
accagccttcctttgtgcat

SEQ ID NO: 186699 - DNA, 20 bp, Artificial Sequence
  Description of Artificial Sequence: Synthetic oligonucleotide
  Target: ATXN1; (-) strand; PAM type: YTN; PAM sequence: CTG
cacatcagccatcctcacca

SEQ ID NO: 186700 - DNA, 20 bp, Artificial Sequence
  Description of Artificial Sequence: Synthetic oligonucleotide
  Target: ATXN1; (-) strand; PAM type: YTN; PAM sequence: TTC
aatctgcacatcagccatcc

SEQ ID NO: 186701 - DNA, 20 bp, Artificial Sequence
  Description of Artificial Sequence: Synthetic oligonucleotide
  Target: ATXN1; (-) strand; PAM type: YTN; PAM sequence: TTT
caatctgcacatcagccatc

SEQ ID NO: 186702 - DNA, 20 bp, Artificial Sequence
  Description of Artificial Sequence: Synthetic oligonucleotide
  Target: ATXN1; (-) strand; PAM type: YTN; PAM sequence: TTA
cgtgtttcaatctgcacatc

SEQ ID NO: 186703 - DNA, 20 bp, Artificial Sequence
  Description of Artificial Sequence: Synthetic oligonucleotide
  Target: ATXN1; (-) strand; PAM type: YTN; PAM sequence: TTG
gttacgtgtttcaatctgca

SEQ ID NO: 186704 - DNA, 20 bp, Artificial Sequence
  Description of Artificial Sequence: Synthetic oligonucleotide
  Target: ATXN1; (-) strand; PAM type: YTN; PAM sequence: CTG
ttggttacgtgtttcaatct

SEQ ID NO: 186705 - DNA, 20 bp, Artificial Sequence
  Description of Artificial Sequence: Synthetic oligonucleotide
  Target: ATXN1; (-) strand; PAM type: YTN; PAM sequence: CTG
cacaggtcccaggctgttgg

SEQ ID NO: 186706 - DNA, 20 bp, Artificial Sequence
  Description of Artificial Sequence: Synthetic oligonucleotide
  Target: ATXN1; (-) strand; PAM type: YTN; PAM sequence: CTG
gacccctgcacaggtcccag

SEQ ID NO: 186707 - DNA, 20 bp, Artificial Sequence
  Description of Artificial Sequence: Synthetic oligonucleotide
  Target: ATXN1; (-) strand; PAM type: YTN; PAM sequence: CTG
ctggacccctgcacaggtcc

SEQ ID NO: 186708 - DNA, 20 bp, Artificial Sequence
  Description of Artificial Sequence: Synthetic oligonucleotide
  Target: ATXN1; (-) strand; PAM type: YTN; PAM sequence: TTC
gctgctggacccctgcacag

SEQ ID NO: 186709 - DNA, 20 bp, Artificial Sequence
  Description of Artificial Sequence: Synthetic oligonucleotide
  Target: ATXN1; (-) strand; PAM type: YTN; PAM sequence: CTG
tcagaattcgctgctggacc

SEQ ID NO: 186710 - DNA, 20 bp, Artificial Sequence
  Description of Artificial Sequence: Synthetic oligonucleotide
  Target: ATXN1; (-) strand; PAM type: YTN; PAM sequence: TTG
ctgtcagaattcgctgctgg

SEQ ID NO: 186711 - DNA, 20 bp, Artificial Sequence
  Description of Artificial Sequence: Synthetic oligonucleotide
  Target: ATXN1; (-) strand; PAM type: YTN; PAM sequence: CTG
cccacattgctgtcagaatt

SEQ ID NO: 186712 - DNA, 20 bp, Artificial Sequence
  Description of Artificial Sequence: Synthetic oligonucleotide
  Target: ATXN1; (-) strand; PAM type: YTN; PAM sequence: CTG
ggaggtgacctgcccacatt

SEQ ID NO: 186713 - DNA, 20 bp, Artificial Sequence
  Description of Artificial Sequence: Synthetic oligonucleotide
  Target: ATXN1; (-) strand; PAM type: YTN; PAM sequence: CTG
gcactgggaggtgacctgcc

SEQ ID NO: 186714 - DNA, 20 bp, Artificial Sequence
  Description of Artificial Sequence: Synthetic oligonucleotide
  Target: ATXN1; (-) strand; PAM type: YTN; PAM sequence: TTG
agtgcctggcactgggaggt

SEQ ID NO: 186715 - DNA, 20 bp, Artificial Sequence
  Description of Artificial Sequence: Synthetic oligonucleotide
  Target: ATXN1; (-) strand; PAM type: YTN; PAM sequence: CTT
gagtgcctggcactgggagg

SEQ ID NO: 186716 - DNA, 20 bp, Artificial Sequence
  Description of Artificial Sequence: Synthetic oligonucleotide
  Target: ATXN1; (-) strand; PAM type: YTN; PAM sequence: TTC
ccagtcttgagtgcctggca

SEQ ID NO: 186717 - DNA, 20 bp, Artificial Sequence
  Description of Artificial Sequence: Synthetic oligonucleotide
  Target: ATXN1; (-) strand; PAM type: YTN; PAM sequence: TTT
cccagtcttgagtgcctggc

SEQ ID NO: 186718 - DNA, 20 bp, Artificial Sequence
  Description of Artificial Sequence: Synthetic oligonucleotide
  Target: ATXN1; (-) strand; PAM type: YTN; PAM sequence: TTG
tgatcatttcccagtcttga

SEQ ID NO: 186719 - DNA, 20 bp, Artificial Sequence
  Description of Artificial Sequence: Synthetic oligonucleotide
  Target: ATXN1; (-) strand; PAM type: YTN; PAM sequence: CTT
gtgatcatttcccagtcttg

SEQ ID NO: 186720 - DNA, 20 bp, Artificial Sequence
  Description of Artificial Sequence: Synthetic oligonucleotide
  Target: ATXN1; (-) strand; PAM type: YTN; PAM sequence: TTA
aacagcatcttgtgatcatt

SEQ ID NO: 186721 - DNA, 20 bp, Artificial Sequence
  Description of Artificial Sequence: Synthetic oligonucleotide
  Target: ATXN1; (-) strand; PAM type: YTN; PAM sequence: TTT
aaacagcatcttgtgatcat

SEQ ID NO: 186722 - DNA, 20 bp, Artificial Sequence
  Description of Artificial Sequence: Synthetic oligonucleotide
  Target: ATXN1; (-) strand; PAM type: YTN; PAM sequence: TTT
taaacagcatcttgtgatca

SEQ ID NO: 186723 - DNA, 20 bp, Artificial Sequence
  Description of Artificial Sequence: Synthetic oligonucleotide
  Target: ATXN1; (-) strand; PAM type: YTN; PAM sequence: TTT
ttaaacagcatcttgtgatc

SEQ ID NO: 186724 - DNA, 20 bp, Artificial Sequence
  Description of Artificial Sequence: Synthetic oligonucleotide
  Target: ATXN1; (-) strand; PAM type: YTN; PAM sequence: CTC
aatacatttttaaacagcat

SEQ ID NO: 186725 - DNA, 20 bp, Artificial Sequence
  Description of Artificial Sequence: Synthetic oligonucleotide
  Target: ATXN1; (-) strand; PAM type: YTN; PAM sequence: TTC
tcaatacatttttaaacagc

SEQ ID NO: 186726 - DNA, 20 bp, Artificial Sequence
  Description of Artificial Sequence: Synthetic oligonucleotide
  Target: ATXN1; (-) strand; PAM type: YTN; PAM sequence: TTT
ctcaatacatttttaaacag

SEQ ID NO: 186727 - DNA, 20 bp, Artificial Sequence
  Description of Artificial Sequence: Synthetic oligonucleotide
  Target: ATXN1; (-) strand; PAM type: YTN; PAM sequence: CTT
tctcaatacatttttaaaca

SEQ ID NO: 186728 - DNA, 20 bp, Artificial Sequence
  Description of Artificial Sequence: Synthetic oligonucleotide
  Target: ATXN1; (-) strand; PAM type: YTN; PAM sequence: TTC
tttctcaatacatttttaaa

SEQ ID NO: 186729 - DNA, 20 bp, Artificial Sequence
  Description of Artificial Sequence: Synthetic oligonucleotide
  Target: ATXN1; (-) strand; PAM type: YTN; PAM sequence: CTT
ctttctcaatacatttttaa

SEQ ID NO: 186730 - DNA, 20 bp, Artificial Sequence
  Description of Artificial Sequence: Synthetic oligonucleotide
  Target: ATXN1; (-) strand; PAM type: YTN; PAM sequence: CTA
cttctttctcaatacatttt

SEQ ID NO: 186731 - DNA, 20 bp, Artificial Sequence
  Description of Artificial Sequence: Synthetic oligonucleotide
  Target: ATXN1; (-) strand; PAM type: YTN; PAM sequence: TTC
tacttctttctcaatacatt

SEQ ID NO: 186732 - DNA, 20 bp, Artificial Sequence
  Description of Artificial Sequence: Synthetic oligonucleotide
  Target: ATXN1; (-) strand; PAM type: YTN; PAM sequence: TTA
aattctacttctttctcaat

SEQ ID NO: 186733 - DNA, 20 bp, Artificial Sequence
  Description of Artificial Sequence: Synthetic oligonucleotide
  Target: ATXN1; (-) strand; PAM type: YTN; PAM sequence: TTT
aaattctacttctttctcaa

SEQ ID NO: 186734 - DNA, 20 bp, Artificial Sequence
  Description of Artificial Sequence: Synthetic oligonucleotide
  Target: ATXN1; (-) strand; PAM type: YTN; PAM sequence: TTT
taaattctacttctttctca

SEQ ID NO: 186735 - DNA, 20 bp, Artificial Sequence
  Description of Artificial Sequence: Synthetic oligonucleotide
  Target: ATXN1; (-) strand; PAM type: YTN; PAM sequence: CTT
ttaaattctacttctttctc

SEQ ID NO: 186736 - DNA, 20 bp, Artificial Sequence
  Description of Artificial Sequence: Synthetic oligonucleotide
  Target: ATXN1; (-) strand; PAM type: YTN; PAM sequence: CTA
cttttaaattctacttcttt

SEQ ID NO: 186737 - DNA, 20 bp, Artificial Sequence
  Description of Artificial Sequence: Synthetic oligonucleotide
  Target: ATXN1; (-) strand; PAM type: YTN; PAM sequence: TTC
tacttttaaattctacttct

SEQ ID NO: 186738 - DNA, 20 bp, Artificial Sequence
  Description of Artificial Sequence: Synthetic oligonucleotide
  Target: ATXN1; (-) strand; PAM type: YTN; PAM sequence: CTT
ctacttttaaattctacttc

SEQ ID NO: 186739 - DNA, 20 bp, Artificial Sequence
  Description of Artificial Sequence: Synthetic oligonucleotide
  Target: ATXN1; (-) strand; PAM type: YTN; PAM sequence: TTC
ttctacttttaaattctact

SEQ ID NO: 186740 - DNA, 20 bp, Artificial Sequence
  Description of Artificial Sequence: Synthetic oligonucleotide
  Target: ATXN1; (-) strand; PAM type: YTN; PAM sequence: CTT
cttctacttttaaattctac

SEQ ID NO: 186741 - DNA, 20 bp, Artificial Sequence
  Description of Artificial Sequence: Synthetic oligonucleotide
  Target: ATXN1; (-) strand; PAM type: YTN; PAM sequence: TTA
accatcttcttctactttta

SEQ ID NO: 186742 - DNA, 20 bp, Artificial Sequence
  Description of Artificial Sequence: Synthetic oligonucleotide
  Target: ATXN1; (-) strand; PAM type: YTN; PAM sequence: CTT
aaccatcttcttctactttt

SEQ ID NO: 186743 - DNA, 20 bp, Artificial Sequence
  Description of Artificial Sequence: Synthetic oligonucleotide
  Target: ATXN1; (-) strand; PAM type: YTN; PAM sequence: CTC
ttaaccatcttcttctactt

SEQ ID NO: 186744 - DNA, 20 bp, Artificial Sequence
  Description of Artificial Sequence: Synthetic oligonucleotide
  Target: ATXN1; (-) strand; PAM type: YTN; PAM sequence: TTG
gactcttaaccatcttcttc

SEQ ID NO: 186745 - DNA, 20 bp, Artificial Sequence
  Description of Artificial Sequence: Synthetic oligonucleotide
  Target: ATXN1; (-) strand; PAM type: YTN; PAM sequence: TTT
ggactcttaaccatcttctt

SEQ ID NO: 186746 - DNA, 20 bp, Artificial Sequence
  Description of Artificial Sequence: Synthetic oligonucleotide
  Target: ATXN1; (-) strand; PAM type: YTN; PAM sequence: CTT
tggactcttaaccatcttct

SEQ ID NO: 186747 - DNA, 20 bp, Artificial Sequence
  Description of Artificial Sequence: Synthetic oligonucleotide
  Target: ATXN1; (-) strand; PAM type: YTN; PAM sequence: CTC
tttggactcttaaccatctt

SEQ ID NO: 186748 - DNA, 20 bp, Artificial Sequence
  Description of Artificial Sequence: Synthetic oligonucleotide
  Target: ATXN1; (-) strand; PAM type: YTN; PAM sequence: TTA
tcatcatgctctttggactc

SEQ ID NO: 186749 - DNA, 20 bp, Artificial Sequence
  Description of Artificial Sequence: Synthetic oligonucleotide
  Target: ATXN1; (-) strand; PAM type: YTN; PAM sequence: TTT
atcatcatgctctttggact

SEQ ID NO: 186750 - DNA, 20 bp, Artificial Sequence
  Description of Artificial Sequence: Synthetic oligonucleotide
  Target: ATXN1; (-) strand; PAM type: YTN; PAM sequence: TTT
tatcatcatgctctttggac

SEQ ID NO: 186751 - DNA, 20 bp, Artificial Sequence
  Description of Artificial Sequence: Synthetic oligonucleotide
  Target: ATXN1; (-) strand; PAM type: YTN; PAM sequence: TTT
ttatcatcatgctctttgga

SEQ ID NO: 186752 - DNA, 20 bp, Artificial Sequence
  Description of Artificial Sequence: Synthetic oligonucleotide
  Target: ATXN1; (-) strand; PAM type: YTN; PAM sequence: CTC
agacaggtttttatcatcat

SEQ ID NO: 186753 - DNA, 20 bp, Artificial Sequence
  Description of Artificial Sequence: Synthetic oligonucleotide
  Target: ATXN1; (-) strand; PAM type: YTN; PAM sequence: TTC
caaaactcagacaggttttt

SEQ ID NO: 186754 - DNA, 20 bp, Artificial Sequence
  Description of Artificial Sequence: Synthetic oligonucleotide
  Target: ATXN1; (-) strand; PAM type: YTN; PAM sequence: TTT
ccaaaactcagacaggtttt

SEQ ID NO: 186755 - DNA, 20 bp, Artificial Sequence
  Description of Artificial Sequence: Synthetic oligonucleotide
  Target: ATXN1; (-) strand; PAM type: YTN; PAM sequence: TTA
tttccaaaactcagacaggt

SEQ ID NO: 186756 - DNA, 20 bp, Artificial Sequence
  Description of Artificial Sequence: Synthetic oligonucleotide
  Target: ATXN1; (-) strand; PAM type: YTN; PAM sequence: TTT
atttccaaaactcagacagg

SEQ ID NO: 186757 - DNA, 20 bp, Artificial Sequence
  Description of Artificial Sequence: Synthetic oligonucleotide
  Target: ATXN1; (-) strand; PAM type: YTN; PAM sequence: TTT
tatttccaaaactcagacag

SEQ ID NO: 186758 - DNA, 20 bp, Artificial Sequence
  Description of Artificial Sequence: Synthetic oligonucleotide
  Target: ATXN1; (-) strand; PAM type: YTN; PAM sequence: CTT
ttatttccaaaactcagaca

SEQ ID NO: 186759 - DNA, 20 bp, Artificial Sequence
  Description of Artificial Sequence: Synthetic oligonucleotide
  Target: ATXN1; (-) strand; PAM type: YTN; PAM sequence: CTA
tcataatcttttatttccaa

SEQ ID NO: 186760 - DNA, 20 bp, Artificial Sequence
  Description of Artificial Sequence: Synthetic oligonucleotide
  Target: ATXN1; (-) strand; PAM type: YTN; PAM sequence: CTC
tatcataatcttttatttcc

SEQ ID NO: 186761 - DNA, 20 bp, Artificial Sequence
  Description of Artificial Sequence: Synthetic oligonucleotide
  Target: ATXN1; (-) strand; PAM type: YTN; PAM sequence: CTA
tcctctatcataatctttta

SEQ ID NO: 186762 - DNA, 20 bp, Artificial Sequence
  Description of Artificial Sequence: Synthetic oligonucleotide
  Target: ATXN1; (-) strand; PAM type: YTN; PAM sequence: TTA
aatggaaacataaatggtat

SEQ ID NO: 186763 - DNA, 20 bp, Artificial Sequence
  Description of Artificial Sequence: Synthetic oligonucleotide
  Target: ATXN1; (-) strand; PAM type: YTN; PAM sequence: CTT
aaatggaaacataaatggta

SEQ ID NO: 186764 - DNA, 20 bp, Artificial Sequence
  Description of Artificial Sequence: Synthetic oligonucleotide
  Target: ATXN1; (-) strand; PAM type: YTN; PAM sequence: CTC
cttaaatggaaacataaatg

SEQ ID NO: 186765 - DNA, 20 bp, Artificial Sequence
  Description of Artificial Sequence: Synthetic oligonucleotide
  Target: ATXN1; (-) strand; PAM type: YTN; PAM sequence: TTA
aggagagtctccttaaatgg

SEQ ID NO: 186766 - DNA, 20 bp, Artificial Sequence
  Description of Artificial Sequence: Synthetic oligonucleotide
  Target: ATXN1; (-) strand; PAM type: YTN; PAM sequence: CTT
aaggagagtctccttaaatg

SEQ ID NO: 186767 - DNA, 20 bp, Artificial Sequence
  Description of Artificial Sequence: Synthetic oligonucleotide
  Target: ATXN1; (-) strand; PAM type: YTN; PAM sequence: TTG
cttaaggagagtctccttaa

SEQ ID NO: 186768 - DNA, 20 bp, Artificial Sequence
  Description of Artificial Sequence: Synthetic oligonucleotide
  Target: ATXN1; (-) strand; PAM type: YTN; PAM sequence: CTT
gcttaaggagagtctcctta

SEQ ID NO: 186769 - DNA, 20 bp, Artificial Sequence
  Description of Artificial Sequence: Synthetic oligonucleotide
  Target: ATXN1; (-) strand; PAM type: YTN; PAM sequence: CTG
aaacaacttgcttaaggaga

SEQ ID NO: 186770 - DNA, 20 bp, Artificial Sequence
  Description of Artificial Sequence: Synthetic oligonucleotide
  Target: ATXN1; (-) strand; PAM type: YTN; PAM sequence: TTC
ctgaaacaacttgcttaagg

SEQ ID NO: 186771 - DNA, 20 bp, Artificial Sequence
  Description of Artificial Sequence: Synthetic oligonucleotide
  Target: ATXN1; (-) strand; PAM type: YTN; PAM sequence: TTA
tattcctgaaacaacttgct

SEQ ID NO: 186772 - DNA, 20 bp, Artificial Sequence
  Description of Artificial Sequence: Synthetic oligonucleotide
  Target: ATXN1; (-) strand; PAM type: YTN; PAM sequence: CTT
atattcctgaaacaacttgc

SEQ ID NO: 186773 - DNA, 20 bp, Artificial Sequence
  Description of Artificial Sequence: Synthetic oligonucleotide
  Target: ATXN1; (-) strand; PAM type: YTN; PAM sequence: TTG
tgcttatattcctgaaacaa

SEQ ID NO: 186774 - DNA, 20 bp, Artificial Sequence
  Description of Artificial Sequence: Synthetic oligonucleotide
  Target: ATXN1; (-) strand; PAM type: YTN; PAM sequence: TTT
gtgcttatattcctgaaaca

SEQ ID NO: 186775 - DNA, 20 bp, Artificial Sequence
  Description of Artificial Sequence: Synthetic oligonucleotide
  Target: ATXN1; (-) strand; PAM type: YTN; PAM sequence: TTG
tatttgtgcttatattcctg

SEQ ID NO: 186776 - DNA, 20 bp, Artificial Sequence
  Description of Artificial Sequence: Synthetic oligonucleotide
  Target: ATXN1; (-) strand; PAM type: YTN; PAM sequence: TTT
gtatttgtgcttatattcct

SEQ ID NO: 186777 - DNA, 20 bp, Artificial Sequence
  Description of Artificial Sequence: Synthetic oligonucleotide
  Target: ATXN1; (-) strand; PAM type: YTN; PAM sequence: TTT
tgtatttgtgcttatattcc

SEQ ID NO: 186778 - DNA, 20 bp, Artificial Sequence
  Description of Artificial Sequence: Synthetic oligonucleotide
  Target: ATXN1; (-) strand; PAM type: YTN; PAM sequence: TTT
ttgtatttgtgcttatattc

SEQ ID NO: 186779 - DNA, 20 bp, Artificial Sequence
  Description of Artificial Sequence: Synthetic oligonucleotide
  Target: ATXN1; (-) strand; PAM type: YTN; PAM sequence: TTT
tttgtatttgtgcttatatt

SEQ ID NO: 186780 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttgtgcttatat

SEQ ID NO: 186781 - DNA, 20 bp, Artificial Sequence
  Description of Artificial Sequence: Synthetic oligonucleotide
  Target: ATXN1; (-) strand; PAM type: YTN; PAM sequence: TTT
tttttgtatttgtgcttata

SEQ ID NO: 186782 - DNA, 20 bp, Artificial Sequence
  Description of Artificial Sequence: Synthetic oligonucleotide
  Target: ATXN1; (-) strand; PAM type: YTN; PAM sequence: TTT
ttttttgtatttgtgcttat

SEQ ID NO: 186783 - DNA, 20 bp, Artificial Sequence
  Description of Artificial Sequence: Synthetic oligonucleotide
  Target: ATXN1; (-) strand; PAM type: YTN; PAM sequence: TTC
agagcaatttttttttgtat

SEQ ID NO: 186784 - DNA, 20 bp, Artificial Sequence
  Description of Artificial Sequence: Synthetic oligonucleotide
  Target: ATXN1; (-) strand; PAM type: YTN; PAM sequence: TTT
cagagcaatttttttttgta

SEQ ID NO: 186785 - DNA, 20 bp, Artificial Sequence
  Description of Artificial Sequence: Synthetic oligonucleotide
  Target: ATXN1; (-) strand; PAM type: YTN; PAM sequence: TTT
tcagagcaatttttttttgt

SEQ ID NO: 186786 - DNA, 20 bp, Artificial Sequence
  Description of Artificial Sequence: Synthetic oligonucleotide
  Target: ATXN1; (-) strand; PAM type: YTN; PAM sequence: TTA
agttttcagagcaatttttt

SEQ ID NO: 186787 - DNA, 20 bp, Artificial Sequence
  Description of Artificial Sequence: Synthetic oligonucleotide
  Target: ATXN1; (-) strand; PAM type: YTN; PAM sequence: TTA
gagaaattaagttttcagag

SEQ ID NO: 186788 - DNA, 20 bp, Artificial Sequence
  Description of Artificial Sequence: Synthetic oligonucleotide
  Target: ATXN1; (-) strand; PAM type: YTN; PAM sequence: CTA
tgttagagaaattaagtttt

SEQ ID NO: 186789 - DNA, 20 bp, Artificial Sequence
  Description of Artificial Sequence: Synthetic oligonucleotide
  Target: ATXN1; (-) strand; PAM type: YTN; PAM sequence: TTC
aaacctatgttagagaaatt

SEQ ID NO: 186790 - DNA, 20 bp, Artificial Sequence
  Description of Artificial Sequence: Synthetic oligonucleotide
  Target: ATXN1; (-) strand; PAM type: YTN; PAM sequence: TTT
caaacctatgttagagaaat

SEQ ID NO: 186791 - DNA, 20 bp, Artificial Sequence
  Description of Artificial Sequence: Synthetic oligonucleotide
  Target: ATXN1; (-) strand; PAM type: YTN; PAM sequence: CTG
tttcaaacctatgttagaga

SEQ ID NO: 186792 - DNA, 20 bp, Artificial Sequence
  Description of Artificial Sequence: Synthetic oligonucleotide
  Target: ATXN1; (-) strand; PAM type: YTN; PAM sequence: TTA
gctgtttcaaacctatgtta

SEQ ID NO: 186793 - DNA, 20 bp, Artificial Sequence
  Description of Artificial Sequence: Synthetic oligonucleotide
  Target: ATXN1; (-) strand; PAM type: YTN; PAM sequence: TTG
aggtgtgatagcaaattagc

SEQ ID NO: 186794 - DNA, 20 bp, Artificial Sequence
  Description of Artificial Sequence: Synthetic oligonucleotide
  Target: ATXN1; (-) strand; PAM type: YTN; PAM sequence: TTT
gaggtgtgatagcaaattag

SEQ ID NO: 186795 - DNA, 20 bp, Artificial Sequence
  Description of Artificial Sequence: Synthetic oligonucleotide
  Target: ATXN1; (-) strand; PAM type: YTN; PAM sequence: TTT
tgaggtgtgatagcaaatta

SEQ ID NO: 186796 - DNA, 20 bp, Artificial Sequence
  Description of Artificial Sequence: Synthetic oligonucleotide
  Target: ATXN1; (-) strand; PAM type: YTN; PAM sequence: TTG
acaagtataaaatgattttg

SEQ ID NO: 186797 - DNA, 20 bp, Artificial Sequence
  Description of Artificial Sequence: Synthetic oligonucleotide
  Target: ATXN1; (-) strand; PAM type: YTN; PAM sequence: TTT
gacaagtataaaatgatttt

SEQ ID NO: 186798 - DNA, 20 bp, Artificial Sequence
  Description of Artificial Sequence: Synthetic oligonucleotide
  Target: ATXN1; (-) strand; PAM type: YTN; PAM sequence: TTT
tgacaagtataaaatgattt

SEQ ID NO: 186799 - DNA, 20 bp, Artificial Sequence
  Description of Artificial Sequence: Synthetic oligonucleotide
  Target: ATXN1; (-) strand; PAM type: YTN; PAM sequence: TTT
ttgacaagtataaaatgatt

SEQ ID NO: 186800 - DNA, 20 bp, Artificial Sequence
  Description of Artificial Sequence: Synthetic oligonucleotide
  Target: ATXN1; (-) strand; PAM type: YTN; PAM sequence: TTC
agaaaaagtcatttttgaca

SEQ ID NO: 186801 - DNA, 20 bp, Artificial Sequence
  Description of Artificial Sequence: Synthetic oligonucleotide
  Target: ATXN1; (-) strand; PAM type: YTN; PAM sequence: TTA
catgattcagaaaaagtcat

SEQ ID NO: 186802 - DNA, 20 bp, Artificial Sequence
  Description of Artificial Sequence: Synthetic oligonucleotide
  Target: ATXN1; (-) strand; PAM type: YTN; PAM sequence: CTA
aacaagtatgttacatgatt

SEQ ID NO: 186803 - DNA, 20 bp, Artificial Sequence
  Description of Artificial Sequence: Synthetic oligonucleotide
  Target: ATXN1; (-) strand; PAM type: YTN; PAM sequence: TTC
cagacacctaaacaagtatg

SEQ ID NO: 186804 - DNA, 20 bp, Artificial Sequence
  Description of Artificial Sequence: Synthetic oligonucleotide
  Target: ATXN1; (-) strand; PAM type: YTN; PAM sequence: TTT
ccagacacctaaacaagtat

SEQ ID NO: 186805 - DNA, 20 bp, Artificial Sequence
  Description of Artificial Sequence: Synthetic oligonucleotide
  Target: ATXN1; (-) strand; PAM type: YTN; PAM sequence: TTT
tccagacacctaaacaagta

SEQ ID NO: 186806 - DNA, 20 bp, Artificial Sequence
  Description of Artificial Sequence: Synthetic oligonucleotide
  Target: ATXN1; (-) strand; PAM type: YTN; PAM sequence: CTT
ttccagacacctaaacaagt

SEQ ID NO: 186807 - DNA, 20 bp, Artificial Sequence
  Description of Artificial Sequence: Synthetic oligonucleotide
  Target: ATXN1; (-) strand; PAM type: YTN; PAM sequence: TTA
accttttccagacacctaaa

SEQ ID NO: 186808 - DNA, 20 bp, Artificial Sequence
  Description of Artificial Sequence: Synthetic oligonucleotide
  Target: ATXN1; (-) strand; PAM type: YTN; PAM sequence: TTA
tgttaaccttttccagacac

SEQ ID NO: 186809 - DNA, 20 bp, Artificial Sequence
  Description of Artificial Sequence: Synthetic oligonucleotide
  Target: ATXN1; (-) strand; PAM type: YTN; PAM sequence: CTG
aagattatgttaaccttttc

SEQ ID NO: 186810 - DNA, 20 bp, Artificial Sequence
  Description of Artificial Sequence: Synthetic oligonucleotide
  Target: ATXN1; (-) strand; PAM type: YTN; PAM sequence: CTA
taaatcctgaagattatgtt

SEQ ID NO: 186811 - DNA, 20 bp, Artificial Sequence
  Description of Artificial Sequence: Synthetic oligonucleotide
  Target: ATXN1; (-) strand; PAM type: YTN; PAM sequence: TTC
tataaatcctgaagattatg

SEQ ID NO: 186812 - DNA, 20 bp, Artificial Sequence
  Description of Artificial Sequence: Synthetic oligonucleotide
  Target: ATXN1; (-) strand; PAM type: YTN; PAM sequence: CTT
ctataaatcctgaagattat

SEQ ID NO: 186813 - DNA, 20 bp, Artificial Sequence
  Description of Artificial Sequence: Synthetic oligonucleotide
  Target: ATXN1; (-) strand; PAM type: YTN; PAM sequence: TTA
atccatcttctataaatcct

SEQ ID NO: 186814 - DNA, 20 bp, Artificial Sequence
  Description of Artificial Sequence: Synthetic oligonucleotide
  Target: ATXN1; (-) strand; PAM type: YTN; PAM sequence: CTG
aaagaattaatccatcttct

SEQ ID NO: 186815 - DNA, 20 bp, Artificial Sequence
  Description of Artificial Sequence: Synthetic oligonucleotide
  Target: ATXN1; (-) strand; PAM type: YTN; PAM sequence: TTG
tagactgaaagaattaatcc

SEQ ID NO: 186816 - DNA, 20 bp, Artificial Sequence
  Description of Artificial Sequence: Synthetic oligonucleotide
  Target: ATXN1; (-) strand; PAM type: YTN; PAM sequence: CTA
agtagaattgtagactgaaa

SEQ ID NO: 186817 - DNA, 20 bp, Artificial Sequence
  Description of Artificial Sequence: Synthetic oligonucleotide
  Target: ATXN1; (-) strand; PAM type: YTN; PAM sequence: TTG
ctaagtagaattgtagactg

SEQ ID NO: 186818 - DNA, 20 bp, Artificial Sequence
  Description of Artificial Sequence: Synthetic oligonucleotide
  Target: ATXN1; (-) strand; PAM type: YTN; PAM sequence: TTA
ttgctaagtagaattgtaga

SEQ ID NO: 186819 - DNA, 20 bp, Artificial Sequence
  Description of Artificial Sequence: Synthetic oligonucleotide
  Target: ATXN1; (-) strand; PAM type: YTN; PAM sequence: CTA
tgtaataaattattgctaag

SEQ ID NO: 186820 - DNA, 20 bp, Artificial Sequence
  Description of Artificial Sequence: Synthetic oligonucleotide
  Target: ATXN1; (-) strand; PAM type: YTN; PAM sequence: TTC
cagtggtagctatgtaataa

SEQ ID NO: 186821 - DNA, 20 bp, Artificial Sequence
  Description of Artificial Sequence: Synthetic oligonucleotide
  Target: ATXN1; (-) strand; PAM type: YTN; PAM sequence: TTT
ccagtggtagctatgtaata

SEQ ID NO: 186822 - DNA, 20 bp, Artificial Sequence
  Description of Artificial Sequence: Synthetic oligonucleotide
  Target: ATXN1; (-) strand; PAM type: YTN; PAM sequence: TTA
aatttccagtggtagctatg

SEQ ID NO: 186823 - DNA, 20 bp, Artificial Sequence
  Description of Artificial Sequence: Synthetic oligonucleotide
  Target: ATXN1; (-) strand; PAM type: YTN; PAM sequence: TTC
atgttaaatttccagtggta

SEQ ID NO: 186824 - DNA, 20 bp, Artificial Sequence
  Description of Artificial Sequence: Synthetic oligonucleotide
  Target: ATXN1; (-) strand; PAM type: YTN; PAM sequence: TTA
aattcatgttaaatttccag

SEQ ID NO: 186825 - DNA, 20 bp, Artificial Sequence
  Description of Artificial Sequence: Synthetic oligonucleotide
  Target: ATXN1; (-) strand; PAM type: YTN; PAM sequence: CTT
aaattcatgttaaatttcca

SEQ ID NO: 186826 - DNA, 20 bp, Artificial Sequence
  Description of Artificial Sequence: Synthetic oligonucleotide
  Target: ATXN1; (-) strand; PAM type: YTN; PAM sequence: CTC
caacttaaattcatgttaaa

SEQ ID NO: 186827 - DNA, 20 bp, Artificial Sequence
  Description of Artificial Sequence: Synthetic oligonucleotide
  Target: ATXN1; (-) strand; PAM type: YTN; PAM sequence: TTA
accatgtctccaacttaaat

SEQ ID NO: 186828 - DNA, 20 bp, Artificial Sequence
  Description of Artificial Sequence: Synthetic oligonucleotide
  Target: ATXN1; (-) strand; PAM type: YTN; PAM sequence: TTA
taccataaaaatattaacca

SEQ ID NO: 186829 - DNA, 20 bp, Artificial Sequence
  Description of Artificial Sequence: Synthetic oligonucleotide
  Target: ATXN1; (-) strand; PAM type: YTN; PAM sequence: TTG
taaaagaatcatattatacc

SEQ ID NO: 186830 - DNA, 20 bp, Artificial Sequence
  Description of Artificial Sequence: Synthetic oligonucleotide
  Target: ATXN1; (-) strand; PAM type: YTN; PAM sequence: TTT
gtaaaagaatcatattatac

SEQ ID NO: 186831 - DNA, 20 bp, Artificial Sequence
  Description of Artificial Sequence: Synthetic oligonucleotide
  Target: ATXN1; (-) strand; PAM type: YTN; PAM sequence: TTT
tgtaaaagaatcatattata

SEQ ID NO: 186832 - DNA, 20 bp, Artificial Sequence
  Description of Artificial Sequence: Synthetic oligonucleotide
  Target: ATXN1; (-) strand; PAM type: YTN; PAM sequence: CTT
ttgtaaaagaatcatattat

SEQ ID NO: 186833 - DNA, 20 bp, Artificial Sequence
  Description of Artificial Sequence: Synthetic oligonucleotide
  Target: ATXN1; (-) strand; PAM type: YTN; PAM sequence: TTC
acttttgtaaaagaatcata

SEQ ID NO: 186834 - DNA, 20 bp, Artificial Sequence
  Description of Artificial Sequence: Synthetic oligonucleotide
  Target: ATXN1; (-) strand; PAM type: YTN; PAM sequence: TTT
cacttttgtaaaagaatcat

SEQ ID NO: 186835 - DNA, 20 bp, Artificial Sequence
  Description of Artificial Sequence: Synthetic oligonucleotide
  Target: ATXN1; (-) strand; PAM type: YTN; PAM sequence: TTT
tcacttttgtaaaagaatca

SEQ ID NO: 186836 - DNA, 20 bp, Artificial Sequence
  Description of Artificial Sequence: Synthetic oligonucleotide
  Target: ATXN1; (-) strand; PAM type: YTN; PAM sequence: TTT
ttcacttttgtaaaagaatc

SEQ ID NO: 186837 - DNA, 20 bp, Artificial Sequence
  Description of Artificial Sequence: Synthetic oligonucleotide
  Target: ATXN1; (-) strand; PAM type: YTN; PAM sequence: CTA
aatttttcacttttgtaaaa

SEQ ID NO: 186838 - DNA, 20 bp, Artificial Sequence
  Description of Artificial Sequence: Synthetic oligonucleotide
  Target: ATXN1; (-) strand; PAM type: YTN; PAM sequence: TTA
tctaaatttttcacttttgt

SEQ ID NO: 186839 - DNA, 20 bp, Artificial Sequence
  Description of Artificial Sequence: Synthetic oligonucleotide
  Target: ATXN1; (-) strand; PAM type: YTN; PAM sequence: TTA
attatctaaatttttcactt

SEQ ID NO: 186840 - DNA, 20 bp, Artificial Sequence
  Description of Artificial Sequence: Synthetic oligonucleotide
  Target: ATXN1; (-) strand; PAM type: YTN; PAM sequence: TTT
aattatctaaatttttcact

SEQ ID NO: 186841 - DNA, 20 bp, Artificial Sequence
  Description of Artificial Sequence: Synthetic oligonucleotide
  Target: ATXN1; (-) strand; PAM type: YTN; PAM sequence: TTT
taattatctaaatttttcac

SEQ ID NO: 186842 - DNA, 20 bp, Artificial Sequence
  Description of Artificial Sequence: Synthetic oligonucleotide
  Target: ATXN1; (-) strand; PAM type: YTN; PAM sequence: TTT
ttaattatctaaatttttca

SEQ ID NO: 186843 - DNA, 20 bp, Artificial Sequence
  Description of Artificial Sequence: Synthetic oligonucleotide
  Target: ATXN1; (-) strand; PAM type: YTN; PAM sequence: TTT
tttaattatctaaatttttc

SEQ ID NO: 186844 - DNA, 20 bp, Artificial Sequence
  Description of Artificial Sequence: Synthetic oligonucleotide
  Target: ATXN1; (-) strand; PAM type: YTN; PAM sequence: TTC
attttttaattatctaaatt

SEQ ID NO: 186845 - DNA, 20 bp, Artificial Sequence
  Description of Artificial Sequence: Synthetic oligonucleotide
  Target: ATXN1; (-) strand; PAM type: YTN; PAM sequence: CTT
cattttttaattatctaaat

SEQ ID NO: 186846 - DNA, 20 bp, Artificial Sequence
  Description of Artificial Sequence: Synthetic oligonucleotide
  Target: ATXN1; (-) strand; PAM type: YTN; PAM sequence: CTA
atgtaaacagacaaatagaa

SEQ ID NO: 186847 - DNA, 20 bp, Artificial Sequence
  Description of Artificial Sequence: Synthetic oligonucleotide
  Target: ATXN1; (-) strand; PAM type: YTN; PAM sequence: TTA
ggactaatgtaaacagacaa

SEQ ID NO: 186848 - DNA, 20 bp, Artificial Sequence
  Description of Artificial Sequence: Synthetic oligonucleotide
  Target: ATXN1; (-) strand; PAM type: YTN; PAM sequence: CTT
aggactaatgtaaacagaca

SEQ ID NO: 186849 - DNA, 20 bp, Artificial Sequence
  Description of Artificial Sequence: Synthetic oligonucleotide
  Target: ATXN1; (-) strand; PAM type: YTN; PAM sequence: CTC
cttaggactaatgtaaacag

SEQ ID NO: 186850 - DNA, 20 bp, Artificial Sequence
  Description of Artificial Sequence: Synthetic oligonucleotide
  Target: ATXN1; (-) strand; PAM type: YTN; PAM sequence: TTA
ctccttaggactaatgtaaa

SEQ ID NO: 186851 - DNA, 20 bp, Artificial Sequence
  Description of Artificial Sequence: Synthetic oligonucleotide
  Target: ATXN1; (-) strand; PAM type: YTN; PAM sequence: TTA
acaacacataaattactcct

SEQ ID NO: 186852 - DNA, 20 bp, Artificial Sequence
  Description of Artificial Sequence: Synthetic oligonucleotide
  Target: ATXN1; (-) strand; PAM type: YTN; PAM sequence: CTT
aacaacacataaattactcc

SEQ ID NO: 186853 - DNA, 20 bp, Artificial Sequence
  Description of Artificial Sequence: Synthetic oligonucleotide
  Target: ATXN1; (-) strand; PAM type: YTN; PAM sequence: TTC
ttaacaacacataaattact

SEQ ID NO: 186854 - DNA, 20 bp, Artificial Sequence
  Description of Artificial Sequence: Synthetic oligonucleotide
  Target: ATXN1; (-) strand; PAM type: YTN; PAM sequence: TTG
gttcttaacaacacataaat

SEQ ID NO: 186855 - DNA, 20 bp, Artificial Sequence
  Description of Artificial Sequence: Synthetic oligonucleotide
  Target: ATXN1; (-) strand; PAM type: YTN; PAM sequence: CTA
ttggttcttaacaacacata

SEQ ID NO: 186856 - DNA, 20 bp, Artificial Sequence
  Description of Artificial Sequence: Synthetic oligonucleotide
  Target: ATXN1; (-) strand; PAM type: YTN; PAM sequence: TTA
gtcatagaacccaaacaaaa

SEQ ID NO: 186857 - DNA, 20 bp, Artificial Sequence
  Description of Artificial Sequence: Synthetic oligonucleotide
  Target: ATXN1; (-) strand; PAM type: YTN; PAM sequence: TTT
agtcatagaacccaaacaaa

SEQ ID NO: 186858 - DNA, 20 bp, Artificial Sequence
  Description of Artificial Sequence: Synthetic oligonucleotide
  Target: ATXN1; (-) strand; PAM type: YTN; PAM sequence: TTG
tttagtcatagaacccaaac

SEQ ID NO: 186859 - DNA, 20 bp, Artificial Sequence
  Description of Artificial Sequence: Synthetic oligonucleotide
  Target: ATXN1; (-) strand; PAM type: YTN; PAM sequence: TTG
acattgtttagtcatagaac

SEQ ID NO: 186860 - DNA, 20 bp, Artificial Sequence
  Description of Artificial Sequence: Synthetic oligonucleotide
  Target: ATXN1; (-) strand; PAM type: YTN; PAM sequence: CTA
gttgacattgtttagtcata

SEQ ID NO: 186861 - DNA, 20 bp, Artificial Sequence
  Description of Artificial Sequence: Synthetic oligonucleotide
  Target: ATXN1; (-) strand; PAM type: YTN; PAM sequence: CTG
aatagtgataagaactagtt

SEQ ID NO: 186862 - DNA, 20 bp, Artificial Sequence
  Description of Artificial Sequence: Synthetic oligonucleotide
  Target: ATXN1; (-) strand; PAM type: YTN; PAM sequence: TTC
aagaatccacaataaagaag

SEQ ID NO: 186863 - DNA, 20 bp, Artificial Sequence
  Description of Artificial Sequence: Synthetic oligonucleotide
  Target: ATXN1; (-) strand; PAM type: YTN; PAM sequence: CTC
aatgttcaagaatccacaat

SEQ ID NO: 186864 - DNA, 20 bp, Artificial Sequence
  Description of Artificial Sequence: Synthetic oligonucleotide
  Target: ATXN1; (-) strand; PAM type: YTN; PAM sequence: TTC
gaagtgctcaatgttcaaga

SEQ ID NO: 186865 - DNA, 20 bp, Artificial Sequence
  Description of Artificial Sequence: Synthetic oligonucleotide
  Target: ATXN1; (-) strand; PAM type: YTN; PAM sequence: TTA
ggtggtataaattcgaagtg

SEQ ID NO: 186866 - DNA, 20 bp, Artificial Sequence
  Description of Artificial Sequence: Synthetic oligonucleotide
  Target: ATXN1; (-) strand; PAM type: YTN; PAM sequence: TTT
aggtggtataaattcgaagt

SEQ ID NO: 186867 - DNA, 20 bp, Artificial Sequence
  Description of Artificial Sequence: Synthetic oligonucleotide
  Target: ATXN1; (-) strand; PAM type: YTN; PAM sequence: TTT
taggtggtataaattcgaag

SEQ ID NO: 186868 - DNA, 20 bp, Artificial Sequence
  Description of Artificial Sequence: Synthetic oligonucleotide
  Target: ATXN1; (-) strand; PAM type: YTN; PAM sequence: TTT
ttaggtggtataaattcgaa

SEQ ID NO: 186869 - DNA, 20 bp, Artificial Sequence
  Description of Artificial Sequence: Synthetic oligonucleotide
  Target: ATXN1; (-) strand; PAM type: YTN; PAM sequence: TTT
tttaggtggtataaattcga

SEQ ID NO: 186870 - DNA, 20 bp, Artificial Sequence
  Description of Artificial Sequence: Synthetic oligonucleotide
  Target: ATXN1; (-) strand; PAM type: YTN; PAM sequence: CTA
aagatgtattttttaggtgg

SEQ ID NO: 186871 - DNA, 20 bp, Artificial Sequence
  Description of Artificial Sequence: Synthetic oligonucleotide
  Target: ATXN1; (-) strand; PAM type: YTN; PAM sequence: TTG
tacagaaaaacccaaacaaa

SEQ ID NO: 186872 - DNA, 20 bp, Artificial Sequence
  Description of Artificial Sequence: Synthetic oligonucleotide
  Target: ATXN1; (-) strand; PAM type: YTN; PAM sequence: TTT
gtacagaaaaacccaaacaa

SEQ ID NO: 186873 - DNA, 20 bp, Artificial Sequence
  Description of Artificial Sequence: Synthetic oligonucleotide
  Target: ATXN1; (-) strand; PAM type: YTN; PAM sequence: CTT
tgtacagaaaaacccaaaca

SEQ ID NO: 186874 - DNA, 20 bp, Artificial Sequence
  Description of Artificial Sequence: Synthetic oligonucleotide
  Target: ATXN1; (-) strand; PAM type: YTN; PAM sequence: CTG
aactttgtacagaaaaaccc

SEQ ID NO: 186875 - DNA, 20 bp, Artificial Sequence
  Description of Artificial Sequence: Synthetic oligonucleotide
  Target: ATXN1; (-) strand; PAM type: YTN; PAM sequence: TTC
caactgaactttgtacagaa

SEQ ID NO: 186876 - DNA, 20 bp, Artificial Sequence
  Description of Artificial Sequence: Synthetic oligonucleotide
  Target: ATXN1; (-) strand; PAM type: YTN; PAM sequence: TTT
ccaactgaactttgtacaga

SEQ ID NO: 186877 - DNA, 20 bp, Artificial Sequence
  Description of Artificial Sequence: Synthetic oligonucleotide
  Target: ATXN1; (-) strand; PAM type: YTN; PAM sequence: TTA
gtaagggcagtgtttccaac

SEQ ID NO: 186878 - DNA, 20 bp, Artificial Sequence
  Description of Artificial Sequence: Synthetic oligonucleotide
  Target: ATXN1; (-) strand; PAM type: YTN; PAM sequence: CTC
ccagcattagtaagggcagt

SEQ ID NO: 186879 - DNA, 20 bp, Artificial Sequence
  Description of Artificial Sequence: Synthetic oligonucleotide
  Target: ATXN1; (-) strand; PAM type: YTN; PAM sequence: CTA
aagaatgatgcctcccagca

SEQ ID NO: 186880 - DNA, 20 bp, Artificial Sequence
  Description of Artificial Sequence: Synthetic oligonucleotide
  Target: ATXN1; (-) strand; PAM type: YTN; PAM sequence: TTG
ggatgcctaaagaatgatgc

SEQ ID NO: 186881 - DNA, 20 bp, Artificial Sequence
  Description of Artificial Sequence: Synthetic oligonucleotide
  Target: ATXN1; (-) strand; PAM type: YTN; PAM sequence: CTT
gggatgcctaaagaatgatg

SEQ ID NO: 186882 - DNA, 20 bp, Artificial Sequence
  Description of Artificial Sequence: Synthetic oligonucleotide
  Target: ATXN1; (-) strand; PAM type: YTN; PAM sequence: TTG
aagcaagaacttgggatgcc

SEQ ID NO: 186883 - DNA, 20 bp, Artificial Sequence
  Description of Artificial Sequence: Synthetic oligonucleotide
  Target: ATXN1; (-) strand; PAM type: YTN; PAM sequence: TTA
tatgtaaaagttgaagcaag

SEQ ID NO: 186884 - DNA, 20 bp, Artificial Sequence
  Description of Artificial Sequence: Synthetic oligonucleotide
  Target: ATXN1; (-) strand; PAM type: YTN; PAM sequence: TTT
atatgtaaaagttgaagcaa

SEQ ID NO: 186885 - DNA, 20 bp, Artificial Sequence
  Description of Artificial Sequence: Synthetic oligonucleotide
  Target: ATXN1; (-) strand; PAM type: YTN; PAM sequence: CTT
tatatgtaaaagttgaagca

SEQ ID NO: 186886 - DNA, 20 bp, Artificial Sequence
  Description of Artificial Sequence: Synthetic oligonucleotide
  Target: ATXN1; (-) strand; PAM type: YTN; PAM sequence: TTG
gatctttatatgtaaaagtt

SEQ ID NO: 186887 - DNA, 20 bp, Artificial Sequence
  Description of Artificial Sequence: Synthetic oligonucleotide
  Target: ATXN1; (-) strand; PAM type: YTN; PAM sequence: TTT
ggatctttatatgtaaaagt

SEQ ID NO: 186888 - DNA, 20 bp, Artificial Sequence
  Description of Artificial Sequence: Synthetic oligonucleotide
  Target: ATXN1; (-) strand; PAM type: YTN; PAM sequence: TTT
tggatctttatatgtaaaag

SEQ ID NO: 186889 - DNA, 20 bp, Artificial Sequence
  Description of Artificial Sequence: Synthetic oligonucleotide
  Target: ATXN1; (-) strand; PAM type: YTN; PAM sequence: CTG
gcacattttggatctttata

SEQ ID NO: 186890 - DNA, 20 bp, Artificial Sequence
  Description of Artificial Sequence: Synthetic oligonucleotide
  Target: ATXN1; (-) strand; PAM type: YTN; PAM sequence: CTA
cgcctggcacattttggatc

SEQ ID NO: 186891 - DNA, 20 bp, Artificial Sequence
  Description of Artificial Sequence: Synthetic oligonucleotide
  Target: ATXN1; (-) strand; PAM type: YTN; PAM sequence: TTA
taggcatcagccactacgcc

SEQ ID NO: 186892 - DNA, 20 bp, Artificial Sequence
  Description of Artificial Sequence: Synthetic oligonucleotide
  Target: ATXN1; (-) strand; PAM type: YTN; PAM sequence: CTG
ggattataggcatcagccac

SEQ ID NO: 186893 - DNA, 20 bp, Artificial Sequence
  Description of Artificial Sequence: Synthetic oligonucleotide
  Target: ATXN1; (-) strand; PAM type: YTN; PAM sequence: TTC
ccaaaatgctgggattatag

SEQ ID NO: 186894 - DNA, 20 bp, Artificial Sequence
  Description of Artificial Sequence: Synthetic oligonucleotide
  Target: ATXN1; (-) strand; PAM type: YTN; PAM sequence: CTT
cccaaaatgctgggattata

SEQ ID NO: 186895 - DNA, 20 bp, Artificial Sequence
  Description of Artificial Sequence: Synthetic oligonucleotide
  Target: ATXN1; (-) strand; PAM type: YTN; PAM sequence: CTC
ggcttcccaaaatgctggga

SEQ ID NO: 186896 - DNA, 20 bp, Artificial Sequence
  Description of Artificial Sequence: Synthetic oligonucleotide
  Target: ATXN1; (-) strand; PAM type: YTN; PAM sequence: CTG
cccacctcggcttcccaaaa

SEQ ID NO: 186897 - DNA, 20 bp, Artificial Sequence
  Description of Artificial Sequence: Synthetic oligonucleotide
  Target: ATXN1; (-) strand; PAM type: YTN; PAM sequence: CTC
aagtgatctgcccacctcgg

SEQ ID NO: 186898 - DNA, 20 bp, Artificial Sequence
  Description of Artificial Sequence: Synthetic oligonucleotide
  Target: ATXN1; (-) strand; PAM type: YTN; PAM sequence: TTG
agctcaagtgatctgcccac

SEQ ID NO: 186899 - DNA, 20 bp, Artificial Sequence
  Description of Artificial Sequence: Synthetic oligonucleotide
  Target: ATXN1; (-) strand; PAM type: YTN; PAM sequence: CTT
gagctcaagtgatctgccca

SEQ ID NO: 186900 - DNA, 20 bp, Artificial Sequence
  Description of Artificial Sequence: Synthetic oligonucleotide
  Target: ATXN1; (-) strand; PAM type: YTN; PAM sequence: CTC
ttgagctcaagtgatctgcc

SEQ ID NO: 186901 - DNA, 20 bp, Artificial Sequence
  Description of Artificial Sequence: Synthetic oligonucleotide
  Target: ATXN1; (-) strand; PAM type: YTN; PAM sequence: CTC
aaactcttgagctcaagtga

SEQ ID NO: 186902 - DNA, 20 bp, Artificial Sequence
  Description of Artificial Sequence: Synthetic oligonucleotide
  Target: ATXN1; (-) strand; PAM type: YTN; PAM sequence: CTG
atctcaaactcttgagctca

SEQ ID NO: 186903 - DNA, 20 bp, Artificial Sequence
  Description of Artificial Sequence: Synthetic oligonucleotide
  Target: ATXN1; (-) strand; PAM type: YTN; PAM sequence: TTG
gccaggctgatctcaaactc

SEQ ID NO: 186904 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctgat

SEQ ID NO: 186905 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctga

SEQ ID NO: 186906 - DNA, 20 bp, Artificial Sequence
  Description of Artificial Sequence: Synthetic oligonucleotide
  Target: ATXN1; (-) strand; PAM type: YTN; PAM sequence: TTG
tagagacaaggtttcaccat

SEQ ID NO: 186907 - DNA, 20 bp, Artificial Sequence
  Description of Artificial Sequence: Synthetic oligonucleotide
  Target: ATXN1; (-) strand; PAM type: YTN; PAM sequence: TTT
gtagagacaaggtttcacca

SEQ ID NO: 186908 - DNA, 20 bp, Artificial Sequence
  Description of Artificial Sequence: Synthetic oligonucleotide
  Target: ATXN1; (-) strand; PAM type: YTN; PAM sequence: TTT
tgtagagacaaggtttcacc

SEQ ID NO: 186909 - DNA, 20 bp, Artificial Sequence
  Description of Artificial Sequence: Synthetic oligonucleotide
  Target: ATXN1; (-) strand; PAM type: YTN; PAM sequence: TTT
ttgtagagacaaggtttcac

SEQ ID NO: 186910 - DNA, 20 bp, Artificial Sequence
  Description of Artificial Sequence: Synthetic oligonucleotide
  Target: ATXN1; (-) strand; PAM type: YTN; PAM sequence: TTT
tttgtagagacaaggtttca

SEQ ID NO: 186911 - DNA, 20 bp, Artificial Sequence
  Description of Artificial Sequence: Synthetic oligonucleotide
  Target: ATXN1; (-) strand; PAM type: YTN; PAM sequence: TTG
tattttttgtagagacaagg

SEQ ID NO: 186912 - DNA, 20 bp, Artificial Sequence
  Description of Artificial Sequence: Synthetic oligonucleotide
  Target: ATXN1; (-) strand; PAM type: YTN; PAM sequence: TTT
gtattttttgtagagacaag

SEQ ID NO: 186913 - DNA, 20 bp, Artificial Sequence
  Description of Artificial Sequence: Synthetic oligonucleotide
  Target: ATXN1; (-) strand; PAM type: YTN; PAM sequence: TTT
tgtattttttgtagagacaa

SEQ ID NO: 186914 - DNA, 20 bp, Artificial Sequence
  Description of Artificial Sequence: Synthetic oligonucleotide
  Target: ATXN1; (-) strand; PAM type: YTN; PAM sequence: TTT
ttgtattttttgtagagaca

SEQ ID NO: 186915 - DNA, 20 bp, Artificial Sequence
  Description of Artificial Sequence: Synthetic oligonucleotide
  Target: ATXN1; (-) strand; PAM type: YTN; PAM sequence: CTA
atttttgtattttttgtaga

SEQ ID NO: 186916 - DNA, 20 bp, Artificial Sequence
  Description of Artificial Sequence: Synthetic oligonucleotide
  Target: ATXN1; (-) strand; PAM type: YTN; PAM sequence: CTC
acaatgcccggctaattttt

SEQ ID NO: 186917 - DNA, 20 bp, Artificial Sequence
  Description of Artificial Sequence: Synthetic oligonucleotide
  Target: ATXN1; (-) strand; PAM type: YTN; PAM sequence: TTA
caggtgtgcctcacaatgcc

SEQ ID NO: 186918 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgcctcac

SEQ ID NO: 186919 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 186920 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 186921 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 186922 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 186923 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 186924 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 186925 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattctcctgc

SEQ ID NO: 186926 - DNA, 20 bp, Artificial Sequence
  Description of Artificial Sequence: Synthetic oligonucleotide
  Target: ATXN1; (-) strand; PAM type: YTN; PAM sequence: TTC
tgggttcaagcgattctcct

SEQ ID NO: 186927 - DNA, 20 bp, Artificial Sequence
  Description of Artificial Sequence: Synthetic oligonucleotide
  Target: ATXN1; (-) strand; PAM type: YTN; PAM sequence: CTT
ctgggttcaagcgattctcc

SEQ ID NO: 186928 - DNA, 20 bp, Artificial Sequence
  Description of Artificial Sequence: Synthetic oligonucleotide
  Target: ATXN1; (-) strand; PAM type: YTN; PAM sequence: CTC
caccttctgggttcaagcga

SEQ ID NO: 186929 - DNA, 20 bp, Artificial Sequence
  Description of Artificial Sequence: Synthetic oligonucleotide
  Target: ATXN1; (-) strand; PAM type: YTN; PAM sequence: CTG
caacctccaccttctgggtt

SEQ ID NO: 186930 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccaccttctg

SEQ ID NO: 186931 - DNA, 20 bp, Artificial Sequence
  Description of Artificial Sequence: Synthetic oligonucleotide
  Target: ATXN1; (-) strand; PAM type: YTN; PAM sequence: TTA
actcactgcaacctccacct

SEQ ID NO: 186932 - DNA, 20 bp, Artificial Sequence
  Description of Artificial Sequence: Synthetic oligonucleotide
  Target: ATXN1; (-) strand; PAM type: YTN; PAM sequence: CTT
aactcactgcaacctccacc

SEQ ID NO: 186933 - DNA, 20 bp, Artificial Sequence
  Description of Artificial Sequence: Synthetic oligonucleotide
  Target: ATXN1; (-) strand; PAM type: YTN; PAM sequence: CTG
gagggcagtggcacgatctt

SEQ ID NO: 186934 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagggcagtgg

SEQ ID NO: 186935 - DNA, 20 bp, Artificial Sequence
  Description of Artificial Sequence: Synthetic oligonucleotide
  Target: ATXN1; (-) strand; PAM type: YTN; PAM sequence: CTG
tgttgcccaggctggagggc

SEQ ID NO: 186936 - DNA, 20 bp, Artificial Sequence
  Description of Artificial Sequence: Synthetic oligonucleotide
  Target: ATXN1; (-) strand; PAM type: YTN; PAM sequence: TTG
ctgtgttgcccaggctggag

SEQ ID NO: 186937 - DNA, 20 bp, Artificial Sequence
  Description of Artificial Sequence: Synthetic oligonucleotide
  Target: ATXN1; (-) strand; PAM type: YTN; PAM sequence: CTT
gctgtgttgcccaggctgga

SEQ ID NO: 186938 - DNA, 20 bp, Artificial Sequence
  Description of Artificial Sequence: Synthetic oligonucleotide
  Target: ATXN1; (-) strand; PAM type: YTN; PAM sequence: CTC
ttgctgtgttgcccaggctg

SEQ ID NO: 186939 - DNA, 20 bp, Artificial Sequence
  Description of Artificial Sequence: Synthetic oligonucleotide
  Target: ATXN1; (-) strand; PAM type: YTN; PAM sequence: TTG
cagatgaagtctcttgctgt

SEQ ID NO: 186940 - DNA, 20 bp, Artificial Sequence
  Description of Artificial Sequence: Synthetic oligonucleotide
  Target: ATXN1; (-) strand; PAM type: YTN; PAM sequence: TTT
gcagatgaagtctcttgctg

SEQ ID NO: 186941 - DNA, 20 bp, Artificial Sequence
  Description of Artificial Sequence: Synthetic oligonucleotide
  Target: ATXN1; (-) strand; PAM type: YTN; PAM sequence: TTT
tgcagatgaagtctcttgct

SEQ ID NO: 186942 - DNA, 20 bp, Artificial Sequence
  Description of Artificial Sequence: Synthetic oligonucleotide
  Target: ATXN1; (-) strand; PAM type: YTN; PAM sequence: TTT
ttgcagatgaagtctcttgc

SEQ ID NO: 186943 - DNA, 20 bp, Artificial Sequence
  Description of Artificial Sequence: Synthetic oligonucleotide
  Target: ATXN1; (-) strand; PAM type: YTN; PAM sequence: TTT
tttgcagatgaagtctcttg

SEQ ID NO: 186944 - DNA, 20 bp, Artificial Sequence
  Description of Artificial Sequence: Synthetic oligonucleotide
  Target: ATXN1; (-) strand; PAM type: YTN; PAM sequence: TTT
ttttgcagatgaagtctctt

SEQ ID NO: 186945 - DNA, 20 bp, Artificial Sequence
  Description of Artificial Sequence: Synthetic oligonucleotide
  Target: ATXN1; (-) strand; PAM type: YTN; PAM sequence: TTT
tttttgcagatgaagtctct

SEQ ID NO: 186946 - DNA, 20 bp, Artificial Sequence
  Description of Artificial Sequence: Synthetic oligonucleotide
  Target: ATXN1; (-) strand; PAM type: YTN; PAM sequence: TTT
ttttttgcagatgaagtctc

SEQ ID NO: 186947 - DNA, 20 bp, Artificial Sequence
  Description of Artificial Sequence: Synthetic oligonucleotide
  Target: ATXN1; (-) strand; PAM type: YTN; PAM sequence: TTT
tttttttgcagatgaagtct

SEQ ID NO: 186948 - DNA, 20 bp, Artificial Sequence
  Description of Artificial Sequence: Synthetic oligonucleotide
  Target: ATXN1; (-) strand; PAM type: YTN; PAM sequence: TTT
ttttttttgcagatgaagtc

SEQ ID NO: 186949 - DNA, 20 bp, Artificial Sequence
  Description of Artificial Sequence: Synthetic oligonucleotide
  Target: ATXN1; (-) strand; PAM type: YTN; PAM sequence: TTT
tttttttttgcagatgaagt

SEQ ID NO: 186950 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgcagatgaag

SEQ ID NO: 186951 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgcagatgaa

SEQ ID NO: 186952 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgcagatga

SEQ ID NO: 186953 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgcagatg

SEQ ID NO: 186954 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgcagat

SEQ ID NO: 186955 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgcaga

SEQ ID NO: 186956 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgcag

SEQ ID NO: 186957 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgca

SEQ ID NO: 186958 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttgc

SEQ ID NO: 186959 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 186960 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 186961 - DNA, 20 bp, Artificial Sequence
  Description of Artificial Sequence: Synthetic oligonucleotide
  Target: ATXN1; (-) strand; PAM type: YTN; PAM sequence: TTA
gatatttttttttttttttt

SEQ ID NO: 186962 - DNA, 20 bp, Artificial Sequence
  Description of Artificial Sequence: Synthetic oligonucleotide
  Target: ATXN1; (-) strand; PAM type: YTN; PAM sequence: TTT
agatattttttttttttttt

SEQ ID NO: 186963 - DNA, 20 bp, Artificial Sequence
  Description of Artificial Sequence: Synthetic oligonucleotide
  Target: ATXN1; (-) strand; PAM type: YTN; PAM sequence: TTT
tagatatttttttttttttt

SEQ ID NO: 186964 - DNA, 20 bp, Artificial Sequence
  Description of Artificial Sequence: Synthetic oligonucleotide
  Target: ATXN1; (-) strand; PAM type: YTN; PAM sequence: TTC
aggatcattttagatatttt

SEQ ID NO: 186965 - DNA, 20 bp, Artificial Sequence
  Description of Artificial Sequence: Synthetic oligonucleotide
  Target: ATXN1; (-) strand; PAM type: YTN; PAM sequence: CTT
caggatcattttagatattt

SEQ ID NO: 186966 - DNA, 20 bp, Artificial Sequence
  Description of Artificial Sequence: Synthetic oligonucleotide
  Target: ATXN1; (-) strand; PAM type: YTN; PAM sequence: TTC
ttcaggatcattttagatat

SEQ ID NO: 186967 - DNA, 20 bp, Artificial Sequence
  Description of Artificial Sequence: Synthetic oligonucleotide
  Target: ATXN1; (-) strand; PAM type: YTN; PAM sequence: TTT
cttcaggatcattttagata

SEQ ID NO: 186968 - DNA, 20 bp, Artificial Sequence
  Description of Artificial Sequence: Synthetic oligonucleotide
  Target: ATXN1; (-) strand; PAM type: YTN; PAM sequence: TTT
tcttcaggatcattttagat

SEQ ID NO: 186969 - DNA, 20 bp, Artificial Sequence
  Description of Artificial Sequence: Synthetic oligonucleotide
  Target: ATXN1; (-) strand; PAM type: YTN; PAM sequence: TTG
tagcacatggccaccaggcc

SEQ ID NO: 186970 - DNA, 20 bp, Artificial Sequence
  Description of Artificial Sequence: Synthetic oligonucleotide
  Target: ATXN1; (-) strand; PAM type: YTN; PAM sequence: TTT
gtagcacatggccaccaggc

SEQ ID NO: 186971 - DNA, 20 bp, Artificial Sequence
  Description of Artificial Sequence: Synthetic oligonucleotide
  Target: ATXN1; (-) strand; PAM type: YTN; PAM sequence: CTG
acaaaaacatagcatgagga

SEQ ID NO: 186972 - DNA, 20 bp, Artificial Sequence
  Description of Artificial Sequence: Synthetic oligonucleotide
  Target: ATXN1; (-) strand; PAM type: YTN; PAM sequence: TTG
aacactgacaaaaacatagc

SEQ ID NO: 186973 - DNA, 20 bp, Artificial Sequence
  Description of Artificial Sequence: Synthetic oligonucleotide
  Target: ATXN1; (-) strand; PAM type: YTN; PAM sequence: TTT
gaacactgacaaaaacatag

SEQ ID NO: 186974 - DNA, 20 bp, Artificial Sequence
  Description of Artificial Sequence: Synthetic oligonucleotide
  Target: ATXN1; (-) strand; PAM type: YTN; PAM sequence: TTG
gtttgaacactgacaaaaac

SEQ ID NO: 186975 - DNA, 20 bp, Artificial Sequence
  Description of Artificial Sequence: Synthetic oligonucleotide
  Target: ATXN1; (-) strand; PAM type: YTN; PAM sequence: TTT
ggtttgaacactgacaaaaa

SEQ ID NO: 186976 - DNA, 20 bp, Artificial Sequence
  Description of Artificial Sequence: Synthetic oligonucleotide
  Target: ATXN1; (-) strand; PAM type: YTN; PAM sequence: TTG
tttggtttgaacactgacaa

SEQ ID NO: 186977 - DNA, 20 bp, Artificial Sequence
  Description of Artificial Sequence: Synthetic oligonucleotide
  Target: ATXN1; (-) strand; PAM type: YTN; PAM sequence: TTC
catcagaaattgtttggttt

SEQ ID NO: 186978 - DNA, 20 bp, Artificial Sequence
  Description of Artificial Sequence: Synthetic oligonucleotide
  Target: ATXN1; (-) strand; PAM type: YTN; PAM sequence: CTT
ccatcagaaattgtttggtt

SEQ ID NO: 186979 - DNA, 20 bp, Artificial Sequence
  Description of Artificial Sequence: Synthetic oligonucleotide
  Target: ATXN1; (-) strand; PAM type: YTN; PAM sequence: TTC
cttccatcagaaattgtttg

SEQ ID NO: 186980 - DNA, 20 bp, Artificial Sequence
  Description of Artificial Sequence: Synthetic oligonucleotide
  Target: ATXN1; (-) strand; PAM type: YTN; PAM sequence: TTT
ccttccatcagaaattgttt

SEQ ID NO: 186981 - DNA, 20 bp, Artificial Sequence
  Description of Artificial Sequence: Synthetic oligonucleotide
  Target: ATXN1; (-) strand; PAM type: YTN; PAM sequence: CTT
tccttccatcagaaattgtt

SEQ ID NO: 186982 - DNA, 20 bp, Artificial Sequence
  Description of Artificial Sequence: Synthetic oligonucleotide
  Target: ATXN1; (-) strand; PAM type: YTN; PAM sequence: CTC
agagccagagctttccttcc

SEQ ID NO: 186983 - DNA, 20 bp, Artificial Sequence
  Description of Artificial Sequence: Synthetic oligonucleotide
  Target: ATXN1; (-) strand; PAM type: YTN; PAM sequence: CTG
ggcatgtgagagctcagagc

SEQ ID NO: 186984 - DNA, 20 bp, Artificial Sequence
  Description of Artificial Sequence: Synthetic oligonucleotide
  Target: ATXN1; (-) strand; PAM type: YTN; PAM sequence: CTG
tgtctgggcatgtgagagct

SEQ ID NO: 186985 - DNA, 20 bp, Artificial Sequence
  Description of Artificial Sequence: Synthetic oligonucleotide
  Target: ATXN1; (-) strand; PAM type: YTN; PAM sequence: TTC
tgtgtctgggcatgtgagag

SEQ ID NO: 186986 - DNA, 20 bp, Artificial Sequence
  Description of Artificial Sequence: Synthetic oligonucleotide
  Target: ATXN1; (-) strand; PAM type: YTN; PAM sequence: CTT
ctgtgtctgggcatgtgaga

SEQ ID NO: 186987 - DNA, 20 bp, Artificial Sequence
  Description of Artificial Sequence: Synthetic oligonucleotide
  Target: ATXN1; (-) strand; PAM type: YTN; PAM sequence: CTA
cttctgtgtctgggcatgtg

SEQ ID NO: 186988 - DNA, 20 bp, Artificial Sequence
  Description of Artificial Sequence: Synthetic oligonucleotide
  Target: ATXN1; (-) strand; PAM type: YTN; PAM sequence: TTA
tgtactacttctgtgtctgg

SEQ ID NO: 186989 - DNA, 20 bp, Artificial Sequence
  Description of Artificial Sequence: Synthetic oligonucleotide
  Target: ATXN1; (-) strand; PAM type: YTN; PAM sequence: TTT
atgtactacttctgtgtctg

SEQ ID NO: 186990 - DNA, 20 bp, Artificial Sequence
  Description of Artificial Sequence: Synthetic oligonucleotide
  Target: ATXN1; (-) strand; PAM type: YTN; PAM sequence: TTT
tatgtactacttctgtgtct

SEQ ID NO: 186991 - DNA, 20 bp, Artificial Sequence
  Description of Artificial Sequence: Synthetic oligonucleotide
  Target: ATXN1; (-) strand; PAM type: YTN; PAM sequence: CTA
ggaatagtattttatgtact

SEQ ID NO: 186992 - DNA, 20 bp, Artificial Sequence
  Description of Artificial Sequence: Synthetic oligonucleotide
  Target: ATXN1; (-) strand; PAM type: YTN; PAM sequence: TTG
agaagagactaggaatagta

SEQ ID NO: 186993 - DNA, 20 bp, Artificial Sequence
  Description of Artificial Sequence: Synthetic oligonucleotide
  Target: ATXN1; (-) strand; PAM type: YTN; PAM sequence: TTT
gagaagagactaggaatagt

SEQ ID NO: 186994 - DNA, 20 bp, Artificial Sequence
  Description of Artificial Sequence: Synthetic oligonucleotide
  Target: ATXN1; (-) strand; PAM type: YTN; PAM sequence: CTT
tgagaagagactaggaatag

SEQ ID NO: 186995 - DNA, 20 bp, Artificial Sequence
  Description of Artificial Sequence: Synthetic oligonucleotide
  Target: ATXN1; (-) strand; PAM type: YTN; PAM sequence: TTA
gagaagacaaaggatgcttt

SEQ ID NO: 186996 - DNA, 20 bp, Artificial Sequence
  Description of Artificial Sequence: Synthetic oligonucleotide
  Target: ATXN1; (-) strand; PAM type: YTN; PAM sequence: TTT
agagaagacaaaggatgctt

SEQ ID NO: 186997 - DNA, 20 bp, Artificial Sequence
  Description of Artificial Sequence: Synthetic oligonucleotide
  Target: ATXN1; (-) strand; PAM type: YTN; PAM sequence: TTC
aacccaatatatatgtgtat

SEQ ID NO: 186998 - DNA, 20 bp, Artificial Sequence
  Description of Artificial Sequence: Synthetic oligonucleotide
  Target: ATXN1; (-) strand; PAM type: YTN; PAM sequence: TTT
caacccaatatatatgtgta

SEQ ID NO: 186999 - DNA, 20 bp, Artificial Sequence
  Description of Artificial Sequence: Synthetic oligonucleotide
  Target: ATXN1; (-) strand; PAM type: YTN; PAM sequence: TTC
aagcagaggtggaatttcaa

SEQ ID NO: 187000 - DNA, 20 bp, Artificial Sequence
  Description of Artificial Sequence: Synthetic oligonucleotide
  Target: ATXN1; (-) strand; PAM type: YTN; PAM sequence: CTT
caagcagaggtggaatttca

SEQ ID NO: 187001 - DNA, 20 bp, Artificial Sequence
  Description of Artificial Sequence: Synthetic oligonucleotide
  Target: ATXN1; (-) strand; PAM type: YTN; PAM sequence: TTG
agccttcaagcagaggtgga

SEQ ID NO: 187002 - DNA, 20 bp, Artificial Sequence
  Description of Artificial Sequence: Synthetic oligonucleotide
  Target: ATXN1; (-) strand; PAM type: YTN; PAM sequence: CTA
aattgagccttcaagcagag

SEQ ID NO: 187003 - DNA, 20 bp, Artificial Sequence
  Description of Artificial Sequence: Synthetic oligonucleotide
  Target: ATXN1; (-) strand; PAM type: YTN; PAM sequence: TTC
agggaagacatctaaattga

SEQ ID NO: 187004 - DNA, 20 bp, Artificial Sequence
  Description of Artificial Sequence: Synthetic oligonucleotide
  Target: ATXN1; (-) strand; PAM type: YTN; PAM sequence: TTT
cagggaagacatctaaattg

SEQ ID NO: 187005 - DNA, 20 bp, Artificial Sequence
  Description of Artificial Sequence: Synthetic oligonucleotide
  Target: ATXN1; (-) strand; PAM type: YTN; PAM sequence: CTG
gaatttcagggaagacatct

SEQ ID NO: 187006 - DNA, 20 bp, Artificial Sequence
  Description of Artificial Sequence: Synthetic oligonucleotide
  Target: ATXN1; (-) strand; PAM type: YTN; PAM sequence: TTG
tcagcgctggaatttcaggg

SEQ ID NO: 187007 - DNA, 20 bp, Artificial Sequence
  Description of Artificial Sequence: Synthetic oligonucleotide
  Target: ATXN1; (-) strand; PAM type: YTN; PAM sequence: TTG
gtggcggagtcaggtgtacc

SEQ ID NO: 187008 - DNA, 20 bp, Artificial Sequence
  Description of Artificial Sequence: Synthetic oligonucleotide
  Target: ATXN1; (-) strand; PAM type: YTN; PAM sequence: CTT
ggtggcggagtcaggtgtac

SEQ ID NO: 187009 - DNA, 20 bp, Artificial Sequence
  Description of Artificial Sequence: Synthetic oligonucleotide
  Target: ATXN1; (-) strand; PAM type: YTN; PAM sequence: CTA
tgggaaggatgtacttggtg

SEQ ID NO: 187010 - DNA, 20 bp, Artificial Sequence
  Description of Artificial Sequence: Synthetic oligonucleotide
  Target: ATXN1; (-) strand; PAM type: YTN; PAM sequence: CTA
ggaaggtgctatgggaagga

SEQ ID NO: 187011 - DNA, 20 bp, Artificial Sequence
  Description of Artificial Sequence: Synthetic oligonucleotide
  Target: ATXN1; (-) strand; PAM type: YTN; PAM sequence: CTC
taggaaggtgctatgggaag

SEQ ID NO: 187012 - DNA, 20 bp, Artificial Sequence
  Description of Artificial Sequence: Synthetic oligonucleotide
  Target: ATXN1; (-) strand; PAM type: YTN; PAM sequence: TTG
agactctaggaaggtgctat

SEQ ID NO: 187013 - DNA, 20 bp, Artificial Sequence
  Description of Artificial Sequence: Synthetic oligonucleotide
  Target: ATXN1; (-) strand; PAM type: YTN; PAM sequence: TTT
gagactctaggaaggtgcta

SEQ ID NO: 187014 - DNA, 20 bp, Artificial Sequence
  Description of Artificial Sequence: Synthetic oligonucleotide
  Target: ATXN1; (-) strand; PAM type: YTN; PAM sequence: CTT
tgagactctaggaaggtgct

SEQ ID NO: 187015 - DNA, 20 bp, Artificial Sequence
  Description of Artificial Sequence: Synthetic oligonucleotide
  Target: ATXN1; (-) strand; PAM type: YTN; PAM sequence: CTG
ccctttgagactctaggaag

SEQ ID NO: 187016 - DNA, 20 bp, Artificial Sequence
  Description of Artificial Sequence: Synthetic oligonucleotide
  Target: ATXN1; (-) strand; PAM type: YTN; PAM sequence: TTA
ctgccctttgagactctagg

SEQ ID NO: 187017 - DNA, 20 bp, Artificial Sequence
  Description of Artificial Sequence: Synthetic oligonucleotide
  Target: ATXN1; (-) strand; PAM type: YTN; PAM sequence: CTT
actgccctttgagactctag

SEQ ID NO: 187018 - DNA, 20 bp, Artificial Sequence
  Description of Artificial Sequence: Synthetic oligonucleotide
  Target: ATXN1; (-) strand; PAM type: YTN; PAM sequence: CTG
tacttactgccctttgagac

SEQ ID NO: 187019 - DNA, 20 bp, Artificial Sequence
  Description of Artificial Sequence: Synthetic oligonucleotide
  Target: ATXN1; (-) strand; PAM type: YTN; PAM sequence: CTG
agtaatctgtacttactgcc

SEQ ID NO: 187020 - DNA, 20 bp, Artificial Sequence
  Description of Artificial Sequence: Synthetic oligonucleotide
  Target: ATXN1; (-) strand; PAM type: YTN; PAM sequence: CTA
tcagggatccagggctgagt

SEQ ID NO: 187021 - DNA, 20 bp, Artificial Sequence
  Description of Artificial Sequence: Synthetic oligonucleotide
  Target: ATXN1; (-) strand; PAM type: YTN; PAM sequence: TTG
agtctatcagggatccaggg

SEQ ID NO: 187022 - DNA, 20 bp, Artificial Sequence
  Description of Artificial Sequence: Synthetic oligonucleotide
  Target: ATXN1; (-) strand; PAM type: YTN; PAM sequence: CTT
gagtctatcagggatccagg

SEQ ID NO: 187023 - DNA, 20 bp, Artificial Sequence
  Description of Artificial Sequence: Synthetic oligonucleotide
  Target: ATXN1; (-) strand; PAM type: YTN; PAM sequence: TTC
ttgagtctatcagggatcca

SEQ ID NO: 187024 - DNA, 20 bp, Artificial Sequence
  Description of Artificial Sequence: Synthetic oligonucleotide
  Target: ATXN1; (-) strand; PAM type: YTN; PAM sequence: TTG
tgtgccaggatgttcttgag

SEQ ID NO: 187025 - DNA, 20 bp, Artificial Sequence
  Description of Artificial Sequence: Synthetic oligonucleotide
  Target: ATXN1; (-) strand; PAM type: YTN; PAM sequence: TTA
aaagagtgttgtgtgccagg

SEQ ID NO: 187026 - DNA, 20 bp, Artificial Sequence
  Description of Artificial Sequence: Synthetic oligonucleotide
  Target: ATXN1; (-) strand; PAM type: YTN; PAM sequence: TTA
ttaaaagagtgttgtgtgcc

SEQ ID NO: 187027 - DNA, 20 bp, Artificial Sequence
  Description of Artificial Sequence: Synthetic oligonucleotide
  Target: ATXN1; (-) strand; PAM type: YTN; PAM sequence: TTT
attaaaagagtgttgtgtgc

SEQ ID NO: 187028 - DNA, 20 bp, Artificial Sequence
  Description of Artificial Sequence: Synthetic oligonucleotide
  Target: ATXN1; (-) strand; PAM type: YTN; PAM sequence: TTA
catgatatttattaaaagag

SEQ ID NO: 187029 - DNA, 20 bp, Artificial Sequence
  Description of Artificial Sequence: Synthetic oligonucleotide
  Target: ATXN1; (-) strand; PAM type: YTN; PAM sequence: CTC
aattacatgatatttattaa

SEQ ID NO: 187030 - DNA, 20 bp, Artificial Sequence
  Description of Artificial Sequence: Synthetic oligonucleotide
  Target: ATXN1; (-) strand; PAM type: YTN; PAM sequence: TTC
actcaattacatgatattta

SEQ ID NO: 187031 - DNA, 20 bp, Artificial Sequence
  Description of Artificial Sequence: Synthetic oligonucleotide
  Target: ATXN1; (-) strand; PAM type: YTN; PAM sequence: TTA
gagttcactcaattacatga

SEQ ID NO: 187032 - DNA, 20 bp, Artificial Sequence
  Description of Artificial Sequence: Synthetic oligonucleotide
  Target: ATXN1; (-) strand; PAM type: YTN; PAM sequence: TTT
agagttcactcaattacatg

SEQ ID NO: 187033 - DNA, 20 bp, Artificial Sequence
  Description of Artificial Sequence: Synthetic oligonucleotide
  Target: ATXN1; (-) strand; PAM type: YTN; PAM sequence: TTA
agtttagagttcactcaatt

SEQ ID NO: 187034 - DNA, 20 bp, Artificial Sequence
  Description of Artificial Sequence: Synthetic oligonucleotide
  Target: ATXN1; (-) strand; PAM type: YTN; PAM sequence: TTT
aagtttagagttcactcaat

SEQ ID NO: 187035 - DNA, 20 bp, Artificial Sequence
  Description of Artificial Sequence: Synthetic oligonucleotide
  Target: ATXN1; (-) strand; PAM type: YTN; PAM sequence: CTT
taagtttagagttcactcaa

SEQ ID NO: 187036 - DNA, 20 bp, Artificial Sequence
  Description of Artificial Sequence: Synthetic oligonucleotide
  Target: ATXN1; (-) strand; PAM type: YTN; PAM sequence: CTC
tttaagtttagagttcactc

SEQ ID NO: 187037 - DNA, 20 bp, Artificial Sequence
  Description of Artificial Sequence: Synthetic oligonucleotide
  Target: ATXN1; (-) strand; PAM type: YTN; PAM sequence: TTG
tgtcctctttaagtttagag

SEQ ID NO: 187038 - DNA, 20 bp, Artificial Sequence
  Description of Artificial Sequence: Synthetic oligonucleotide
  Target: ATXN1; (-) strand; PAM type: YTN; PAM sequence: TTT
gtgtcctctttaagtttaga

SEQ ID NO: 187039 - DNA, 20 bp, Artificial Sequence
  Description of Artificial Sequence: Synthetic oligonucleotide
  Target: ATXN1; (-) strand; PAM type: YTN; PAM sequence: TTT
tgtgtcctctttaagtttag

SEQ ID NO: 187040 - DNA, 20 bp, Artificial Sequence
  Description of Artificial Sequence: Synthetic oligonucleotide
  Target: ATXN1; (-) strand; PAM type: YTN; PAM sequence: CTT
ttgtgtcctctttaagttta

SEQ ID NO: 187041 - DNA, 20 bp, Artificial Sequence
  Description of Artificial Sequence: Synthetic oligonucleotide
  Target: ATXN1; (-) strand; PAM type: YTN; PAM sequence: CTG
aatagtgccaaggtaaaatg

SEQ ID NO: 187042 - DNA, 20 bp, Artificial Sequence
  Description of Artificial Sequence: Synthetic oligonucleotide
  Target: ATXN1; (-) strand; PAM type: YTN; PAM sequence: TTG
taactgaatagtgccaaggt

SEQ ID NO: 187043 - DNA, 20 bp, Artificial Sequence
  Description of Artificial Sequence: Synthetic oligonucleotide
  Target: ATXN1; (-) strand; PAM type: YTN; PAM sequence: TTT
gtaactgaatagtgccaagg

SEQ ID NO: 187044 - DNA, 20 bp, Artificial Sequence
  Description of Artificial Sequence: Synthetic oligonucleotide
  Target: ATXN1; (-) strand; PAM type: YTN; PAM sequence: CTT
tgtaactgaatagtgccaag

SEQ ID NO: 187045 - DNA, 20 bp, Artificial Sequence
  Description of Artificial Sequence: Synthetic oligonucleotide
  Target: ATXN1; (-) strand; PAM type: YTN; PAM sequence: CTG
ctttgtaactgaatagtgcc

SEQ ID NO: 187046 - DNA, 20 bp, Artificial Sequence
  Description of Artificial Sequence: Synthetic oligonucleotide
  Target: ATXN1; (-) strand; PAM type: YTN; PAM sequence: CTG
gtcaggctgctttgtaactg

SEQ ID NO: 187047 - DNA, 20 bp, Artificial Sequence
  Description of Artificial Sequence: Synthetic oligonucleotide
  Target: ATXN1; (-) strand; PAM type: YTN; PAM sequence: CTA
tggggtgaaacaacatcaac

SEQ ID NO: 187048 - DNA, 20 bp, Artificial Sequence
  Description of Artificial Sequence: Synthetic oligonucleotide
  Target: ATXN1; (-) strand; PAM type: YTN; PAM sequence: TTC
tatggggtgaaacaacatca

SEQ ID NO: 187049 - DNA, 20 bp, Artificial Sequence
  Description of Artificial Sequence: Synthetic oligonucleotide
  Target: ATXN1; (-) strand; PAM type: YTN; PAM sequence: TTG
tgttctatggggtgaaacaa

SEQ ID NO: 187050 - DNA, 20 bp, Artificial Sequence
  Description of Artificial Sequence: Synthetic oligonucleotide
  Target: ATXN1; (-) strand; PAM type: YTN; PAM sequence: TTT
gtgttctatggggtgaaaca

SEQ ID NO: 187051 - DNA, 20 bp, Artificial Sequence
  Description of Artificial Sequence: Synthetic oligonucleotide
  Target: ATXN1; (-) strand; PAM type: YTN; PAM sequence: TTA
caacatttgtgttctatggg

SEQ ID NO: 187052 - DNA, 20 bp, Artificial Sequence
  Description of Artificial Sequence: Synthetic oligonucleotide
  Target: ATXN1; (-) strand; PAM type: YTN; PAM sequence: TTT
acaacatttgtgttctatgg

SEQ ID NO: 187053 - DNA, 20 bp, Artificial Sequence
  Description of Artificial Sequence: Synthetic oligonucleotide
  Target: ATXN1; (-) strand; PAM type: YTN; PAM sequence: TTT
tacaacatttgtgttctatg

SEQ ID NO: 187054 - DNA, 20 bp, Artificial Sequence
  Description of Artificial Sequence: Synthetic oligonucleotide
  Target: ATXN1; (-) strand; PAM type: YTN; PAM sequence: CTT
ttacaacatttgtgttctat

SEQ ID NO: 187055 - DNA, 20 bp, Artificial Sequence
  Description of Artificial Sequence: Synthetic oligonucleotide
  Target: ATXN1; (-) strand; PAM type: YTN; PAM sequence: TTC
atggatcttttacaacattt

SEQ ID NO: 187056 - DNA, 20 bp, Artificial Sequence
  Description of Artificial Sequence: Synthetic oligonucleotide
  Target: ATXN1; (-) strand; PAM type: YTN; PAM sequence: TTG
tggaaggaaaaaagttcatg

SEQ ID NO: 187057 - DNA, 20 bp, Artificial Sequence
  Description of Artificial Sequence: Synthetic oligonucleotide
  Target: ATXN1; (-) strand; PAM type: YTN; PAM sequence: TTG
gagaggaggaggaaaatgca

SEQ ID NO: 187058 - DNA, 20 bp, Artificial Sequence
  Description of Artificial Sequence: Synthetic oligonucleotide
  Target: ATXN1; (-) strand; PAM type: YTN; PAM sequence: CTT
ggagaggaggaggaaaatgc

SEQ ID NO: 187059 - DNA, 20 bp, Artificial Sequence
  Description of Artificial Sequence: Synthetic oligonucleotide
  Target: ATXN1; (-) strand; PAM type: YTN; PAM sequence: CTC
agcatcttggagaggaggag

SEQ ID NO: 187060 - DNA, 20 bp, Artificial Sequence
  Description of Artificial Sequence: Synthetic oligonucleotide
  Target: ATXN1; (-) strand; PAM type: YTN; PAM sequence: CTC
tcagcatcttggagaggagg

SEQ ID NO: 187061 - DNA, 20 bp, Artificial Sequence
  Description of Artificial Sequence: Synthetic oligonucleotide
  Target: ATXN1; (-) strand; PAM type: YTN; PAM sequence: CTC
ctctcagcatcttggagagg

SEQ ID NO: 187062 - DNA, 20 bp, Artificial Sequence
  Description of Artificial Sequence: Synthetic oligonucleotide
  Target: ATXN1; (-) strand; PAM type: YTN; PAM sequence: CTC
ctcctctcagcatcttggag

SEQ ID NO: 187063 - DNA, 20 bp, Artificial Sequence
  Description of Artificial Sequence: Synthetic oligonucleotide
  Target: ATXN1; (-) strand; PAM type: YTN; PAM sequence: CTC
agctcctcctctcagcatct

SEQ ID NO: 187064 - DNA, 20 bp, Artificial Sequence
  Description of Artificial Sequence: Synthetic oligonucleotide
  Target: ATXN1; (-) strand; PAM type: YTN; PAM sequence: CTC
aagtactcagctcctcctct

SEQ ID NO: 187065 - DNA, 20 bp, Artificial Sequence
  Description of Artificial Sequence: Synthetic oligonucleotide
  Target: ATXN1; (-) strand; PAM type: YTN; PAM sequence: TTC
ctcaagtactcagctcctcc

SEQ ID NO: 187066 - DNA, 20 bp, Artificial Sequence
  Description of Artificial Sequence: Synthetic oligonucleotide
  Target: ATXN1; (-) strand; PAM type: YTN; PAM sequence: CTT
cctcaagtactcagctcctc

SEQ ID NO: 187067 - DNA, 20 bp, Artificial Sequence
  Description of Artificial Sequence: Synthetic oligonucleotide
  Target: ATXN1; (-) strand; PAM type: YTN; PAM sequence: TTC
ttcctcaagtactcagctcc

SEQ ID NO: 187068 - DNA, 20 bp, Artificial Sequence
  Description of Artificial Sequence: Synthetic oligonucleotide
  Target: ATXN1; (-) strand; PAM type: YTN; PAM sequence: CTT
cttcctcaagtactcagctc

SEQ ID NO: 187069 - DNA, 20 bp, Artificial Sequence
  Description of Artificial Sequence: Synthetic oligonucleotide
  Target: ATXN1; (-) strand; PAM type: YTN; PAM sequence: CTC
agcaccttcttcctcaagta

SEQ ID NO: 187070 - DNA, 20 bp, Artificial Sequence
  Description of Artificial Sequence: Synthetic oligonucleotide
  Target: ATXN1; (-) strand; PAM type: YTN; PAM sequence: TTC
ccctcagcaccttcttcctc

SEQ ID NO: 187071 - DNA, 20 bp, Artificial Sequence
  Description of Artificial Sequence: Synthetic oligonucleotide
  Target: ATXN1; (-) strand; PAM type: YTN; PAM sequence: TTT
cccctcagcaccttcttcct

SEQ ID NO: 187072 - DNA, 20 bp, Artificial Sequence
  Description of Artificial Sequence: Synthetic oligonucleotide
  Target: ATXN1; (-) strand; PAM type: YTN; PAM sequence: CTT
tcccctcagcaccttcttcc

SEQ ID NO: 187073 - DNA, 20 bp, Artificial Sequence
  Description of Artificial Sequence: Synthetic oligonucleotide
  Target: ATXN1; (-) strand; PAM type: YTN; PAM sequence: CTG
acaaagcgtagcccatccca

SEQ ID NO: 187074 - DNA, 20 bp, Artificial Sequence
  Description of Artificial Sequence: Synthetic oligonucleotide
  Target: ATXN1; (-) strand; PAM type: YTN; PAM sequence: CTG
aggcaactgacaaagcgtag

SEQ ID NO: 187075 - DNA, 20 bp, Artificial Sequence
  Description of Artificial Sequence: Synthetic oligonucleotide
  Target: ATXN1; (-) strand; PAM type: YTN; PAM sequence: CTC
ctgaggcaactgacaaagcg

SEQ ID NO: 187076 - DNA, 20 bp, Artificial Sequence
  Description of Artificial Sequence: Synthetic oligonucleotide
  Target: ATXN1; (-) strand; PAM type: YTN; PAM sequence: CTA
cctcctgaggcaactgacaa

SEQ ID NO: 187077 - DNA, 20 bp, Artificial Sequence
  Description of Artificial Sequence: Synthetic oligonucleotide
  Target: ATXN1; (-) strand; PAM type: YTN; PAM sequence: CTA
agaagtggtgtcagagctac

SEQ ID NO: 187078 - DNA, 20 bp, Artificial Sequence
  Description of Artificial Sequence: Synthetic oligonucleotide
  Target: ATXN1; (-) strand; PAM type: YTN; PAM sequence: TTC
taagaagtggtgtcagagct

SEQ ID NO: 187079 - DNA, 20 bp, Artificial Sequence
  Description of Artificial Sequence: Synthetic oligonucleotide
  Target: ATXN1; (-) strand; PAM type: YTN; PAM sequence: CTT
ctaagaagtggtgtcagagc

SEQ ID NO: 187080 - DNA, 20 bp, Artificial Sequence
  Description of Artificial Sequence: Synthetic oligonucleotide
  Target: ATXN1; (-) strand; PAM type: YTN; PAM sequence: CTG
cttctaagaagtggtgtcag

SEQ ID NO: 187081 - DNA, 20 bp, Artificial Sequence
  Description of Artificial Sequence: Synthetic oligonucleotide
  Target: ATXN1; (-) strand; PAM type: YTN; PAM sequence: TTG
caggagtcactgcttctaag

SEQ ID NO: 187082 - DNA, 20 bp, Artificial Sequence
  Description of Artificial Sequence: Synthetic oligonucleotide
  Target: ATXN1; (-) strand; PAM type: YTN; PAM sequence: TTT
gcaggagtcactgcttctaa

SEQ ID NO: 187083 - DNA, 20 bp, Artificial Sequence
  Description of Artificial Sequence: Synthetic oligonucleotide
  Target: ATXN1; (-) strand; PAM type: YTN; PAM sequence: CTT
tgcaggagtcactgcttcta

SEQ ID NO: 187084 - DNA, 20 bp, Artificial Sequence
  Description of Artificial Sequence: Synthetic oligonucleotide
  Target: ATXN1; (-) strand; PAM type: YTN; PAM sequence: TTG
gcagggtctttgcaggagtc

SEQ ID NO: 187085 - DNA, 20 bp, Artificial Sequence
  Description of Artificial Sequence: Synthetic oligonucleotide
  Target: ATXN1; (-) strand; PAM type: YTN; PAM sequence: TTT
ggcagggtctttgcaggagt

SEQ ID NO: 187086 - DNA, 20 bp, Artificial Sequence
  Description of Artificial Sequence: Synthetic oligonucleotide
  Target: ATXN1; (-) strand; PAM type: YTN; PAM sequence: CTT
tggcagggtctttgcaggag

SEQ ID NO: 187087 - DNA, 20 bp, Artificial Sequence
  Description of Artificial Sequence: Synthetic oligonucleotide
  Target: ATXN1; (-) strand; PAM type: YTN; PAM sequence: TTG
ggatgggcacctttggcagg

SEQ ID NO: 187088 - DNA, 20 bp, Artificial Sequence
  Description of Artificial Sequence: Synthetic oligonucleotide
  Target: ATXN1; (-) strand; PAM type: YTN; PAM sequence: TTT
gggatgggcacctttggcag

SEQ ID NO: 187089 - DNA, 20 bp, Artificial Sequence
  Description of Artificial Sequence: Synthetic oligonucleotide
  Target: ATXN1; (-) strand; PAM type: YTN; PAM sequence: TTA
tttgggatgggcacctttgg

SEQ ID NO: 187090 - DNA, 20 bp, Artificial Sequence
  Description of Artificial Sequence: Synthetic oligonucleotide
  Target: ATXN1; (-) strand; PAM type: YTN; PAM sequence: CTG
gtgtgttatttgggatgggc

SEQ ID NO: 187091 - DNA, 20 bp, Artificial Sequence
  Description of Artificial Sequence: Synthetic oligonucleotide
  Target: ATXN1; (-) strand; PAM type: YTN; PAM sequence: TTG
cccctggtgtgttatttggg

SEQ ID NO: 187092 - DNA, 20 bp, Artificial Sequence
  Description of Artificial Sequence: Synthetic oligonucleotide
  Target: ATXN1; (-) strand; PAM type: YTN; PAM sequence: CTG
gccattgcccctggtgtgtt

SEQ ID NO: 187093 - DNA, 20 bp, Artificial Sequence
  Description of Artificial Sequence: Synthetic oligonucleotide
  Target: ATXN1; (-) strand; PAM type: YTN; PAM sequence: TTC
ctggccattgcccctggtgt

SEQ ID NO: 187094 - DNA, 20 bp, Artificial Sequence
  Description of Artificial Sequence: Synthetic oligonucleotide
  Target: ATXN1; (-) strand; PAM type: YTN; PAM sequence: CTA
gttcctggccattgcccctg

SEQ ID NO: 187095 - DNA, 20 bp, Artificial Sequence
  Description of Artificial Sequence: Synthetic oligonucleotide
  Target: ATXN1; (-) strand; PAM type: YTN; PAM sequence: TTC
actagttcctggccattgcc

SEQ ID NO: 187096 - DNA, 20 bp, Artificial Sequence
  Description of Artificial Sequence: Synthetic oligonucleotide
  Target: ATXN1; (-) strand; PAM type: YTN; PAM sequence: CTT
cactagttcctggccattgc

SEQ ID NO: 187097 - DNA, 20 bp, Artificial Sequence
  Description of Artificial Sequence: Synthetic oligonucleotide
  Target: ATXN1; (-) strand; PAM type: YTN; PAM sequence: TTG
acagcttcactagttcctgg

SEQ ID NO: 187098 - DNA, 20 bp, Artificial Sequence
  Description of Artificial Sequence: Synthetic oligonucleotide
  Target: ATXN1; (-) strand; PAM type: YTN; PAM sequence: CTG
attgacagcttcactagttc

SEQ ID NO: 187099 - DNA, 20 bp, Artificial Sequence
  Description of Artificial Sequence: Synthetic oligonucleotide
  Target: ATXN1; (-) strand; PAM type: YTN; PAM sequence: TTC
tgattgacagcttcactagt

SEQ ID NO: 187100 - DNA, 20 bp, Artificial Sequence
  Description of Artificial Sequence: Synthetic oligonucleotide
  Target: ATXN1; (-) strand; PAM type: YTN; PAM sequence: CTT
ctgattgacagcttcactag

SEQ ID NO: 187101 - DNA, 20 bp, Artificial Sequence
  Description of Artificial Sequence: Synthetic oligonucleotide
  Target: ATXN1; (-) strand; PAM type: YTN; PAM sequence: TTG
aatggcttctgattgacagc

SEQ ID NO: 187102 - DNA, 20 bp, Artificial Sequence
  Description of Artificial Sequence: Synthetic oligonucleotide
  Target: ATXN1; (-) strand; PAM type: YTN; PAM sequence: CTT
gaatggcttctgattgacag

SEQ ID NO: 187103 - DNA, 20 bp, Artificial Sequence
  Description of Artificial Sequence: Synthetic oligonucleotide
  Target: ATXN1; (-) strand; PAM type: YTN; PAM sequence: TTC
cttgaatggcttctgattga

SEQ ID NO: 187104 - DNA, 20 bp, Artificial Sequence
  Description of Artificial Sequence: Synthetic oligonucleotide
  Target: ATXN1; (-) strand; PAM type: YTN; PAM sequence: CTT
ccttgaatggcttctgattg

SEQ ID NO: 187105 - DNA, 20 bp, Artificial Sequence
  Description of Artificial Sequence: Synthetic oligonucleotide
  Target: ATXN1; (-) strand; PAM type: YTN; PAM sequence: CTC
agacttccttgaatggcttc

SEQ ID NO: 187106 - DNA, 20 bp, Artificial Sequence
  Description of Artificial Sequence: Synthetic oligonucleotide
  Target: ATXN1; (-) strand; PAM type: YTN; PAM sequence: TTC
ctcagacttccttgaatggc

SEQ ID NO: 187107 - DNA, 20 bp, Artificial Sequence
  Description of Artificial Sequence: Synthetic oligonucleotide
  Target: ATXN1; (-) strand; PAM type: YTN; PAM sequence: CTT
cctcagacttccttgaatgg

SEQ ID NO: 187108 - DNA, 20 bp, Artificial Sequence
  Description of Artificial Sequence: Synthetic oligonucleotide
  Target: ATXN1; (-) strand; PAM type: YTN; PAM sequence: CTC
ttcctcagacttccttgaat

SEQ ID NO: 187109 - DNA, 20 bp, Artificial Sequence
  Description of Artificial Sequence: Synthetic oligonucleotide
  Target: ATXN1; (-) strand; PAM type: YTN; PAM sequence: CTC
tcttcctcagacttccttga

SEQ ID NO: 187110 - DNA, 20 bp, Artificial Sequence
  Description of Artificial Sequence: Synthetic oligonucleotide
  Target: ATXN1; (-) strand; PAM type: YTN; PAM sequence: CTC
tctcttcctcagacttcctt

SEQ ID NO: 187111 - DNA, 20 bp, Artificial Sequence
  Description of Artificial Sequence: Synthetic oligonucleotide
  Target: ATXN1; (-) strand; PAM type: YTN; PAM sequence: TTC
tctctcttcctcagacttcc

SEQ ID NO: 187112 - DNA, 20 bp, Artificial Sequence
  Description of Artificial Sequence: Synthetic oligonucleotide
  Target: ATXN1; (-) strand; PAM type: YTN; PAM sequence: TTT
ctctctcttcctcagacttc

SEQ ID NO: 187113 - DNA, 20 bp, Artificial Sequence
  Description of Artificial Sequence: Synthetic oligonucleotide
  Target: ATXN1; (-) strand; PAM type: YTN; PAM sequence: TTC
acccatttctctctcttcct

SEQ ID NO: 187114 - DNA, 20 bp, Artificial Sequence
  Description of Artificial Sequence: Synthetic oligonucleotide
  Target: ATXN1; (-) strand; PAM type: YTN; PAM sequence: TTT
cacccatttctctctcttcc

SEQ ID NO: 187115 - DNA, 20 bp, Artificial Sequence
  Description of Artificial Sequence: Synthetic oligonucleotide
  Target: ATXN1; (-) strand; PAM type: YTN; PAM sequence: CTT
tcacccatttctctctcttc

SEQ ID NO: 187116 - DNA, 20 bp, Artificial Sequence
  Description of Artificial Sequence: Synthetic oligonucleotide
  Target: ATXN1; (-) strand; PAM type: YTN; PAM sequence: CTC
tttcacccatttctctctct

SEQ ID NO: 187117 - DNA, 20 bp, Artificial Sequence
  Description of Artificial Sequence: Synthetic oligonucleotide
  Target: ATXN1; (-) strand; PAM type: YTN; PAM sequence: TTC
tctttcacccatttctctct

SEQ ID NO: 187118 - DNA, 20 bp, Artificial Sequence
  Description of Artificial Sequence: Synthetic oligonucleotide
  Target: ATXN1; (-) strand; PAM type: YTN; PAM sequence: TTT
ctctttcacccatttctctc

SEQ ID NO: 187119 - DNA, 20 bp, Artificial Sequence
  Description of Artificial Sequence: Synthetic oligonucleotide
  Target: ATXN1; (-) strand; PAM type: YTN; PAM sequence: TTT
tctctttcacccatttctct

SEQ ID NO: 187120 - DNA, 20 bp, Artificial Sequence
  Description of Artificial Sequence: Synthetic oligonucleotide
  Target: ATXN1; (-) strand; PAM type: YTN; PAM sequence: CTA
gagttttctctttcacccat

SEQ ID NO: 187121 - DNA, 20 bp, Artificial Sequence
  Description of Artificial Sequence: Synthetic oligonucleotide
  Target: ATXN1; (-) strand; PAM type: YTN; PAM sequence: TTC
tagagttttctctttcaccc

SEQ ID NO: 187122 - DNA, 20 bp, Artificial Sequence
  Description of Artificial Sequence: Synthetic oligonucleotide
  Target: ATXN1; (-) strand; PAM type: YTN; PAM sequence: CTT
ctagagttttctctttcacc

SEQ ID NO: 187123 - DNA, 20 bp, Artificial Sequence
  Description of Artificial Sequence: Synthetic oligonucleotide
  Target: ATXN1; (-) strand; PAM type: YTN; PAM sequence: TTC
aagtcttctagagttttctc

SEQ ID NO: 187124 - DNA, 20 bp, Artificial Sequence
  Description of Artificial Sequence: Synthetic oligonucleotide
  Target: ATXN1; (-) strand; PAM type: YTN; PAM sequence: CTT
caagtcttctagagttttct

SEQ ID NO: 187125 - DNA, 20 bp, Artificial Sequence
  Description of Artificial Sequence: Synthetic oligonucleotide
  Target: ATXN1; (-) strand; PAM type: YTN; PAM sequence: CTG
gggatagcttcaagtcttct

SEQ ID NO: 187126 - DNA, 20 bp, Artificial Sequence
  Description of Artificial Sequence: Synthetic oligonucleotide
  Target: ATXN1; (-) strand; PAM type: YTN; PAM sequence: TTC
catccaagtgcactggggat

SEQ ID NO: 187127 - DNA, 20 bp, Artificial Sequence
  Description of Artificial Sequence: Synthetic oligonucleotide
  Target: ATXN1; (-) strand; PAM type: YTN; PAM sequence: CTC
attccatccaagtgcactgg

SEQ ID NO: 187128 - DNA, 20 bp, Artificial Sequence
  Description of Artificial Sequence: Synthetic oligonucleotide
  Target: ATXN1; (-) strand; PAM type: YTN; PAM sequence: CTG
agctcattccatccaagtgc

SEQ ID NO: 187129 - DNA, 20 bp, Artificial Sequence
  Description of Artificial Sequence: Synthetic oligonucleotide
  Target: ATXN1; (-) strand; PAM type: YTN; PAM sequence: TTA
tgactgagctcattccatcc

SEQ ID NO: 187130 - DNA, 20 bp, Artificial Sequence
  Description of Artificial Sequence: Synthetic oligonucleotide
  Target: ATXN1; (-) strand; PAM type: YTN; PAM sequence: TTG
taaaggcagagaggttatga

SEQ ID NO: 187131 - DNA, 20 bp, Artificial Sequence
  Description of Artificial Sequence: Synthetic oligonucleotide
  Target: ATXN1; (-) strand; PAM type: YTN; PAM sequence: CTA
cagattgtaaaggcagagag

SEQ ID NO: 187132 - DNA, 20 bp, Artificial Sequence
  Description of Artificial Sequence: Synthetic oligonucleotide
  Target: ATXN1; (-) strand; PAM type: YTN; PAM sequence: TTG
acctacagattgtaaaggca

SEQ ID NO: 187133 - DNA, 20 bp, Artificial Sequence
  Description of Artificial Sequence: Synthetic oligonucleotide
  Target: ATXN1; (-) strand; PAM type: YTN; PAM sequence: CTG
cagattgacctacagattgt

SEQ ID NO: 187134 - DNA, 20 bp, Artificial Sequence
  Description of Artificial Sequence: Synthetic oligonucleotide
  Target: ATXN1; (-) strand; PAM type: YTN; PAM sequence: CTC
ctgcagattgacctacagat

SEQ ID NO: 187135 - DNA, 20 bp, Artificial Sequence
  Description of Artificial Sequence: Synthetic oligonucleotide
  Target: ATXN1; (-) strand; PAM type: YTN; PAM sequence: TTG
taatgctcctgcagattgac

SEQ ID NO: 187136 - DNA, 20 bp, Artificial Sequence
  Description of Artificial Sequence: Synthetic oligonucleotide
  Target: ATXN1; (-) strand; PAM type: YTN; PAM sequence: CTT
gtaatgctcctgcagattga

SEQ ID NO: 187137 - DNA, 20 bp, Artificial Sequence
  Description of Artificial Sequence: Synthetic oligonucleotide
  Target: ATXN1; (-) strand; PAM type: YTN; PAM sequence: TTG
cttgtaatgctcctgcagat

SEQ ID NO: 187138 - DNA, 20 bp, Artificial Sequence
  Description of Artificial Sequence: Synthetic oligonucleotide
  Target: ATXN1; (-) strand; PAM type: YTN; PAM sequence: CTT
gcttgtaatgctcctgcaga

SEQ ID NO: 187139 - DNA, 20 bp, Artificial Sequence
  Description of Artificial Sequence: Synthetic oligonucleotide
  Target: ATXN1; (-) strand; PAM type: YTN; PAM sequence: TTA
aatccttgcttgtaatgctc

SEQ ID NO: 187140 - DNA, 20 bp, Artificial Sequence
  Description of Artificial Sequence: Synthetic oligonucleotide
  Target: ATXN1; (-) strand; PAM type: YTN; PAM sequence: CTT
aaatccttgcttgtaatgct

SEQ ID NO: 187141 - DNA, 20 bp, Artificial Sequence
  Description of Artificial Sequence: Synthetic oligonucleotide
  Target: ATXN1; (-) strand; PAM type: YTN; PAM sequence: TTC
ttaaatccttgcttgtaatg

SEQ ID NO: 187142 - DNA, 20 bp, Artificial Sequence
  Description of Artificial Sequence: Synthetic oligonucleotide
  Target: ATXN1; (-) strand; PAM type: YTN; PAM sequence: TTT
cttaaatccttgcttgtaat

SEQ ID NO: 187143 - DNA, 20 bp, Artificial Sequence
  Description of Artificial Sequence: Synthetic oligonucleotide
  Target: ATXN1; (-) strand; PAM type: YTN; PAM sequence: TTT
tcttaaatccttgcttgtaa

SEQ ID NO: 187144 - DNA, 20 bp, Artificial Sequence
  Description of Artificial Sequence: Synthetic oligonucleotide
  Target: ATXN1; (-) strand; PAM type: YTN; PAM sequence: TTT
ttcttaaatccttgcttgta

SEQ ID NO: 187145 - DNA, 20 bp, Artificial Sequence
  Description of Artificial Sequence: Synthetic oligonucleotide
  Target: ATXN1; (-) strand; PAM type: YTN; PAM sequence: CTT
tttcttaaatccttgcttgt

SEQ ID NO: 187146 - DNA, 20 bp, Artificial Sequence
  Description of Artificial Sequence: Synthetic oligonucleotide
  Target: ATXN1; (-) strand; PAM type: YTN; PAM sequence: CTC
ctttttcttaaatccttgct

SEQ ID NO: 187147 - DNA, 20 bp, Artificial Sequence
  Description of Artificial Sequence: Synthetic oligonucleotide
  Target: ATXN1; (-) strand; PAM type: YTN; PAM sequence: TTG
gacaagtgagggagaacaat

SEQ ID NO: 187148 - DNA, 20 bp, Artificial Sequence
  Description of Artificial Sequence: Synthetic oligonucleotide
  Target: ATXN1; (-) strand; PAM type: YTN; PAM sequence: TTT
ggacaagtgagggagaacaa

SEQ ID NO: 187149 - DNA, 20 bp, Artificial Sequence
  Description of Artificial Sequence: Synthetic oligonucleotide
  Target: ATXN1; (-) strand; PAM type: YTN; PAM sequence: TTT
tggacaagtgagggagaaca

SEQ ID NO: 187150 - DNA, 20 bp, Artificial Sequence
  Description of Artificial Sequence: Synthetic oligonucleotide
  Target: ATXN1; (-) strand; PAM type: YTN; PAM sequence: CTT
ttggacaagtgagggagaac

SEQ ID NO: 187151 - DNA, 20 bp, Artificial Sequence
  Description of Artificial Sequence: Synthetic oligonucleotide
  Target: ATXN1; (-) strand; PAM type: YTN; PAM sequence: TTC
caccacttttggacaagtga

SEQ ID NO: 187152 - DNA, 20 bp, Artificial Sequence
  Description of Artificial Sequence: Synthetic oligonucleotide
  Target: ATXN1; (-) strand; PAM type: YTN; PAM sequence: CTG
aagtagataagagggtcagg

SEQ ID NO: 187153 - DNA, 20 bp, Artificial Sequence
  Description of Artificial Sequence: Synthetic oligonucleotide
  Target: ATXN1; (-) strand; PAM type: YTN; PAM sequence: TTA
caaaaaaaaaatctgaagta

SEQ ID NO: 187154 - DNA, 20 bp, Artificial Sequence
  Description of Artificial Sequence: Synthetic oligonucleotide
  Target: ATXN1; (-) strand; PAM type: YTN; PAM sequence: CTC
cagcgttacaaaaaaaaaat

SEQ ID NO: 187155 - DNA, 20 bp, Artificial Sequence
  Description of Artificial Sequence: Synthetic oligonucleotide
  Target: ATXN1; (-) strand; PAM type: YTN; PAM sequence: TTC
tccagcgttacaaaaaaaaa

SEQ ID NO: 187156 - DNA, 20 bp, Artificial Sequence
  Description of Artificial Sequence: Synthetic oligonucleotide
  Target: ATXN1; (-) strand; PAM type: YTN; PAM sequence: CTG
tgataccaaattctccagcg

SEQ ID NO: 187157 - DNA, 20 bp, Artificial Sequence
  Description of Artificial Sequence: Synthetic oligonucleotide
  Target: ATXN1; (-) strand; PAM type: YTN; PAM sequence: TTG
ccatctgtgataccaaattc

SEQ ID NO: 187158 - DNA, 20 bp, Artificial Sequence
  Description of Artificial Sequence: Synthetic oligonucleotide
  Target: ATXN1; (-) strand; PAM type: YTN; PAM sequence: TTT
gccatctgtgataccaaatt

SEQ ID NO: 187159 - DNA, 20 bp, Artificial Sequence
  Description of Artificial Sequence: Synthetic oligonucleotide
  Target: ATXN1; (-) strand; PAM type: YTN; PAM sequence: TTA
gatttgccatctgtgatacc

SEQ ID NO: 187160 - DNA, 20 bp, Artificial Sequence
  Description of Artificial Sequence: Synthetic oligonucleotide
  Target: ATXN1; (-) strand; PAM type: YTN; PAM sequence: TTT
agatttgccatctgtgatac

SEQ ID NO: 187161 - DNA, 20 bp, Artificial Sequence
  Description of Artificial Sequence: Synthetic oligonucleotide
  Target: ATXN1; (-) strand; PAM type: YTN; PAM sequence: TTT
tagatttgccatctgtgata

SEQ ID NO: 187162 - DNA, 20 bp, Artificial Sequence
  Description of Artificial Sequence: Synthetic oligonucleotide
  Target: ATXN1; (-) strand; PAM type: YTN; PAM sequence: CTT
ttagatttgccatctgtgat

SEQ ID NO: 187163 - DNA, 20 bp, Artificial Sequence
  Description of Artificial Sequence: Synthetic oligonucleotide
  Target: ATXN1; (-) strand; PAM type: YTN; PAM sequence: TTG
taccttttagatttgccatc

SEQ ID NO: 187164 - DNA, 20 bp, Artificial Sequence
  Description of Artificial Sequence: Synthetic oligonucleotide
  Target: ATXN1; (-) strand; PAM type: YTN; PAM sequence: TTT
gtaccttttagatttgccat

SEQ ID NO: 187165 - DNA, 20 bp, Artificial Sequence
  Description of Artificial Sequence: Synthetic oligonucleotide
  Target: ATXN1; (-) strand; PAM type: YTN; PAM sequence: CTG
tcagtttgtaccttttagat

SEQ ID NO: 187166 - DNA, 20 bp, Artificial Sequence
  Description of Artificial Sequence: Synthetic oligonucleotide
  Target: ATXN1; (-) strand; PAM type: YTN; PAM sequence: CTG
tgtctgtcagtttgtacctt

SEQ ID NO: 187167 - DNA, 20 bp, Artificial Sequence
  Description of Artificial Sequence: Synthetic oligonucleotide
  Target: ATXN1; (-) strand; PAM type: YTN; PAM sequence: CTC
tgtgtctgtcagtttgtacc

SEQ ID NO: 187168 - DNA, 20 bp, Artificial Sequence
  Description of Artificial Sequence: Synthetic oligonucleotide
  Target: ATXN1; (-) strand; PAM type: YTN; PAM sequence: TTC
cctctgtgtctgtcagtttg

SEQ ID NO: 187169 - DNA, 20 bp, Artificial Sequence
  Description of Artificial Sequence: Synthetic oligonucleotide
  Target: ATXN1; (-) strand; PAM type: YTN; PAM sequence: TTT
ccctctgtgtctgtcagttt

SEQ ID NO: 187170 - DNA, 20 bp, Artificial Sequence
  Description of Artificial Sequence: Synthetic oligonucleotide
  Target: ATXN1; (-) strand; PAM type: YTN; PAM sequence: CTG
ggaatttccctctgtgtctg

SEQ ID NO: 187171 - DNA, 20 bp, Artificial Sequence
  Description of Artificial Sequence: Synthetic oligonucleotide
  Target: ATXN1; (-) strand; PAM type: YTN; PAM sequence: CTA
ataagagcaatctgggaatt

SEQ ID NO: 187172 - DNA, 20 bp, Artificial Sequence
  Description of Artificial Sequence: Synthetic oligonucleotide
  Target: ATXN1; (-) strand; PAM type: YTN; PAM sequence: CTC
taataagagcaatctgggaa

SEQ ID NO: 187173 - DNA, 20 bp, Artificial Sequence
  Description of Artificial Sequence: Synthetic oligonucleotide
  Target: ATXN1; (-) strand; PAM type: YTN; PAM sequence: TTG
cacacacacgcacactctaa

SEQ ID NO: 187174 - DNA, 20 bp, Artificial Sequence
  Description of Artificial Sequence: Synthetic oligonucleotide
  Target: ATXN1; (-) strand; PAM type: YTN; PAM sequence: CTA
agagaattgcacacacacgc

SEQ ID NO: 187175 - DNA, 20 bp, Artificial Sequence
  Description of Artificial Sequence: Synthetic oligonucleotide
  Target: ATXN1; (-) strand; PAM type: YTN; PAM sequence: CTC
cagactaagagaattgcaca

SEQ ID NO: 187176 - DNA, 20 bp, Artificial Sequence
  Description of Artificial Sequence: Synthetic oligonucleotide
  Target: ATXN1; (-) strand; PAM type: YTN; PAM sequence: CTG
aatctccagactaagagaat

SEQ ID NO: 187177 - DNA, 20 bp, Artificial Sequence
  Description of Artificial Sequence: Synthetic oligonucleotide
  Target: ATXN1; (-) strand; PAM type: YTN; PAM sequence: CTC
tgaatctccagactaagaga

SEQ ID NO: 187178 - DNA, 20 bp, Artificial Sequence
  Description of Artificial Sequence: Synthetic oligonucleotide
  Target: ATXN1; (-) strand; PAM type: YTN; PAM sequence: TTA
ctctgaatctccagactaag

SEQ ID NO: 187179 - DNA, 20 bp, Artificial Sequence
  Description of Artificial Sequence: Synthetic oligonucleotide
  Target: ATXN1; (-) strand; PAM type: YTN; PAM sequence: CTT
actctgaatctccagactaa

SEQ ID NO: 187180 - DNA, 20 bp, Artificial Sequence
  Description of Artificial Sequence: Synthetic oligonucleotide
  Target: ATXN1; (-) strand; PAM type: YTN; PAM sequence: CTC
ttactctgaatctccagact

SEQ ID NO: 187181 - DNA, 20 bp, Artificial Sequence
  Description of Artificial Sequence: Synthetic oligonucleotide
  Target: ATXN1; (-) strand; PAM type: YTN; PAM sequence: TTC
tcttactctgaatctccaga

SEQ ID NO: 187182 - DNA, 20 bp, Artificial Sequence
  Description of Artificial Sequence: Synthetic oligonucleotide
  Target: ATXN1; (-) strand; PAM type: YTN; PAM sequence: TTT
ctcttactctgaatctccag

SEQ ID NO: 187183 - DNA, 20 bp, Artificial Sequence
  Description of Artificial Sequence: Synthetic oligonucleotide
  Target: ATXN1; (-) strand; PAM type: YTN; PAM sequence: CTG
aatttctcttactctgaatc

SEQ ID NO: 187184 - DNA, 20 bp, Artificial Sequence
  Description of Artificial Sequence: Synthetic oligonucleotide
  Target: ATXN1; (-) strand; PAM type: YTN; PAM sequence: TTA
aaaaatgggagctgaatttc

SEQ ID NO: 187185 - DNA, 20 bp, Artificial Sequence
  Description of Artificial Sequence: Synthetic oligonucleotide
  Target: ATXN1; (-) strand; PAM type: YTN; PAM sequence: CTT
aaaaaatgggagctgaattt

SEQ ID NO: 187186 - DNA, 20 bp, Artificial Sequence
  Description of Artificial Sequence: Synthetic oligonucleotide
  Target: ATXN1; (-) strand; PAM type: YTN; PAM sequence: CTG
tgtaagtcttaaaaaatggg

SEQ ID NO: 187187 - DNA, 20 bp, Artificial Sequence
  Description of Artificial Sequence: Synthetic oligonucleotide
  Target: ATXN1; (-) strand; PAM type: YTN; PAM sequence: CTG
tctgtgtaagtcttaaaaaa

SEQ ID NO: 187188 - DNA, 20 bp, Artificial Sequence
  Description of Artificial Sequence: Synthetic oligonucleotide
  Target: ATXN1; (-) strand; PAM type: YTN; PAM sequence: TTA
tgctgtctgtgtaagtctta

SEQ ID NO: 187189 - DNA, 20 bp, Artificial Sequence
  Description of Artificial Sequence: Synthetic oligonucleotide
  Target: ATXN1; (-) strand; PAM type: YTN; PAM sequence: CTG
tgtaaacagcattatgctgt

SEQ ID NO: 187190 - DNA, 20 bp, Artificial Sequence
  Description of Artificial Sequence: Synthetic oligonucleotide
  Target: ATXN1; (-) strand; PAM type: YTN; PAM sequence: CTG
tacctgtgtaaacagcatta

SEQ ID NO: 187191 - DNA, 20 bp, Artificial Sequence
  Description of Artificial Sequence: Synthetic oligonucleotide
  Target: ATXN1; (-) strand; PAM type: YTN; PAM sequence: CTC
tgtacctgtgtaaacagcat

SEQ ID NO: 187192 - DNA, 20 bp, Artificial Sequence
  Description of Artificial Sequence: Synthetic oligonucleotide
  Target: ATXN1; (-) strand; PAM type: YTN; PAM sequence: CTA
aaataaatacctctgtacct

SEQ ID NO: 187193 - DNA, 20 bp, Artificial Sequence
  Description of Artificial Sequence: Synthetic oligonucleotide
  Target: ATXN1; (-) strand; PAM type: YTN; PAM sequence: CTA
ggaagaaatggagagactaa

SEQ ID NO: 187194 - DNA, 20 bp, Artificial Sequence
  Description of Artificial Sequence: Synthetic oligonucleotide
  Target: ATXN1; (-) strand; PAM type: YTN; PAM sequence: TTC
ctaggaagaaatggagagac

SEQ ID NO: 187195 - DNA, 20 bp, Artificial Sequence
  Description of Artificial Sequence: Synthetic oligonucleotide
  Target: ATXN1; (-) strand; PAM type: YTN; PAM sequence: TTA
ttcctaggaagaaatggaga

SEQ ID NO: 187196 - DNA, 20 bp, Artificial Sequence
  Description of Artificial Sequence: Synthetic oligonucleotide
  Target: ATXN1; (-) strand; PAM type: YTN; PAM sequence: TTT
attcctaggaagaaatggag

SEQ ID NO: 187197 - DNA, 20 bp, Artificial Sequence
  Description of Artificial Sequence: Synthetic oligonucleotide
  Target: ATXN1; (-) strand; PAM type: YTN; PAM sequence: CTT
tattcctaggaagaaatgga

SEQ ID NO: 187198 - DNA, 20 bp, Artificial Sequence
  Description of Artificial Sequence: Synthetic oligonucleotide
  Target: ATXN1; (-) strand; PAM type: YTN; PAM sequence: TTA
ctttattcctaggaagaaat

SEQ ID NO: 187199 - DNA, 20 bp, Artificial Sequence
  Description of Artificial Sequence: Synthetic oligonucleotide
  Target: ATXN1; (-) strand; PAM type: YTN; PAM sequence: CTG
agtgcaggcattactttatt

SEQ ID NO: 187200 - DNA, 20 bp, Artificial Sequence
  Description of Artificial Sequence: Synthetic oligonucleotide
  Target: ATXN1; (-) strand; PAM type: YTN; PAM sequence: CTC
tgagtgcaggcattacttta

SEQ ID NO: 187201 - DNA, 20 bp, Artificial Sequence
  Description of Artificial Sequence: Synthetic oligonucleotide
  Target: ATXN1; (-) strand; PAM type: YTN; PAM sequence: CTG
ctctgagtgcaggcattact

SEQ ID NO: 187202 - DNA, 20 bp, Artificial Sequence
  Description of Artificial Sequence: Synthetic oligonucleotide
  Target: ATXN1; (-) strand; PAM type: YTN; PAM sequence: TTC
agaataactgctctgagtgc

SEQ ID NO: 187203 - DNA, 20 bp, Artificial Sequence
  Description of Artificial Sequence: Synthetic oligonucleotide
  Target: ATXN1; (-) strand; PAM type: YTN; PAM sequence: TTT
cagaataactgctctgagtg

SEQ ID NO: 187204 - DNA, 20 bp, Artificial Sequence
  Description of Artificial Sequence: Synthetic oligonucleotide
  Target: ATXN1; (-) strand; PAM type: YTN; PAM sequence: TTT
tcagaataactgctctgagt

SEQ ID NO: 187205 - DNA, 20 bp, Artificial Sequence
  Description of Artificial Sequence: Synthetic oligonucleotide
  Target: ATXN1; (-) strand; PAM type: YTN; PAM sequence: CTT
ttcagaataactgctctgag

SEQ ID NO: 187206 - DNA, 20 bp, Artificial Sequence
  Description of Artificial Sequence: Synthetic oligonucleotide
  Target: ATXN1; (-) strand; PAM type: YTN; PAM sequence: CTC
ccttttcagaataactgctc

SEQ ID NO: 187207 - DNA, 20 bp, Artificial Sequence
  Description of Artificial Sequence: Synthetic oligonucleotide
  Target: ATXN1; (-) strand; PAM type: YTN; PAM sequence: CTA
tggactcccttttcagaata

SEQ ID NO: 187208 - DNA, 20 bp, Artificial Sequence
  Description of Artificial Sequence: Synthetic oligonucleotide
  Target: ATXN1; (-) strand; PAM type: YTN; PAM sequence: TTG
tgtgtctatggactcccttt

SEQ ID NO: 187209 - DNA, 20 bp, Artificial Sequence
  Description of Artificial Sequence: Synthetic oligonucleotide
  Target: ATXN1; (-) strand; PAM type: YTN; PAM sequence: TTT
gtgtgtctatggactccctt

SEQ ID NO: 187210 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtctatggactccct

SEQ ID NO: 187211 - DNA, 20 bp, Artificial Sequence
  Description of Artificial Sequence: Synthetic oligonucleotide
  Target: ATXN1; (-) strand; PAM type: YTN; PAM sequence: CTG
gaattttgtgtgtctatgga

SEQ ID NO: 187212 - DNA, 20 bp, Artificial Sequence
  Description of Artificial Sequence: Synthetic oligonucleotide
  Target: ATXN1; (-) strand; PAM type: YTN; PAM sequence: TTC
tggaattttgtgtgtctatg

SEQ ID NO: 187213 - DNA, 20 bp, Artificial Sequence
  Description of Artificial Sequence: Synthetic oligonucleotide
  Target: ATXN1; (-) strand; PAM type: YTN; PAM sequence: TTT
ctggaattttgtgtgtctat

SEQ ID NO: 187214 - DNA, 20 bp, Artificial Sequence
  Description of Artificial Sequence: Synthetic oligonucleotide
  Target: ATXN1; (-) strand; PAM type: YTN; PAM sequence: TTG
aggacagcaataataaaggt

SEQ ID NO: 187215 - DNA, 20 bp, Artificial Sequence
  Description of Artificial Sequence: Synthetic oligonucleotide
  Target: ATXN1; (-) strand; PAM type: YTN; PAM sequence: TTT
gaggacagcaataataaagg

SEQ ID NO: 187216 - DNA, 20 bp, Artificial Sequence
  Description of Artificial Sequence: Synthetic oligonucleotide
  Target: ATXN1; (-) strand; PAM type: YTN; PAM sequence: TTT
tgaggacagcaataataaag

SEQ ID NO: 187217 - DNA, 20 bp, Artificial Sequence
  Description of Artificial Sequence: Synthetic oligonucleotide
  Target: ATXN1; (-) strand; PAM type: YTN; PAM sequence: CTT
ttgaggacagcaataataaa

SEQ ID NO: 187218 - DNA, 20 bp, Artificial Sequence
  Description of Artificial Sequence: Synthetic oligonucleotide
  Target: ATXN1; (-) strand; PAM type: YTN; PAM sequence: TTA
gcttttgaggacagcaataa

SEQ ID NO: 187219 - DNA, 20 bp, Artificial Sequence
  Description of Artificial Sequence: Synthetic oligonucleotide
  Target: ATXN1; (-) strand; PAM type: YTN; PAM sequence: CTA
gttagcttttgaggacagca

SEQ ID NO: 187220 - DNA, 20 bp, Artificial Sequence
  Description of Artificial Sequence: Synthetic oligonucleotide
  Target: ATXN1; (-) strand; PAM type: YTN; PAM sequence: TTG
tgctagttagcttttgagga

SEQ ID NO: 187221 - DNA, 20 bp, Artificial Sequence
  Description of Artificial Sequence: Synthetic oligonucleotide
  Target: ATXN1; (-) strand; PAM type: YTN; PAM sequence: TTA
gggaggcattgtgctagtta

SEQ ID NO: 187222 - DNA, 20 bp, Artificial Sequence
  Description of Artificial Sequence: Synthetic oligonucleotide
  Target: ATXN1; (-) strand; PAM type: YTN; PAM sequence: CTT
agggaggcattgtgctagtt

SEQ ID NO: 187223 - DNA, 20 bp, Artificial Sequence
  Description of Artificial Sequence: Synthetic oligonucleotide
  Target: ATXN1; (-) strand; PAM type: YTN; PAM sequence: TTC
ttagggaggcattgtgctag

SEQ ID NO: 187224 - DNA, 20 bp, Artificial Sequence
  Description of Artificial Sequence: Synthetic oligonucleotide
  Target: ATXN1; (-) strand; PAM type: YTN; PAM sequence: TTT
cttagggaggcattgtgcta

SEQ ID NO: 187225 - DNA, 20 bp, Artificial Sequence
  Description of Artificial Sequence: Synthetic oligonucleotide
  Target: ATXN1; (-) strand; PAM type: YTN; PAM sequence: CTT
tcttagggaggcattgtgct

SEQ ID NO: 187226 - DNA, 20 bp, Artificial Sequence
  Description of Artificial Sequence: Synthetic oligonucleotide
  Target: ATXN1; (-) strand; PAM type: YTN; PAM sequence: TTC
acaaaagctttcttagggag

SEQ ID NO: 187227 - DNA, 20 bp, Artificial Sequence
  Description of Artificial Sequence: Synthetic oligonucleotide
  Target: ATXN1; (-) strand; PAM type: YTN; PAM sequence: CTG
tggtgtgtgatgggaagttc

SEQ ID NO: 187228 - DNA, 20 bp, Artificial Sequence
  Description of Artificial Sequence: Synthetic oligonucleotide
  Target: ATXN1; (-) strand; PAM type: YTN; PAM sequence: CTC
tgtggtgtgtgatgggaagt

SEQ ID NO: 187229 - DNA, 20 bp, Artificial Sequence
  Description of Artificial Sequence: Synthetic oligonucleotide
  Target: ATXN1; (-) strand; PAM type: YTN; PAM sequence: TTA
atgtctctgtggtgtgtgat

SEQ ID NO: 187230 - DNA, 20 bp, Artificial Sequence
  Description of Artificial Sequence: Synthetic oligonucleotide
  Target: ATXN1; (-) strand; PAM type: YTN; PAM sequence: TTT
aatgtctctgtggtgtgtga

SEQ ID NO: 187231 - DNA, 20 bp, Artificial Sequence
  Description of Artificial Sequence: Synthetic oligonucleotide
  Target: ATXN1; (-) strand; PAM type: YTN; PAM sequence: CTG
gtacaaatgaaacccattta

SEQ ID NO: 187232 - DNA, 20 bp, Artificial Sequence
  Description of Artificial Sequence: Synthetic oligonucleotide
  Target: ATXN1; (-) strand; PAM type: YTN; PAM sequence: TTA
gaatgaaaaaatggtgtgct

SEQ ID NO: 187233 - DNA, 20 bp, Artificial Sequence
  Description of Artificial Sequence: Synthetic oligonucleotide
  Target: ATXN1; (-) strand; PAM type: YTN; PAM sequence: CTT
agaatgaaaaaatggtgtgc

SEQ ID NO: 187234 - DNA, 20 bp, Artificial Sequence
  Description of Artificial Sequence: Synthetic oligonucleotide
  Target: ATXN1; (-) strand; PAM type: YTN; PAM sequence: CTA
gtgcacaccttagaatgaaa

SEQ ID NO: 187235 - DNA, 20 bp, Artificial Sequence
  Description of Artificial Sequence: Synthetic oligonucleotide
  Target: ATXN1; (-) strand; PAM type: YTN; PAM sequence: TTC
tagtgcacaccttagaatga

SEQ ID NO: 187236 - DNA, 20 bp, Artificial Sequence
  Description of Artificial Sequence: Synthetic oligonucleotide
  Target: ATXN1; (-) strand; PAM type: YTN; PAM sequence: TTC
attctagtgcacaccttaga

SEQ ID NO: 187237 - DNA, 20 bp, Artificial Sequence
  Description of Artificial Sequence: Synthetic oligonucleotide
  Target: ATXN1; (-) strand; PAM type: YTN; PAM sequence: CTT
cattctagtgcacaccttag

SEQ ID NO: 187238 - DNA, 20 bp, Artificial Sequence
  Description of Artificial Sequence: Synthetic oligonucleotide
  Target: ATXN1; (-) strand; PAM type: YTN; PAM sequence: CTG
aataacacttcattctagtg

SEQ ID NO: 187239 - DNA, 20 bp, Artificial Sequence
  Description of Artificial Sequence: Synthetic oligonucleotide
  Target: ATXN1; (-) strand; PAM type: YTN; PAM sequence: CTG
actgaataacacttcattct

SEQ ID NO: 187240 - DNA, 20 bp, Artificial Sequence
  Description of Artificial Sequence: Synthetic oligonucleotide
  Target: ATXN1; (-) strand; PAM type: YTN; PAM sequence: CTA
gaaaggggctgactgaataa

SEQ ID NO: 187241 - DNA, 20 bp, Artificial Sequence
  Description of Artificial Sequence: Synthetic oligonucleotide
  Target: ATXN1; (-) strand; PAM type: YTN; PAM sequence: CTC
cctagaaaggggctgactga

SEQ ID NO: 187242 - DNA, 20 bp, Artificial Sequence
  Description of Artificial Sequence: Synthetic oligonucleotide
  Target: ATXN1; (-) strand; PAM type: YTN; PAM sequence: CTG
tatctccctagaaaggggct

SEQ ID NO: 187243 - DNA, 20 bp, Artificial Sequence
  Description of Artificial Sequence: Synthetic oligonucleotide
  Target: ATXN1; (-) strand; PAM type: YTN; PAM sequence: CTG
aagtgctgtatctccctaga

SEQ ID NO: 187244 - DNA, 20 bp, Artificial Sequence
  Description of Artificial Sequence: Synthetic oligonucleotide
  Target: ATXN1; (-) strand; PAM type: YTN; PAM sequence: TTC
aaagtagggatgggcctgaa

SEQ ID NO: 187245 - DNA, 20 bp, Artificial Sequence
  Description of Artificial Sequence: Synthetic oligonucleotide
  Target: ATXN1; (-) strand; PAM type: YTN; PAM sequence: TTT
caaagtagggatgggcctga

SEQ ID NO: 187246 - DNA, 20 bp, Artificial Sequence
  Description of Artificial Sequence: Synthetic oligonucleotide
  Target: ATXN1; (-) strand; PAM type: YTN; PAM sequence: TTT
tcaaagtagggatgggcctg

SEQ ID NO: 187247 - DNA, 20 bp, Artificial Sequence
  Description of Artificial Sequence: Synthetic oligonucleotide
  Target: ATXN1; (-) strand; PAM type: YTN; PAM sequence: CTT
ttcaaagtagggatgggcct

SEQ ID NO: 187248 - DNA, 20 bp, Artificial Sequence
  Description of Artificial Sequence: Synthetic oligonucleotide
  Target: ATXN1; (-) strand; PAM type: YTN; PAM sequence: TTC
ttttcaaagtagggatgggc

SEQ ID NO: 187249 - DNA, 20 bp, Artificial Sequence
  Description of Artificial Sequence: Synthetic oligonucleotide
  Target: ATXN1; (-) strand; PAM type: YTN; PAM sequence: TTT
cttttcaaagtagggatggg

SEQ ID NO: 187250 - DNA, 20 bp, Artificial Sequence
  Description of Artificial Sequence: Synthetic oligonucleotide
  Target: ATXN1; (-) strand; PAM type: YTN; PAM sequence: TTC
atatttcttttcaaagtagg

SEQ ID NO: 187251 - DNA, 20 bp, Artificial Sequence
  Description of Artificial Sequence: Synthetic oligonucleotide
  Target: ATXN1; (-) strand; PAM type: YTN; PAM sequence: TTA
cgttcatatttcttttcaaa

SEQ ID NO: 187252 - DNA, 20 bp, Artificial Sequence
  Description of Artificial Sequence: Synthetic oligonucleotide
  Target: ATXN1; (-) strand; PAM type: YTN; PAM sequence: CTT
acgttcatatttcttttcaa

SEQ ID NO: 187253 - DNA, 20 bp, Artificial Sequence
  Description of Artificial Sequence: Synthetic oligonucleotide
  Target: ATXN1; (-) strand; PAM type: YTN; PAM sequence: CTG
cttacgttcatatttctttt

SEQ ID NO: 187254 - DNA, 20 bp, Artificial Sequence
  Description of Artificial Sequence: Synthetic oligonucleotide
  Target: ATXN1; (-) strand; PAM type: YTN; PAM sequence: TTC
atcactgcttacgttcatat

SEQ ID NO: 187255 - DNA, 20 bp, Artificial Sequence
  Description of Artificial Sequence: Synthetic oligonucleotide
  Target: ATXN1; (-) strand; PAM type: YTN; PAM sequence: TTT
catcactgcttacgttcata

SEQ ID NO: 187256 - DNA, 20 bp, Artificial Sequence
  Description of Artificial Sequence: Synthetic oligonucleotide
  Target: ATXN1; (-) strand; PAM type: YTN; PAM sequence: TTA
tcatcacatcatttcatcac

SEQ ID NO: 187257 - DNA, 20 bp, Artificial Sequence
  Description of Artificial Sequence: Synthetic oligonucleotide
  Target: ATXN1; (-) strand; PAM type: YTN; PAM sequence: CTT
atcatcacatcatttcatca

SEQ ID NO: 187258 - DNA, 20 bp, Artificial Sequence
  Description of Artificial Sequence: Synthetic oligonucleotide
  Target: ATXN1; (-) strand; PAM type: YTN; PAM sequence: CTC
ttatcatcacatcatttcat

SEQ ID NO: 187259 - DNA, 20 bp, Artificial Sequence
  Description of Artificial Sequence: Synthetic oligonucleotide
  Target: ATXN1; (-) strand; PAM type: YTN; PAM sequence: TTG
tctcttatcatcacatcatt

SEQ ID NO: 187260 - DNA, 20 bp, Artificial Sequence
  Description of Artificial Sequence: Synthetic oligonucleotide
  Target: ATXN1; (-) strand; PAM type: YTN; PAM sequence: TTT
gtctcttatcatcacatcat

SEQ ID NO: 187261 - DNA, 20 bp, Artificial Sequence
  Description of Artificial Sequence: Synthetic oligonucleotide
  Target: ATXN1; (-) strand; PAM type: YTN; PAM sequence: TTT
tgtctcttatcatcacatca

SEQ ID NO: 187262 - DNA, 20 bp, Artificial Sequence
  Description of Artificial Sequence: Synthetic oligonucleotide
  Target: ATXN1; (-) strand; PAM type: YTN; PAM sequence: CTG
tgaacggcggtggttttgtc

SEQ ID NO: 187263 - DNA, 20 bp, Artificial Sequence
  Description of Artificial Sequence: Synthetic oligonucleotide
  Target: ATXN1; (-) strand; PAM type: YTN; PAM sequence: TTC
tgtgaacggcggtggttttg

SEQ ID NO: 187264 - DNA, 20 bp, Artificial Sequence
  Description of Artificial Sequence: Synthetic oligonucleotide
  Target: ATXN1; (-) strand; PAM type: YTN; PAM sequence: TTT
ctgtgaacggcggtggtttt

SEQ ID NO: 187265 - DNA, 20 bp, Artificial Sequence
  Description of Artificial Sequence: Synthetic oligonucleotide
  Target: ATXN1; (-) strand; PAM type: YTN; PAM sequence: CTT
tctgtgaacggcggtggttt

SEQ ID NO: 187266 - DNA, 20 bp, Artificial Sequence
  Description of Artificial Sequence: Synthetic oligonucleotide
  Target: ATXN1; (-) strand; PAM type: YTN; PAM sequence: CTG
gctttctgtgaacggcggtg

SEQ ID NO: 187267 - DNA, 20 bp, Artificial Sequence
  Description of Artificial Sequence: Synthetic oligonucleotide
  Target: ATXN1; (-) strand; PAM type: YTN; PAM sequence: CTG
ccctggctttctgtgaacgg

SEQ ID NO: 187268 - DNA, 20 bp, Artificial Sequence
  Description of Artificial Sequence: Synthetic oligonucleotide
  Target: ATXN1; (-) strand; PAM type: YTN; PAM sequence: TTG
tgagcatcctgccctggctt

SEQ ID NO: 187269 - DNA, 20 bp, Artificial Sequence
  Description of Artificial Sequence: Synthetic oligonucleotide
  Target: ATXN1; (-) strand; PAM type: YTN; PAM sequence: TTT
gtgagcatcctgccctggct

SEQ ID NO: 187270 - DNA, 20 bp, Artificial Sequence
  Description of Artificial Sequence: Synthetic oligonucleotide
  Target: ATXN1; (-) strand; PAM type: YTN; PAM sequence: TTG
tttgtgagcatcctgccctg

SEQ ID NO: 187271 - DNA, 20 bp, Artificial Sequence
  Description of Artificial Sequence: Synthetic oligonucleotide
  Target: ATXN1; (-) strand; PAM type: YTN; PAM sequence: CTT
gtttgtgagcatcctgccct

SEQ ID NO: 187272 - DNA, 20 bp, Artificial Sequence
  Description of Artificial Sequence: Synthetic oligonucleotide
  Target: ATXN1; (-) strand; PAM type: YTN; PAM sequence: TTG
tcacttgtttgtgagcatcc

SEQ ID NO: 187273 - DNA, 20 bp, Artificial Sequence
  Description of Artificial Sequence: Synthetic oligonucleotide
  Target: ATXN1; (-) strand; PAM type: YTN; PAM sequence: TTT
gtcacttgtttgtgagcatc

SEQ ID NO: 187274 - DNA, 20 bp, Artificial Sequence
  Description of Artificial Sequence: Synthetic oligonucleotide
  Target: ATXN1; (-) strand; PAM type: YTN; PAM sequence: CTT
tgtcacttgtttgtgagcat

SEQ ID NO: 187275 - DNA, 20 bp, Artificial Sequence
  Description of Artificial Sequence: Synthetic oligonucleotide
  Target: ATXN1; (-) strand; PAM type: YTN; PAM sequence: TTG
ctttgtcacttgtttgtgag

SEQ ID NO: 187276 - DNA, 20 bp, Artificial Sequence
  Description of Artificial Sequence: Synthetic oligonucleotide
  Target: ATXN1; (-) strand; PAM type: YTN; PAM sequence: TTT
gctttgtcacttgtttgtga

SEQ ID NO: 187277 - DNA, 20 bp, Artificial Sequence
  Description of Artificial Sequence: Synthetic oligonucleotide
  Target: ATXN1; (-) strand; PAM type: YTN; PAM sequence: TTG
agtggtttgctttgtcactt

SEQ ID NO: 187278 - DNA, 20 bp, Artificial Sequence
  Description of Artificial Sequence: Synthetic oligonucleotide
  Target: ATXN1; (-) strand; PAM type: YTN; PAM sequence: TTT
gagtggtttgctttgtcact

SEQ ID NO: 187279 - DNA, 20 bp, Artificial Sequence
  Description of Artificial Sequence: Synthetic oligonucleotide
  Target: ATXN1; (-) strand; PAM type: YTN; PAM sequence: TTC
catttgagtggtttgctttg

SEQ ID NO: 187280 - DNA, 20 bp, Artificial Sequence
  Description of Artificial Sequence: Synthetic oligonucleotide
  Target: ATXN1; (-) strand; PAM type: YTN; PAM sequence: TTT
ccatttgagtggtttgcttt

SEQ ID NO: 187281 - DNA, 20 bp, Artificial Sequence
  Description of Artificial Sequence: Synthetic oligonucleotide
  Target: ATXN1; (-) strand; PAM type: YTN; PAM sequence: TTT
tccatttgagtggtttgctt

SEQ ID NO: 187282 - DNA, 20 bp, Artificial Sequence
  Description of Artificial Sequence: Synthetic oligonucleotide
  Target: ATXN1; (-) strand; PAM type: YTN; PAM sequence: CTT
ttccatttgagtggtttgct

SEQ ID NO: 187283 - DNA, 20 bp, Artificial Sequence
  Description of Artificial Sequence: Synthetic oligonucleotide
  Target: ATXN1; (-) strand; PAM type: YTN; PAM sequence: CTC
cttttccatttgagtggttt

SEQ ID NO: 187284 - DNA, 20 bp, Artificial Sequence
  Description of Artificial Sequence: Synthetic oligonucleotide
  Target: ATXN1; (-) strand; PAM type: YTN; PAM sequence: CTC
tccttttccatttgagtggt

SEQ ID NO: 187285 - DNA, 20 bp, Artificial Sequence
  Description of Artificial Sequence: Synthetic oligonucleotide
  Target: ATXN1; (-) strand; PAM type: YTN; PAM sequence: TTC
ctctccttttccatttgagt

SEQ ID NO: 187286 - DNA, 20 bp, Artificial Sequence
  Description of Artificial Sequence: Synthetic oligonucleotide
  Target: ATXN1; (-) strand; PAM type: YTN; PAM sequence: TTT
cctctccttttccatttgag

SEQ ID NO: 187287 - DNA, 20 bp, Artificial Sequence
  Description of Artificial Sequence: Synthetic oligonucleotide
  Target: ATXN1; (-) strand; PAM type: YTN; PAM sequence: CTG
tatttcctctccttttccat

SEQ ID NO: 187288 - DNA, 20 bp, Artificial Sequence
  Description of Artificial Sequence: Synthetic oligonucleotide
  Target: ATXN1; (-) strand; PAM type: YTN; PAM sequence: CTG
tctgtatttcctctcctttt

SEQ ID NO: 187289 - DNA, 20 bp, Artificial Sequence
  Description of Artificial Sequence: Synthetic oligonucleotide
  Target: ATXN1; (-) strand; PAM type: YTN; PAM sequence: CTG
cactgtctgtatttcctctc

SEQ ID NO: 187290 - DNA, 20 bp, Artificial Sequence
  Description of Artificial Sequence: Synthetic oligonucleotide
  Target: ATXN1; (-) strand; PAM type: YTN; PAM sequence: TTA
aaagtctgcactgtctgtat

SEQ ID NO: 187291 - DNA, 20 bp, Artificial Sequence
  Description of Artificial Sequence: Synthetic oligonucleotide
  Target: ATXN1; (-) strand; PAM type: YTN; PAM sequence: TTT
aaaagtctgcactgtctgta

SEQ ID NO: 187292 - DNA, 20 bp, Artificial Sequence
  Description of Artificial Sequence: Synthetic oligonucleotide
  Target: ATXN1; (-) strand; PAM type: YTN; PAM sequence: TTT
taaaagtctgcactgtctgt

SEQ ID NO: 187293 - DNA, 20 bp, Artificial Sequence
  Description of Artificial Sequence: Synthetic oligonucleotide
  Target: ATXN1; (-) strand; PAM type: YTN; PAM sequence: TTT
ttaaaagtctgcactgtctg

SEQ ID NO: 187294 - DNA, 20 bp, Artificial Sequence
  Description of Artificial Sequence: Synthetic oligonucleotide
  Target: ATXN1; (-) strand; PAM type: YTN; PAM sequence: TTT
tttaaaagtctgcactgtct

SEQ ID NO: 187295 - DNA, 20 bp, Artificial Sequence
  Description of Artificial Sequence: Synthetic oligonucleotide
  Target: ATXN1; (-) strand; PAM type: YTN; PAM sequence: TTT
ttttaaaagtctgcactgtc

SEQ ID NO: 187296 - DNA, 20 bp, Artificial Sequence
  Description of Artificial Sequence: Synthetic oligonucleotide
  Target: ATXN1; (-) strand; PAM type: YTN; PAM sequence: CTT
tttttaaaagtctgcactgt

SEQ ID NO: 187297 - DNA, 20 bp, Artificial Sequence
  Description of Artificial Sequence: Synthetic oligonucleotide
  Target: ATXN1; (-) strand; PAM type: YTN; PAM sequence: CTA
atactttttttaaaagtctg

SEQ ID NO: 187298 - DNA, 20 bp, Artificial Sequence
  Description of Artificial Sequence: Synthetic oligonucleotide
  Target: ATXN1; (-) strand; PAM type: YTN; PAM sequence: TTC
taatactttttttaaaagtc

SEQ ID NO: 187299 - DNA, 20 bp, Artificial Sequence
  Description of Artificial Sequence: Synthetic oligonucleotide
  Target: ATXN1; (-) strand; PAM type: YTN; PAM sequence: TTT
ctaatactttttttaaaagt

SEQ ID NO: 187300 - DNA, 20 bp, Artificial Sequence
  Description of Artificial Sequence: Synthetic oligonucleotide
  Target: ATXN1; (-) strand; PAM type: YTN; PAM sequence: TTT
tctaatactttttttaaaag

SEQ ID NO: 187301 - DNA, 20 bp, Artificial Sequence
  Description of Artificial Sequence: Synthetic oligonucleotide
  Target: ATXN1; (-) strand; PAM type: YTN; PAM sequence: TTG
gggattttctaatacttttt

SEQ ID NO: 187302 - DNA, 20 bp, Artificial Sequence
  Description of Artificial Sequence: Synthetic oligonucleotide
  Target: ATXN1; (-) strand; PAM type: YTN; PAM sequence: TTT
ggggattttctaatactttt

SEQ ID NO: 187303 - DNA, 20 bp, Artificial Sequence
  Description of Artificial Sequence: Synthetic oligonucleotide
  Target: ATXN1; (-) strand; PAM type: YTN; PAM sequence: CTA
tcagtagagtttggggattt

SEQ ID NO: 187304 - DNA, 20 bp, Artificial Sequence
  Description of Artificial Sequence: Synthetic oligonucleotide
  Target: ATXN1; (-) strand; PAM type: YTN; PAM sequence: CTA
gacctatcagtagagtttgg

SEQ ID NO: 187305 - DNA, 20 bp, Artificial Sequence
  Description of Artificial Sequence: Synthetic oligonucleotide
  Target: ATXN1; (-) strand; PAM type: YTN; PAM sequence: TTC
tagacctatcagtagagttt

SEQ ID NO: 187306 - DNA, 20 bp, Artificial Sequence
  Description of Artificial Sequence: Synthetic oligonucleotide
  Target: ATXN1; (-) strand; PAM type: YTN; PAM sequence: TTG
tgtaaaaaaaaaaaaattct

SEQ ID NO: 187307 - DNA, 20 bp, Artificial Sequence
  Description of Artificial Sequence: Synthetic oligonucleotide
  Target: ATXN1; (-) strand; PAM type: YTN; PAM sequence: TTT
gtgtaaaaaaaaaaaaattc

SEQ ID NO: 187308 - DNA, 20 bp, Artificial Sequence
  Description of Artificial Sequence: Synthetic oligonucleotide
  Target: ATXN1; (-) strand; PAM type: YTN; PAM sequence: TTG
atgtgtataaagaaatgtga

SEQ ID NO: 187309 - DNA, 20 bp, Artificial Sequence
  Description of Artificial Sequence: Synthetic oligonucleotide
  Target: ATXN1; (-) strand; PAM type: YTN; PAM sequence: CTT
gatgtgtataaagaaatgtg

SEQ ID NO: 187310 - DNA, 20 bp, Artificial Sequence
  Description of Artificial Sequence: Synthetic oligonucleotide
  Target: ATXN1; (-) strand; PAM type: YTN; PAM sequence: TTA
gaagtggatacttgatgtgt

SEQ ID NO: 187311 - DNA, 20 bp, Artificial Sequence
  Description of Artificial Sequence: Synthetic oligonucleotide
  Target: ATXN1; (-) strand; PAM type: YTN; PAM sequence: CTT
agaagtggatacttgatgtg

SEQ ID NO: 187312 - DNA, 20 bp, Artificial Sequence
  Description of Artificial Sequence: Synthetic oligonucleotide
  Target: ATXN1; (-) strand; PAM type: YTN; PAM sequence: TTC
cttagaagtggatacttgat

SEQ ID NO: 187313 - DNA, 20 bp, Artificial Sequence
  Description of Artificial Sequence: Synthetic oligonucleotide
  Target: ATXN1; (-) strand; PAM type: YTN; PAM sequence: TTT
ccttagaagtggatacttga

SEQ ID NO: 187314 - DNA, 20 bp, Artificial Sequence
  Description of Artificial Sequence: Synthetic oligonucleotide
  Target: ATXN1; (-) strand; PAM type: YTN; PAM sequence: TTT
tccttagaagtggatacttg

SEQ ID NO: 187315 - DNA, 20 bp, Artificial Sequence
  Description of Artificial Sequence: Synthetic oligonucleotide
  Target: ATXN1; (-) strand; PAM type: YTN; PAM sequence: CTA
ttttccttagaagtggatac

SEQ ID NO: 187316 - DNA, 20 bp, Artificial Sequence
  Description of Artificial Sequence: Synthetic oligonucleotide
  Target: ATXN1; (-) strand; PAM type: YTN; PAM sequence: CTA
gactattttccttagaagtg

SEQ ID NO: 187317 - DNA, 20 bp, Artificial Sequence
  Description of Artificial Sequence: Synthetic oligonucleotide
  Target: ATXN1; (-) strand; PAM type: YTN; PAM sequence: TTA
agggtgtggggaagggatgg

SEQ ID NO: 187318 - DNA, 20 bp, Artificial Sequence
  Description of Artificial Sequence: Synthetic oligonucleotide
  Target: ATXN1; (-) strand; PAM type: YTN; PAM sequence: TTT
aagggtgtggggaagggatg

SEQ ID NO: 187319 - DNA, 20 bp, Artificial Sequence
  Description of Artificial Sequence: Synthetic oligonucleotide
  Target: ATXN1; (-) strand; PAM type: YTN; PAM sequence: CTG
atagcagtttaagggtgtgg

SEQ ID NO: 187320 - DNA, 20 bp, Artificial Sequence
  Description of Artificial Sequence: Synthetic oligonucleotide
  Target: ATXN1; (-) strand; PAM type: YTN; PAM sequence: TTG
aatctgatagcagtttaagg

SEQ ID NO: 187321 - DNA, 20 bp, Artificial Sequence
  Description of Artificial Sequence: Synthetic oligonucleotide
  Target: ATXN1; (-) strand; PAM type: YTN; PAM sequence: CTT
gaatctgatagcagtttaag

SEQ ID NO: 187322 - DNA, 20 bp, Artificial Sequence
  Description of Artificial Sequence: Synthetic oligonucleotide
  Target: ATXN1; (-) strand; PAM type: YTN; PAM sequence: CTG
atgagaatgcttgaatctga

SEQ ID NO: 187323 - DNA, 20 bp, Artificial Sequence
  Description of Artificial Sequence: Synthetic oligonucleotide
  Target: ATXN1; (-) strand; PAM type: YTN; PAM sequence: TTC
tgatgagaatgcttgaatct

SEQ ID NO: 187324 - DNA, 20 bp, Artificial Sequence
  Description of Artificial Sequence: Synthetic oligonucleotide
  Target: ATXN1; (-) strand; PAM type: YTN; PAM sequence: CTG
ttctgatgagaatgcttgaa

SEQ ID NO: 187325 - DNA, 20 bp, Artificial Sequence
  Description of Artificial Sequence: Synthetic oligonucleotide
  Target: ATXN1; (-) strand; PAM type: YTN; PAM sequence: TTA
ggaaaaggaacatacatgct

SEQ ID NO: 187326 - DNA, 20 bp, Artificial Sequence
  Description of Artificial Sequence: Synthetic oligonucleotide
  Target: ATXN1; (-) strand; PAM type: YTN; PAM sequence: CTG
agccattaggaaaaggaaca

SEQ ID NO: 187327 - DNA, 20 bp, Artificial Sequence
  Description of Artificial Sequence: Synthetic oligonucleotide
  Target: ATXN1; (-) strand; PAM type: YTN; PAM sequence: CTC
atgtgtgggcctgagccatt

SEQ ID NO: 187328 - DNA, 20 bp, Artificial Sequence
  Description of Artificial Sequence: Synthetic oligonucleotide
  Target: ATXN1; (-) strand; PAM type: YTN; PAM sequence: CTC
tcatgtgtgggcctgagcca

SEQ ID NO: 187329 - DNA, 20 bp, Artificial Sequence
  Description of Artificial Sequence: Synthetic oligonucleotide
  Target: ATXN1; (-) strand; PAM type: YTN; PAM sequence: CTA
agtgaatgcctctcatgtgt

SEQ ID NO: 187330 - DNA, 20 bp, Artificial Sequence
  Description of Artificial Sequence: Synthetic oligonucleotide
  Target: ATXN1; (-) strand; PAM type: YTN; PAM sequence: TTC
actaagtgaatgcctctcat

SEQ ID NO: 187331 - DNA, 20 bp, Artificial Sequence
  Description of Artificial Sequence: Synthetic oligonucleotide
  Target: ATXN1; (-) strand; PAM type: YTN; PAM sequence: CTA
aatgacattcactaagtgaa

SEQ ID NO: 187332 - DNA, 20 bp, Artificial Sequence
  Description of Artificial Sequence: Synthetic oligonucleotide
  Target: ATXN1; (-) strand; PAM type: YTN; PAM sequence: TTG
agtgaatgcctaaatgacat

SEQ ID NO: 187333 - DNA, 20 bp, Artificial Sequence
  Description of Artificial Sequence: Synthetic oligonucleotide
  Target: ATXN1; (-) strand; PAM type: YTN; PAM sequence: TTC
attgagtgaatgcctaaatg

SEQ ID NO: 187334 - DNA, 20 bp, Artificial Sequence
  Description of Artificial Sequence: Synthetic oligonucleotide
  Target: ATXN1; (-) strand; PAM type: YTN; PAM sequence: TTC
ccataatgggcagtcagtaa

SEQ ID NO: 187335 - DNA, 20 bp, Artificial Sequence
  Description of Artificial Sequence: Synthetic oligonucleotide
  Target: ATXN1; (-) strand; PAM type: YTN; PAM sequence: TTG
ttcccataatgggcagtcag

SEQ ID NO: 187336 - DNA, 20 bp, Artificial Sequence
  Description of Artificial Sequence: Synthetic oligonucleotide
  Target: ATXN1; (-) strand; PAM type: YTN; PAM sequence: CTT
gttcccataatgggcagtca

SEQ ID NO: 187337 - DNA, 20 bp, Artificial Sequence
  Description of Artificial Sequence: Synthetic oligonucleotide
  Target: ATXN1; (-) strand; PAM type: YTN; PAM sequence: CTG
cttgttcccataatgggcag

SEQ ID NO: 187338 - DNA, 20 bp, Artificial Sequence
  Description of Artificial Sequence: Synthetic oligonucleotide
  Target: ATXN1; (-) strand; PAM type: YTN; PAM sequence: CTA
aaatactgcttgttcccata

SEQ ID NO: 187339 - DNA, 20 bp, Artificial Sequence
  Description of Artificial Sequence: Synthetic oligonucleotide
  Target: ATXN1; (-) strand; PAM type: YTN; PAM sequence: CTG
gtgaatgaatagtacctaaa

SEQ ID NO: 187340 - DNA, 20 bp, Artificial Sequence
  Description of Artificial Sequence: Synthetic oligonucleotide
  Target: ATXN1; (-) strand; PAM type: YTN; PAM sequence: TTC
cctggtgaatgaatagtacc

SEQ ID NO: 187341 - DNA, 20 bp, Artificial Sequence
  Description of Artificial Sequence: Synthetic oligonucleotide
  Target: ATXN1; (-) strand; PAM type: YTN; PAM sequence: CTT
ccctggtgaatgaatagtac

SEQ ID NO: 187342 - DNA, 20 bp, Artificial Sequence
  Description of Artificial Sequence: Synthetic oligonucleotide
  Target: ATXN1; (-) strand; PAM type: YTN; PAM sequence: TTC
ttccctggtgaatgaatagt

SEQ ID NO: 187343 - DNA, 20 bp, Artificial Sequence
  Description of Artificial Sequence: Synthetic oligonucleotide
  Target: ATXN1; (-) strand; PAM type: YTN; PAM sequence: TTA
ttcttccctggtgaatgaat

SEQ ID NO: 187344 - DNA, 20 bp, Artificial Sequence
  Description of Artificial Sequence: Synthetic oligonucleotide
  Target: ATXN1; (-) strand; PAM type: YTN; PAM sequence: CTT
attcttccctggtgaatgaa

SEQ ID NO: 187345 - DNA, 20 bp, Artificial Sequence
  Description of Artificial Sequence: Synthetic oligonucleotide
  Target: ATXN1; (-) strand; PAM type: YTN; PAM sequence: TTC
ttattcttccctggtgaatg

SEQ ID NO: 187346 - DNA, 20 bp, Artificial Sequence
  Description of Artificial Sequence: Synthetic oligonucleotide
  Target: ATXN1; (-) strand; PAM type: YTN; PAM sequence: CTC
attcttattcttccctggtg

SEQ ID NO: 187347 - DNA, 20 bp, Artificial Sequence
  Description of Artificial Sequence: Synthetic oligonucleotide
  Target: ATXN1; (-) strand; PAM type: YTN; PAM sequence: TTC
tcattcttattcttccctgg

SEQ ID NO: 187348 - DNA, 20 bp, Artificial Sequence
  Description of Artificial Sequence: Synthetic oligonucleotide
  Target: ATXN1; (-) strand; PAM type: YTN; PAM sequence: TTA
ttctcattcttattcttccc

SEQ ID NO: 187349 - DNA, 20 bp, Artificial Sequence
  Description of Artificial Sequence: Synthetic oligonucleotide
  Target: ATXN1; (-) strand; PAM type: YTN; PAM sequence: CTT
attctcattcttattcttcc

SEQ ID NO: 187350 - DNA, 20 bp, Artificial Sequence
  Description of Artificial Sequence: Synthetic oligonucleotide
  Target: ATXN1; (-) strand; PAM type: YTN; PAM sequence: TTA
tccttattctcattcttatt

SEQ ID NO: 187351 - DNA, 20 bp, Artificial Sequence
  Description of Artificial Sequence: Synthetic oligonucleotide
  Target: ATXN1; (-) strand; PAM type: YTN; PAM sequence: CTT
atccttattctcattcttat

SEQ ID NO: 187352 - DNA, 20 bp, Artificial Sequence
  Description of Artificial Sequence: Synthetic oligonucleotide
  Target: ATXN1; (-) strand; PAM type: YTN; PAM sequence: TTC
ttatccttattctcattctt

SEQ ID NO: 187353 - DNA, 20 bp, Artificial Sequence
  Description of Artificial Sequence: Synthetic oligonucleotide
  Target: ATXN1; (-) strand; PAM type: YTN; PAM sequence: CTG
caaaaggagggatggtattc

SEQ ID NO: 187354 - DNA, 20 bp, Artificial Sequence
  Description of Artificial Sequence: Synthetic oligonucleotide
  Target: ATXN1; (-) strand; PAM type: YTN; PAM sequence: CTC
tgcaaaaggagggatggtat

SEQ ID NO: 187355 - DNA, 20 bp, Artificial Sequence
  Description of Artificial Sequence: Synthetic oligonucleotide
  Target: ATXN1; (-) strand; PAM type: YTN; PAM sequence: CTG
caagctctgcaaaaggaggg

SEQ ID NO: 187356 - DNA, 20 bp, Artificial Sequence
  Description of Artificial Sequence: Synthetic oligonucleotide
  Target: ATXN1; (-) strand; PAM type: YTN; PAM sequence: CTA
gtctgcaagctctgcaaaag

SEQ ID NO: 187357 - DNA, 20 bp, Artificial Sequence
  Description of Artificial Sequence: Synthetic oligonucleotide
  Target: ATXN1; (-) strand; PAM type: YTN; PAM sequence: CTC
aactagtctgcaagctctgc

SEQ ID NO: 187358 - DNA, 20 bp, Artificial Sequence
  Description of Artificial Sequence: Synthetic oligonucleotide
  Target: ATXN1; (-) strand; PAM type: YTN; PAM sequence: CTC
ctcaactagtctgcaagctc

SEQ ID NO: 187359 - DNA, 20 bp, Artificial Sequence
  Description of Artificial Sequence: Synthetic oligonucleotide
  Target: ATXN1; (-) strand; PAM type: YTN; PAM sequence: TTA
atcatcagtctcctcaacta

SEQ ID NO: 187360 - DNA, 20 bp, Artificial Sequence
  Description of Artificial Sequence: Synthetic oligonucleotide
  Target: ATXN1; (-) strand; PAM type: YTN; PAM sequence: TTG
ttaatcatcagtctcctcaa

SEQ ID NO: 187361 - DNA, 20 bp, Artificial Sequence
  Description of Artificial Sequence: Synthetic oligonucleotide
  Target: ATXN1; (-) strand; PAM type: YTN; PAM sequence: TTT
gttaatcatcagtctcctca

SEQ ID NO: 187362 - DNA, 20 bp, Artificial Sequence
  Description of Artificial Sequence: Synthetic oligonucleotide
  Target: ATXN1; (-) strand; PAM type: YTN; PAM sequence: TTA
tttgttaatcatcagtctcc

SEQ ID NO: 187363 - DNA, 20 bp, Artificial Sequence
  Description of Artificial Sequence: Synthetic oligonucleotide
  Target: ATXN1; (-) strand; PAM type: YTN; PAM sequence: TTT
atttgttaatcatcagtctc

SEQ ID NO: 187364 - DNA, 20 bp, Artificial Sequence
  Description of Artificial Sequence: Synthetic oligonucleotide
  Target: ATXN1; (-) strand; PAM type: YTN; PAM sequence: TTA
tatatttatttgttaatcat

SEQ ID NO: 187365 - DNA, 20 bp, Artificial Sequence
  Description of Artificial Sequence: Synthetic oligonucleotide
  Target: ATXN1; (-) strand; PAM type: YTN; PAM sequence: TTA
catattatatatttatttgt

SEQ ID NO: 187366 - DNA, 20 bp, Artificial Sequence
  Description of Artificial Sequence: Synthetic oligonucleotide
  Target: ATXN1; (-) strand; PAM type: YTN; PAM sequence: CTT
acatattatatatttatttg

SEQ ID NO: 187367 - DNA, 20 bp, Artificial Sequence
  Description of Artificial Sequence: Synthetic oligonucleotide
  Target: ATXN1; (-) strand; PAM type: YTN; PAM sequence: TTA
agcaccttacatattatata

SEQ ID NO: 187368 - DNA, 20 bp, Artificial Sequence
  Description of Artificial Sequence: Synthetic oligonucleotide
  Target: ATXN1; (-) strand; PAM type: YTN; PAM sequence: TTT
aagcaccttacatattatat

SEQ ID NO: 187369 - DNA, 20 bp, Artificial Sequence
  Description of Artificial Sequence: Synthetic oligonucleotide
  Target: ATXN1; (-) strand; PAM type: YTN; PAM sequence: TTT
taagcaccttacatattata

SEQ ID NO: 187370 - DNA, 20 bp, Artificial Sequence
  Description of Artificial Sequence: Synthetic oligonucleotide
  Target: ATXN1; (-) strand; PAM type: YTN; PAM sequence: CTT
ttaagcaccttacatattat

SEQ ID NO: 187371 - DNA, 20 bp, Artificial Sequence
  Description of Artificial Sequence: Synthetic oligonucleotide
  Target: ATXN1; (-) strand; PAM type: YTN; PAM sequence: TTC
ttttaagcaccttacatatt

SEQ ID NO: 187372 - DNA, 20 bp, Artificial Sequence
  Description of Artificial Sequence: Synthetic oligonucleotide
  Target: ATXN1; (-) strand; PAM type: YTN; PAM sequence: TTT
cttttaagcaccttacatat

SEQ ID NO: 187373 - DNA, 20 bp, Artificial Sequence
  Description of Artificial Sequence: Synthetic oligonucleotide
  Target: ATXN1; (-) strand; PAM type: YTN; PAM sequence: TTT
tcttttaagcaccttacata

SEQ ID NO: 187374 - DNA, 20 bp, Artificial Sequence
  Description of Artificial Sequence: Synthetic oligonucleotide
  Target: ATXN1; (-) strand; PAM type: YTN; PAM sequence: TTT
ttcttttaagcaccttacat

SEQ ID NO: 187375 - DNA, 20 bp, Artificial Sequence
  Description of Artificial Sequence: Synthetic oligonucleotide
  Target: ATXN1; (-) strand; PAM type: YTN; PAM sequence: CTG
tgtttttcttttaagcacct

SEQ ID NO: 187376 - DNA, 20 bp, Artificial Sequence
  Description of Artificial Sequence: Synthetic oligonucleotide
  Target: ATXN1; (-) strand; PAM type: YTN; PAM sequence: TTC
tgtgtttttcttttaagcac

SEQ ID NO: 187377 - DNA, 20 bp, Artificial Sequence
  Description of Artificial Sequence: Synthetic oligonucleotide
  Target: ATXN1; (-) strand; PAM type: YTN; PAM sequence: CTT
ctgtgtttttcttttaagca

SEQ ID NO: 187378 - DNA, 20 bp, Artificial Sequence
  Description of Artificial Sequence: Synthetic oligonucleotide
  Target: ATXN1; (-) strand; PAM type: YTN; PAM sequence: CTA
gccttctgtgtttttctttt

SEQ ID NO: 187379 - DNA, 20 bp, Artificial Sequence
  Description of Artificial Sequence: Synthetic oligonucleotide
  Target: ATXN1; (-) strand; PAM type: YTN; PAM sequence: CTC
tagccttctgtgtttttctt

SEQ ID NO: 187380 - DNA, 20 bp, Artificial Sequence
  Description of Artificial Sequence: Synthetic oligonucleotide
  Target: ATXN1; (-) strand; PAM type: YTN; PAM sequence: CTC
agtcctctagccttctgtgt

SEQ ID NO: 187381 - DNA, 20 bp, Artificial Sequence
  Description of Artificial Sequence: Synthetic oligonucleotide
  Target: ATXN1; (-) strand; PAM type: YTN; PAM sequence: CTC
tcagtcctctagccttctgt

SEQ ID NO: 187382 - DNA, 20 bp, Artificial Sequence
  Description of Artificial Sequence: Synthetic oligonucleotide
  Target: ATXN1; (-) strand; PAM type: YTN; PAM sequence: CTA
cataaaatagcatccacccc

SEQ ID NO: 187383 - DNA, 20 bp, Artificial Sequence
  Description of Artificial Sequence: Synthetic oligonucleotide
  Target: ATXN1; (-) strand; PAM type: YTN; PAM sequence: CTG
atctacataaaatagcatcc

SEQ ID NO: 187384 - DNA, 20 bp, Artificial Sequence
  Description of Artificial Sequence: Synthetic oligonucleotide
  Target: ATXN1; (-) strand; PAM type: YTN; PAM sequence: TTC
cctgatctacataaaatagc

SEQ ID NO: 187385 - DNA, 20 bp, Artificial Sequence
  Description of Artificial Sequence: Synthetic oligonucleotide
  Target: ATXN1; (-) strand; PAM type: YTN; PAM sequence: CTT
ccctgatctacataaaatag

SEQ ID NO: 187386 - DNA, 20 bp, Artificial Sequence
  Description of Artificial Sequence: Synthetic oligonucleotide
  Target: ATXN1; (-) strand; PAM type: YTN; PAM sequence: TTA
tcaaagcagccttccctgat

SEQ ID NO: 187387 - DNA, 20 bp, Artificial Sequence
  Description of Artificial Sequence: Synthetic oligonucleotide
  Target: ATXN1; (-) strand; PAM type: YTN; PAM sequence: CTT
atcaaagcagccttccctga

SEQ ID NO: 187388 - DNA, 20 bp, Artificial Sequence
  Description of Artificial Sequence: Synthetic oligonucleotide
  Target: ATXN1; (-) strand; PAM type: YTN; PAM sequence: TTA
ccttatcaaagcagccttcc

SEQ ID NO: 187389 - DNA, 20 bp, Artificial Sequence
  Description of Artificial Sequence: Synthetic oligonucleotide
  Target: ATXN1; (-) strand; PAM type: YTN; PAM sequence: TTG
agttaccttatcaaagcagc

SEQ ID NO: 187390 - DNA, 20 bp, Artificial Sequence
  Description of Artificial Sequence: Synthetic oligonucleotide
  Target: ATXN1; (-) strand; PAM type: YTN; PAM sequence: CTT
gagttaccttatcaaagcag

SEQ ID NO: 187391 - DNA, 20 bp, Artificial Sequence
  Description of Artificial Sequence: Synthetic oligonucleotide
  Target: ATXN1; (-) strand; PAM type: YTN; PAM sequence: TTC
ttgagttaccttatcaaagc

SEQ ID NO: 187392 - DNA, 20 bp, Artificial Sequence
  Description of Artificial Sequence: Synthetic oligonucleotide
  Target: ATXN1; (-) strand; PAM type: YTN; PAM sequence: TTA
agtaggaattcttgagttac

SEQ ID NO: 187393 - DNA, 20 bp, Artificial Sequence
  Description of Artificial Sequence: Synthetic oligonucleotide
  Target: ATXN1; (-) strand; PAM type: YTN; PAM sequence: CTT
aagtaggaattcttgagtta

SEQ ID NO: 187394 - DNA, 20 bp, Artificial Sequence
  Description of Artificial Sequence: Synthetic oligonucleotide
  Target: ATXN1; (-) strand; PAM type: YTN; PAM sequence: TTC
cttaagtaggaattcttgag

SEQ ID NO: 187395 - DNA, 20 bp, Artificial Sequence
  Description of Artificial Sequence: Synthetic oligonucleotide
  Target: ATXN1; (-) strand; PAM type: YTN; PAM sequence: CTT
ccttaagtaggaattcttga

SEQ ID NO: 187396 - DNA, 20 bp, Artificial Sequence
  Description of Artificial Sequence: Synthetic oligonucleotide
  Target: ATXN1; (-) strand; PAM type: YTN; PAM sequence: CTG
cttccttaagtaggaattct

SEQ ID NO: 187397 - DNA, 20 bp, Artificial Sequence
  Description of Artificial Sequence: Synthetic oligonucleotide
  Target: ATXN1; (-) strand; PAM type: YTN; PAM sequence: CTC
tgcttccttaagtaggaatt

SEQ ID NO: 187398 - DNA, 20 bp, Artificial Sequence
  Description of Artificial Sequence: Synthetic oligonucleotide
  Target: ATXN1; (-) strand; PAM type: YTN; PAM sequence: TTC
tctgcttccttaagtaggaa

SEQ ID NO: 187399 - DNA, 20 bp, Artificial Sequence
  Description of Artificial Sequence: Synthetic oligonucleotide
  Target: ATXN1; (-) strand; PAM type: YTN; PAM sequence: CTT
ctctgcttccttaagtagga

SEQ ID NO: 187400 - DNA, 20 bp, Artificial Sequence
  Description of Artificial Sequence: Synthetic oligonucleotide
  Target: ATXN1; (-) strand; PAM type: YTN; PAM sequence: CTA
agcttctctgcttccttaag

SEQ ID NO: 187401 - DNA, 20 bp, Artificial Sequence
  Description of Artificial Sequence: Synthetic oligonucleotide
  Target: ATXN1; (-) strand; PAM type: YTN; PAM sequence: TTC
ctaagcttctctgcttcctt

SEQ ID NO: 187402 - DNA, 20 bp, Artificial Sequence
  Description of Artificial Sequence: Synthetic oligonucleotide
  Target: ATXN1; (-) strand; PAM type: YTN; PAM sequence: TTC
attcctaagcttctctgctt

SEQ ID NO: 187403 - DNA, 20 bp, Artificial Sequence
  Description of Artificial Sequence: Synthetic oligonucleotide
  Target: ATXN1; (-) strand; PAM type: YTN; PAM sequence: TTT
cattcctaagcttctctgct

SEQ ID NO: 187404 - DNA, 20 bp, Artificial Sequence
  Description of Artificial Sequence: Synthetic oligonucleotide
  Target: ATXN1; (-) strand; PAM type: YTN; PAM sequence: CTA
agcaaggagaaagtgatcca

SEQ ID NO: 187405 - DNA, 20 bp, Artificial Sequence
  Description of Artificial Sequence: Synthetic oligonucleotide
  Target: ATXN1; (-) strand; PAM type: YTN; PAM sequence: TTA
gagtctaagcaaggagaaag

SEQ ID NO: 187406 - DNA, 20 bp, Artificial Sequence
  Description of Artificial Sequence: Synthetic oligonucleotide
  Target: ATXN1; (-) strand; PAM type: YTN; PAM sequence: TTG
gttagagtctaagcaaggag

SEQ ID NO: 187407 - DNA, 20 bp, Artificial Sequence
  Description of Artificial Sequence: Synthetic oligonucleotide
  Target: ATXN1; (-) strand; PAM type: YTN; PAM sequence: CTC
aaatattggttagagtctaa

SEQ ID NO: 187408 - DNA, 20 bp, Artificial Sequence
  Description of Artificial Sequence: Synthetic oligonucleotide
  Target: ATXN1; (-) strand; PAM type: YTN; PAM sequence: CTG
tgctcaaatattggttagag

SEQ ID NO: 187409 - DNA, 20 bp, Artificial Sequence
  Description of Artificial Sequence: Synthetic oligonucleotide
  Target: ATXN1; (-) strand; PAM type: YTN; PAM sequence: CTC
tgtgctcaaatattggttag

SEQ ID NO: 187410 - DNA, 20 bp, Artificial Sequence
  Description of Artificial Sequence: Synthetic oligonucleotide
  Target: ATXN1; (-) strand; PAM type: YTN; PAM sequence: CTA
aaaccacctctgtgctcaaa

SEQ ID NO: 187411 - DNA, 20 bp, Artificial Sequence
  Description of Artificial Sequence: Synthetic oligonucleotide
  Target: ATXN1; (-) strand; PAM type: YTN; PAM sequence: TTC
taaaaccacctctgtgctca

SEQ ID NO: 187412 - DNA, 20 bp, Artificial Sequence
  Description of Artificial Sequence: Synthetic oligonucleotide
  Target: ATXN1; (-) strand; PAM type: YTN; PAM sequence: TTT
ctaaaaccacctctgtgctc

SEQ ID NO: 187413 - DNA, 20 bp, Artificial Sequence
  Description of Artificial Sequence: Synthetic oligonucleotide
  Target: ATXN1; (-) strand; PAM type: YTN; PAM sequence: TTT
tctaaaaccacctctgtgct

SEQ ID NO: 187414 - DNA, 20 bp, Artificial Sequence
  Description of Artificial Sequence: Synthetic oligonucleotide
  Target: ATXN1; (-) strand; PAM type: YTN; PAM sequence: TTG
agttttctaaaaccacctct

SEQ ID NO: 187415 - DNA, 20 bp, Artificial Sequence
  Description of Artificial Sequence: Synthetic oligonucleotide
  Target: ATXN1; (-) strand; PAM type: YTN; PAM sequence: CTT
gagttttctaaaaccacctc

SEQ ID NO: 187416 - DNA, 20 bp, Artificial Sequence
  Description of Artificial Sequence: Synthetic oligonucleotide
  Target: ATXN1; (-) strand; PAM type: YTN; PAM sequence: TTG
aacttgagttttctaaaacc

SEQ ID NO: 187417 - DNA, 20 bp, Artificial Sequence
  Description of Artificial Sequence: Synthetic oligonucleotide
  Target: ATXN1; (-) strand; PAM type: YTN; PAM sequence: TTT
gaacttgagttttctaaaac

SEQ ID NO: 187418 - DNA, 20 bp, Artificial Sequence
  Description of Artificial Sequence: Synthetic oligonucleotide
  Target: ATXN1; (-) strand; PAM type: YTN; PAM sequence: TTT
tgaacttgagttttctaaaa

SEQ ID NO: 187419 - DNA, 20 bp, Artificial Sequence
  Description of Artificial Sequence: Synthetic oligonucleotide
  Target: ATXN1; (-) strand; PAM type: YTN; PAM sequence: TTT
ttgaacttgagttttctaaa

SEQ ID NO: 187420 - DNA, 20 bp, Artificial Sequence
  Description of Artificial Sequence: Synthetic oligonucleotide
  Target: ATXN1; (-) strand; PAM type: YTN; PAM sequence: TTG
aaaataaacaggaacgattt

SEQ ID NO: 187421 - DNA, 20 bp, Artificial Sequence
  Description of Artificial Sequence: Synthetic oligonucleotide
  Target: ATXN1; (-) strand; PAM type: YTN; PAM sequence: TTT
gaaaataaacaggaacgatt

SEQ ID NO: 187422 - DNA, 20 bp, Artificial Sequence
  Description of Artificial Sequence: Synthetic oligonucleotide
  Target: ATXN1; (-) strand; PAM type: YTN; PAM sequence: TTT
tgaaaataaacaggaacgat

SEQ ID NO: 187423 - DNA, 20 bp, Artificial Sequence
  Description of Artificial Sequence: Synthetic oligonucleotide
  Target: ATXN1; (-) strand; PAM type: YTN; PAM sequence: CTT
ttgaaaataaacaggaacga

SEQ ID NO: 187424 - DNA, 20 bp, Artificial Sequence
  Description of Artificial Sequence: Synthetic oligonucleotide
  Target: ATXN1; (-) strand; PAM type: YTN; PAM sequence: TTG
gtccttttgaaaataaacag

SEQ ID NO: 187425 - DNA, 20 bp, Artificial Sequence
  Description of Artificial Sequence: Synthetic oligonucleotide
  Target: ATXN1; (-) strand; PAM type: YTN; PAM sequence: CTC
attggtccttttgaaaataa

SEQ ID NO: 187426 - DNA, 20 bp, Artificial Sequence
  Description of Artificial Sequence: Synthetic oligonucleotide
  Target: ATXN1; (-) strand; PAM type: YTN; PAM sequence: TTA
gggtccacactcattggtcc

SEQ ID NO: 187427 - DNA, 20 bp, Artificial Sequence
  Description of Artificial Sequence: Synthetic oligonucleotide
  Target: ATXN1; (-) strand; PAM type: YTN; PAM sequence: TTT
agggtccacactcattggtc

SEQ ID NO: 187428 - DNA, 20 bp, Artificial Sequence
  Description of Artificial Sequence: Synthetic oligonucleotide
  Target: ATXN1; (-) strand; PAM type: YTN; PAM sequence: TTA
aatttagggtccacactcat

SEQ ID NO: 187429 - DNA, 20 bp, Artificial Sequence
  Description of Artificial Sequence: Synthetic oligonucleotide
  Target: ATXN1; (-) strand; PAM type: YTN; PAM sequence: TTT
aaatttagggtccacactca

SEQ ID NO: 187430 - DNA, 20 bp, Artificial Sequence
  Description of Artificial Sequence: Synthetic oligonucleotide
  Target: ATXN1; (-) strand; PAM type: YTN; PAM sequence: CTG
tttaaatttagggtccacac

SEQ ID NO: 187431 - DNA, 20 bp, Artificial Sequence
  Description of Artificial Sequence: Synthetic oligonucleotide
  Target: ATXN1; (-) strand; PAM type: YTN; PAM sequence: TTA
gctgtttaaatttagggtcc

SEQ ID NO: 187432 - DNA, 20 bp, Artificial Sequence
  Description of Artificial Sequence: Synthetic oligonucleotide
  Target: ATXN1; (-) strand; PAM type: YTN; PAM sequence: TTT
agctgtttaaatttagggtc

SEQ ID NO: 187433 - DNA, 20 bp, Artificial Sequence
  Description of Artificial Sequence: Synthetic oligonucleotide
  Target: ATXN1; (-) strand; PAM type: YTN; PAM sequence: CTT
tagctgtttaaatttagggt

SEQ ID NO: 187434 - DNA, 20 bp, Artificial Sequence
  Description of Artificial Sequence: Synthetic oligonucleotide
  Target: ATXN1; (-) strand; PAM type: YTN; PAM sequence: CTA
tagctttagctgtttaaatt

SEQ ID NO: 187435 - DNA, 20 bp, Artificial Sequence
  Description of Artificial Sequence: Synthetic oligonucleotide
  Target: ATXN1; (-) strand; PAM type: YTN; PAM sequence: TTA
gactatagctttagctgttt

SEQ ID NO: 187436 - DNA, 20 bp, Artificial Sequence
  Description of Artificial Sequence: Synthetic oligonucleotide
  Target: ATXN1; (-) strand; PAM type: YTN; PAM sequence: CTT
agactatagctttagctgtt

SEQ ID NO: 187437 - DNA, 20 bp, Artificial Sequence
  Description of Artificial Sequence: Synthetic oligonucleotide
  Target: ATXN1; (-) strand; PAM type: YTN; PAM sequence: CTG
tccttagactatagctttag

SEQ ID NO: 187438 - DNA, 20 bp, Artificial Sequence
  Description of Artificial Sequence: Synthetic oligonucleotide
  Target: ATXN1; (-) strand; PAM type: YTN; PAM sequence: TTG
agactgtccttagactatag

SEQ ID NO: 187439 - DNA, 20 bp, Artificial Sequence
  Description of Artificial Sequence: Synthetic oligonucleotide
  Target: ATXN1; (-) strand; PAM type: YTN; PAM sequence: TTT
gagactgtccttagactata

SEQ ID NO: 187440 - DNA, 20 bp, Artificial Sequence
  Description of Artificial Sequence: Synthetic oligonucleotide
  Target: ATXN1; (-) strand; PAM type: YTN; PAM sequence: TTA
tttgagactgtccttagact

SEQ ID NO: 187441 - DNA, 20 bp, Artificial Sequence
  Description of Artificial Sequence: Synthetic oligonucleotide
  Target: ATXN1; (-) strand; PAM type: YTN; PAM sequence: TTT
atttgagactgtccttagac

SEQ ID NO: 187442 - DNA, 20 bp, Artificial Sequence
  Description of Artificial Sequence: Synthetic oligonucleotide
  Target: ATXN1; (-) strand; PAM type: YTN; PAM sequence: TTC
aaaggtatttatttgagact

SEQ ID NO: 187443 - DNA, 20 bp, Artificial Sequence
  Description of Artificial Sequence: Synthetic oligonucleotide
  Target: ATXN1; (-) strand; PAM type: YTN; PAM sequence: CTG
ggcaccatatgacaattcaa

SEQ ID NO: 187444 - DNA, 20 bp, Artificial Sequence
  Description of Artificial Sequence: Synthetic oligonucleotide
  Target: ATXN1; (-) strand; PAM type: YTN; PAM sequence: CTC
ctgggcaccatatgacaatt

SEQ ID NO: 187445 - DNA, 20 bp, Artificial Sequence
  Description of Artificial Sequence: Synthetic oligonucleotide
  Target: ATXN1; (-) strand; PAM type: YTN; PAM sequence: TTC
cacaagaccctcctgggcac

SEQ ID NO: 187446 - DNA, 20 bp, Artificial Sequence
  Description of Artificial Sequence: Synthetic oligonucleotide
  Target: ATXN1; (-) strand; PAM type: YTN; PAM sequence: TTT
ccacaagaccctcctgggca

SEQ ID NO: 187447 - DNA, 20 bp, Artificial Sequence
  Description of Artificial Sequence: Synthetic oligonucleotide
  Target: ATXN1; (-) strand; PAM type: YTN; PAM sequence: CTT
tccacaagaccctcctgggc

SEQ ID NO: 187448 - DNA, 20 bp, Artificial Sequence
  Description of Artificial Sequence: Synthetic oligonucleotide
  Target: ATXN1; (-) strand; PAM type: YTN; PAM sequence: CTA
ccatgaaaccctttccacaa

SEQ ID NO: 187449 - DNA, 20 bp, Artificial Sequence
  Description of Artificial Sequence: Synthetic oligonucleotide
  Target: ATXN1; (-) strand; PAM type: YTN; PAM sequence: TTC
actaccatgaaaccctttcc

SEQ ID NO: 187450 - DNA, 20 bp, Artificial Sequence
  Description of Artificial Sequence: Synthetic oligonucleotide
  Target: ATXN1; (-) strand; PAM type: YTN; PAM sequence: TTT
cactaccatgaaaccctttc

SEQ ID NO: 187451 - DNA, 20 bp, Artificial Sequence
  Description of Artificial Sequence: Synthetic oligonucleotide
  Target: ATXN1; (-) strand; PAM type: YTN; PAM sequence: CTT
tcactaccatgaaacccttt

SEQ ID NO: 187452 - DNA, 20 bp, Artificial Sequence
  Description of Artificial Sequence: Synthetic oligonucleotide
  Target: ATXN1; (-) strand; PAM type: YTN; PAM sequence: TTA
catctttcactaccatgaaa

SEQ ID NO: 187453 - DNA, 20 bp, Artificial Sequence
  Description of Artificial Sequence: Synthetic oligonucleotide
  Target: ATXN1; (-) strand; PAM type: YTN; PAM sequence: TTA
ttacatctttcactaccatg

SEQ ID NO: 187454 - DNA, 20 bp, Artificial Sequence
  Description of Artificial Sequence: Synthetic oligonucleotide
  Target: ATXN1; (-) strand; PAM type: YTN; PAM sequence: TTA
aaagaaaaaaagagttatta

SEQ ID NO: 187455 - DNA, 20 bp, Artificial Sequence
  Description of Artificial Sequence: Synthetic oligonucleotide
  Target: ATXN1; (-) strand; PAM type: YTN; PAM sequence: TTA
gggttaaaagaaaaaaagag

SEQ ID NO: 187456 - DNA, 20 bp, Artificial Sequence
  Description of Artificial Sequence: Synthetic oligonucleotide
  Target: ATXN1; (-) strand; PAM type: YTN; PAM sequence: CTT
agggttaaaagaaaaaaaga

SEQ ID NO: 187457 - DNA, 20 bp, Artificial Sequence
  Description of Artificial Sequence: Synthetic oligonucleotide
  Target: ATXN1; (-) strand; PAM type: YTN; PAM sequence: TTG
agcacagtcttagggttaaa

SEQ ID NO: 187458 - DNA, 20 bp, Artificial Sequence
  Description of Artificial Sequence: Synthetic oligonucleotide
  Target: ATXN1; (-) strand; PAM type: YTN; PAM sequence: TTA
aaacattgagcacagtctta

SEQ ID NO: 187459 - DNA, 20 bp, Artificial Sequence
  Description of Artificial Sequence: Synthetic oligonucleotide
  Target: ATXN1; (-) strand; PAM type: YTN; PAM sequence: TTT
aaaacattgagcacagtctt

SEQ ID NO: 187460 - DNA, 20 bp, Artificial Sequence
  Description of Artificial Sequence: Synthetic oligonucleotide
  Target: ATXN1; (-) strand; PAM type: YTN; PAM sequence: TTT
taaaacattgagcacagtct

SEQ ID NO: 187461 - DNA, 20 bp, Artificial Sequence
  Description of Artificial Sequence: Synthetic oligonucleotide
  Target: ATXN1; (-) strand; PAM type: YTN; PAM sequence: TTT
ttaaaacattgagcacagtc

SEQ ID NO: 187462 - DNA, 20 bp, Artificial Sequence
  Description of Artificial Sequence: Synthetic oligonucleotide
  Target: ATXN1; (-) strand; PAM type: YTN; PAM sequence: CTG
tttttaaaacattgagcaca

SEQ ID NO: 187463 - DNA, 20 bp, Artificial Sequence
  Description of Artificial Sequence: Synthetic oligonucleotide
  Target: ATXN1; (-) strand; PAM type: YTN; PAM sequence: TTA
caactgtttttaaaacattg

SEQ ID NO: 187464 - DNA, 20 bp, Artificial Sequence
  Description of Artificial Sequence: Synthetic oligonucleotide
  Target: ATXN1; (-) strand; PAM type: YTN; PAM sequence: TTT
acaactgtttttaaaacatt

SEQ ID NO: 187465 - DNA, 20 bp, Artificial Sequence
  Description of Artificial Sequence: Synthetic oligonucleotide
  Target: ATXN1; (-) strand; PAM type: YTN; PAM sequence: CTC
atttacaactgtttttaaaa

SEQ ID NO: 187466 - DNA, 20 bp, Artificial Sequence
  Description of Artificial Sequence: Synthetic oligonucleotide
  Target: ATXN1; (-) strand; PAM type: YTN; PAM sequence: CTA
cctcatttacaactgttttt

SEQ ID NO: 187467 - DNA, 20 bp, Artificial Sequence
  Description of Artificial Sequence: Synthetic oligonucleotide
  Target: ATXN1; (-) strand; PAM type: YTN; PAM sequence: TTG
gcactacctcatttacaact

SEQ ID NO: 187468 - DNA, 20 bp, Artificial Sequence
  Description of Artificial Sequence: Synthetic oligonucleotide
  Target: ATXN1; (-) strand; PAM type: YTN; PAM sequence: TTT
ggcactacctcatttacaac

SEQ ID NO: 187469 - DNA, 20 bp, Artificial Sequence
  Description of Artificial Sequence: Synthetic oligonucleotide
  Target: ATXN1; (-) strand; PAM type: YTN; PAM sequence: CTA
aaaatcaatgatttggcact

SEQ ID NO: 187470 - DNA, 20 bp, Artificial Sequence
  Description of Artificial Sequence: Synthetic oligonucleotide
  Target: ATXN1; (-) strand; PAM type: YTN; PAM sequence: TTC
ctaaaaatcaatgatttggc

SEQ ID NO: 187471 - DNA, 20 bp, Artificial Sequence
  Description of Artificial Sequence: Synthetic oligonucleotide
  Target: ATXN1; (-) strand; PAM type: YTN; PAM sequence: TTG
ggttcctaaaaatcaatgat

SEQ ID NO: 187472 - DNA, 20 bp, Artificial Sequence
  Description of Artificial Sequence: Synthetic oligonucleotide
  Target: ATXN1; (-) strand; PAM type: YTN; PAM sequence: CTT
gggttcctaaaaatcaatga

SEQ ID NO: 187473 - DNA, 20 bp, Artificial Sequence
  Description of Artificial Sequence: Synthetic oligonucleotide
  Target: ATXN1; (-) strand; PAM type: YTN; PAM sequence: TTC
ttgggttcctaaaaatcaat

SEQ ID NO: 187474 - DNA, 20 bp, Artificial Sequence
  Description of Artificial Sequence: Synthetic oligonucleotide
  Target: ATXN1; (-) strand; PAM type: YTN; PAM sequence: CTT
cttgggttcctaaaaatcaa

SEQ ID NO: 187475 - DNA, 20 bp, Artificial Sequence
  Description of Artificial Sequence: Synthetic oligonucleotide
  Target: ATXN1; (-) strand; PAM type: YTN; PAM sequence: TTA
ccttcttgggttcctaaaaa

SEQ ID NO: 187476 - DNA, 20 bp, Artificial Sequence
  Description of Artificial Sequence: Synthetic oligonucleotide
  Target: ATXN1; (-) strand; PAM type: YTN; PAM sequence: TTT
accttcttgggttcctaaaa

SEQ ID NO: 187477 - DNA, 20 bp, Artificial Sequence
  Description of Artificial Sequence: Synthetic oligonucleotide
  Target: ATXN1; (-) strand; PAM type: YTN; PAM sequence: TTT
taccttcttgggttcctaaa

SEQ ID NO: 187478 - DNA, 20 bp, Artificial Sequence
  Description of Artificial Sequence: Synthetic oligonucleotide
  Target: ATXN1; (-) strand; PAM type: YTN; PAM sequence: TTA
ttttaccttcttgggttcct

SEQ ID NO: 187479 - DNA, 20 bp, Artificial Sequence
  Description of Artificial Sequence: Synthetic oligonucleotide
  Target: ATXN1; (-) strand; PAM type: YTN; PAM sequence: TTT
attttaccttcttgggttcc

SEQ ID NO: 187480 - DNA, 20 bp, Artificial Sequence
  Description of Artificial Sequence: Synthetic oligonucleotide
  Target: ATXN1; (-) strand; PAM type: YTN; PAM sequence: TTG
aacgtttattttaccttctt

SEQ ID NO: 187481 - DNA, 20 bp, Artificial Sequence
  Description of Artificial Sequence: Synthetic oligonucleotide
  Target: ATXN1; (-) strand; PAM type: YTN; PAM sequence: TTA
gatgaggccaattgaacgtt

SEQ ID NO: 187482 - DNA, 20 bp, Artificial Sequence
  Description of Artificial Sequence: Synthetic oligonucleotide
  Target: ATXN1; (-) strand; PAM type: YTN; PAM sequence: CTT
agatgaggccaattgaacgt

SEQ ID NO: 187483 - DNA, 20 bp, Artificial Sequence
  Description of Artificial Sequence: Synthetic oligonucleotide
  Target: ATXN1; (-) strand; PAM type: YTN; PAM sequence: TTG
cataaagtatcagccttaga

SEQ ID NO: 187484 - DNA, 20 bp, Artificial Sequence
  Description of Artificial Sequence: Synthetic oligonucleotide
  Target: ATXN1; (-) strand; PAM type: YTN; PAM sequence: CTC
aagttgcataaagtatcagc

SEQ ID NO: 187485 - DNA, 20 bp, Artificial Sequence
  Description of Artificial Sequence: Synthetic oligonucleotide
  Target: ATXN1; (-) strand; PAM type: YTN; PAM sequence: CTA
agtgtctcaagttgcataaa

SEQ ID NO: 187486 - DNA, 20 bp, Artificial Sequence
  Description of Artificial Sequence: Synthetic oligonucleotide
  Target: ATXN1; (-) strand; PAM type: YTN; PAM sequence: TTA
ccctaagtgtctcaagttgc

SEQ ID NO: 187487 - DNA, 20 bp, Artificial Sequence
  Description of Artificial Sequence: Synthetic oligonucleotide
  Target: ATXN1; (-) strand; PAM type: YTN; PAM sequence: TTT
accctaagtgtctcaagttg

SEQ ID NO: 187488 - DNA, 20 bp, Artificial Sequence
  Description of Artificial Sequence: Synthetic oligonucleotide
  Target: ATXN1; (-) strand; PAM type: YTN; PAM sequence: TTT
taccctaagtgtctcaagtt

SEQ ID NO: 187489 - DNA, 20 bp, Artificial Sequence
  Description of Artificial Sequence: Synthetic oligonucleotide
  Target: ATXN1; (-) strand; PAM type: YTN; PAM sequence: TTT
ttaccctaagtgtctcaagt

SEQ ID NO: 187490 - DNA, 20 bp, Artificial Sequence
  Description of Artificial Sequence: Synthetic oligonucleotide
  Target: ATXN1; (-) strand; PAM type: YTN; PAM sequence: CTC
cagtggtggtttttacccta

SEQ ID NO: 187491 - DNA, 20 bp, Artificial Sequence
  Description of Artificial Sequence: Synthetic oligonucleotide
  Target: ATXN1; (-) strand; PAM type: YTN; PAM sequence: TTA
aatcacctccagtggtggtt

SEQ ID NO: 187492 - DNA, 20 bp, Artificial Sequence
  Description of Artificial Sequence: Synthetic oligonucleotide
  Target: ATXN1; (-) strand; PAM type: YTN; PAM sequence: TTG
agttaaatcacctccagtgg

SEQ ID NO: 187493 - DNA, 20 bp, Artificial Sequence
  Description of Artificial Sequence: Synthetic oligonucleotide
  Target: ATXN1; (-) strand; PAM type: YTN; PAM sequence: TTG
agaaaattgagttaaatcac

SEQ ID NO: 187494 - DNA, 20 bp, Artificial Sequence
  Description of Artificial Sequence: Synthetic oligonucleotide
  Target: ATXN1; (-) strand; PAM type: YTN; PAM sequence: CTT
gagaaaattgagttaaatca

SEQ ID NO: 187495 - DNA, 20 bp, Artificial Sequence
  Description of Artificial Sequence: Synthetic oligonucleotide
  Target: ATXN1; (-) strand; PAM type: YTN; PAM sequence: TTA
tgatggacaacttgagaaaa

SEQ ID NO: 187496 - DNA, 20 bp, Artificial Sequence
  Description of Artificial Sequence: Synthetic oligonucleotide
  Target: ATXN1; (-) strand; PAM type: YTN; PAM sequence: TTT
atgatggacaacttgagaaa

SEQ ID NO: 187497 - DNA, 20 bp, Artificial Sequence
  Description of Artificial Sequence: Synthetic oligonucleotide
  Target: ATXN1; (-) strand; PAM type: YTN; PAM sequence: TTT
tatgatggacaacttgagaa

SEQ ID NO: 187498 - DNA, 20 bp, Artificial Sequence
  Description of Artificial Sequence: Synthetic oligonucleotide
  Target: ATXN1; (-) strand; PAM type: YTN; PAM sequence: CTC
attttatgatggacaacttg

SEQ ID NO: 187499 - DNA, 20 bp, Artificial Sequence
  Description of Artificial Sequence: Synthetic oligonucleotide
  Target: ATXN1; (-) strand; PAM type: YTN; PAM sequence: CTA
ccatggggactcattttatg

SEQ ID NO: 187500 - DNA, 20 bp, Artificial Sequence
  Description of Artificial Sequence: Synthetic oligonucleotide
  Target: ATXN1; (-) strand; PAM type: YTN; PAM sequence: CTC
taccatggggactcatttta

SEQ ID NO: 187501 - DNA, 20 bp, Artificial Sequence
  Description of Artificial Sequence: Synthetic oligonucleotide
  Target: ATXN1; (-) strand; PAM type: YTN; PAM sequence: CTC
tctaccatggggactcattt

SEQ ID NO: 187502 - DNA, 20 bp, Artificial Sequence
  Description of Artificial Sequence: Synthetic oligonucleotide
  Target: ATXN1; (-) strand; PAM type: YTN; PAM sequence: TTG
ggtcctctctaccatgggga

SEQ ID NO: 187503 - DNA, 20 bp, Artificial Sequence
  Description of Artificial Sequence: Synthetic oligonucleotide
  Target: ATXN1; (-) strand; PAM type: YTN; PAM sequence: CTT
gggtcctctctaccatgggg

SEQ ID NO: 187504 - DNA, 20 bp, Artificial Sequence
  Description of Artificial Sequence: Synthetic oligonucleotide
  Target: ATXN1; (-) strand; PAM type: YTN; PAM sequence: TTA
gccatataaccttgggtcct

SEQ ID NO: 187505 - DNA, 20 bp, Artificial Sequence
  Description of Artificial Sequence: Synthetic oligonucleotide
  Target: ATXN1; (-) strand; PAM type: YTN; PAM sequence: TTG
ttagccatataaccttgggt

SEQ ID NO: 187506 - DNA, 20 bp, Artificial Sequence
  Description of Artificial Sequence: Synthetic oligonucleotide
  Target: ATXN1; (-) strand; PAM type: YTN; PAM sequence: CTG
ttgttagccatataaccttg

SEQ ID NO: 187507 - DNA, 20 bp, Artificial Sequence
  Description of Artificial Sequence: Synthetic oligonucleotide
  Target: ATXN1; (-) strand; PAM type: YTN; PAM sequence: TTA
tgcacaatgctgttgttagc

SEQ ID NO: 187508 - DNA, 20 bp, Artificial Sequence
  Description of Artificial Sequence: Synthetic oligonucleotide
  Target: ATXN1; (-) strand; PAM type: YTN; PAM sequence: TTT
atgcacaatgctgttgttag

SEQ ID NO: 187509 - DNA, 20 bp, Artificial Sequence
  Description of Artificial Sequence: Synthetic oligonucleotide
  Target: ATXN1; (-) strand; PAM type: YTN; PAM sequence: TTT
tatgcacaatgctgttgtta

SEQ ID NO: 187510 - DNA, 20 bp, Artificial Sequence
  Description of Artificial Sequence: Synthetic oligonucleotide
  Target: ATXN1; (-) strand; PAM type: YTN; PAM sequence: CTG
gattttatgcacaatgctgt

SEQ ID NO: 187511 - DNA, 20 bp, Artificial Sequence
  Description of Artificial Sequence: Synthetic oligonucleotide
  Target: ATXN1; (-) strand; PAM type: YTN; PAM sequence: TTA
gcagacctggattttatgca

SEQ ID NO: 187512 - DNA, 20 bp, Artificial Sequence
  Description of Artificial Sequence: Synthetic oligonucleotide
  Target: ATXN1; (-) strand; PAM type: YTN; PAM sequence: CTC
agagttagcagacctggatt

SEQ ID NO: 187513 - DNA, 20 bp, Artificial Sequence
  Description of Artificial Sequence: Synthetic oligonucleotide
  Target: ATXN1; (-) strand; PAM type: YTN; PAM sequence: CTG
aactcagagttagcagacct

SEQ ID NO: 187514 - DNA, 20 bp, Artificial Sequence
  Description of Artificial Sequence: Synthetic oligonucleotide
  Target: ATXN1; (-) strand; PAM type: YTN; PAM sequence: CTG
acactgaactcagagttagc

SEQ ID NO: 187515 - DNA, 20 bp, Artificial Sequence
  Description of Artificial Sequence: Synthetic oligonucleotide
  Target: ATXN1; (-) strand; PAM type: YTN; PAM sequence: TTG
tacaagaagagaatgatgct

SEQ ID NO: 187516 - DNA, 20 bp, Artificial Sequence
  Description of Artificial Sequence: Synthetic oligonucleotide
  Target: ATXN1; (-) strand; PAM type: YTN; PAM sequence: CTT
gtacaagaagagaatgatgc

SEQ ID NO: 187517 - DNA, 20 bp, Artificial Sequence
  Description of Artificial Sequence: Synthetic oligonucleotide
  Target: ATXN1; (-) strand; PAM type: YTN; PAM sequence: CTG
gggggaggggggatcttgta

SEQ ID NO: 187518 - DNA, 20 bp, Artificial Sequence
  Description of Artificial Sequence: Synthetic oligonucleotide
  Target: ATXN1; (-) strand; PAM type: YTN; PAM sequence: CTG
taagggctggggggaggggg

SEQ ID NO: 187519 - DNA, 20 bp, Artificial Sequence
  Description of Artificial Sequence: Synthetic oligonucleotide
  Target: ATXN1; (-) strand; PAM type: YTN; PAM sequence: CTG
gctgtaagggctggggggag

SEQ ID NO: 187520 - DNA, 20 bp, Artificial Sequence
  Description of Artificial Sequence: Synthetic oligonucleotide
  Target: ATXN1; (-) strand; PAM type: YTN; PAM sequence: TTC
agactggctgtaagggctgg

SEQ ID NO: 187521 - DNA, 20 bp, Artificial Sequence
  Description of Artificial Sequence: Synthetic oligonucleotide
  Target: ATXN1; (-) strand; PAM type: YTN; PAM sequence: TTT
cagactggctgtaagggctg

SEQ ID NO: 187522 - DNA, 20 bp, Artificial Sequence
  Description of Artificial Sequence: Synthetic oligonucleotide
  Target: ATXN1; (-) strand; PAM type: YTN; PAM sequence: CTG
aagatgtttcagactggctg

SEQ ID NO: 187523 - DNA, 20 bp, Artificial Sequence
  Description of Artificial Sequence: Synthetic oligonucleotide
  Target: ATXN1; (-) strand; PAM type: YTN; PAM sequence: TTG
cccctgaagatgtttcagac

SEQ ID NO: 187524 - DNA, 20 bp, Artificial Sequence
  Description of Artificial Sequence: Synthetic oligonucleotide
  Target: ATXN1; (-) strand; PAM type: YTN; PAM sequence: TTT
gcccctgaagatgtttcaga

SEQ ID NO: 187525 - DNA, 20 bp, Artificial Sequence
  Description of Artificial Sequence: Synthetic oligonucleotide
  Target: ATXN1; (-) strand; PAM type: YTN; PAM sequence: CTT
tgcccctgaagatgtttcag

SEQ ID NO: 187526 - DNA, 20 bp, Artificial Sequence
  Description of Artificial Sequence: Synthetic oligonucleotide
  Target: ATXN1; (-) strand; PAM type: YTN; PAM sequence: TTG
ccagcagatggcctttgccc

SEQ ID NO: 187527 - DNA, 20 bp, Artificial Sequence
  Description of Artificial Sequence: Synthetic oligonucleotide
  Target: ATXN1; (-) strand; PAM type: YTN; PAM sequence: CTT
gccagcagatggcctttgcc

SEQ ID NO: 187528 - DNA, 20 bp, Artificial Sequence
  Description of Artificial Sequence: Synthetic oligonucleotide
  Target: ATXN1; (-) strand; PAM type: YTN; PAM sequence: CTG
ccaccacttgccagcagatg

SEQ ID NO: 187529 - DNA, 20 bp, Artificial Sequence
  Description of Artificial Sequence: Synthetic oligonucleotide
  Target: ATXN1; (-) strand; PAM type: YTN; PAM sequence: CTC
aaatctgccaccacttgcca

SEQ ID NO: 187530 - DNA, 20 bp, Artificial Sequence
  Description of Artificial Sequence: Synthetic oligonucleotide
  Target: ATXN1; (-) strand; PAM type: YTN; PAM sequence: CTC
tcaaatctgccaccacttgc

SEQ ID NO: 187531 - DNA, 20 bp, Artificial Sequence
  Description of Artificial Sequence: Synthetic oligonucleotide
  Target: ATXN1; (-) strand; PAM type: YTN; PAM sequence: CTG
cctctcaaatctgccaccac

SEQ ID NO: 187532 - DNA, 20 bp, Artificial Sequence
  Description of Artificial Sequence: Synthetic oligonucleotide
  Target: ATXN1; (-) strand; PAM type: YTN; PAM sequence: TTA
actgcctctcaaatctgcca

SEQ ID NO: 187533 - DNA, 20 bp, Artificial Sequence
  Description of Artificial Sequence: Synthetic oligonucleotide
  Target: ATXN1; (-) strand; PAM type: YTN; PAM sequence: CTG
tgcatgtcccattaactgcc

SEQ ID NO: 187534 - DNA, 20 bp, Artificial Sequence
  Description of Artificial Sequence: Synthetic oligonucleotide
  Target: ATXN1; (-) strand; PAM type: YTN; PAM sequence: TTC
ctgtgcatgtcccattaact

SEQ ID NO: 187535 - DNA, 20 bp, Artificial Sequence
  Description of Artificial Sequence: Synthetic oligonucleotide
  Target: ATXN1; (-) strand; PAM type: YTN; PAM sequence: TTC
attcctgtgcatgtcccatt

SEQ ID NO: 187536 - DNA, 20 bp, Artificial Sequence
  Description of Artificial Sequence: Synthetic oligonucleotide
  Target: ATXN1; (-) strand; PAM type: YTN; PAM sequence: CTG
gcattcattcctgtgcatgt

SEQ ID NO: 187537 - DNA, 20 bp, Artificial Sequence
  Description of Artificial Sequence: Synthetic oligonucleotide
  Target: ATXN1; (-) strand; PAM type: YTN; PAM sequence: CTC
ctggcattcattcctgtgca

SEQ ID NO: 187538 - DNA, 20 bp, Artificial Sequence
  Description of Artificial Sequence: Synthetic oligonucleotide
  Target: ATXN1; (-) strand; PAM type: YTN; PAM sequence: TTA
ctcctggcattcattcctgt

SEQ ID NO: 187539 - DNA, 20 bp, Artificial Sequence
  Description of Artificial Sequence: Synthetic oligonucleotide
  Target: ATXN1; (-) strand; PAM type: YTN; PAM sequence: TTG
cagatgttactcctggcatt

SEQ ID NO: 187540 - DNA, 20 bp, Artificial Sequence
  Description of Artificial Sequence: Synthetic oligonucleotide
  Target: ATXN1; (-) strand; PAM type: YTN; PAM sequence: CTT
gcagatgttactcctggcat

SEQ ID NO: 187541 - DNA, 20 bp, Artificial Sequence
  Description of Artificial Sequence: Synthetic oligonucleotide
  Target: ATXN1; (-) strand; PAM type: YTN; PAM sequence: CTC
agcagtccttgcagatgtta

SEQ ID NO: 187542 - DNA, 20 bp, Artificial Sequence
  Description of Artificial Sequence: Synthetic oligonucleotide
  Target: ATXN1; (-) strand; PAM type: YTN; PAM sequence: TTC
ccatgctcagcagtccttgc

SEQ ID NO: 187543 - DNA, 20 bp, Artificial Sequence
  Description of Artificial Sequence: Synthetic oligonucleotide
  Target: ATXN1; (-) strand; PAM type: YTN; PAM sequence: TTG
gaagtagtggttcccatgct

SEQ ID NO: 187544 - DNA, 20 bp, Artificial Sequence
  Description of Artificial Sequence: Synthetic oligonucleotide
  Target: ATXN1; (-) strand; PAM type: YTN; PAM sequence: CTA
ggagtgggtgtataaatgtg

SEQ ID NO: 187545 - DNA, 20 bp, Artificial Sequence
  Description of Artificial Sequence: Synthetic oligonucleotide
  Target: ATXN1; (-) strand; PAM type: YTN; PAM sequence: TTG
cacataaacagggtctagga

SEQ ID NO: 187546 - DNA, 20 bp, Artificial Sequence
  Description of Artificial Sequence: Synthetic oligonucleotide
  Target: ATXN1; (-) strand; PAM type: YTN; PAM sequence: TTT
gcacataaacagggtctagg

SEQ ID NO: 187547 - DNA, 20 bp, Artificial Sequence
  Description of Artificial Sequence: Synthetic oligonucleotide
  Target: ATXN1; (-) strand; PAM type: YTN; PAM sequence: TTC
aaagaatgcatgtttgcaca

SEQ ID NO: 187548 - DNA, 20 bp, Artificial Sequence
  Description of Artificial Sequence: Synthetic oligonucleotide
  Target: ATXN1; (-) strand; PAM type: YTN; PAM sequence: TTT
caaagaatgcatgtttgcac

SEQ ID NO: 187549 - DNA, 20 bp, Artificial Sequence
  Description of Artificial Sequence: Synthetic oligonucleotide
  Target: ATXN1; (-) strand; PAM type: YTN; PAM sequence: TTT
tcaaagaatgcatgtttgca

SEQ ID NO: 187550 - DNA, 20 bp, Artificial Sequence
  Description of Artificial Sequence: Synthetic oligonucleotide
  Target: ATXN1; (-) strand; PAM type: YTN; PAM sequence: TTG
cagtagagaaggcaggcaat

SEQ ID NO: 187551 - DNA, 20 bp, Artificial Sequence
  Description of Artificial Sequence: Synthetic oligonucleotide
  Target: ATXN1; (-) strand; PAM type: YTN; PAM sequence: CTG
ttgcagtagagaaggcaggc

SEQ ID NO: 187552 - DNA, 20 bp, Artificial Sequence
  Description of Artificial Sequence: Synthetic oligonucleotide
  Target: ATXN1; (-) strand; PAM type: YTN; PAM sequence: CTG
tgccatggagaactgttgca

SEQ ID NO: 187553 - DNA, 20 bp, Artificial Sequence
  Description of Artificial Sequence: Synthetic oligonucleotide
  Target: ATXN1; (-) strand; PAM type: YTN; PAM sequence: CTG
catgccccaaagcctgtgcc

SEQ ID NO: 187554 - DNA, 20 bp, Artificial Sequence
  Description of Artificial Sequence: Synthetic oligonucleotide
  Target: ATXN1; (-) strand; PAM type: YTN; PAM sequence: TTA
gtgtcctgcatgccccaaag

SEQ ID NO: 187555 - DNA, 20 bp, Artificial Sequence
  Description of Artificial Sequence: Synthetic oligonucleotide
  Target: ATXN1; (-) strand; PAM type: YTN; PAM sequence: TTT
agtgtcctgcatgccccaaa

SEQ ID NO: 187556 - DNA, 20 bp, Artificial Sequence
  Description of Artificial Sequence: Synthetic oligonucleotide
  Target: ATXN1; (-) strand; PAM type: YTN; PAM sequence: CTG
ggtttagtgtcctgcatgcc

SEQ ID NO: 187557 - DNA, 20 bp, Artificial Sequence
  Description of Artificial Sequence: Synthetic oligonucleotide
  Target: ATXN1; (-) strand; PAM type: YTN; PAM sequence: TTC
ctgggtttagtgtcctgcat

SEQ ID NO: 187558 - DNA, 20 bp, Artificial Sequence
  Description of Artificial Sequence: Synthetic oligonucleotide
  Target: ATXN1; (-) strand; PAM type: YTN; PAM sequence: CTT
cctgggtttagtgtcctgca

SEQ ID NO: 187559 - DNA, 20 bp, Artificial Sequence
  Description of Artificial Sequence: Synthetic oligonucleotide
  Target: ATXN1; (-) strand; PAM type: YTN; PAM sequence: CTG
tcttcctgggtttagtgtcc

SEQ ID NO: 187560 - DNA, 20 bp, Artificial Sequence
  Description of Artificial Sequence: Synthetic oligonucleotide
  Target: ATXN1; (-) strand; PAM type: YTN; PAM sequence: TTC
tgtcttcctgggtttagtgt

SEQ ID NO: 187561 - DNA, 20 bp, Artificial Sequence
  Description of Artificial Sequence: Synthetic oligonucleotide
  Target: ATXN1; (-) strand; PAM type: YTN; PAM sequence: TTT
ctgtcttcctgggtttagtg

SEQ ID NO: 187562 - DNA, 20 bp, Artificial Sequence
  Description of Artificial Sequence: Synthetic oligonucleotide
  Target: ATXN1; (-) strand; PAM type: YTN; PAM sequence: TTT
tctgtcttcctgggtttagt

SEQ ID NO: 187563 - DNA, 20 bp, Artificial Sequence
  Description of Artificial Sequence: Synthetic oligonucleotide
  Target: ATXN1; (-) strand; PAM type: YTN; PAM sequence: CTG
gttttctgtcttcctgggtt

SEQ ID NO: 187564 - DNA, 20 bp, Artificial Sequence
  Description of Artificial Sequence: Synthetic oligonucleotide
  Target: ATXN1; (-) strand; PAM type: YTN; PAM sequence: TTA
caacactggttttctgtctt

SEQ ID NO: 187565 - DNA, 20 bp, Artificial Sequence
  Description of Artificial Sequence: Synthetic oligonucleotide
  Target: ATXN1; (-) strand; PAM type: YTN; PAM sequence: TTT
acaacactggttttctgtct

SEQ ID NO: 187566 - DNA, 20 bp, Artificial Sequence
  Description of Artificial Sequence: Synthetic oligonucleotide
  Target: ATXN1; (-) strand; PAM type: YTN; PAM sequence: CTG
ggcacatgtttacaacactg

SEQ ID NO: 187567 - DNA, 20 bp, Artificial Sequence
  Description of Artificial Sequence: Synthetic oligonucleotide
  Target: ATXN1; (-) strand; PAM type: YTN; PAM sequence: TTA
tctgggcacatgtttacaac

SEQ ID NO: 187568 - DNA, 20 bp, Artificial Sequence
  Description of Artificial Sequence: Synthetic oligonucleotide
  Target: ATXN1; (-) strand; PAM type: YTN; PAM sequence: TTC
attatctgggcacatgttta

SEQ ID NO: 187569 - DNA, 20 bp, Artificial Sequence
  Description of Artificial Sequence: Synthetic oligonucleotide
  Target: ATXN1; (-) strand; PAM type: YTN; PAM sequence: TTT
cattatctgggcacatgttt

SEQ ID NO: 187570 - DNA, 20 bp, Artificial Sequence
  Description of Artificial Sequence: Synthetic oligonucleotide
  Target: ATXN1; (-) strand; PAM type: YTN; PAM sequence: CTT
tcattatctgggcacatgtt

SEQ ID NO: 187571 - DNA, 20 bp, Artificial Sequence
  Description of Artificial Sequence: Synthetic oligonucleotide
  Target: ATXN1; (-) strand; PAM type: YTN; PAM sequence: TTG
gtaacctttcattatctggg

SEQ ID NO: 187572 - DNA, 20 bp, Artificial Sequence
  Description of Artificial Sequence: Synthetic oligonucleotide
  Target: ATXN1; (-) strand; PAM type: YTN; PAM sequence: CTG
tgatgttggtaacctttcat

SEQ ID NO: 187573 - DNA, 20 bp, Artificial Sequence
  Description of Artificial Sequence: Synthetic oligonucleotide
  Target: ATXN1; (-) strand; PAM type: YTN; PAM sequence: TTA
gtaaactgtgatgttggtaa

SEQ ID NO: 187574 - DNA, 20 bp, Artificial Sequence
  Description of Artificial Sequence: Synthetic oligonucleotide
  Target: ATXN1; (-) strand; PAM type: YTN; PAM sequence: CTT
agtaaactgtgatgttggta

SEQ ID NO: 187575 - DNA, 20 bp, Artificial Sequence
  Description of Artificial Sequence: Synthetic oligonucleotide
  Target: ATXN1; (-) strand; PAM type: YTN; PAM sequence: TTC
ttagtaaactgtgatgttgg

SEQ ID NO: 187576 - DNA, 20 bp, Artificial Sequence
  Description of Artificial Sequence: Synthetic oligonucleotide
  Target: ATXN1; (-) strand; PAM type: YTN; PAM sequence: TTT
cttagtaaactgtgatgttg

SEQ ID NO: 187577 - DNA, 20 bp, Artificial Sequence
  Description of Artificial Sequence: Synthetic oligonucleotide
  Target: ATXN1; (-) strand; PAM type: YTN; PAM sequence: TTT
tcttagtaaactgtgatgtt

SEQ ID NO: 187578 - DNA, 20 bp, Artificial Sequence
  Description of Artificial Sequence: Synthetic oligonucleotide
  Target: ATXN1; (-) strand; PAM type: YTN; PAM sequence: CTA
gttttcttagtaaactgtga

SEQ ID NO: 187579 - DNA, 20 bp, Artificial Sequence
  Description of Artificial Sequence: Synthetic oligonucleotide
  Target: ATXN1; (-) strand; PAM type: YTN; PAM sequence: TTC
ctagttttcttagtaaactg

SEQ ID NO: 187580 - DNA, 20 bp, Artificial Sequence
  Description of Artificial Sequence: Synthetic oligonucleotide
  Target: ATXN1; (-) strand; PAM type: YTN; PAM sequence: TTG
gtaggggcagtggggggttc

SEQ ID NO: 187581 - DNA, 20 bp, Artificial Sequence
  Description of Artificial Sequence: Synthetic oligonucleotide
  Target: ATXN1; (-) strand; PAM type: YTN; PAM sequence: CTT
ggtaggggcagtggggggtt

SEQ ID NO: 187582 - DNA, 20 bp, Artificial Sequence
  Description of Artificial Sequence: Synthetic oligonucleotide
  Target: ATXN1; (-) strand; PAM type: YTN; PAM sequence: TTG
cttggtaggggcagtggggg

SEQ ID NO: 187583 - DNA, 20 bp, Artificial Sequence
  Description of Artificial Sequence: Synthetic oligonucleotide
  Target: ATXN1; (-) strand; PAM type: YTN; PAM sequence: TTT
gcttggtaggggcagtgggg

SEQ ID NO: 187584 - DNA, 20 bp, Artificial Sequence
  Description of Artificial Sequence: Synthetic oligonucleotide
  Target: ATXN1; (-) strand; PAM type: YTN; PAM sequence: TTC
aaaaccgcatttgcttggta

SEQ ID NO: 187585 - DNA, 20 bp, Artificial Sequence
  Description of Artificial Sequence: Synthetic oligonucleotide
  Target: ATXN1; (-) strand; PAM type: YTN; PAM sequence: TTT
caaaaccgcatttgcttggt

SEQ ID NO: 187586 - DNA, 20 bp, Artificial Sequence
  Description of Artificial Sequence: Synthetic oligonucleotide
  Target: ATXN1; (-) strand; PAM type: YTN; PAM sequence: TTT
tcaaaaccgcatttgcttgg

SEQ ID NO: 187587 - DNA, 20 bp, Artificial Sequence
  Description of Artificial Sequence: Synthetic oligonucleotide
  Target: ATXN1; (-) strand; PAM type: YTN; PAM sequence: CTT
ttcaaaaccgcatttgcttg

SEQ ID NO: 187588 - DNA, 20 bp, Artificial Sequence
  Description of Artificial Sequence: Synthetic oligonucleotide
  Target: ATXN1; (-) strand; PAM type: YTN; PAM sequence: TTC
ttttcaaaaccgcatttgct

SEQ ID NO: 187589 - DNA, 20 bp, Artificial Sequence
  Description of Artificial Sequence: Synthetic oligonucleotide
  Target: ATXN1; (-) strand; PAM type: YTN; PAM sequence: TTT
cttttcaaaaccgcatttgc

SEQ ID NO: 187590 - DNA, 20 bp, Artificial Sequence
  Description of Artificial Sequence: Synthetic oligonucleotide
  Target: ATXN1; (-) strand; PAM type: YTN; PAM sequence: CTT
tcttttcaaaaccgcatttg

SEQ ID NO: 187591 - DNA, 20 bp, Artificial Sequence
  Description of Artificial Sequence: Synthetic oligonucleotide
  Target: ATXN1; (-) strand; PAM type: YTN; PAM sequence: CTA
agtactttcttttcaaaacc

SEQ ID NO: 187592 - DNA, 20 bp, Artificial Sequence
  Description of Artificial Sequence: Synthetic oligonucleotide
  Target: ATXN1; (-) strand; PAM type: YTN; PAM sequence: TTG
tgcatgctaagtactttctt

SEQ ID NO: 187593 - DNA, 20 bp, Artificial Sequence
  Description of Artificial Sequence: Synthetic oligonucleotide
  Target: ATXN1; (-) strand; PAM type: YTN; PAM sequence: TTT
gtgcatgctaagtactttct

SEQ ID NO: 187594 - DNA, 20 bp, Artificial Sequence
  Description of Artificial Sequence: Synthetic oligonucleotide
  Target: ATXN1; (-) strand; PAM type: YTN; PAM sequence: CTT
tgtgcatgctaagtactttc

SEQ ID NO: 187595 - DNA, 20 bp, Artificial Sequence
  Description of Artificial Sequence: Synthetic oligonucleotide
  Target: ATXN1; (-) strand; PAM type: YTN; PAM sequence: CTC
tttgtgcatgctaagtactt

SEQ ID NO: 187596 - DNA, 20 bp, Artificial Sequence
  Description of Artificial Sequence: Synthetic oligonucleotide
  Target: ATXN1; (-) strand; PAM type: YTN; PAM sequence: CTA
gtgaactctttgtgcatgct

SEQ ID NO: 187597 - DNA, 20 bp, Artificial Sequence
  Description of Artificial Sequence: Synthetic oligonucleotide
  Target: ATXN1; (-) strand; PAM type: YTN; PAM sequence: TTC
tagtgaactctttgtgcatg

SEQ ID NO: 187598 - DNA, 20 bp, Artificial Sequence
  Description of Artificial Sequence: Synthetic oligonucleotide
  Target: ATXN1; (-) strand; PAM type: YTN; PAM sequence: TTG
agagagcaaggaaataccaa

SEQ ID NO: 187599 - DNA, 20 bp, Artificial Sequence
  Description of Artificial Sequence: Synthetic oligonucleotide
  Target: ATXN1; (-) strand; PAM type: YTN; PAM sequence: CTG
taaatggagtgtgttgagag

SEQ ID NO: 187600 - DNA, 20 bp, Artificial Sequence
  Description of Artificial Sequence: Synthetic oligonucleotide
  Target: ATXN1; (-) strand; PAM type: YTN; PAM sequence: TTC
tgtaaatggagtgtgttgag

SEQ ID NO: 187601 - DNA, 20 bp, Artificial Sequence
  Description of Artificial Sequence: Synthetic oligonucleotide
  Target: ATXN1; (-) strand; PAM type: YTN; PAM sequence: CTT
ctgtaaatggagtgtgttga

SEQ ID NO: 187602 - DNA, 20 bp, Artificial Sequence
  Description of Artificial Sequence: Synthetic oligonucleotide
  Target: ATXN1; (-) strand; PAM type: YTN; PAM sequence: TTA
aaatccttctgtaaatggag

SEQ ID NO: 187603 - DNA, 20 bp, Artificial Sequence
  Description of Artificial Sequence: Synthetic oligonucleotide
  Target: ATXN1; (-) strand; PAM type: YTN; PAM sequence: TTT
aaaatccttctgtaaatgga

SEQ ID NO: 187604 - DNA, 20 bp, Artificial Sequence
  Description of Artificial Sequence: Synthetic oligonucleotide
  Target: ATXN1; (-) strand; PAM type: YTN; PAM sequence: TTT
taaaatccttctgtaaatgg

SEQ ID NO: 187605 - DNA, 20 bp, Artificial Sequence
  Description of Artificial Sequence: Synthetic oligonucleotide
  Target: ATXN1; (-) strand; PAM type: YTN; PAM sequence: TTG
aagtaattttaaaatccttc

SEQ ID NO: 187606 - DNA, 20 bp, Artificial Sequence
  Description of Artificial Sequence: Synthetic oligonucleotide
  Target: ATXN1; (-) strand; PAM type: YTN; PAM sequence: CTT
gaagtaattttaaaatcctt

SEQ ID NO: 187607 - DNA, 20 bp, Artificial Sequence
  Description of Artificial Sequence: Synthetic oligonucleotide
  Target: ATXN1; (-) strand; PAM type: YTN; PAM sequence: TTA
agatgccacatggcagactt

SEQ ID NO: 187608 - DNA, 20 bp, Artificial Sequence
  Description of Artificial Sequence: Synthetic oligonucleotide
  Target: ATXN1; (-) strand; PAM type: YTN; PAM sequence: TTT
aagatgccacatggcagact

SEQ ID NO: 187609 - DNA, 20 bp, Artificial Sequence
  Description of Artificial Sequence: Synthetic oligonucleotide
  Target: ATXN1; (-) strand; PAM type: YTN; PAM sequence: CTT
taagatgccacatggcagac

SEQ ID NO: 187610 - DNA, 20 bp, Artificial Sequence
  Description of Artificial Sequence: Synthetic oligonucleotide
  Target: ATXN1; (-) strand; PAM type: YTN; PAM sequence: CTG
aagtgtacactttaagatgc

SEQ ID NO: 187611 - DNA, 20 bp, Artificial Sequence
  Description of Artificial Sequence: Synthetic oligonucleotide
  Target: ATXN1; (-) strand; PAM type: YTN; PAM sequence: TTC
tgaagtgtacactttaagat

SEQ ID NO: 187612 - DNA, 20 bp, Artificial Sequence
  Description of Artificial Sequence: Synthetic oligonucleotide
  Target: ATXN1; (-) strand; PAM type: YTN; PAM sequence: CTT
ctgaagtgtacactttaaga

SEQ ID NO: 187613 - DNA, 20 bp, Artificial Sequence
  Description of Artificial Sequence: Synthetic oligonucleotide
  Target: ATXN1; (-) strand; PAM type: YTN; PAM sequence: TTC
aaaggacttctgaagtgtac

SEQ ID NO: 187614 - DNA, 20 bp, Artificial Sequence
  Description of Artificial Sequence: Synthetic oligonucleotide
  Target: ATXN1; (-) strand; PAM type: YTN; PAM sequence: TTT
caaaggacttctgaagtgta

SEQ ID NO: 187615 - DNA, 20 bp, Artificial Sequence
  Description of Artificial Sequence: Synthetic oligonucleotide
  Target: ATXN1; (-) strand; PAM type: YTN; PAM sequence: TTT
tcaaaggacttctgaagtgt

SEQ ID NO: 187616 - DNA, 20 bp, Artificial Sequence
  Description of Artificial Sequence: Synthetic oligonucleotide
  Target: ATXN1; (-) strand; PAM type: YTN; PAM sequence: TTG
agtgaggttttcaaaggact

SEQ ID NO: 187617 - DNA, 20 bp, Artificial Sequence
  Description of Artificial Sequence: Synthetic oligonucleotide
  Target: ATXN1; (-) strand; PAM type: YTN; PAM sequence: CTC
aaagattgagtgaggttttc

SEQ ID NO: 187618 - DNA, 20 bp, Artificial Sequence
  Description of Artificial Sequence: Synthetic oligonucleotide
  Target: ATXN1; (-) strand; PAM type: YTN; PAM sequence: CTG
tcagacctcaaagattgagt

SEQ ID NO: 187619 - DNA, 20 bp, Artificial Sequence
  Description of Artificial Sequence: Synthetic oligonucleotide
  Target: ATXN1; (-) strand; PAM type: YTN; PAM sequence: TTC
atgtgacaccctgtcagacc

SEQ ID NO: 187620 - DNA, 20 bp, Artificial Sequence
  Description of Artificial Sequence: Synthetic oligonucleotide
  Target: ATXN1; (-) strand; PAM type: YTN; PAM sequence: CTG
ttcatgtgacaccctgtcag

SEQ ID NO: 187621 - DNA, 20 bp, Artificial Sequence
  Description of Artificial Sequence: Synthetic oligonucleotide
  Target: ATXN1; (-) strand; PAM type: YTN; PAM sequence: TTG
aactgttcatgtgacaccct

SEQ ID NO: 187622 - DNA, 20 bp, Artificial Sequence
  Description of Artificial Sequence: Synthetic oligonucleotide
  Target: ATXN1; (-) strand; PAM type: YTN; PAM sequence: TTT
gaactgttcatgtgacaccc

SEQ ID NO: 187623 - DNA, 20 bp, Artificial Sequence
  Description of Artificial Sequence: Synthetic oligonucleotide
  Target: ATXN1; (-) strand; PAM type: YTN; PAM sequence: CTT
tgaactgttcatgtgacacc

SEQ ID NO: 187624 - DNA, 20 bp, Artificial Sequence
  Description of Artificial Sequence: Synthetic oligonucleotide
  Target: ATXN1; (-) strand; PAM type: YTN; PAM sequence: TTG
ctttgaactgttcatgtgac

SEQ ID NO: 187625 - DNA, 20 bp, Artificial Sequence
  Description of Artificial Sequence: Synthetic oligonucleotide
  Target: ATXN1; (-) strand; PAM type: YTN; PAM sequence: TTA
accgttgctttgaactgttc

SEQ ID NO: 187626 - DNA, 20 bp, Artificial Sequence
  Description of Artificial Sequence: Synthetic oligonucleotide
  Target: ATXN1; (-) strand; PAM type: YTN; PAM sequence: TTT
aaccgttgctttgaactgtt

SEQ ID NO: 187627 - DNA, 20 bp, Artificial Sequence
  Description of Artificial Sequence: Synthetic oligonucleotide
  Target: ATXN1; (-) strand; PAM type: YTN; PAM sequence: TTT
taaccgttgctttgaactgt

SEQ ID NO: 187628 - DNA, 20 bp, Artificial Sequence
  Description of Artificial Sequence: Synthetic oligonucleotide
  Target: ATXN1; (-) strand; PAM type: YTN; PAM sequence: TTG
ttttaaccgttgctttgaac

SEQ ID NO: 187629 - DNA, 20 bp, Artificial Sequence
  Description of Artificial Sequence: Synthetic oligonucleotide
  Target: ATXN1; (-) strand; PAM type: YTN; PAM sequence: TTG
ttgttttaaccgttgctttg

SEQ ID NO: 187630 - DNA, 20 bp, Artificial Sequence
  Description of Artificial Sequence: Synthetic oligonucleotide
  Target: ATXN1; (-) strand; PAM type: YTN; PAM sequence: TTG
ttgttgttttaaccgttgct

SEQ ID NO: 187631 - DNA, 20 bp, Artificial Sequence
  Description of Artificial Sequence: Synthetic oligonucleotide
  Target: ATXN1; (-) strand; PAM type: YTN; PAM sequence: TTT
gttgttgttttaaccgttgc

SEQ ID NO: 187632 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttttaaccgttg

SEQ ID NO: 187633 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttttaaccgtt

SEQ ID NO: 187634 - DNA, 20 bp, Artificial Sequence
  Description of Artificial Sequence: Synthetic oligonucleotide
  Target: ATXN1; (-) strand; PAM type: YTN; PAM sequence: TTT
tttgttgttgttttaaccgt

SEQ ID NO: 187635 - DNA, 20 bp, Artificial Sequence
  Description of Artificial Sequence: Synthetic oligonucleotide
  Target: ATXN1; (-) strand; PAM type: YTN; PAM sequence: CTA
gtgggggttttttgttgttg

SEQ ID NO: 187636 - DNA, 20 bp, Artificial Sequence
  Description of Artificial Sequence: Synthetic oligonucleotide
  Target: ATXN1; (-) strand; PAM type: YTN; PAM sequence: TTC
aaatctagtgggggtttttt

SEQ ID NO: 187637 - DNA, 20 bp, Artificial Sequence
  Description of Artificial Sequence: Synthetic oligonucleotide
  Target: ATXN1; (-) strand; PAM type: YTN; PAM sequence: TTT
caaatctagtgggggttttt

SEQ ID NO: 187638 - DNA, 20 bp, Artificial Sequence
  Description of Artificial Sequence: Synthetic oligonucleotide
  Target: ATXN1; (-) strand; PAM type: YTN; PAM sequence: TTG
tttcaaatctagtgggggtt

SEQ ID NO: 187639 - DNA, 20 bp, Artificial Sequence
  Description of Artificial Sequence: Synthetic oligonucleotide
  Target: ATXN1; (-) strand; PAM type: YTN; PAM sequence: TTT
gtttcaaatctagtgggggt

SEQ ID NO: 187640 - DNA, 20 bp, Artificial Sequence
  Description of Artificial Sequence: Synthetic oligonucleotide
  Target: ATXN1; (-) strand; PAM type: YTN; PAM sequence: TTT
tgtttcaaatctagtggggg

SEQ ID NO: 187641 - DNA, 20 bp, Artificial Sequence
  Description of Artificial Sequence: Synthetic oligonucleotide
  Target: ATXN1; (-) strand; PAM type: YTN; PAM sequence: CTT
ttgtttcaaatctagtgggg

SEQ ID NO: 187642 - DNA, 20 bp, Artificial Sequence
  Description of Artificial Sequence: Synthetic oligonucleotide
  Target: ATXN1; (-) strand; PAM type: YTN; PAM sequence: TTA
ccataatcaagatagctttt

SEQ ID NO: 187643 - DNA, 20 bp, Artificial Sequence
  Description of Artificial Sequence: Synthetic oligonucleotide
  Target: ATXN1; (-) strand; PAM type: YTN; PAM sequence: CTC
atgcagttaccataatcaag

SEQ ID NO: 187644 - DNA, 20 bp, Artificial Sequence
  Description of Artificial Sequence: Synthetic oligonucleotide
  Target: ATXN1; (-) strand; PAM type: YTN; PAM sequence: TTA
aataactcatgcagttacca

SEQ ID NO: 187645 - DNA, 20 bp, Artificial Sequence
  Description of Artificial Sequence: Synthetic oligonucleotide
  Target: ATXN1; (-) strand; PAM type: YTN; PAM sequence: TTT
aaataactcatgcagttacc

SEQ ID NO: 187646 - DNA, 20 bp, Artificial Sequence
  Description of Artificial Sequence: Synthetic oligonucleotide
  Target: ATXN1; (-) strand; PAM type: YTN; PAM sequence: CTA
tttaaataactcatgcagtt

SEQ ID NO: 187647 - DNA, 20 bp, Artificial Sequence
  Description of Artificial Sequence: Synthetic oligonucleotide
  Target: ATXN1; (-) strand; PAM type: YTN; PAM sequence: CTC
tatttaaataactcatgcag

SEQ ID NO: 187648 - DNA, 20 bp, Artificial Sequence
  Description of Artificial Sequence: Synthetic oligonucleotide
  Target: ATXN1; (-) strand; PAM type: YTN; PAM sequence: TTC
aggctctatttaaataactc

SEQ ID NO: 187649 - DNA, 20 bp, Artificial Sequence
  Description of Artificial Sequence: Synthetic oligonucleotide
  Target: ATXN1; (-) strand; PAM type: YTN; PAM sequence: TTT
caggctctatttaaataact

SEQ ID NO: 187650 - DNA, 20 bp, Artificial Sequence
  Description of Artificial Sequence: Synthetic oligonucleotide
  Target: ATXN1; (-) strand; PAM type: YTN; PAM sequence: TTA
ggtttcaggctctatttaaa

SEQ ID NO: 187651 - DNA, 20 bp, Artificial Sequence
  Description of Artificial Sequence: Synthetic oligonucleotide
  Target: ATXN1; (-) strand; PAM type: YTN; PAM sequence: TTT
aggtttcaggctctatttaa

SEQ ID NO: 187652 - DNA, 20 bp, Artificial Sequence
  Description of Artificial Sequence: Synthetic oligonucleotide
  Target: ATXN1; (-) strand; PAM type: YTN; PAM sequence: CTT
taggtttcaggctctattta

SEQ ID NO: 187653 - DNA, 20 bp, Artificial Sequence
  Description of Artificial Sequence: Synthetic oligonucleotide
  Target: ATXN1; (-) strand; PAM type: YTN; PAM sequence: CTG
ctttaggtttcaggctctat

SEQ ID NO: 187654 - DNA, 20 bp, Artificial Sequence
  Description of Artificial Sequence: Synthetic oligonucleotide
  Target: ATXN1; (-) strand; PAM type: YTN; PAM sequence: TTA
tgtaaaactgctttaggttt

SEQ ID NO: 187655 - DNA, 20 bp, Artificial Sequence
  Description of Artificial Sequence: Synthetic oligonucleotide
  Target: ATXN1; (-) strand; PAM type: YTN; PAM sequence: CTT
atgtaaaactgctttaggtt

SEQ ID NO: 187656 - DNA, 20 bp, Artificial Sequence
  Description of Artificial Sequence: Synthetic oligonucleotide
  Target: ATXN1; (-) strand; PAM type: YTN; PAM sequence: CTA
ggaaacaagtgtcttatgta

SEQ ID NO: 187657 - DNA, 20 bp, Artificial Sequence
  Description of Artificial Sequence: Synthetic oligonucleotide
  Target: ATXN1; (-) strand; PAM type: YTN; PAM sequence: TTA
tcctaggaaacaagtgtctt

SEQ ID NO: 187658 - DNA, 20 bp, Artificial Sequence
  Description of Artificial Sequence: Synthetic oligonucleotide
  Target: ATXN1; (-) strand; PAM type: YTN; PAM sequence: TTT
atcctaggaaacaagtgtct

SEQ ID NO: 187659 - DNA, 20 bp, Artificial Sequence
  Description of Artificial Sequence: Synthetic oligonucleotide
  Target: ATXN1; (-) strand; PAM type: YTN; PAM sequence: TTT
tatcctaggaaacaagtgtc

SEQ ID NO: 187660 - DNA, 20 bp, Artificial Sequence
  Description of Artificial Sequence: Synthetic oligonucleotide
  Target: ATXN1; (-) strand; PAM type: YTN; PAM sequence: TTT
ttatcctaggaaacaagtgt

SEQ ID NO: 187661 - DNA, 20 bp, Artificial Sequence
  Description of Artificial Sequence: Synthetic oligonucleotide
  Target: ATXN1; (-) strand; PAM type: YTN; PAM sequence: TTA
aagcatttttatcctaggaa

SEQ ID NO: 187662 - DNA, 20 bp, Artificial Sequence
  Description of Artificial Sequence: Synthetic oligonucleotide
  Target: ATXN1; (-) strand; PAM type: YTN; PAM sequence: TTT
aaagcatttttatcctagga

SEQ ID NO: 187663 - DNA, 20 bp, Artificial Sequence
  Description of Artificial Sequence: Synthetic oligonucleotide
  Target: ATXN1; (-) strand; PAM type: YTN; PAM sequence: TTT
taaagcatttttatcctagg

SEQ ID NO: 187664 - DNA, 20 bp, Artificial Sequence
  Description of Artificial Sequence: Synthetic oligonucleotide
  Target: ATXN1; (-) strand; PAM type: YTN; PAM sequence: TTT
ttaaagcatttttatcctag

SEQ ID NO: 187665 - DNA, 20 bp, Artificial Sequence
  Description of Artificial Sequence: Synthetic oligonucleotide
  Target: ATXN1; (-) strand; PAM type: YTN; PAM sequence: TTT
tttaaagcatttttatccta

SEQ ID NO: 187666 - DNA, 20 bp, Artificial Sequence
  Description of Artificial Sequence: Synthetic oligonucleotide
  Target: ATXN1; (-) strand; PAM type: YTN; PAM sequence: CTG
gtggtattttttaaagcatt

SEQ ID NO: 187667 - DNA, 20 bp, Artificial Sequence
  Description of Artificial Sequence: Synthetic oligonucleotide
  Target: ATXN1; (-) strand; PAM type: YTN; PAM sequence: TTC
tggtggtattttttaaagca

SEQ ID NO: 187668 - DNA, 20 bp, Artificial Sequence
  Description of Artificial Sequence: Synthetic oligonucleotide
  Target: ATXN1; (-) strand; PAM type: YTN; PAM sequence: CTT
ctggtggtattttttaaagc

SEQ ID NO: 187669 - DNA, 20 bp, Artificial Sequence
  Description of Artificial Sequence: Synthetic oligonucleotide
  Target: ATXN1; (-) strand; PAM type: YTN; PAM sequence: TTA
gaatgcacttctggtggtat

SEQ ID NO: 187670 - DNA, 20 bp, Artificial Sequence
  Description of Artificial Sequence: Synthetic oligonucleotide
  Target: ATXN1; (-) strand; PAM type: YTN; PAM sequence: CTG
ttagaatgcacttctggtgg

SEQ ID NO: 187671 - DNA, 20 bp, Artificial Sequence
  Description of Artificial Sequence: Synthetic oligonucleotide
  Target: ATXN1; (-) strand; PAM type: YTN; PAM sequence: TTC
ccaatcaggtaactgttaga

SEQ ID NO: 187672 - DNA, 20 bp, Artificial Sequence
  Description of Artificial Sequence: Synthetic oligonucleotide
  Target: ATXN1; (-) strand; PAM type: YTN; PAM sequence: TTT
cccaatcaggtaactgttag

SEQ ID NO: 187673 - DNA, 20 bp, Artificial Sequence
  Description of Artificial Sequence: Synthetic oligonucleotide
  Target: ATXN1; (-) strand; PAM type: YTN; PAM sequence: TTT
tcccaatcaggtaactgtta

SEQ ID NO: 187674 - DNA, 20 bp, Artificial Sequence
  Description of Artificial Sequence: Synthetic oligonucleotide
  Target: ATXN1; (-) strand; PAM type: YTN; PAM sequence: CTA
gaaatcattttcccaatcag

SEQ ID NO: 187675 - DNA, 20 bp, Artificial Sequence
  Description of Artificial Sequence: Synthetic oligonucleotide
  Target: ATXN1; (-) strand; PAM type: YTN; PAM sequence: TTA
ctagaaatcattttcccaat

SEQ ID NO: 187676 - DNA, 20 bp, Artificial Sequence
  Description of Artificial Sequence: Synthetic oligonucleotide
  Target: ATXN1; (-) strand; PAM type: YTN; PAM sequence: TTT
actagaaatcattttcccaa

SEQ ID NO: 187677 - DNA, 20 bp, Artificial Sequence
  Description of Artificial Sequence: Synthetic oligonucleotide
  Target: ATXN1; (-) strand; PAM type: YTN; PAM sequence: TTT
tactagaaatcattttccca

SEQ ID NO: 187678 - DNA, 20 bp, Artificial Sequence
  Description of Artificial Sequence: Synthetic oligonucleotide
  Target: ATXN1; (-) strand; PAM type: YTN; PAM sequence: TTA
cagtgtgttttactagaaat

SEQ ID NO: 187679 - DNA, 20 bp, Artificial Sequence
  Description of Artificial Sequence: Synthetic oligonucleotide
  Target: ATXN1; (-) strand; PAM type: YTN; PAM sequence: CTC
cagttacagtgtgttttact

SEQ ID NO: 187680 - DNA, 20 bp, Artificial Sequence
  Description of Artificial Sequence: Synthetic oligonucleotide
  Target: ATXN1; (-) strand; PAM type: YTN; PAM sequence: TTG
ggtactccagttacagtgtg

SEQ ID NO: 187681 - DNA, 20 bp, Artificial Sequence
  Description of Artificial Sequence: Synthetic oligonucleotide
  Target: ATXN1; (-) strand; PAM type: YTN; PAM sequence: TTT
gggtactccagttacagtgt

SEQ ID NO: 187682 - DNA, 20 bp, Artificial Sequence
  Description of Artificial Sequence: Synthetic oligonucleotide
  Target: ATXN1; (-) strand; PAM type: YTN; PAM sequence: TTA
gatttgggtactccagttac

SEQ ID NO: 187683 - DNA, 20 bp, Artificial Sequence
  Description of Artificial Sequence: Synthetic oligonucleotide
  Target: ATXN1; (-) strand; PAM type: YTN; PAM sequence: TTG
tgggccatgttagatttggg

SEQ ID NO: 187684 - DNA, 20 bp, Artificial Sequence
  Description of Artificial Sequence: Synthetic oligonucleotide
  Target: ATXN1; (-) strand; PAM type: YTN; PAM sequence: CTA
tcaaggaataattgtgggcc

SEQ ID NO: 187685 - DNA, 20 bp, Artificial Sequence
  Description of Artificial Sequence: Synthetic oligonucleotide
  Target: ATXN1; (-) strand; PAM type: YTN; PAM sequence: CTG
tcactatcaaggaataattg

SEQ ID NO: 187686 - DNA, 20 bp, Artificial Sequence
  Description of Artificial Sequence: Synthetic oligonucleotide
  Target: ATXN1; (-) strand; PAM type: YTN; PAM sequence: TTC
tgtcactatcaaggaataat

SEQ ID NO: 187687 - DNA, 20 bp, Artificial Sequence
  Description of Artificial Sequence: Synthetic oligonucleotide
  Target: ATXN1; (-) strand; PAM type: YTN; PAM sequence: TTT
ctgtcactatcaaggaataa

SEQ ID NO: 187688 - DNA, 20 bp, Artificial Sequence
  Description of Artificial Sequence: Synthetic oligonucleotide
  Target: ATXN1; (-) strand; PAM type: YTN; PAM sequence: TTG
taaaagtttctgtcactatc

SEQ ID NO: 187689 - DNA, 20 bp, Artificial Sequence
  Description of Artificial Sequence: Synthetic oligonucleotide
  Target: ATXN1; (-) strand; PAM type: YTN; PAM sequence: TTA
ttgtaaaagtttctgtcact

SEQ ID NO: 187690 - DNA, 20 bp, Artificial Sequence
  Description of Artificial Sequence: Synthetic oligonucleotide
  Target: ATXN1; (-) strand; PAM type: YTN; PAM sequence: CTT
attgtaaaagtttctgtcac

SEQ ID NO: 187691 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaccttattgtaaaa

SEQ ID NO: 187692 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaccttattgtaaa

SEQ ID NO: 187693 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaaccttattgtaa

SEQ ID NO: 187694 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaaaaccttattgta

SEQ ID NO: 187695 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaaaaccttattgt

SEQ ID NO: 187696 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaaaaccttattg

SEQ ID NO: 187697 - DNA, 20 bp, Artificial Sequence
  Description of Artificial Sequence: Synthetic oligonucleotide
  Target: ATXN1; (-) strand; PAM type: YTN; PAM sequence: TTA
tttttttaaaaaaaacctta

SEQ ID NO: 187698 - DNA, 20 bp, Artificial Sequence
  Description of Artificial Sequence: Synthetic oligonucleotide
  Target: ATXN1; (-) strand; PAM type: YTN; PAM sequence: CTT
atttttttaaaaaaaacctt

SEQ ID NO: 187699 - DNA, 20 bp, Artificial Sequence
  Description of Artificial Sequence: Synthetic oligonucleotide
  Target: ATXN1; (-) strand; PAM type: YTN; PAM sequence: TTA
cttatttttttaaaaaaaac

SEQ ID NO: 187700 - DNA, 20 bp, Artificial Sequence
  Description of Artificial Sequence: Synthetic oligonucleotide
  Target: ATXN1; (-) strand; PAM type: YTN; PAM sequence: TTT
acttatttttttaaaaaaaa

SEQ ID NO: 187701 - DNA, 20 bp, Artificial Sequence
  Description of Artificial Sequence: Synthetic oligonucleotide
  Target: ATXN1; (-) strand; PAM type: YTN; PAM sequence: TTT
tacttatttttttaaaaaaa

SEQ ID NO: 187702 - DNA, 20 bp, Artificial Sequence
  Description of Artificial Sequence: Synthetic oligonucleotide
  Target: ATXN1; (-) strand; PAM type: YTN; PAM sequence: CTA
ttttacttatttttttaaaa

SEQ ID NO: 187703 - DNA, 20 bp, Artificial Sequence
  Description of Artificial Sequence: Synthetic oligonucleotide
  Target: ATXN1; (-) strand; PAM type: YTN; PAM sequence: TTG
tgaaagcactattttactta

SEQ ID NO: 187704 - DNA, 20 bp, Artificial Sequence
  Description of Artificial Sequence: Synthetic oligonucleotide
  Target: ATXN1; (-) strand; PAM type: YTN; PAM sequence: CTC
ataaggggaagagcattgtg

SEQ ID NO: 187705 - DNA, 20 bp, Artificial Sequence
  Description of Artificial Sequence: Synthetic oligonucleotide
  Target: ATXN1; (-) strand; PAM type: YTN; PAM sequence: TTA
gggtcctcataaggggaaga

SEQ ID NO: 187706 - DNA, 20 bp, Artificial Sequence
  Description of Artificial Sequence: Synthetic oligonucleotide
  Target: ATXN1; (-) strand; PAM type: YTN; PAM sequence: TTT
agggtcctcataaggggaag

SEQ ID NO: 187707 - DNA, 20 bp, Artificial Sequence
  Description of Artificial Sequence: Synthetic oligonucleotide
  Target: ATXN1; (-) strand; PAM type: YTN; PAM sequence: TTG
gtttagggtcctcataaggg

SEQ ID NO: 187708 - DNA, 20 bp, Artificial Sequence
  Description of Artificial Sequence: Synthetic oligonucleotide
  Target: ATXN1; (-) strand; PAM type: YTN; PAM sequence: CTT
ggtttagggtcctcataagg

SEQ ID NO: 187709 - DNA, 20 bp, Artificial Sequence
  Description of Artificial Sequence: Synthetic oligonucleotide
  Target: ATXN1; (-) strand; PAM type: YTN; PAM sequence: TTA
agcaatcagcatcttggttt

SEQ ID NO: 187710 - DNA, 20 bp, Artificial Sequence
  Description of Artificial Sequence: Synthetic oligonucleotide
  Target: ATXN1; (-) strand; PAM type: YTN; PAM sequence: TTA
ttaagcaatcagcatcttgg

SEQ ID NO: 187711 - DNA, 20 bp, Artificial Sequence
  Description of Artificial Sequence: Synthetic oligonucleotide
  Target: ATXN1; (-) strand; PAM type: YTN; PAM sequence: TTT
attaagcaatcagcatcttg

SEQ ID NO: 187712 - DNA, 20 bp, Artificial Sequence
  Description of Artificial Sequence: Synthetic oligonucleotide
  Target: ATXN1; (-) strand; PAM type: YTN; PAM sequence: TTT
tattaagcaatcagcatctt

SEQ ID NO: 187713 - DNA, 20 bp, Artificial Sequence
  Description of Artificial Sequence: Synthetic oligonucleotide
  Target: ATXN1; (-) strand; PAM type: YTN; PAM sequence: TTT
ttattaagcaatcagcatct

SEQ ID NO: 187714 - DNA, 20 bp, Artificial Sequence
  Description of Artificial Sequence: Synthetic oligonucleotide
  Target: ATXN1; (-) strand; PAM type: YTN; PAM sequence: CTT
tttattaagcaatcagcatc

SEQ ID NO: 187715 - DNA, 20 bp, Artificial Sequence
  Description of Artificial Sequence: Synthetic oligonucleotide
  Target: ATXN1; (-) strand; PAM type: YTN; PAM sequence: CTA
cctttttattaagcaatcag

SEQ ID NO: 187716 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccatccc

SEQ ID NO: 187717 - DNA, 20 bp, Artificial Sequence
  Description of Artificial Sequence: Synthetic oligonucleotide
  Target: ATXN1; (-) strand; PAM type: YTN; PAM sequence: TTG
attacaggcatgagccacca

SEQ ID NO: 187718 - DNA, 20 bp, Artificial Sequence
  Description of Artificial Sequence: Synthetic oligonucleotide
  Target: ATXN1; (-) strand; PAM type: YTN; PAM sequence: TTT
gattacaggcatgagccacc

SEQ ID NO: 187719 - DNA, 20 bp, Artificial Sequence
  Description of Artificial Sequence: Synthetic oligonucleotide
  Target: ATXN1; (-) strand; PAM type: YTN; PAM sequence: TTT
tgattacaggcatgagccac

SEQ ID NO: 187720 - DNA, 20 bp, Artificial Sequence
  Description of Artificial Sequence: Synthetic oligonucleotide
  Target: ATXN1; (-) strand; PAM type: YTN; PAM sequence: TTC
ccaaaatgttttgattacag

SEQ ID NO: 187721 - DNA, 20 bp, Artificial Sequence
  Description of Artificial Sequence: Synthetic oligonucleotide
  Target: ATXN1; (-) strand; PAM type: YTN; PAM sequence: CTT
cccaaaatgttttgattaca

SEQ ID NO: 187722 - DNA, 20 bp, Artificial Sequence
  Description of Artificial Sequence: Synthetic oligonucleotide
  Target: ATXN1; (-) strand; PAM type: YTN; PAM sequence: CTG
cttcccaaaatgttttgatt

SEQ ID NO: 187723 - DNA, 20 bp, Artificial Sequence
  Description of Artificial Sequence: Synthetic oligonucleotide
  Target: ATXN1; (-) strand; PAM type: YTN; PAM sequence: CTC
tgcttcccaaaatgttttga

SEQ ID NO: 187724 - DNA, 20 bp, Artificial Sequence
  Description of Artificial Sequence: Synthetic oligonucleotide
  Target: ATXN1; (-) strand; PAM type: YTN; PAM sequence: CTC
ccgcctctgcttcccaaaat

SEQ ID NO: 187725 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcccgcctctg

SEQ ID NO: 187726 - DNA, 20 bp, Artificial Sequence
  Description of Artificial Sequence: Synthetic oligonucleotide
  Target: ATXN1; (-) strand; PAM type: YTN; PAM sequence: CTG
agctcaagtgatcctcccgc

SEQ ID NO: 187727 - DNA, 20 bp, Artificial Sequence
  Description of Artificial Sequence: Synthetic oligonucleotide
  Target: ATXN1; (-) strand; PAM type: YTN; PAM sequence: CTA
ctgagctcaagtgatcctcc

SEQ ID NO: 187728 - DNA, 20 bp, Artificial Sequence
  Description of Artificial Sequence: Synthetic oligonucleotide
  Target: ATXN1; (-) strand; PAM type: YTN; PAM sequence: TTG
aactactgagctcaagtgat

SEQ ID NO: 187729 - DNA, 20 bp, Artificial Sequence
  Description of Artificial Sequence: Synthetic oligonucleotide
  Target: ATXN1; (-) strand; PAM type: YTN; PAM sequence: CTT
gaactactgagctcaagtga

SEQ ID NO: 187730 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactactgagctca

SEQ ID NO: 187731 - DNA, 20 bp, Artificial Sequence
  Description of Artificial Sequence: Synthetic oligonucleotide
  Target: ATXN1; (-) strand; PAM type: YTN; PAM sequence: CTC
aggctggtcttgaactactg

SEQ ID NO: 187732 - DNA, 20 bp, Artificial Sequence
  Description of Artificial Sequence: Synthetic oligonucleotide
  Target: ATXN1; (-) strand; PAM type: YTN; PAM sequence: TTG
ctcaggctggtcttgaacta

SEQ ID NO: 187733 - DNA, 20 bp, Artificial Sequence
  Description of Artificial Sequence: Synthetic oligonucleotide
  Target: ATXN1; (-) strand; PAM type: YTN; PAM sequence: TTC
accatgttgctcaggctggt

SEQ ID NO: 187734 - DNA, 20 bp, Artificial Sequence
  Description of Artificial Sequence: Synthetic oligonucleotide
  Target: ATXN1; (-) strand; PAM type: YTN; PAM sequence: TTT
caccatgttgctcaggctgg

SEQ ID NO: 187735 - DNA, 20 bp, Artificial Sequence
  Description of Artificial Sequence: Synthetic oligonucleotide
  Target: ATXN1; (-) strand; PAM type: YTN; PAM sequence: TTG
gtagagacagagtttcacca

SEQ ID NO: 187736 - DNA, 20 bp, Artificial Sequence
  Description of Artificial Sequence: Synthetic oligonucleotide
  Target: ATXN1; (-) strand; PAM type: YTN; PAM sequence: TTT
ggtagagacagagtttcacc

SEQ ID NO: 187737 - DNA, 20 bp, Artificial Sequence
  Description of Artificial Sequence: Synthetic oligonucleotide
  Target: ATXN1; (-) strand; PAM type: YTN; PAM sequence: TTT
tggtagagacagagtttcac

SEQ ID NO: 187738 - DNA, 20 bp, Artificial Sequence
  Description of Artificial Sequence: Synthetic oligonucleotide
  Target: ATXN1; (-) strand; PAM type: YTN; PAM sequence: TTT
ttggtagagacagagtttca

SEQ ID NO: 187739 - DNA, 20 bp, Artificial Sequence
  Description of Artificial Sequence: Synthetic oligonucleotide
  Target: ATXN1; (-) strand; PAM type: YTN; PAM sequence: TTG
tatttttggtagagacagag

SEQ ID NO: 187740 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtagagacaga

SEQ ID NO: 187741 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtagagacag

SEQ ID NO: 187742 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtagagaca

SEQ ID NO: 187743 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttggtagagac

SEQ ID NO: 187744 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttggtag

SEQ ID NO: 187745 - DNA, 20 bp, Artificial Sequence
  Description of Artificial Sequence: Synthetic oligonucleotide
  Target: ATXN1; (-) strand; PAM type: YTN; PAM sequence: CTG
gctaattttttgtatttttg

SEQ ID NO: 187746 - DNA, 20 bp, Artificial Sequence
  Description of Artificial Sequence: Synthetic oligonucleotide
  Target: ATXN1; (-) strand; PAM type: YTN; PAM sequence: CTG
ggaccacaggtgcacaccac

SEQ ID NO: 187747 - DNA, 20 bp, Artificial Sequence
  Description of Artificial Sequence: Synthetic oligonucleotide
  Target: ATXN1; (-) strand; PAM type: YTN; PAM sequence: TTC
agagtagctgggaccacagg

SEQ ID NO: 187748 - DNA, 20 bp, Artificial Sequence
  Description of Artificial Sequence: Synthetic oligonucleotide
  Target: ATXN1; (-) strand; PAM type: YTN; PAM sequence: CTT
cagagtagctgggaccacag

SEQ ID NO: 187749 - DNA, 20 bp, Artificial Sequence
  Description of Artificial Sequence: Synthetic oligonucleotide
  Target: ATXN1; (-) strand; PAM type: YTN; PAM sequence: CTC
agccttcagagtagctggga

SEQ ID NO: 187750 - DNA, 20 bp, Artificial Sequence
  Description of Artificial Sequence: Synthetic oligonucleotide
  Target: ATXN1; (-) strand; PAM type: YTN; PAM sequence: CTC
ccacctcagccttcagagta

SEQ ID NO: 187751 - DNA, 20 bp, Artificial Sequence
  Description of Artificial Sequence: Synthetic oligonucleotide
  Target: ATXN1; (-) strand; PAM type: YTN; PAM sequence: CTC
aagtgaccctcccacctcag

SEQ ID NO: 187752 - DNA, 20 bp, Artificial Sequence
  Description of Artificial Sequence: Synthetic oligonucleotide
  Target: ATXN1; (-) strand; PAM type: YTN; PAM sequence: CTC
ccaagctcaagtgaccctcc

SEQ ID NO: 187753 - DNA, 20 bp, Artificial Sequence
  Description of Artificial Sequence: Synthetic oligonucleotide
  Target: ATXN1; (-) strand; PAM type: YTN; PAM sequence: CTG
cctcccaagctcaagtgacc

SEQ ID NO: 187754 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaagctcaagtga

SEQ ID NO: 187755 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccaagct

SEQ ID NO: 187756 - DNA, 20 bp, Artificial Sequence
  Description of Artificial Sequence: Synthetic oligonucleotide
  Target: ATXN1; (-) strand; PAM type: YTN; PAM sequence: TTC
actgcaacctctgcctccca

SEQ ID NO: 187757 - DNA, 20 bp, Artificial Sequence
  Description of Artificial Sequence: Synthetic oligonucleotide
  Target: ATXN1; (-) strand; PAM type: YTN; PAM sequence: CTC
gattcactgcaacctctgcc

SEQ ID NO: 187758 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggcaagatctc

SEQ ID NO: 187759 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcaa

SEQ ID NO: 187760 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 187761 - DNA, 20 bp, Artificial Sequence
  Description of Artificial Sequence: Synthetic oligonucleotide
  Target: ATXN1; (-) strand; PAM type: YTN; PAM sequence: TTA
ctctgtcacccaggctggag

SEQ ID NO: 187762 - DNA, 20 bp, Artificial Sequence
  Description of Artificial Sequence: Synthetic oligonucleotide
  Target: ATXN1; (-) strand; PAM type: YTN; PAM sequence: CTT
actctgtcacccaggctgga

SEQ ID NO: 187763 - DNA, 20 bp, Artificial Sequence
  Description of Artificial Sequence: Synthetic oligonucleotide
  Target: ATXN1; (-) strand; PAM type: YTN; PAM sequence: TTG
aggtggtgccttactctgtc

SEQ ID NO: 187764 - DNA, 20 bp, Artificial Sequence
  Description of Artificial Sequence: Synthetic oligonucleotide
  Target: ATXN1; (-) strand; PAM type: YTN; PAM sequence: TTA
attgaggtggtgccttactc

SEQ ID NO: 187765 - DNA, 20 bp, Artificial Sequence
  Description of Artificial Sequence: Synthetic oligonucleotide
  Target: ATXN1; (-) strand; PAM type: YTN; PAM sequence: TTT
aattgaggtggtgccttact

SEQ ID NO: 187766 - DNA, 20 bp, Artificial Sequence
  Description of Artificial Sequence: Synthetic oligonucleotide
  Target: ATXN1; (-) strand; PAM type: YTN; PAM sequence: TTT
taattgaggtggtgccttac

SEQ ID NO: 187767 - DNA, 20 bp, Artificial Sequence
  Description of Artificial Sequence: Synthetic oligonucleotide
  Target: ATXN1; (-) strand; PAM type: YTN; PAM sequence: TTT
ttaattgaggtggtgcctta

SEQ ID NO: 187768 - DNA, 20 bp, Artificial Sequence
  Description of Artificial Sequence: Synthetic oligonucleotide
  Target: ATXN1; (-) strand; PAM type: YTN; PAM sequence: CTT
tttaattgaggtggtgcctt

SEQ ID NO: 187769 - DNA, 20 bp, Artificial Sequence
  Description of Artificial Sequence: Synthetic oligonucleotide
  Target: ATXN1; (-) strand; PAM type: YTN; PAM sequence: TTC
tttttaattgaggtggtgcc

SEQ ID NO: 187770 - DNA, 20 bp, Artificial Sequence
  Description of Artificial Sequence: Synthetic oligonucleotide
  Target: ATXN1; (-) strand; PAM type: YTN; PAM sequence: TTT
ctttttaattgaggtggtgc

SEQ ID NO: 187771 - DNA, 20 bp, Artificial Sequence
  Description of Artificial Sequence: Synthetic oligonucleotide
  Target: ATXN1; (-) strand; PAM type: YTN; PAM sequence: TTT
tctttttaattgaggtggtg

SEQ ID NO: 187772 - DNA, 20 bp, Artificial Sequence
  Description of Artificial Sequence: Synthetic oligonucleotide
  Target: ATXN1; (-) strand; PAM type: YTN; PAM sequence: TTT
ttctttttaattgaggtggt

SEQ ID NO: 187773 - DNA, 20 bp, Artificial Sequence
  Description of Artificial Sequence: Synthetic oligonucleotide
  Target: ATXN1; (-) strand; PAM type: YTN; PAM sequence: TTT
tttctttttaattgaggtgg

SEQ ID NO: 187774 - DNA, 20 bp, Artificial Sequence
  Description of Artificial Sequence: Synthetic oligonucleotide
  Target: ATXN1; (-) strand; PAM type: YTN; PAM sequence: TTT
ttttctttttaattgaggtg

SEQ ID NO: 187775 - DNA, 20 bp, Artificial Sequence
  Description of Artificial Sequence: Synthetic oligonucleotide
  Target: ATXN1; (-) strand; PAM type: YTN; PAM sequence: TTC
atttttttctttttaattga

SEQ ID NO: 187776 - DNA, 20 bp, Artificial Sequence
  Description of Artificial Sequence: Synthetic oligonucleotide
  Target: ATXN1; (-) strand; PAM type: YTN; PAM sequence: TTT
catttttttctttttaattg

SEQ ID NO: 187777 - DNA, 20 bp, Artificial Sequence
  Description of Artificial Sequence: Synthetic oligonucleotide
  Target: ATXN1; (-) strand; PAM type: YTN; PAM sequence: TTT
tcatttttttctttttaatt

SEQ ID NO: 187778 - DNA, 20 bp, Artificial Sequence
  Description of Artificial Sequence: Synthetic oligonucleotide
  Target: ATXN1; (-) strand; PAM type: YTN; PAM sequence: TTA
ttttcatttttttcttttta

SEQ ID NO: 187779 - DNA, 20 bp, Artificial Sequence
  Description of Artificial Sequence: Synthetic oligonucleotide
  Target: ATXN1; (-) strand; PAM type: YTN; PAM sequence: CTT
attttcatttttttcttttt

SEQ ID NO: 187780 - DNA, 20 bp, Artificial Sequence
  Description of Artificial Sequence: Synthetic oligonucleotide
  Target: ATXN1; (-) strand; PAM type: YTN; PAM sequence: CTA
ccttattttcatttttttct

SEQ ID NO: 187781 - DNA, 20 bp, Artificial Sequence
  Description of Artificial Sequence: Synthetic oligonucleotide
  Target: ATXN1; (-) strand; PAM type: YTN; PAM sequence: TTC
atactaccttattttcattt

SEQ ID NO: 187782 - DNA, 20 bp, Artificial Sequence
  Description of Artificial Sequence: Synthetic oligonucleotide
  Target: ATXN1; (-) strand; PAM type: YTN; PAM sequence: CTT
catactaccttattttcatt

SEQ ID NO: 187783 - DNA, 20 bp, Artificial Sequence
  Description of Artificial Sequence: Synthetic oligonucleotide
  Target: ATXN1; (-) strand; PAM type: YTN; PAM sequence: TTG
cttcatactaccttattttc

SEQ ID NO: 187784 - DNA, 20 bp, Artificial Sequence
  Description of Artificial Sequence: Synthetic oligonucleotide
  Target: ATXN1; (-) strand; PAM type: YTN; PAM sequence: CTG
tgtattgcttcatactacct

SEQ ID NO: 187785 - DNA, 20 bp, Artificial Sequence
  Description of Artificial Sequence: Synthetic oligonucleotide
  Target: ATXN1; (-) strand; PAM type: YTN; PAM sequence: TTG
caagtctgtgtattgcttca

SEQ ID NO: 187786 - DNA, 20 bp, Artificial Sequence
  Description of Artificial Sequence: Synthetic oligonucleotide
  Target: ATXN1; (-) strand; PAM type: YTN; PAM sequence: TTT
gcaagtctgtgtattgcttc

SEQ ID NO: 187787 - DNA, 20 bp, Artificial Sequence
  Description of Artificial Sequence: Synthetic oligonucleotide
  Target: ATXN1; (-) strand; PAM type: YTN; PAM sequence: TTT
tgcaagtctgtgtattgctt

SEQ ID NO: 187788 - DNA, 20 bp, Artificial Sequence
  Description of Artificial Sequence: Synthetic oligonucleotide
  Target: ATXN1; (-) strand; PAM type: YTN; PAM sequence: TTG
ggcaagtcgcgagcccccat

SEQ ID NO: 187789 - DNA, 20 bp, Artificial Sequence
  Description of Artificial Sequence: Synthetic oligonucleotide
  Target: ATXN1; (-) strand; PAM type: YTN; PAM sequence: CTT
gggcaagtcgcgagccccca

SEQ ID NO: 187790 - DNA, 20 bp, Artificial Sequence
  Description of Artificial Sequence: Synthetic oligonucleotide
  Target: ATXN1; (-) strand; PAM type: YTN; PAM sequence: CTG
gcaaccttgggcaagtcgcg

SEQ ID NO: 187791 - DNA, 20 bp, Artificial Sequence
  Description of Artificial Sequence: Synthetic oligonucleotide
  Target: ATXN1; (-) strand; PAM type: YTN; PAM sequence: TTG
agatcaagtacactggcaac

SEQ ID NO: 187792 - DNA, 20 bp, Artificial Sequence
  Description of Artificial Sequence: Synthetic oligonucleotide
  Target: ATXN1; (-) strand; PAM type: YTN; PAM sequence: CTG
ttgagatcaagtacactggc

SEQ ID NO: 187793 - DNA, 20 bp, Artificial Sequence
  Description of Artificial Sequence: Synthetic oligonucleotide
  Target: ATXN1; (-) strand; PAM type: YTN; PAM sequence: CTA
ctgttgagatcaagtacact

SEQ ID NO: 187794 - DNA, 20 bp, Artificial Sequence
  Description of Artificial Sequence: Synthetic oligonucleotide
  Target: ATXN1; (-) strand; PAM type: YTN; PAM sequence: TTC
ctactgttgagatcaagtac

SEQ ID NO: 187795 - DNA, 20 bp, Artificial Sequence
  Description of Artificial Sequence: Synthetic oligonucleotide
  Target: ATXN1; (-) strand; PAM type: YTN; PAM sequence: CTA
ttcctactgttgagatcaag

SEQ ID NO: 187796 - DNA, 20 bp, Artificial Sequence
  Description of Artificial Sequence: Synthetic oligonucleotide
  Target: ATXN1; (-) strand; PAM type: YTN; PAM sequence: CTG
aatcctattcctactgttga

SEQ ID NO: 187797 - DNA, 20 bp, Artificial Sequence
  Description of Artificial Sequence: Synthetic oligonucleotide
  Target: ATXN1; (-) strand; PAM type: YTN; PAM sequence: CTG
acctgaatcctattcctact

SEQ ID NO: 187798 - DNA, 20 bp, Artificial Sequence
  Description of Artificial Sequence: Synthetic oligonucleotide
  Target: ATXN1; (-) strand; PAM type: YTN; PAM sequence: CTG
gaatcagctgacctgaatcc

SEQ ID NO: 187799 - DNA, 20 bp, Artificial Sequence
  Description of Artificial Sequence: Synthetic oligonucleotide
  Target: ATXN1; (-) strand; PAM type: YTN; PAM sequence: CTA
gtggaaatcagtcagcctgg

SEQ ID NO: 187800 - DNA, 20 bp, Artificial Sequence
  Description of Artificial Sequence: Synthetic oligonucleotide
  Target: ATXN1; (-) strand; PAM type: YTN; PAM sequence: TTG
ggtctagtggaaatcagtca

SEQ ID NO: 187801 - DNA, 20 bp, Artificial Sequence
  Description of Artificial Sequence: Synthetic oligonucleotide
  Target: ATXN1; (-) strand; PAM type: YTN; PAM sequence: CTG
tacacgttgggtctagtgga

SEQ ID NO: 187802 - DNA, 20 bp, Artificial Sequence
  Description of Artificial Sequence: Synthetic oligonucleotide
  Target: ATXN1; (-) strand; PAM type: YTN; PAM sequence: TTC
tgtacacgttgggtctagtg

SEQ ID NO: 187803 - DNA, 20 bp, Artificial Sequence
  Description of Artificial Sequence: Synthetic oligonucleotide
  Target: ATXN1; (-) strand; PAM type: YTN; PAM sequence: TTC
cattctgtacacgttgggtc

SEQ ID NO: 187804 - DNA, 20 bp, Artificial Sequence
  Description of Artificial Sequence: Synthetic oligonucleotide
  Target: ATXN1; (-) strand; PAM type: YTN; PAM sequence: TTT
ccattctgtacacgttgggt

SEQ ID NO: 187805 - DNA, 20 bp, Artificial Sequence
  Description of Artificial Sequence: Synthetic oligonucleotide
  Target: ATXN1; (-) strand; PAM type: YTN; PAM sequence: TTG
tgtttccattctgtacacgt

SEQ ID NO: 187806 - DNA, 20 bp, Artificial Sequence
  Description of Artificial Sequence: Synthetic oligonucleotide
  Target: ATXN1; (-) strand; PAM type: YTN; PAM sequence: TTC
attgtgtttccattctgtac

SEQ ID NO: 187807 - DNA, 20 bp, Artificial Sequence
  Description of Artificial Sequence: Synthetic oligonucleotide
  Target: ATXN1; (-) strand; PAM type: YTN; PAM sequence: CTT
cattgtgtttccattctgta

SEQ ID NO: 187808 - DNA, 20 bp, Artificial Sequence
  Description of Artificial Sequence: Synthetic oligonucleotide
  Target: ATXN1; (-) strand; PAM type: YTN; PAM sequence: CTG
aagcttcattgtgtttccat

SEQ ID NO: 187809 - DNA, 20 bp, Artificial Sequence
  Description of Artificial Sequence: Synthetic oligonucleotide
  Target: ATXN1; (-) strand; PAM type: YTN; PAM sequence: TTG
aaagcagacagtgggagaca

SEQ ID NO: 187810 - DNA, 20 bp, Artificial Sequence
  Description of Artificial Sequence: Synthetic oligonucleotide
  Target: ATXN1; (-) strand; PAM type: YTN; PAM sequence: TTC
attgaaagcagacagtggga

SEQ ID NO: 187811 - DNA, 20 bp, Artificial Sequence
  Description of Artificial Sequence: Synthetic oligonucleotide
  Target: ATXN1; (-) strand; PAM type: YTN; PAM sequence: CTT
cattgaaagcagacagtggg

SEQ ID NO: 187812 - DNA, 20 bp, Artificial Sequence
  Description of Artificial Sequence: Synthetic oligonucleotide
  Target: ATXN1; (-) strand; PAM type: YTN; PAM sequence: TTC
ccagtgcttcattgaaagca

SEQ ID NO: 187813 - DNA, 20 bp, Artificial Sequence
  Description of Artificial Sequence: Synthetic oligonucleotide
  Target: ATXN1; (-) strand; PAM type: YTN; PAM sequence: TTT
cccagtgcttcattgaaagc

SEQ ID NO: 187814 - DNA, 20 bp, Artificial Sequence
  Description of Artificial Sequence: Synthetic oligonucleotide
  Target: ATXN1; (-) strand; PAM type: YTN; PAM sequence: TTT
tcccagtgcttcattgaaag

SEQ ID NO: 187815 - DNA, 20 bp, Artificial Sequence
  Description of Artificial Sequence: Synthetic oligonucleotide
  Target: ATXN1; (-) strand; PAM type: YTN; PAM sequence: TTC
aaattttcccagtgcttcat

SEQ ID NO: 187816 - DNA, 20 bp, Artificial Sequence
  Description of Artificial Sequence: Synthetic oligonucleotide
  Target: ATXN1; (-) strand; PAM type: YTN; PAM sequence: TTA
aattcaaattttcccagtgc

SEQ ID NO: 187817 - DNA, 20 bp, Artificial Sequence
  Description of Artificial Sequence: Synthetic oligonucleotide
  Target: ATXN1; (-) strand; PAM type: YTN; PAM sequence: TTA
ttaaattcaaattttcccag

SEQ ID NO: 187818 - DNA, 20 bp, Artificial Sequence
  Description of Artificial Sequence: Synthetic oligonucleotide
  Target: ATXN1; (-) strand; PAM type: YTN; PAM sequence: CTT
attaaattcaaattttccca

SEQ ID NO: 187819 - DNA, 20 bp, Artificial Sequence
  Description of Artificial Sequence: Synthetic oligonucleotide
  Target: ATXN1; (-) strand; PAM type: YTN; PAM sequence: TTA
atatgagcttattaaattca

SEQ ID NO: 187820 - DNA, 20 bp, Artificial Sequence
  Description of Artificial Sequence: Synthetic oligonucleotide
  Target: ATXN1; (-) strand; PAM type: YTN; PAM sequence: TTA
aataatcagtaatattaata

SEQ ID NO: 187821 - DNA, 20 bp, Artificial Sequence
  Description of Artificial Sequence: Synthetic oligonucleotide
  Target: ATXN1; (-) strand; PAM type: YTN; PAM sequence: CTC
agggttaaataatcagtaat

SEQ ID NO: 187822 - DNA, 20 bp, Artificial Sequence
  Description of Artificial Sequence: Synthetic oligonucleotide
  Target: ATXN1; (-) strand; PAM type: YTN; PAM sequence: CTC
ctcagggttaaataatcagt

SEQ ID NO: 187823 - DNA, 20 bp, Artificial Sequence
  Description of Artificial Sequence: Synthetic oligonucleotide
  Target: ATXN1; (-) strand; PAM type: YTN; PAM sequence: TTA
aaatatgcatatgtatccat

SEQ ID NO: 187824 - DNA, 20 bp, Artificial Sequence
  Description of Artificial Sequence: Synthetic oligonucleotide
  Target: ATXN1; (-) strand; PAM type: YTN; PAM sequence: TTG
tattaaaatatgcatatgta

SEQ ID NO: 187825 - DNA, 20 bp, Artificial Sequence
  Description of Artificial Sequence: Synthetic oligonucleotide
  Target: ATXN1; (-) strand; PAM type: YTN; PAM sequence: TTT
gtattaaaatatgcatatgt

SEQ ID NO: 187826 - DNA, 20 bp, Artificial Sequence
  Description of Artificial Sequence: Synthetic oligonucleotide
  Target: ATXN1; (-) strand; PAM type: YTN; PAM sequence: CTA
aacatttgtattaaaatatg

SEQ ID NO: 187827 - DNA, 20 bp, Artificial Sequence
  Description of Artificial Sequence: Synthetic oligonucleotide
  Target: ATXN1; (-) strand; PAM type: YTN; PAM sequence: TTC
taaacatttgtattaaaata

SEQ ID NO: 187828 - DNA, 20 bp, Artificial Sequence
  Description of Artificial Sequence: Synthetic oligonucleotide
  Target: ATXN1; (-) strand; PAM type: YTN; PAM sequence: TTT
ctaaacatttgtattaaaat

SEQ ID NO: 187829 - DNA, 20 bp, Artificial Sequence
  Description of Artificial Sequence: Synthetic oligonucleotide
  Target: ATXN1; (-) strand; PAM type: YTN; PAM sequence: TTC
atagatttctaaacatttgt

SEQ ID NO: 187830 - DNA, 20 bp, Artificial Sequence
  Description of Artificial Sequence: Synthetic oligonucleotide
  Target: ATXN1; (-) strand; PAM type: YTN; PAM sequence: TTT
catagatttctaaacatttg

SEQ ID NO: 187831 - DNA, 20 bp, Artificial Sequence
  Description of Artificial Sequence: Synthetic oligonucleotide
  Target: ATXN1; (-) strand; PAM type: YTN; PAM sequence: TTG
gtttcatagatttctaaaca

SEQ ID NO: 187832 - DNA, 20 bp, Artificial Sequence
  Description of Artificial Sequence: Synthetic oligonucleotide
  Target: ATXN1; (-) strand; PAM type: YTN; PAM sequence: TTT
ggtttcatagatttctaaac

SEQ ID NO: 187833 - DNA, 20 bp, Artificial Sequence
  Description of Artificial Sequence: Synthetic oligonucleotide
  Target: ATXN1; (-) strand; PAM type: YTN; PAM sequence: TTT
tggtttcatagatttctaaa

SEQ ID NO: 187834 - DNA, 20 bp, Artificial Sequence
  Description of Artificial Sequence: Synthetic oligonucleotide
  Target: ATXN1; (-) strand; PAM type: YTN; PAM sequence: TTT
ttggtttcatagatttctaa

SEQ ID NO: 187835 - DNA, 20 bp, Artificial Sequence
  Description of Artificial Sequence: Synthetic oligonucleotide
  Target: ATXN1; (-) strand; PAM type: YTN; PAM sequence: TTT
tttggtttcatagatttcta

SEQ ID NO: 187836 - DNA, 20 bp, Artificial Sequence
  Description of Artificial Sequence: Synthetic oligonucleotide
  Target: ATXN1; (-) strand; PAM type: YTN; PAM sequence: TTT
ttttggtttcatagatttct

SEQ ID NO: 187837 - DNA, 20 bp, Artificial Sequence
  Description of Artificial Sequence: Synthetic oligonucleotide
  Target: ATXN1; (-) strand; PAM type: YTN; PAM sequence: CTA
atttttttggtttcatagat

SEQ ID NO: 187838 - DNA, 20 bp, Artificial Sequence
  Description of Artificial Sequence: Synthetic oligonucleotide
  Target: ATXN1; (-) strand; PAM type: YTN; PAM sequence: TTC
ctaatttttttggtttcata

SEQ ID NO: 187839 - DNA, 20 bp, Artificial Sequence
  Description of Artificial Sequence: Synthetic oligonucleotide
  Target: ATXN1; (-) strand; PAM type: YTN; PAM sequence: TTG
acaaggaaaaaaaatgttcc

SEQ ID NO: 187840 - DNA, 20 bp, Artificial Sequence
  Description of Artificial Sequence: Synthetic oligonucleotide
  Target: ATXN1; (-) strand; PAM type: YTN; PAM sequence: TTG
taaagagcaaagtgtagcat

SEQ ID NO: 187841 - DNA, 20 bp, Artificial Sequence
  Description of Artificial Sequence: Synthetic oligonucleotide
  Target: ATXN1; (-) strand; PAM type: YTN; PAM sequence: TTT
gtaaagagcaaagtgtagca

SEQ ID NO: 187842 - DNA, 20 bp, Artificial Sequence
  Description of Artificial Sequence: Synthetic oligonucleotide
  Target: ATXN1; (-) strand; PAM type: YTN; PAM sequence: CTA
caagatttgtaaagagcaaa

SEQ ID NO: 187843 - DNA, 20 bp, Artificial Sequence
  Description of Artificial Sequence: Synthetic oligonucleotide
  Target: ATXN1; (-) strand; PAM type: YTN; PAM sequence: TTG
cctacaagatttgtaaagag

SEQ ID NO: 187844 - DNA, 20 bp, Artificial Sequence
  Description of Artificial Sequence: Synthetic oligonucleotide
  Target: ATXN1; (-) strand; PAM type: YTN; PAM sequence: TTG
cagttgcctacaagatttgt

SEQ ID NO: 187845 - DNA, 20 bp, Artificial Sequence
  Description of Artificial Sequence: Synthetic oligonucleotide
  Target: ATXN1; (-) strand; PAM type: YTN; PAM sequence: TTT
gcagttgcctacaagatttg

SEQ ID NO: 187846 - DNA, 20 bp, Artificial Sequence
  Description of Artificial Sequence: Synthetic oligonucleotide
  Target: ATXN1; (-) strand; PAM type: YTN; PAM sequence: TTT
tgcagttgcctacaagattt

SEQ ID NO: 187847 - DNA, 20 bp, Artificial Sequence
  Description of Artificial Sequence: Synthetic oligonucleotide
  Target: ATXN1; (-) strand; PAM type: YTN; PAM sequence: TTT
ttgcagttgcctacaagatt

SEQ ID NO: 187848 - DNA, 20 bp, Artificial Sequence
  Description of Artificial Sequence: Synthetic oligonucleotide
  Target: ATXN1; (-) strand; PAM type: YTN; PAM sequence: TTT
tttgcagttgcctacaagat

SEQ ID NO: 187849 - DNA, 20 bp, Artificial Sequence
  Description of Artificial Sequence: Synthetic oligonucleotide
  Target: ATXN1; (-) strand; PAM type: YTN; PAM sequence: TTT
ttttgcagttgcctacaaga

SEQ ID NO: 187850 - DNA, 20 bp, Artificial Sequence
  Description of Artificial Sequence: Synthetic oligonucleotide
  Target: ATXN1; (-) strand; PAM type: YTN; PAM sequence: TTT
tttttgcagttgcctacaag

SEQ ID NO: 187851 - DNA, 20 bp, Artificial Sequence
  Description of Artificial Sequence: Synthetic oligonucleotide
  Target: ATXN1; (-) strand; PAM type: YTN; PAM sequence: CTA
ttttttttgcagttgcctac

SEQ ID NO: 187852 - DNA, 20 bp, Artificial Sequence
  Description of Artificial Sequence: Synthetic oligonucleotide
  Target: ATXN1; (-) strand; PAM type: YTN; PAM sequence: TTA
cctattttttttgcagttgc

SEQ ID NO: 187853 - DNA, 20 bp, Artificial Sequence
  Description of Artificial Sequence: Synthetic oligonucleotide
  Target: ATXN1; (-) strand; PAM type: YTN; PAM sequence: TTG
aacatgtattacctattttt

SEQ ID NO: 187854 - DNA, 20 bp, Artificial Sequence
  Description of Artificial Sequence: Synthetic oligonucleotide
  Target: ATXN1; (-) strand; PAM type: YTN; PAM sequence: TTT
gaacatgtattacctatttt

SEQ ID NO: 187855 - DNA, 20 bp, Artificial Sequence
  Description of Artificial Sequence: Synthetic oligonucleotide
  Target: ATXN1; (-) strand; PAM type: YTN; PAM sequence: TTT
tgaacatgtattacctattt

SEQ ID NO: 187856 - DNA, 20 bp, Artificial Sequence
  Description of Artificial Sequence: Synthetic oligonucleotide
  Target: ATXN1; (-) strand; PAM type: YTN; PAM sequence: TTT
ttgaacatgtattacctatt

SEQ ID NO: 187857 - DNA, 20 bp, Artificial Sequence
  Description of Artificial Sequence: Synthetic oligonucleotide
  Target: ATXN1; (-) strand; PAM type: YTN; PAM sequence: TTT
tttgaacatgtattacctat

SEQ ID NO: 187858 - DNA, 20 bp, Artificial Sequence
  Description of Artificial Sequence: Synthetic oligonucleotide
  Target: ATXN1; (-) strand; PAM type: YTN; PAM sequence: CTT
ttttgaacatgtattaccta

SEQ ID NO: 187859 - DNA, 20 bp, Artificial Sequence
  Description of Artificial Sequence: Synthetic oligonucleotide
  Target: ATXN1; (-) strand; PAM type: YTN; PAM sequence: CTC
agccagaaaacttttttgaa

SEQ ID NO: 187860 - DNA, 20 bp, Artificial Sequence
  Description of Artificial Sequence: Synthetic oligonucleotide
  Target: ATXN1; (-) strand; PAM type: YTN; PAM sequence: TTA
actcagccagaaaacttttt

SEQ ID NO: 187861 - DNA, 20 bp, Artificial Sequence
  Description of Artificial Sequence: Synthetic oligonucleotide
  Target: ATXN1; (-) strand; PAM type: YTN; PAM sequence: CTT
aactcagccagaaaactttt

SEQ ID NO: 187862 - DNA, 20 bp, Artificial Sequence
  Description of Artificial Sequence: Synthetic oligonucleotide
  Target: ATXN1; (-) strand; PAM type: YTN; PAM sequence: TTC
ttaactcagccagaaaactt

SEQ ID NO: 187863 - DNA, 20 bp, Artificial Sequence
  Description of Artificial Sequence: Synthetic oligonucleotide
  Target: ATXN1; (-) strand; PAM type: YTN; PAM sequence: CTT
cttaactcagccagaaaact

SEQ ID NO: 187864 - DNA, 20 bp, Artificial Sequence
  Description of Artificial Sequence: Synthetic oligonucleotide
  Target: ATXN1; (-) strand; PAM type: YTN; PAM sequence: TTC
cagcttcttaactcagccag

SEQ ID NO: 187865 - DNA, 20 bp, Artificial Sequence
  Description of Artificial Sequence: Synthetic oligonucleotide
  Target: ATXN1; (-) strand; PAM type: YTN; PAM sequence: TTT
ccagcttcttaactcagcca

SEQ ID NO: 187866 - DNA, 20 bp, Artificial Sequence
  Description of Artificial Sequence: Synthetic oligonucleotide
  Target: ATXN1; (-) strand; PAM type: YTN; PAM sequence: TTA
ggtttccagcttcttaactc

SEQ ID NO: 187867 - DNA, 20 bp, Artificial Sequence
  Description of Artificial Sequence: Synthetic oligonucleotide
  Target: ATXN1; (-) strand; PAM type: YTN; PAM sequence: TTT
aggtttccagcttcttaact

SEQ ID NO: 187868 - DNA, 20 bp, Artificial Sequence
  Description of Artificial Sequence: Synthetic oligonucleotide
  Target: ATXN1; (-) strand; PAM type: YTN; PAM sequence: TTA
tgtatgtgtgtgcgtgtaca

SEQ ID NO: 187869 - DNA, 20 bp, Artificial Sequence
  Description of Artificial Sequence: Synthetic oligonucleotide
  Target: ATXN1; (-) strand; PAM type: YTN; PAM sequence: TTT
atgtatgtgtgtgcgtgtac

SEQ ID NO: 187870 - DNA, 20 bp, Artificial Sequence
  Description of Artificial Sequence: Synthetic oligonucleotide
  Target: ATXN1; (-) strand; PAM type: YTN; PAM sequence: TTG
tttatgtatgtgtgtgcgtg

SEQ ID NO: 187871 - DNA, 20 bp, Artificial Sequence
  Description of Artificial Sequence: Synthetic oligonucleotide
  Target: ATXN1; (-) strand; PAM type: YTN; PAM sequence: CTT
gtttatgtatgtgtgtgcgt

SEQ ID NO: 187872 - DNA, 20 bp, Artificial Sequence
  Description of Artificial Sequence: Synthetic oligonucleotide
  Target: ATXN1; (-) strand; PAM type: YTN; PAM sequence: CTC
ttgtttatgtatgtgtgtgc

SEQ ID NO: 187873 - DNA, 20 bp, Artificial Sequence
  Description of Artificial Sequence: Synthetic oligonucleotide
  Target: ATXN1; (-) strand; PAM type: YTN; PAM sequence: CTG
taatatatatgtatactctt

SEQ ID NO: 187874 - DNA, 20 bp, Artificial Sequence
  Description of Artificial Sequence: Synthetic oligonucleotide
  Target: ATXN1; (-) strand; PAM type: YTN; PAM sequence: TTC
tgtaatatatatgtatactc

SEQ ID NO: 187875 - DNA, 20 bp, Artificial Sequence
  Description of Artificial Sequence: Synthetic oligonucleotide
  Target: ATXN1; (-) strand; PAM type: YTN; PAM sequence: TTT
ctgtaatatatatgtatact

SEQ ID NO: 187876 - DNA, 20 bp, Artificial Sequence
  Description of Artificial Sequence: Synthetic oligonucleotide
  Target: ATXN1; (-) strand; PAM type: YTN; PAM sequence: TTG
tgtatatataaatacatata

SEQ ID NO: 187877 - DNA, 20 bp, Artificial Sequence
  Description of Artificial Sequence: Synthetic oligonucleotide
  Target: ATXN1; (-) strand; PAM type: YTN; PAM sequence: TTT
gtgtatatataaatacatat

SEQ ID NO: 187878 - DNA, 20 bp, Artificial Sequence
  Description of Artificial Sequence: Synthetic oligonucleotide
  Target: ATXN1; (-) strand; PAM type: YTN; PAM sequence: TTT
tgtgtatatataaatacata

SEQ ID NO: 187879 - DNA, 20 bp, Artificial Sequence
  Description of Artificial Sequence: Synthetic oligonucleotide
  Target: ATXN1; (-) strand; PAM type: YTN; PAM sequence: TTT
ttgtgtatatataaatacat

SEQ ID NO: 187880 - DNA, 20 bp, Artificial Sequence
  Description of Artificial Sequence: Synthetic oligonucleotide
  Target: ATXN1; (-) strand; PAM type: YTN; PAM sequence: TTG
tttttgtgtatatataaata

SEQ ID NO: 187881 - DNA, 20 bp, Artificial Sequence
  Description of Artificial Sequence: Synthetic oligonucleotide
  Target: ATXN1; (-) strand; PAM type: YTN; PAM sequence: TTG
ttgtttttgtgtatatataa

SEQ ID NO: 187882 - DNA, 20 bp, Artificial Sequence
  Description of Artificial Sequence: Synthetic oligonucleotide
  Target: ATXN1; (-) strand; PAM type: YTN; PAM sequence: TTG
ttgttgtttttgtgtatata

SEQ ID NO: 187883 - DNA, 20 bp, Artificial Sequence
  Description of Artificial Sequence: Synthetic oligonucleotide
  Target: ATXN1; (-) strand; PAM type: YTN; PAM sequence: TTT
gttgttgtttttgtgtatat

SEQ ID NO: 187884 - DNA, 20 bp, Artificial Sequence
  Description of Artificial Sequence: Synthetic oligonucleotide
  Target: ATXN1; (-) strand; PAM type: YTN; PAM sequence: TTT
tgttgttgtttttgtgtata

SEQ ID NO: 187885 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgtttttgtgtat

SEQ ID NO: 187886 - DNA, 20 bp, Artificial Sequence
  Description of Artificial Sequence: Synthetic oligonucleotide
  Target: ATXN1; (-) strand; PAM type: YTN; PAM sequence: CTA
ggtttttgttgttgtttttg

SEQ ID NO: 187887 - DNA, 20 bp, Artificial Sequence
  Description of Artificial Sequence: Synthetic oligonucleotide
  Target: ATXN1; (-) strand; PAM type: YTN; PAM sequence: TTC
taggtttttgttgttgtttt

SEQ ID NO: 187888 - DNA, 20 bp, Artificial Sequence
  Description of Artificial Sequence: Synthetic oligonucleotide
  Target: ATXN1; (-) strand; PAM type: YTN; PAM sequence: CTT
ctaggtttttgttgttgttt

SEQ ID NO: 187889 - DNA, 20 bp, Artificial Sequence
  Description of Artificial Sequence: Synthetic oligonucleotide
  Target: ATXN1; (-) strand; PAM type: YTN; PAM sequence: TTC
ttctaggtttttgttgttgt

SEQ ID NO: 187890 - DNA, 20 bp, Artificial Sequence
  Description of Artificial Sequence: Synthetic oligonucleotide
  Target: ATXN1; (-) strand; PAM type: YTN; PAM sequence: TTT
cttctaggtttttgttgttg

SEQ ID NO: 187891 - DNA, 20 bp, Artificial Sequence
  Description of Artificial Sequence: Synthetic oligonucleotide
  Target: ATXN1; (-) strand; PAM type: YTN; PAM sequence: TTA
ggaaatgacaagccaatttc

SEQ ID NO: 187892 - DNA, 20 bp, Artificial Sequence
  Description of Artificial Sequence: Synthetic oligonucleotide
  Target: ATXN1; (-) strand; PAM type: YTN; PAM sequence: TTT
aggaaatgacaagccaattt

SEQ ID NO: 187893 - DNA, 20 bp, Artificial Sequence
  Description of Artificial Sequence: Synthetic oligonucleotide
  Target: ATXN1; (-) strand; PAM type: YTN; PAM sequence: TTT
taggaaatgacaagccaatt

SEQ ID NO: 187894 - DNA, 20 bp, Artificial Sequence
  Description of Artificial Sequence: Synthetic oligonucleotide
  Target: ATXN1; (-) strand; PAM type: YTN; PAM sequence: TTC
aaattttaggaaatgacaag

SEQ ID NO: 187895 - DNA, 20 bp, Artificial Sequence
  Description of Artificial Sequence: Synthetic oligonucleotide
  Target: ATXN1; (-) strand; PAM type: YTN; PAM sequence: CTT
caaattttaggaaatgacaa

SEQ ID NO: 187896 - DNA, 20 bp, Artificial Sequence
  Description of Artificial Sequence: Synthetic oligonucleotide
  Target: ATXN1; (-) strand; PAM type: YTN; PAM sequence: TTA
tcttcaaattttaggaaatg

SEQ ID NO: 187897 - DNA, 20 bp, Artificial Sequence
  Description of Artificial Sequence: Synthetic oligonucleotide
  Target: ATXN1; (-) strand; PAM type: YTN; PAM sequence: CTG
aggacgagaagatattatct

SEQ ID NO: 187898 - DNA, 20 bp, Artificial Sequence
  Description of Artificial Sequence: Synthetic oligonucleotide
  Target: ATXN1; (-) strand; PAM type: YTN; PAM sequence: CTC
tgaggacgagaagatattat

SEQ ID NO: 187899 - DNA, 20 bp, Artificial Sequence
  Description of Artificial Sequence: Synthetic oligonucleotide
  Target: ATXN1; (-) strand; PAM type: YTN; PAM sequence: CTA
tgaatacctctgaggacgag

SEQ ID NO: 187900 - DNA, 20 bp, Artificial Sequence
  Description of Artificial Sequence: Synthetic oligonucleotide
  Target: ATXN1; (-) strand; PAM type: YTN; PAM sequence: CTA
catgaaacccaggatggcct

SEQ ID NO: 187901 - DNA, 20 bp, Artificial Sequence
  Description of Artificial Sequence: Synthetic oligonucleotide
  Target: ATXN1; (-) strand; PAM type: YTN; PAM sequence: TTG
accaggaaagaaaatagcta

SEQ ID NO: 187902 - DNA, 20 bp, Artificial Sequence
  Description of Artificial Sequence: Synthetic oligonucleotide
  Target: ATXN1; (-) strand; PAM type: YTN; PAM sequence: TTT
gaccaggaaagaaaatagct

SEQ ID NO: 187903 - DNA, 20 bp, Artificial Sequence
  Description of Artificial Sequence: Synthetic oligonucleotide
  Target: ATXN1; (-) strand; PAM type: YTN; PAM sequence: TTT
tgaccaggaaagaaaatagc

SEQ ID NO: 187904 - DNA, 20 bp, Artificial Sequence
  Description of Artificial Sequence: Synthetic oligonucleotide
  Target: ATXN1; (-) strand; PAM type: YTN; PAM sequence: TTA
ggagattttgaccaggaaag

SEQ ID NO: 187905 - DNA, 20 bp, Artificial Sequence
  Description of Artificial Sequence: Synthetic oligonucleotide
  Target: ATXN1; (-) strand; PAM type: YTN; PAM sequence: CTG
tgtcacaaaacacagttagg

SEQ ID NO: 187906 - DNA, 20 bp, Artificial Sequence
  Description of Artificial Sequence: Synthetic oligonucleotide
  Target: ATXN1; (-) strand; PAM type: YTN; PAM sequence: CTG
gactgtgtcacaaaacacag

SEQ ID NO: 187907 - DNA, 20 bp, Artificial Sequence
  Description of Artificial Sequence: Synthetic oligonucleotide
  Target: ATXN1; (-) strand; PAM type: YTN; PAM sequence: TTG
ctggactgtgtcacaaaaca

SEQ ID NO: 187908 - DNA, 20 bp, Artificial Sequence
  Description of Artificial Sequence: Synthetic oligonucleotide
  Target: ATXN1; (-) strand; PAM type: YTN; PAM sequence: TTG
ttgctggactgtgtcacaaa

SEQ ID NO: 187909 - DNA, 20 bp, Artificial Sequence
  Description of Artificial Sequence: Synthetic oligonucleotide
  Target: ATXN1; (-) strand; PAM type: YTN; PAM sequence: CTT
gttgctggactgtgtcacaa

SEQ ID NO: 187910 - DNA, 20 bp, Artificial Sequence
  Description of Artificial Sequence: Synthetic oligonucleotide
  Target: ATXN1; (-) strand; PAM type: YTN; PAM sequence: TTA
ccttgttgctggactgtgtc

SEQ ID NO: 187911 - DNA, 20 bp, Artificial Sequence
  Description of Artificial Sequence: Synthetic oligonucleotide
  Target: ATXN1; (-) strand; PAM type: YTN; PAM sequence: TTT
accttgttgctggactgtgt

SEQ ID NO: 187912 - DNA, 20 bp, Artificial Sequence
  Description of Artificial Sequence: Synthetic oligonucleotide
  Target: ATXN1; (-) strand; PAM type: YTN; PAM sequence: CTA
gagaatttaccttgttgctg

SEQ ID NO: 187913 - DNA, 20 bp, Artificial Sequence
  Description of Artificial Sequence: Synthetic oligonucleotide
  Target: ATXN1; (-) strand; PAM type: YTN; PAM sequence: TTC
tagagaatttaccttgttgc

SEQ ID NO: 187914 - DNA, 20 bp, Artificial Sequence
  Description of Artificial Sequence: Synthetic oligonucleotide
  Target: ATXN1; (-) strand; PAM type: YTN; PAM sequence: TTT
ctagagaatttaccttgttg

SEQ ID NO: 187915 - DNA, 20 bp, Artificial Sequence
  Description of Artificial Sequence: Synthetic oligonucleotide
  Target: ATXN1; (-) strand; PAM type: YTN; PAM sequence: CTT
tctagagaatttaccttgtt

SEQ ID NO: 187916 - DNA, 20 bp, Artificial Sequence
  Description of Artificial Sequence: Synthetic oligonucleotide
  Target: ATXN1; (-) strand; PAM type: YTN; PAM sequence: CTA
ctttctagagaatttacctt

SEQ ID NO: 187917 - DNA, 20 bp, Artificial Sequence
  Description of Artificial Sequence: Synthetic oligonucleotide
  Target: ATXN1; (-) strand; PAM type: YTN; PAM sequence: CTC
ctactttctagagaatttac

SEQ ID NO: 187918 - DNA, 20 bp, Artificial Sequence
  Description of Artificial Sequence: Synthetic oligonucleotide
  Target: ATXN1; (-) strand; PAM type: YTN; PAM sequence: CTC
agccctcctactttctagag

SEQ ID NO: 187919 - DNA, 20 bp, Artificial Sequence
  Description of Artificial Sequence: Synthetic oligonucleotide
  Target: ATXN1; (-) strand; PAM type: YTN; PAM sequence: CTA
ggaaataatgcaaaggtgct

SEQ ID NO: 187920 - DNA, 20 bp, Artificial Sequence
  Description of Artificial Sequence: Synthetic oligonucleotide
  Target: ATXN1; (-) strand; PAM type: YTN; PAM sequence: TTC
cactaggaaataatgcaaag

SEQ ID NO: 187921 - DNA, 20 bp, Artificial Sequence
  Description of Artificial Sequence: Synthetic oligonucleotide
  Target: ATXN1; (-) strand; PAM type: YTN; PAM sequence: CTT
ccactaggaaataatgcaaa

SEQ ID NO: 187922 - DNA, 20 bp, Artificial Sequence
  Description of Artificial Sequence: Synthetic oligonucleotide
  Target: ATXN1; (-) strand; PAM type: YTN; PAM sequence: TTC
agggagcccttccactagga

SEQ ID NO: 187923 - DNA, 20 bp, Artificial Sequence
  Description of Artificial Sequence: Synthetic oligonucleotide
  Target: ATXN1; (-) strand; PAM type: YTN; PAM sequence: CTT
cagggagcccttccactagg

SEQ ID NO: 187924 - DNA, 20 bp, Artificial Sequence
  Description of Artificial Sequence: Synthetic oligonucleotide
  Target: ATXN1; (-) strand; PAM type: YTN; PAM sequence: TTA
gtgtcaggtaatggaagaga

SEQ ID NO: 187925 - DNA, 20 bp, Artificial Sequence
  Description of Artificial Sequence: Synthetic oligonucleotide
  Target: ATXN1; (-) strand; PAM type: YTN; PAM sequence: TTT
agtgtcaggtaatggaagag

SEQ ID NO: 187926 - DNA, 20 bp, Artificial Sequence
  Description of Artificial Sequence: Synthetic oligonucleotide
  Target: ATXN1; (-) strand; PAM type: YTN; PAM sequence: TTT
tagtgtcaggtaatggaaga

SEQ ID NO: 187927 - DNA, 20 bp, Artificial Sequence
  Description of Artificial Sequence: Synthetic oligonucleotide
  Target: ATXN1; (-) strand; PAM type: YTN; PAM sequence: TTG
catgagaagttttagtgtca

SEQ ID NO: 187928 - DNA, 20 bp, Artificial Sequence
  Description of Artificial Sequence: Synthetic oligonucleotide
  Target: ATXN1; (-) strand; PAM type: YTN; PAM sequence: CTT
gcatgagaagttttagtgtc

SEQ ID NO: 187929 - DNA, 20 bp, Artificial Sequence
  Description of Artificial Sequence: Synthetic oligonucleotide
  Target: ATXN1; (-) strand; PAM type: YTN; PAM sequence: CTG
atggccgccttgcatgagaa

SEQ ID NO: 187930 - DNA, 20 bp, Artificial Sequence
  Description of Artificial Sequence: Synthetic oligonucleotide
  Target: ATXN1; (-) strand; PAM type: YTN; PAM sequence: TTC
ccacatgtcacctgatggcc

SEQ ID NO: 187931 - DNA, 20 bp, Artificial Sequence
  Description of Artificial Sequence: Synthetic oligonucleotide
  Target: ATXN1; (-) strand; PAM type: YTN; PAM sequence: TTG
ttcccacatgtcacctgatg

SEQ ID NO: 187932 - DNA, 20 bp, Artificial Sequence
  Description of Artificial Sequence: Synthetic oligonucleotide
  Target: ATXN1; (-) strand; PAM type: YTN; PAM sequence: TTT
gttcccacatgtcacctgat

SEQ ID NO: 187933 - DNA, 20 bp, Artificial Sequence
  Description of Artificial Sequence: Synthetic oligonucleotide
  Target: ATXN1; (-) strand; PAM type: YTN; PAM sequence: TTA
gtaaagtttgttcccacatg

SEQ ID NO: 187934 - DNA, 20 bp, Artificial Sequence
  Description of Artificial Sequence: Synthetic oligonucleotide
  Target: ATXN1; (-) strand; PAM type: YTN; PAM sequence: TTG
agattagtaaagtttgttcc

SEQ ID NO: 187935 - DNA, 20 bp, Artificial Sequence
  Description of Artificial Sequence: Synthetic oligonucleotide
  Target: ATXN1; (-) strand; PAM type: YTN; PAM sequence: TTT
gagattagtaaagtttgttc

SEQ ID NO: 187936 - DNA, 20 bp, Artificial Sequence
  Description of Artificial Sequence: Synthetic oligonucleotide
  Target: ATXN1; (-) strand; PAM type: YTN; PAM sequence: TTT
tgagattagtaaagtttgtt

SEQ ID NO: 187937 - DNA, 20 bp, Artificial Sequence
  Description of Artificial Sequence: Synthetic oligonucleotide
  Target: ATXN1; (-) strand; PAM type: YTN; PAM sequence: TTG
ggattttgagattagtaaag

SEQ ID NO: 187938 - DNA, 20 bp, Artificial Sequence
  Description of Artificial Sequence: Synthetic oligonucleotide
  Target: ATXN1; (-) strand; PAM type: YTN; PAM sequence: CTT
gggattttgagattagtaaa

SEQ ID NO: 187939 - DNA, 20 bp, Artificial Sequence
  Description of Artificial Sequence: Synthetic oligonucleotide
  Target: ATXN1; (-) strand; PAM type: YTN; PAM sequence: CTG
gcttgggattttgagattag

SEQ ID NO: 187940 - DNA, 20 bp, Artificial Sequence
  Description of Artificial Sequence: Synthetic oligonucleotide
  Target: ATXN1; (-) strand; PAM type: YTN; PAM sequence: TTA
ctggcttgggattttgagat

SEQ ID NO: 187941 - DNA, 20 bp, Artificial Sequence
  Description of Artificial Sequence: Synthetic oligonucleotide
  Target: ATXN1; (-) strand; PAM type: YTN; PAM sequence: TTG
atcagttactggcttgggat

SEQ ID NO: 187942 - DNA, 20 bp, Artificial Sequence
  Description of Artificial Sequence: Synthetic oligonucleotide
  Target: ATXN1; (-) strand; PAM type: YTN; PAM sequence: TTT
gatcagttactggcttggga

SEQ ID NO: 187943 - DNA, 20 bp, Artificial Sequence
  Description of Artificial Sequence: Synthetic oligonucleotide
  Target: ATXN1; (-) strand; PAM type: YTN; PAM sequence: TTT
tgatcagttactggcttggg

SEQ ID NO: 187944 - DNA, 20 bp, Artificial Sequence
  Description of Artificial Sequence: Synthetic oligonucleotide
  Target: ATXN1; (-) strand; PAM type: YTN; PAM sequence: CTG
gttttgatcagttactggct

SEQ ID NO: 187945 - DNA, 20 bp, Artificial Sequence
  Description of Artificial Sequence: Synthetic oligonucleotide
  Target: ATXN1; (-) strand; PAM type: YTN; PAM sequence: TTA
ctggttttgatcagttactg

SEQ ID NO: 187946 - DNA, 20 bp, Artificial Sequence
  Description of Artificial Sequence: Synthetic oligonucleotide
  Target: ATXN1; (-) strand; PAM type: YTN; PAM sequence: TTT
actggttttgatcagttact

SEQ ID NO: 187947 - DNA, 20 bp, Artificial Sequence
  Description of Artificial Sequence: Synthetic oligonucleotide
  Target: ATXN1; (-) strand; PAM type: YTN; PAM sequence: CTG
atttactggttttgatcagt

SEQ ID NO: 187948 - DNA, 20 bp, Artificial Sequence
  Description of Artificial Sequence: Synthetic oligonucleotide
  Target: ATXN1; (-) strand; PAM type: YTN; PAM sequence: TTA
aaatgagctgatttactggt

SEQ ID NO: 187949 - DNA, 20 bp, Artificial Sequence
  Description of Artificial Sequence: Synthetic oligonucleotide
  Target: ATXN1; (-) strand; PAM type: YTN; PAM sequence: CTT
aaaatgagctgatttactgg

SEQ ID NO: 187950 - DNA, 20 bp, Artificial Sequence
  Description of Artificial Sequence: Synthetic oligonucleotide
  Target: ATXN1; (-) strand; PAM type: YTN; PAM sequence: TTA
cttaaaatgagctgatttac

SEQ ID NO: 187951 - DNA, 20 bp, Artificial Sequence
  Description of Artificial Sequence: Synthetic oligonucleotide
  Target: ATXN1; (-) strand; PAM type: YTN; PAM sequence: CTT
acttaaaatgagctgattta

SEQ ID NO: 187952 - DNA, 20 bp, Artificial Sequence
  Description of Artificial Sequence: Synthetic oligonucleotide
  Target: ATXN1; (-) strand; PAM type: YTN; PAM sequence: TTC
ccttacttaaaatgagctga

SEQ ID NO: 187953 - DNA, 20 bp, Artificial Sequence
  Description of Artificial Sequence: Synthetic oligonucleotide
  Target: ATXN1; (-) strand; PAM type: YTN; PAM sequence: CTT
cccttacttaaaatgagctg

SEQ ID NO: 187954 - DNA, 20 bp, Artificial Sequence
  Description of Artificial Sequence: Synthetic oligonucleotide
  Target: ATXN1; (-) strand; PAM type: YTN; PAM sequence: TTG
gtgcttcccttacttaaaat

SEQ ID NO: 187955 - DNA, 20 bp, Artificial Sequence
  Description of Artificial Sequence: Synthetic oligonucleotide
  Target: ATXN1; (-) strand; PAM type: YTN; PAM sequence: TTT
ggtgcttcccttacttaaaa

SEQ ID NO: 187956 - DNA, 20 bp, Artificial Sequence
  Description of Artificial Sequence: Synthetic oligonucleotide
  Target: ATXN1; (-) strand; PAM type: YTN; PAM sequence: TTA
tgtttggtgcttcccttact

SEQ ID NO: 187957 - DNA, 20 bp, Artificial Sequence
  Description of Artificial Sequence: Synthetic oligonucleotide
  Target: ATXN1; (-) strand; PAM type: YTN; PAM sequence: TTA
caagcagttatgtttggtgc

SEQ ID NO: 187958 - DNA, 20 bp, Artificial Sequence
  Description of Artificial Sequence: Synthetic oligonucleotide
  Target: ATXN1; (-) strand; PAM type: YTN; PAM sequence: TTG
aggtatgcaagttacaagca

SEQ ID NO: 187959 - DNA, 20 bp, Artificial Sequence
  Description of Artificial Sequence: Synthetic oligonucleotide
  Target: ATXN1; (-) strand; PAM type: YTN; PAM sequence: CTT
gaggtatgcaagttacaagc

SEQ ID NO: 187960 - DNA, 20 bp, Artificial Sequence
  Description of Artificial Sequence: Synthetic oligonucleotide
  Target: ATXN1; (-) strand; PAM type: YTN; PAM sequence: TTG
taaaatcttgaggtatgcaa

SEQ ID NO: 187961 - DNA, 20 bp, Artificial Sequence
  Description of Artificial Sequence: Synthetic oligonucleotide
  Target: ATXN1; (-) strand; PAM type: YTN; PAM sequence: CTT
gtaaaatcttgaggtatgca

SEQ ID NO: 187962 - DNA, 20 bp, Artificial Sequence
  Description of Artificial Sequence: Synthetic oligonucleotide
  Target: ATXN1; (-) strand; PAM type: YTN; PAM sequence: CTG
gcttgtaaaatcttgaggta

SEQ ID NO: 187963 - DNA, 20 bp, Artificial Sequence
  Description of Artificial Sequence: Synthetic oligonucleotide
  Target: ATXN1; (-) strand; PAM type: YTN; PAM sequence: CTC
tggcttgtaaaatcttgagg

SEQ ID NO: 187964 - DNA, 20 bp, Artificial Sequence
  Description of Artificial Sequence: Synthetic oligonucleotide
  Target: ATXN1; (-) strand; PAM type: YTN; PAM sequence: CTC
tctggcttgtaaaatcttga

SEQ ID NO: 187965 - DNA, 20 bp, Artificial Sequence
  Description of Artificial Sequence: Synthetic oligonucleotide
  Target: ATXN1; (-) strand; PAM type: YTN; PAM sequence: TTC
tctctggcttgtaaaatctt

SEQ ID NO: 187966 - DNA, 20 bp, Artificial Sequence
  Description of Artificial Sequence: Synthetic oligonucleotide
  Target: ATXN1; (-) strand; PAM type: YTN; PAM sequence: TTT
ctctctggcttgtaaaatct

SEQ ID NO: 187967 - DNA, 20 bp, Artificial Sequence
  Description of Artificial Sequence: Synthetic oligonucleotide
  Target: ATXN1; (-) strand; PAM type: YTN; PAM sequence: TTT
tctctctggcttgtaaaatc

SEQ ID NO: 187968 - DNA, 20 bp, Artificial Sequence
  Description of Artificial Sequence: Synthetic oligonucleotide
  Target: ATXN1; (-) strand; PAM type: YTN; PAM sequence: TTT
ttctctctggcttgtaaaat

SEQ ID NO: 187969 - DNA, 20 bp, Artificial Sequence
  Description of Artificial Sequence: Synthetic oligonucleotide
  Target: ATXN1; (-) strand; PAM type: YTN; PAM sequence: TTG
atgaaaatgacatttttctc

SEQ ID NO: 187970 - DNA, 20 bp, Artificial Sequence
  Description of Artificial Sequence: Synthetic oligonucleotide
  Target: ATXN1; (-) strand; PAM type: YTN; PAM sequence: CTG
tatgtgcagttgatgaaaat

SEQ ID NO: 187971 - DNA, 20 bp, Artificial Sequence
  Description of Artificial Sequence: Synthetic oligonucleotide
  Target: ATXN1; (-) strand; PAM type: YTN; PAM sequence: TTC
tgtatgtgcagttgatgaaa

SEQ ID NO: 187972 - DNA, 20 bp, Artificial Sequence
  Description of Artificial Sequence: Synthetic oligonucleotide
  Target: ATXN1; (-) strand; PAM type: YTN; PAM sequence: CTT
ctgtatgtgcagttgatgaa

SEQ ID NO: 187973 - DNA, 20 bp, Artificial Sequence
  Description of Artificial Sequence: Synthetic oligonucleotide
  Target: ATXN1; (-) strand; PAM type: YTN; PAM sequence: TTC
ttctgtatgtgcagttgatg

SEQ ID NO: 187974 - DNA, 20 bp, Artificial Sequence
  Description of Artificial Sequence: Synthetic oligonucleotide
  Target: ATXN1; (-) strand; PAM type: YTN; PAM sequence: TTA
ttcttctgtatgtgcagttg

SEQ ID NO: 187975 - DNA, 20 bp, Artificial Sequence
  Description of Artificial Sequence: Synthetic oligonucleotide
  Target: ATXN1; (-) strand; PAM type: YTN; PAM sequence: TTC
catccagcaattattcttct

SEQ ID NO: 187976 - DNA, 20 bp, Artificial Sequence
  Description of Artificial Sequence: Synthetic oligonucleotide
  Target: ATXN1; (-) strand; PAM type: YTN; PAM sequence: TTT
ccatccagcaattattcttc

SEQ ID NO: 187977 - DNA, 20 bp, Artificial Sequence
  Description of Artificial Sequence: Synthetic oligonucleotide
  Target: ATXN1; (-) strand; PAM type: YTN; PAM sequence: TTA
gcaatcagagtttccatcca

SEQ ID NO: 187978 - DNA, 20 bp, Artificial Sequence
  Description of Artificial Sequence: Synthetic oligonucleotide
  Target: ATXN1; (-) strand; PAM type: YTN; PAM sequence: CTA
aggattagcaatcagagttt

SEQ ID NO: 187979 - DNA, 20 bp, Artificial Sequence
  Description of Artificial Sequence: Synthetic oligonucleotide
  Target: ATXN1; (-) strand; PAM type: YTN; PAM sequence: CTC
caggctaaggattagcaatc

SEQ ID NO: 187980 - DNA, 20 bp, Artificial Sequence
  Description of Artificial Sequence: Synthetic oligonucleotide
  Target: ATXN1; (-) strand; PAM type: YTN; PAM sequence: TTC
tccaggctaaggattagcaa

SEQ ID NO: 187981 - DNA, 20 bp, Artificial Sequence
  Description of Artificial Sequence: Synthetic oligonucleotide
  Target: ATXN1; (-) strand; PAM type: YTN; PAM sequence: TTG
gtgagtagggggtaaaattc

SEQ ID NO: 187982 - DNA, 20 bp, Artificial Sequence
  Description of Artificial Sequence: Synthetic oligonucleotide
  Target: ATXN1; (-) strand; PAM type: YTN; PAM sequence: TTA
ggttggtgagtagggggtaa

SEQ ID NO: 187983 - DNA, 20 bp, Artificial Sequence
  Description of Artificial Sequence: Synthetic oligonucleotide
  Target: ATXN1; (-) strand; PAM type: YTN; PAM sequence: TTT
aggttggtgagtagggggta

SEQ ID NO: 187984 - DNA, 20 bp, Artificial Sequence
  Description of Artificial Sequence: Synthetic oligonucleotide
  Target: ATXN1; (-) strand; PAM type: YTN; PAM sequence: TTT
taggttggtgagtagggggt

SEQ ID NO: 187985 - DNA, 20 bp, Artificial Sequence
  Description of Artificial Sequence: Synthetic oligonucleotide
  Target: ATXN1; (-) strand; PAM type: YTN; PAM sequence: CTT
ttaggttggtgagtaggggg

SEQ ID NO: 187986 - DNA, 20 bp, Artificial Sequence
  Description of Artificial Sequence: Synthetic oligonucleotide
  Target: ATXN1; (-) strand; PAM type: YTN; PAM sequence: TTC
ttttaggttggtgagtaggg

SEQ ID NO: 187987 - DNA, 20 bp, Artificial Sequence
  Description of Artificial Sequence: Synthetic oligonucleotide
  Target: ATXN1; (-) strand; PAM type: YTN; PAM sequence: TTG
cagttcttttaggttggtga

SEQ ID NO: 187988 - DNA, 20 bp, Artificial Sequence
  Description of Artificial Sequence: Synthetic oligonucleotide
  Target: ATXN1; (-) strand; PAM type: YTN; PAM sequence: CTG
ttgcagttcttttaggttgg

SEQ ID NO: 187989 - DNA, 20 bp, Artificial Sequence
  Description of Artificial Sequence: Synthetic oligonucleotide
  Target: ATXN1; (-) strand; PAM type: YTN; PAM sequence: CTG
ggctgttgcagttcttttag

SEQ ID NO: 187990 - DNA, 20 bp, Artificial Sequence
  Description of Artificial Sequence: Synthetic oligonucleotide
  Target: ATXN1; (-) strand; PAM type: YTN; PAM sequence: TTA
aactgggctgttgcagttct

SEQ ID NO: 187991 - DNA, 20 bp, Artificial Sequence
  Description of Artificial Sequence: Synthetic oligonucleotide
  Target: ATXN1; (-) strand; PAM type: YTN; PAM sequence: TTT
aaactgggctgttgcagttc

SEQ ID NO: 187992 - DNA, 20 bp, Artificial Sequence
  Description of Artificial Sequence: Synthetic oligonucleotide
  Target: ATXN1; (-) strand; PAM type: YTN; PAM sequence: CTT
taaactgggctgttgcagtt

SEQ ID NO: 187993 - DNA, 20 bp, Artificial Sequence
  Description of Artificial Sequence: Synthetic oligonucleotide
  Target: ATXN1; (-) strand; PAM type: YTN; PAM sequence: TTA
gagcagcccctttaaactgg

SEQ ID NO: 187994 - DNA, 20 bp, Artificial Sequence
  Description of Artificial Sequence: Synthetic oligonucleotide
  Target: ATXN1; (-) strand; PAM type: YTN; PAM sequence: TTT
agagcagcccctttaaactg

SEQ ID NO: 187995 - DNA, 20 bp, Artificial Sequence
  Description of Artificial Sequence: Synthetic oligonucleotide
  Target: ATXN1; (-) strand; PAM type: YTN; PAM sequence: CTG
gtacagtcaaatagtatcag

SEQ ID NO: 187996 - DNA, 20 bp, Artificial Sequence
  Description of Artificial Sequence: Synthetic oligonucleotide
  Target: ATXN1; (-) strand; PAM type: YTN; PAM sequence: CTA
ctggtacagtcaaatagtat

SEQ ID NO: 187997 - DNA, 20 bp, Artificial Sequence
  Description of Artificial Sequence: Synthetic oligonucleotide
  Target: ATXN1; (-) strand; PAM type: YTN; PAM sequence: TTC
tactggtacagtcaaatagt

SEQ ID NO: 187998 - DNA, 20 bp, Artificial Sequence
  Description of Artificial Sequence: Synthetic oligonucleotide
  Target: ATXN1; (-) strand; PAM type: YTN; PAM sequence: TTT
ctactggtacagtcaaatag

SEQ ID NO: 187999 - DNA, 20 bp, Artificial Sequence
  Description of Artificial Sequence: Synthetic oligonucleotide
  Target: ATXN1; (-) strand; PAM type: YTN; PAM sequence: TTT
tctactggtacagtcaaata

SEQ ID NO: 188000 - DNA, 20 bp, Artificial Sequence
  Description of Artificial Sequence: Synthetic oligonucleotide
  Target: ATXN1; (-) strand; PAM type: YTN; PAM sequence: CTT
ttctactggtacagtcaaat

SEQ ID NO: 188001 - DNA, 20 bp, Artificial Sequence
  Description of Artificial Sequence: Synthetic oligonucleotide
  Target: ATXN1; (-) strand; PAM type: YTN; PAM sequence: TTG
taggaacaccttttctactg

SEQ ID NO: 188002 - DNA, 20 bp, Artificial Sequence
  Description of Artificial Sequence: Synthetic oligonucleotide
  Target: ATXN1; (-) strand; PAM type: YTN; PAM sequence: TTC
attgtaggaacaccttttct

SEQ ID NO: 188003 - DNA, 20 bp, Artificial Sequence
  Description of Artificial Sequence: Synthetic oligonucleotide
  Target: ATXN1; (-) strand; PAM type: YTN; PAM sequence: TTT
cattgtaggaacaccttttc

SEQ ID NO: 188004 - DNA, 20 bp, Artificial Sequence
  Description of Artificial Sequence: Synthetic oligonucleotide
  Target: ATXN1; (-) strand; PAM type: YTN; PAM sequence: CTT
tcattgtaggaacacctttt

SEQ ID NO: 188005 - DNA, 20 bp, Artificial Sequence
  Description of Artificial Sequence: Synthetic oligonucleotide
  Target: ATXN1; (-) strand; PAM type: YTN; PAM sequence: TTC
tttcattgtaggaacacctt

SEQ ID NO: 188006 - DNA, 20 bp, Artificial Sequence
  Description of Artificial Sequence: Synthetic oligonucleotide
  Target: ATXN1; (-) strand; PAM type: YTN; PAM sequence: TTC
aggaataaaaggatggaata

SEQ ID NO: 188007 - DNA, 20 bp, Artificial Sequence
  Description of Artificial Sequence: Synthetic oligonucleotide
  Target: ATXN1; (-) strand; PAM type: YTN; PAM sequence: CTT
caggaataaaaggatggaat

SEQ ID NO: 188008 - DNA, 20 bp, Artificial Sequence
  Description of Artificial Sequence: Synthetic oligonucleotide
  Target: ATXN1; (-) strand; PAM type: YTN; PAM sequence: CTA
cttcaggaataaaaggatgg

SEQ ID NO: 188009 - DNA, 20 bp, Artificial Sequence
  Description of Artificial Sequence: Synthetic oligonucleotide
  Target: ATXN1; (-) strand; PAM type: YTN; PAM sequence: CTA
tctacttcaggaataaaagg

SEQ ID NO: 188010 - DNA, 20 bp, Artificial Sequence
  Description of Artificial Sequence: Synthetic oligonucleotide
  Target: ATXN1; (-) strand; PAM type: YTN; PAM sequence: CTG
caaactatctacttcaggaa

SEQ ID NO: 188011 - DNA, 20 bp, Artificial Sequence
  Description of Artificial Sequence: Synthetic oligonucleotide
  Target: ATXN1; (-) strand; PAM type: YTN; PAM sequence: CTA
tggcatgctgcaaactatct

SEQ ID NO: 188012 - DNA, 20 bp, Artificial Sequence
  Description of Artificial Sequence: Synthetic oligonucleotide
  Target: ATXN1; (-) strand; PAM type: YTN; PAM sequence: TTC
tatggcatgctgcaaactat

SEQ ID NO: 188013 - DNA, 20 bp, Artificial Sequence
  Description of Artificial Sequence: Synthetic oligonucleotide
  Target: ATXN1; (-) strand; PAM type: YTN; PAM sequence: CTT
ctatggcatgctgcaaacta

SEQ ID NO: 188014 - DNA, 20 bp, Artificial Sequence
  Description of Artificial Sequence: Synthetic oligonucleotide
  Target: ATXN1; (-) strand; PAM type: YTN; PAM sequence: CTC
ggcttctatggcatgctgca

SEQ ID NO: 188015 - DNA, 20 bp, Artificial Sequence
  Description of Artificial Sequence: Synthetic oligonucleotide
  Target: ATXN1; (-) strand; PAM type: YTN; PAM sequence: CTC
tcggcttctatggcatgctg

SEQ ID NO: 188016 - DNA, 20 bp, Artificial Sequence
  Description of Artificial Sequence: Synthetic oligonucleotide
  Target: ATXN1; (-) strand; PAM type: YTN; PAM sequence: TTC
tctcggcttctatggcatgc

SEQ ID NO: 188017 - DNA, 20 bp, Artificial Sequence
  Description of Artificial Sequence: Synthetic oligonucleotide
  Target: ATXN1; (-) strand; PAM type: YTN; PAM sequence: TTT
ctctcggcttctatggcatg

SEQ ID NO: 188018 - DNA, 20 bp, Artificial Sequence
  Description of Artificial Sequence: Synthetic oligonucleotide
  Target: ATXN1; (-) strand; PAM type: YTN; PAM sequence: CTT
tctctcggcttctatggcat

SEQ ID NO: 188019 - DNA, 20 bp, Artificial Sequence
  Description of Artificial Sequence: Synthetic oligonucleotide
  Target: ATXN1; (-) strand; PAM type: YTN; PAM sequence: TTG
cctttctctcggcttctatg

SEQ ID NO: 188020 - DNA, 20 bp, Artificial Sequence
  Description of Artificial Sequence: Synthetic oligonucleotide
  Target: ATXN1; (-) strand; PAM type: YTN; PAM sequence: CTT
gcctttctctcggcttctat

SEQ ID NO: 188021 - DNA, 20 bp, Artificial Sequence
  Description of Artificial Sequence: Synthetic oligonucleotide
  Target: ATXN1; (-) strand; PAM type: YTN; PAM sequence: CTG
gaacttgcctttctctcggc

SEQ ID NO: 188022 - DNA, 20 bp, Artificial Sequence
  Description of Artificial Sequence: Synthetic oligonucleotide
  Target: ATXN1; (-) strand; PAM type: YTN; PAM sequence: TTG
ctggaacttgcctttctctc

SEQ ID NO: 188023 - DNA, 20 bp, Artificial Sequence
  Description of Artificial Sequence: Synthetic oligonucleotide
  Target: ATXN1; (-) strand; PAM type: YTN; PAM sequence: TTT
gctggaacttgcctttctct

SEQ ID NO: 188024 - DNA, 20 bp, Artificial Sequence
  Description of Artificial Sequence: Synthetic oligonucleotide
  Target: ATXN1; (-) strand; PAM type: YTN; PAM sequence: TTG
tatttgctggaacttgcctt

SEQ ID NO: 188025 - DNA, 20 bp, Artificial Sequence
  Description of Artificial Sequence: Synthetic oligonucleotide
  Target: ATXN1; (-) strand; PAM type: YTN; PAM sequence: TTT
gtatttgctggaacttgcct

SEQ ID NO: 188026 - DNA, 20 bp, Artificial Sequence
  Description of Artificial Sequence: Synthetic oligonucleotide
  Target: ATXN1; (-) strand; PAM type: YTN; PAM sequence: CTG
tttgtatttgctggaacttg

SEQ ID NO: 188027 - DNA, 20 bp, Artificial Sequence
  Description of Artificial Sequence: Synthetic oligonucleotide
  Target: ATXN1; (-) strand; PAM type: YTN; PAM sequence: TTA
agggaagaggtcctgtttgt

SEQ ID NO: 188028 - DNA, 20 bp, Artificial Sequence
  Description of Artificial Sequence: Synthetic oligonucleotide
  Target: ATXN1; (-) strand; PAM type: YTN; PAM sequence: TTT
aagggaagaggtcctgtttg

SEQ ID NO: 188029 - DNA, 20 bp, Artificial Sequence
  Description of Artificial Sequence: Synthetic oligonucleotide
  Target: ATXN1; (-) strand; PAM type: YTN; PAM sequence: TTT
taagggaagaggtcctgttt

SEQ ID NO: 188030 - DNA, 20 bp, Artificial Sequence
  Description of Artificial Sequence: Synthetic oligonucleotide
  Target: ATXN1; (-) strand; PAM type: YTN; PAM sequence: TTT
ttaagggaagaggtcctgtt

SEQ ID NO: 188031 - DNA, 20 bp, Artificial Sequence
  Description of Artificial Sequence: Synthetic oligonucleotide
  Target: ATXN1; (-) strand; PAM type: YTN; PAM sequence: TTT
tttaagggaagaggtcctgt

SEQ ID NO: 188032 - DNA, 20 bp, Artificial Sequence
  Description of Artificial Sequence: Synthetic oligonucleotide
  Target: ATXN1; (-) strand; PAM type: YTN; PAM sequence: TTA
attttttaagggaagaggtc

SEQ ID NO: 188033 - DNA, 20 bp, Artificial Sequence
  Description of Artificial Sequence: Synthetic oligonucleotide
  Target: ATXN1; (-) strand; PAM type: YTN; PAM sequence: TTT
aattttttaagggaagaggt

SEQ ID NO: 188034 - DNA, 20 bp, Artificial Sequence
  Description of Artificial Sequence: Synthetic oligonucleotide
  Target: ATXN1; (-) strand; PAM type: YTN; PAM sequence: TTG
gaagggaatttaatttttta

SEQ ID NO: 188035 - DNA, 20 bp, Artificial Sequence
  Description of Artificial Sequence: Synthetic oligonucleotide
  Target: ATXN1; (-) strand; PAM type: YTN; PAM sequence: TTA
attggaagggaatttaattt

SEQ ID NO: 188036 - DNA, 20 bp, Artificial Sequence
  Description of Artificial Sequence: Synthetic oligonucleotide
  Target: ATXN1; (-) strand; PAM type: YTN; PAM sequence: TTT
aattggaagggaatttaatt

SEQ ID NO: 188037 - DNA, 20 bp, Artificial Sequence
  Description of Artificial Sequence: Synthetic oligonucleotide
  Target: ATXN1; (-) strand; PAM type: YTN; PAM sequence: TTT
taattggaagggaatttaat

SEQ ID NO: 188038 - DNA, 20 bp, Artificial Sequence
  Description of Artificial Sequence: Synthetic oligonucleotide
  Target: ATXN1; (-) strand; PAM type: YTN; PAM sequence: TTT
ttaattggaagggaatttaa

SEQ ID NO: 188039 - DNA, 20 bp, Artificial Sequence
  Description of Artificial Sequence: Synthetic oligonucleotide
  Target: ATXN1; (-) strand; PAM type: YTN; PAM sequence: TTT
tttaattggaagggaattta

SEQ ID NO: 188040 - DNA, 20 bp, Artificial Sequence
  Description of Artificial Sequence: Synthetic oligonucleotide
  Target: ATXN1; (-) strand; PAM type: YTN; PAM sequence: TTT
ttttaattggaagggaattt

SEQ ID NO: 188041 - DNA, 20 bp, Artificial Sequence
  Description of Artificial Sequence: Synthetic oligonucleotide
  Target: ATXN1; (-) strand; PAM type: YTN; PAM sequence: CTT
tttttaattggaagggaatt

SEQ ID NO: 188042 - DNA, 20 bp, Artificial Sequence
  Description of Artificial Sequence: Synthetic oligonucleotide
  Target: ATXN1; (-) strand; PAM type: YTN; PAM sequence: TTC
tttttttaattggaagggaa

SEQ ID NO: 188043 - DNA, 20 bp, Artificial Sequence
  Description of Artificial Sequence: Synthetic oligonucleotide
  Target: ATXN1; (-) strand; PAM type: YTN; PAM sequence: TTT
ctttttttaattggaaggga

SEQ ID NO: 188044 - DNA, 20 bp, Artificial Sequence
  Description of Artificial Sequence: Synthetic oligonucleotide
  Target: ATXN1; (-) strand; PAM type: YTN; PAM sequence: TTA
atttctttttttaattggaa

SEQ ID NO: 188045 - DNA, 20 bp, Artificial Sequence
  Description of Artificial Sequence: Synthetic oligonucleotide
  Target: ATXN1; (-) strand; PAM type: YTN; PAM sequence: CTA
ggtgatcgtccaattaattt

SEQ ID NO: 188046 - DNA, 20 bp, Artificial Sequence
  Description of Artificial Sequence: Synthetic oligonucleotide
  Target: ATXN1; (-) strand; PAM type: YTN; PAM sequence: CTC
taggtgatcgtccaattaat

SEQ ID NO: 188047 - DNA, 20 bp, Artificial Sequence
  Description of Artificial Sequence: Synthetic oligonucleotide
  Target: ATXN1; (-) strand; PAM type: YTN; PAM sequence: TTA
gcatgagctctaggtgatcg

SEQ ID NO: 188048 - DNA, 20 bp, Artificial Sequence
  Description of Artificial Sequence: Synthetic oligonucleotide
  Target: ATXN1; (-) strand; PAM type: YTN; PAM sequence: TTG
aaggggtattagcatgagct

SEQ ID NO: 188049 - DNA, 20 bp, Artificial Sequence
  Description of Artificial Sequence: Synthetic oligonucleotide
  Target: ATXN1; (-) strand; PAM type: YTN; PAM sequence: TTG
atgtaaccgagccaggtgtt

SEQ ID NO: 188050 - DNA, 20 bp, Artificial Sequence
  Description of Artificial Sequence: Synthetic oligonucleotide
  Target: ATXN1; (-) strand; PAM type: YTN; PAM sequence: CTT
gatgtaaccgagccaggtgt

SEQ ID NO: 188051 - DNA, 20 bp, Artificial Sequence
  Description of Artificial Sequence: Synthetic oligonucleotide
  Target: ATXN1; (-) strand; PAM type: YTN; PAM sequence: TTC
atgaatcacttgatgtaacc

SEQ ID NO: 188052 - DNA, 20 bp, Artificial Sequence
  Description of Artificial Sequence: Synthetic oligonucleotide
  Target: ATXN1; (-) strand; PAM type: YTN; PAM sequence: TTG
taggattcatgaatcacttg

SEQ ID NO: 188053 - DNA, 20 bp, Artificial Sequence
  Description of Artificial Sequence: Synthetic oligonucleotide
  Target: ATXN1; (-) strand; PAM type: YTN; PAM sequence: CTT
gtaggattcatgaatcactt

SEQ ID NO: 188054 - DNA, 20 bp, Artificial Sequence
  Description of Artificial Sequence: Synthetic oligonucleotide
  Target: ATXN1; (-) strand; PAM type: YTN; PAM sequence: TTG
ccttgtaggattcatgaatc

SEQ ID NO: 188055 - DNA, 20 bp, Artificial Sequence
  Description of Artificial Sequence: Synthetic oligonucleotide
  Target: ATXN1; (-) strand; PAM type: YTN; PAM sequence: CTT
gccttgtaggattcatgaat

SEQ ID NO: 188056 - DNA, 20 bp, Artificial Sequence
  Description of Artificial Sequence: Synthetic oligonucleotide
  Target: ATXN1; (-) strand; PAM type: YTN; PAM sequence: TTA
acaaccaagaacaatatgtg

SEQ ID NO: 188057 - DNA, 20 bp, Artificial Sequence
  Description of Artificial Sequence: Synthetic oligonucleotide
  Target: ATXN1; (-) strand; PAM type: YTN; PAM sequence: TTG
taagttaacaaccaagaaca

SEQ ID NO: 188058 - DNA, 20 bp, Artificial Sequence
  Description of Artificial Sequence: Synthetic oligonucleotide
  Target: ATXN1; (-) strand; PAM type: YTN; PAM sequence: CTG
tgaacagtacgcagtgaatg

SEQ ID NO: 188059 - DNA, 20 bp, Artificial Sequence
  Description of Artificial Sequence: Synthetic oligonucleotide
  Target: ATXN1; (-) strand; PAM type: YTN; PAM sequence: CTA
cctgtgaacagtacgcagtg

SEQ ID NO: 188060 - DNA, 20 bp, Artificial Sequence
  Description of Artificial Sequence: Synthetic oligonucleotide
  Target: ATXN1; (-) strand; PAM type: YTN; PAM sequence: CTG
aggctacctgtgaacagtac

SEQ ID NO: 188061 - DNA, 20 bp, Artificial Sequence
  Description of Artificial Sequence: Synthetic oligonucleotide
  Target: ATXN1; (-) strand; PAM type: YTN; PAM sequence: CTC
catggtgaagtataggctga

SEQ ID NO: 188062 - DNA, 20 bp, Artificial Sequence
  Description of Artificial Sequence: Synthetic oligonucleotide
  Target: ATXN1; (-) strand; PAM type: YTN; PAM sequence: CTG
tgggaagtctccatggtgaa

SEQ ID NO: 188063 - DNA, 20 bp, Artificial Sequence
  Description of Artificial Sequence: Synthetic oligonucleotide
  Target: ATXN1; (-) strand; PAM type: YTN; PAM sequence: CTC
cagagcctgtgggaagtctc

SEQ ID NO: 188064 - DNA, 20 bp, Artificial Sequence
  Description of Artificial Sequence: Synthetic oligonucleotide
  Target: ATXN1; (-) strand; PAM type: YTN; PAM sequence: CTC
aggagccctccagagcctgt

SEQ ID NO: 188065 - DNA, 20 bp, Artificial Sequence
  Description of Artificial Sequence: Synthetic oligonucleotide
  Target: ATXN1; (-) strand; PAM type: YTN; PAM sequence: CTG
agcccaagagccctcaggag

SEQ ID NO: 188066 - DNA, 20 bp, Artificial Sequence
  Description of Artificial Sequence: Synthetic oligonucleotide
  Target: ATXN1; (-) strand; PAM type: YTN; PAM sequence: CTG
tgaaaggaagaaagaacacg

SEQ ID NO: 188067 - DNA, 20 bp, Artificial Sequence
  Description of Artificial Sequence: Synthetic oligonucleotide
  Target: ATXN1; (-) strand; PAM type: YTN; PAM sequence: CTC
tgtgaaaggaagaaagaaca

SEQ ID NO: 188068 - DNA, 20 bp, Artificial Sequence
  Description of Artificial Sequence: Synthetic oligonucleotide
  Target: ATXN1; (-) strand; PAM type: YTN; PAM sequence: TTC
tctgtgaaaggaagaaagaa

SEQ ID NO: 188069 - DNA, 20 bp, Artificial Sequence
  Description of Artificial Sequence: Synthetic oligonucleotide
  Target: ATXN1; (-) strand; PAM type: YTN; PAM sequence: CTT
ctctgtgaaaggaagaaaga

SEQ ID NO: 188070 - DNA, 20 bp, Artificial Sequence
  Description of Artificial Sequence: Synthetic oligonucleotide
  Target: ATXN1; (-) strand; PAM type: YTN; PAM sequence: CTC
acttctctgtgaaaggaaga

SEQ ID NO: 188071 - DNA, 20 bp, Artificial Sequence
  Description of Artificial Sequence: Synthetic oligonucleotide
  Target: ATXN1; (-) strand; PAM type: YTN; PAM sequence: TTC
tcacttctctgtgaaaggaa

SEQ ID NO: 188072 - DNA, 20 bp, Artificial Sequence
  Description of Artificial Sequence: Synthetic oligonucleotide
  Target: ATXN1; (-) strand; PAM type: YTN; PAM sequence: TTT
ctcacttctctgtgaaagga

SEQ ID NO: 188073 - DNA, 20 bp, Artificial Sequence
  Description of Artificial Sequence: Synthetic oligonucleotide
  Target: ATXN1; (-) strand; PAM type: YTN; PAM sequence: CTA
ggtatttctcacttctctgt

SEQ ID NO: 188074 - DNA, 20 bp, Artificial Sequence
  Description of Artificial Sequence: Synthetic oligonucleotide
  Target: ATXN1; (-) strand; PAM type: YTN; PAM sequence: TTC
catgctaggtatttctcact

SEQ ID NO: 188075 - DNA, 20 bp, Artificial Sequence
  Description of Artificial Sequence: Synthetic oligonucleotide
  Target: ATXN1; (-) strand; PAM type: YTN; PAM sequence: TTT
ccatgctaggtatttctcac

SEQ ID NO: 188076 - DNA, 20 bp, Artificial Sequence
  Description of Artificial Sequence: Synthetic oligonucleotide
  Target: ATXN1; (-) strand; PAM type: YTN; PAM sequence: CTA
tttccatgctaggtatttct

SEQ ID NO: 188077 - DNA, 20 bp, Artificial Sequence
  Description of Artificial Sequence: Synthetic oligonucleotide
  Target: ATXN1; (-) strand; PAM type: YTN; PAM sequence: TTC
tatttccatgctaggtattt

SEQ ID NO: 188078 - DNA, 20 bp, Artificial Sequence
  Description of Artificial Sequence: Synthetic oligonucleotide
  Target: ATXN1; (-) strand; PAM type: YTN; PAM sequence: CTG
ttctatttccatgctaggta

SEQ ID NO: 188079 - DNA, 20 bp, Artificial Sequence
  Description of Artificial Sequence: Synthetic oligonucleotide
  Target: ATXN1; (-) strand; PAM type: YTN; PAM sequence: TTC
tgttctatttccatgctagg

SEQ ID NO: 188080 - DNA, 20 bp, Artificial Sequence
  Description of Artificial Sequence: Synthetic oligonucleotide
  Target: ATXN1; (-) strand; PAM type: YTN; PAM sequence: CTT
ctgttctatttccatgctag

SEQ ID NO: 188081 - DNA, 20 bp, Artificial Sequence
  Description of Artificial Sequence: Synthetic oligonucleotide
  Target: ATXN1; (-) strand; PAM type: YTN; PAM sequence: TTC
ttctgttctatttccatgct

SEQ ID NO: 188082 - DNA, 20 bp, Artificial Sequence
  Description of Artificial Sequence: Synthetic oligonucleotide
  Target: ATXN1; (-) strand; PAM type: YTN; PAM sequence: TTT
cttctgttctatttccatgc

SEQ ID NO: 188083 - DNA, 20 bp, Artificial Sequence
  Description of Artificial Sequence: Synthetic oligonucleotide
  Target: ATXN1; (-) strand; PAM type: YTN; PAM sequence: TTT
tcttctgttctatttccatg

SEQ ID NO: 188084 - DNA, 20 bp, Artificial Sequence
  Description of Artificial Sequence: Synthetic oligonucleotide
  Target: ATXN1; (-) strand; PAM type: YTN; PAM sequence: TTT
ttcttctgttctatttccat

SEQ ID NO: 188085 - DNA, 20 bp, Artificial Sequence
  Description of Artificial Sequence: Synthetic oligonucleotide
  Target: ATXN1; (-) strand; PAM type: YTN; PAM sequence: CTT
tttcttctgttctatttcca

SEQ ID NO: 188086 - DNA, 20 bp, Artificial Sequence
  Description of Artificial Sequence: Synthetic oligonucleotide
  Target: ATXN1; (-) strand; PAM type: YTN; PAM sequence: TTC
tttttcttctgttctatttc

SEQ ID NO: 188087 - DNA, 20 bp, Artificial Sequence
  Description of Artificial Sequence: Synthetic oligonucleotide
  Target: ATXN1; (-) strand; PAM type: YTN; PAM sequence: TTT
ctttttcttctgttctattt

SEQ ID NO: 188088 - DNA, 20 bp, Artificial Sequence
  Description of Artificial Sequence: Synthetic oligonucleotide
  Target: ATXN1; (-) strand; PAM type: YTN; PAM sequence: TTT
tctttttcttctgttctatt

SEQ ID NO: 188089 - DNA, 20 bp, Artificial Sequence
  Description of Artificial Sequence: Synthetic oligonucleotide
  Target: ATXN1; (-) strand; PAM type: YTN; PAM sequence: TTT
ttctttttcttctgttctat

SEQ ID NO: 188090 - DNA, 20 bp, Artificial Sequence
  Description of Artificial Sequence: Synthetic oligonucleotide
  Target: ATXN1; (-) strand; PAM type: YTN; PAM sequence: CTT
tttctttttcttctgttcta

SEQ ID NO: 188091 - DNA, 20 bp, Artificial Sequence
  Description of Artificial Sequence: Synthetic oligonucleotide
  Target: ATXN1; (-) strand; PAM type: YTN; PAM sequence: TTA
cctttttctttttcttctgt

SEQ ID NO: 188092 - DNA, 20 bp, Artificial Sequence
  Description of Artificial Sequence: Synthetic oligonucleotide
  Target: ATXN1; (-) strand; PAM type: YTN; PAM sequence: TTT
acctttttctttttcttctg

SEQ ID NO: 188093 - DNA, 20 bp, Artificial Sequence
  Description of Artificial Sequence: Synthetic oligonucleotide
  Target: ATXN1; (-) strand; PAM type: YTN; PAM sequence: TTG
atgatgtgtttacctttttc

SEQ ID NO: 188094 - DNA, 20 bp, Artificial Sequence
  Description of Artificial Sequence: Synthetic oligonucleotide
  Target: ATXN1; (-) strand; PAM type: YTN; PAM sequence: TTT
gatgatgtgtttaccttttt

SEQ ID NO: 188095 - DNA, 20 bp, Artificial Sequence
  Description of Artificial Sequence: Synthetic oligonucleotide
  Target: ATXN1; (-) strand; PAM type: YTN; PAM sequence: TTC
agataacaagtgatttgatg

SEQ ID NO: 188096 - DNA, 20 bp, Artificial Sequence
  Description of Artificial Sequence: Synthetic oligonucleotide
  Target: ATXN1; (-) strand; PAM type: YTN; PAM sequence: TTG
ttcagataacaagtgatttg

SEQ ID NO: 188097 - DNA, 20 bp, Artificial Sequence
  Description of Artificial Sequence: Synthetic oligonucleotide
  Target: ATXN1; (-) strand; PAM type: YTN; PAM sequence: TTT
gttcagataacaagtgattt

SEQ ID NO: 188098 - DNA, 20 bp, Artificial Sequence
  Description of Artificial Sequence: Synthetic oligonucleotide
  Target: ATXN1; (-) strand; PAM type: YTN; PAM sequence: CTG
tatttgttcagataacaagt

SEQ ID NO: 188099 - DNA, 20 bp, Artificial Sequence
  Description of Artificial Sequence: Synthetic oligonucleotide
  Target: ATXN1; (-) strand; PAM type: YTN; PAM sequence: TTG
gtcgtgagactgtatttgtt

SEQ ID NO: 188100 - DNA, 20 bp, Artificial Sequence
  Description of Artificial Sequence: Synthetic oligonucleotide
  Target: ATXN1; (-) strand; PAM type: YTN; PAM sequence: CTA
attggtcgtgagactgtatt

SEQ ID NO: 188101 - DNA, 20 bp, Artificial Sequence
  Description of Artificial Sequence: Synthetic oligonucleotide
  Target: ATXN1; (-) strand; PAM type: YTN; PAM sequence: TTC
gtctaattggtcgtgagact

SEQ ID NO: 188102 - DNA, 20 bp, Artificial Sequence
  Description of Artificial Sequence: Synthetic oligonucleotide
  Target: ATXN1; (-) strand; PAM type: YTN; PAM sequence: CTA
tcaattcgtctaattggtcg

SEQ ID NO: 188103 - DNA, 20 bp, Artificial Sequence
  Description of Artificial Sequence: Synthetic oligonucleotide
  Target: ATXN1; (-) strand; PAM type: YTN; PAM sequence: TTG
gtgaactatcaattcgtcta

SEQ ID NO: 188104 - DNA, 20 bp, Artificial Sequence
  Description of Artificial Sequence: Synthetic oligonucleotide
  Target: ATXN1; (-) strand; PAM type: YTN; PAM sequence: TTT
ggtgaactatcaattcgtct

SEQ ID NO: 188105 - DNA, 20 bp, Artificial Sequence
  Description of Artificial Sequence: Synthetic oligonucleotide
  Target: ATXN1; (-) strand; PAM type: YTN; PAM sequence: CTT
tggtgaactatcaattcgtc

SEQ ID NO: 188106 - DNA, 20 bp, Artificial Sequence
  Description of Artificial Sequence: Synthetic oligonucleotide
  Target: ATXN1; (-) strand; PAM type: YTN; PAM sequence: TTA
agaaaatggtctttggtgaa

SEQ ID NO: 188107 - DNA, 20 bp, Artificial Sequence
  Description of Artificial Sequence: Synthetic oligonucleotide
  Target: ATXN1; (-) strand; PAM type: YTN; PAM sequence: TTT
aagaaaatggtctttggtga

SEQ ID NO: 188108 - DNA, 20 bp, Artificial Sequence
  Description of Artificial Sequence: Synthetic oligonucleotide
  Target: ATXN1; (-) strand; PAM type: YTN; PAM sequence: TTT
taagaaaatggtctttggtg

SEQ ID NO: 188109 - DNA, 20 bp, Artificial Sequence
  Description of Artificial Sequence: Synthetic oligonucleotide
  Target: ATXN1; (-) strand; PAM type: YTN; PAM sequence: TTT
ttaagaaaatggtctttggt

SEQ ID NO: 188110 - DNA, 20 bp, Artificial Sequence
  Description of Artificial Sequence: Synthetic oligonucleotide
  Target: ATXN1; (-) strand; PAM type: YTN; PAM sequence: TTT
tttaagaaaatggtctttgg

SEQ ID NO: 188111 - DNA, 20 bp, Artificial Sequence
  Description of Artificial Sequence: Synthetic oligonucleotide
  Target: ATXN1; (-) strand; PAM type: YTN; PAM sequence: CTT
ttttaagaaaatggtctttg

SEQ ID NO: 188112 - DNA, 20 bp, Artificial Sequence
  Description of Artificial Sequence: Synthetic oligonucleotide
  Target: ATXN1; (-) strand; PAM type: YTN; PAM sequence: TTC
ttttttaagaaaatggtctt

SEQ ID NO: 188113 - DNA, 20 bp, Artificial Sequence
  Description of Artificial Sequence: Synthetic oligonucleotide
  Target: ATXN1; (-) strand; PAM type: YTN; PAM sequence: CTT
cttttttaagaaaatggtct

SEQ ID NO: 188114 - DNA, 20 bp, Artificial Sequence
  Description of Artificial Sequence: Synthetic oligonucleotide
  Target: ATXN1; (-) strand; PAM type: YTN; PAM sequence: TTG
aacttcttttttaagaaaat

SEQ ID NO: 188115 - DNA, 20 bp, Artificial Sequence
  Description of Artificial Sequence: Synthetic oligonucleotide
  Target: ATXN1; (-) strand; PAM type: YTN; PAM sequence: TTG
ggaaaagagcaagaacattg

SEQ ID NO: 188116 - DNA, 20 bp, Artificial Sequence
  Description of Artificial Sequence: Synthetic oligonucleotide
  Target: ATXN1; (-) strand; PAM type: YTN; PAM sequence: TTT
gggaaaagagcaagaacatt

SEQ ID NO: 188117 - DNA, 20 bp, Artificial Sequence
  Description of Artificial Sequence: Synthetic oligonucleotide
  Target: ATXN1; (-) strand; PAM type: YTN; PAM sequence: TTT
tgggaaaagagcaagaacat

SEQ ID NO: 188118 - DNA, 20 bp, Artificial Sequence
  Description of Artificial Sequence: Synthetic oligonucleotide
  Target: ATXN1; (-) strand; PAM type: YTN; PAM sequence: TTT
ttgggaaaagagcaagaaca

SEQ ID NO: 188119 - DNA, 20 bp, Artificial Sequence
  Description of Artificial Sequence: Synthetic oligonucleotide
  Target: ATXN1; (-) strand; PAM type: YTN; PAM sequence: CTT
tttgggaaaagagcaagaac

SEQ ID NO: 188120 - DNA, 20 bp, Artificial Sequence
  Description of Artificial Sequence: Synthetic oligonucleotide
  Target: ATXN1; (-) strand; PAM type: YTN; PAM sequence: TTC
tttttgggaaaagagcaaga

SEQ ID NO: 188121 - DNA, 20 bp, Artificial Sequence
  Description of Artificial Sequence: Synthetic oligonucleotide
  Target: ATXN1; (-) strand; PAM type: YTN; PAM sequence: TTG
tgttctttttgggaaaagag

SEQ ID NO: 188122 - DNA, 20 bp, Artificial Sequence
  Description of Artificial Sequence: Synthetic oligonucleotide
  Target: ATXN1; (-) strand; PAM type: YTN; PAM sequence: CTG
taccatgttgtgttcttttt

SEQ ID NO: 188123 - DNA, 20 bp, Artificial Sequence
  Description of Artificial Sequence: Synthetic oligonucleotide
  Target: ATXN1; (-) strand; PAM type: YTN; PAM sequence: CTG
gctgtaccatgttgtgttct

SEQ ID NO: 188124 - DNA, 20 bp, Artificial Sequence
  Description of Artificial Sequence: Synthetic oligonucleotide
  Target: ATXN1; (-) strand; PAM type: YTN; PAM sequence: TTG
gggtgaggagaggctggctg

SEQ ID NO: 188125 - DNA, 20 bp, Artificial Sequence
  Description of Artificial Sequence: Synthetic oligonucleotide
  Target: ATXN1; (-) strand; PAM type: YTN; PAM sequence: TTT
ggggtgaggagaggctggct

SEQ ID NO: 188126 - DNA, 20 bp, Artificial Sequence
  Description of Artificial Sequence: Synthetic oligonucleotide
  Target: ATXN1; (-) strand; PAM type: YTN; PAM sequence: CTT
tggggtgaggagaggctggc

SEQ ID NO: 188127 - DNA, 20 bp, Artificial Sequence
  Description of Artificial Sequence: Synthetic oligonucleotide
  Target: ATXN1; (-) strand; PAM type: YTN; PAM sequence: TTC
aactttggggtgaggagagg

SEQ ID NO: 188128 - DNA, 20 bp, Artificial Sequence
  Description of Artificial Sequence: Synthetic oligonucleotide
  Target: ATXN1; (-) strand; PAM type: YTN; PAM sequence: CTT
caactttggggtgaggagag

SEQ ID NO: 188129 - DNA, 20 bp, Artificial Sequence
  Description of Artificial Sequence: Synthetic oligonucleotide
  Target: ATXN1; (-) strand; PAM type: YTN; PAM sequence: CTC
ccagaaatggcttcaacttt

SEQ ID NO: 188130 - DNA, 20 bp, Artificial Sequence
  Description of Artificial Sequence: Synthetic oligonucleotide
  Target: ATXN1; (-) strand; PAM type: YTN; PAM sequence: CTG
aagtctcccagaaatggctt

SEQ ID NO: 188131 - DNA, 20 bp, Artificial Sequence
  Description of Artificial Sequence: Synthetic oligonucleotide
  Target: ATXN1; (-) strand; PAM type: YTN; PAM sequence: TTG
tgtctgaagtctcccagaaa

SEQ ID NO: 188132 - DNA, 20 bp, Artificial Sequence
  Description of Artificial Sequence: Synthetic oligonucleotide
  Target: ATXN1; (-) strand; PAM type: YTN; PAM sequence: CTA
agattgtgtctgaagtctcc

SEQ ID NO: 188133 - DNA, 20 bp, Artificial Sequence
  Description of Artificial Sequence: Synthetic oligonucleotide
  Target: ATXN1; (-) strand; PAM type: YTN; PAM sequence: CTC
agctaagattgtgtctgaag

SEQ ID NO: 188134 - DNA, 20 bp, Artificial Sequence
  Description of Artificial Sequence: Synthetic oligonucleotide
  Target: ATXN1; (-) strand; PAM type: YTN; PAM sequence: TTG
catctcagctaagattgtgt

SEQ ID NO: 188135 - DNA, 20 bp, Artificial Sequence
  Description of Artificial Sequence: Synthetic oligonucleotide
  Target: ATXN1; (-) strand; PAM type: YTN; PAM sequence: TTT
gcatctcagctaagattgtg

SEQ ID NO: 188136 - DNA, 20 bp, Artificial Sequence
  Description of Artificial Sequence: Synthetic oligonucleotide
  Target: ATXN1; (-) strand; PAM type: YTN; PAM sequence: TTG
caagtttgcatctcagctaa

SEQ ID NO: 188137 - DNA, 20 bp, Artificial Sequence
  Description of Artificial Sequence: Synthetic oligonucleotide
  Target: ATXN1; (-) strand; PAM type: YTN; PAM sequence: TTT
gcaagtttgcatctcagcta

SEQ ID NO: 188138 - DNA, 20 bp, Artificial Sequence
  Description of Artificial Sequence: Synthetic oligonucleotide
  Target: ATXN1; (-) strand; PAM type: YTN; PAM sequence: TTT
tgcaagtttgcatctcagct

SEQ ID NO: 188139 - DNA, 20 bp, Artificial Sequence
  Description of Artificial Sequence: Synthetic oligonucleotide
  Target: ATXN1; (-) strand; PAM type: YTN; PAM sequence: CTT
ttgcaagtttgcatctcagc

SEQ ID NO: 188140 - DNA, 20 bp, Artificial Sequence
  Description of Artificial Sequence: Synthetic oligonucleotide
  Target: ATXN1; (-) strand; PAM type: YTN; PAM sequence: TTG
aggcttttgcaagtttgcat

SEQ ID NO: 188141 - DNA, 20 bp, Artificial Sequence
  Description of Artificial Sequence: Synthetic oligonucleotide
  Target: ATXN1; (-) strand; PAM type: YTN; PAM sequence: TTT
gaggcttttgcaagtttgca

SEQ ID NO: 188142 - DNA, 20 bp, Artificial Sequence
  Description of Artificial Sequence: Synthetic oligonucleotide
  Target: ATXN1; (-) strand; PAM type: YTN; PAM sequence: TTT
tgaggcttttgcaagtttgc

SEQ ID NO: 188143 - DNA, 20 bp, Artificial Sequence
  Description of Artificial Sequence: Synthetic oligonucleotide
  Target: ATXN1; (-) strand; PAM type: YTN; PAM sequence: CTG
ttttgaggcttttgcaagtt

SEQ ID NO: 188144 - DNA, 20 bp, Artificial Sequence
  Description of Artificial Sequence: Synthetic oligonucleotide
  Target: ATXN1; (-) strand; PAM type: YTN; PAM sequence: TTG
cagaagagtaaagccaagtg

SEQ ID NO: 188145 - DNA, 20 bp, Artificial Sequence
  Description of Artificial Sequence: Synthetic oligonucleotide
  Target: ATXN1; (-) strand; PAM type: YTN; PAM sequence: TTT
gcagaagagtaaagccaagt

SEQ ID NO: 188146 - DNA, 20 bp, Artificial Sequence
  Description of Artificial Sequence: Synthetic oligonucleotide
  Target: ATXN1; (-) strand; PAM type: YTN; PAM sequence: TTT
tgcagaagagtaaagccaag

SEQ ID NO: 188147 - DNA, 20 bp, Artificial Sequence
  Description of Artificial Sequence: Synthetic oligonucleotide
  Target: ATXN1; (-) strand; PAM type: YTN; PAM sequence: CTT
ttgcagaagagtaaagccaa

SEQ ID NO: 188148 - DNA, 20 bp, Artificial Sequence
  Description of Artificial Sequence: Synthetic oligonucleotide
  Target: ATXN1; (-) strand; PAM type: YTN; PAM sequence: CTC
cttttgcagaagagtaaagc

SEQ ID NO: 188149 - DNA, 20 bp, Artificial Sequence
  Description of Artificial Sequence: Synthetic oligonucleotide
  Target: ATXN1; (-) strand; PAM type: YTN; PAM sequence: TTG
cctccttttgcagaagagta

SEQ ID NO: 188150 - DNA, 20 bp, Artificial Sequence
  Description of Artificial Sequence: Synthetic oligonucleotide
  Target: ATXN1; (-) strand; PAM type: YTN; PAM sequence: CTT
gcctccttttgcagaagagt

SEQ ID NO: 188151 - DNA, 20 bp, Artificial Sequence
  Description of Artificial Sequence: Synthetic oligonucleotide
  Target: ATXN1; (-) strand; PAM type: YTN; PAM sequence: CTA
gtccttgcctccttttgcag

SEQ ID NO: 188152 - DNA, 20 bp, Artificial Sequence
  Description of Artificial Sequence: Synthetic oligonucleotide
  Target: ATXN1; (-) strand; PAM type: YTN; PAM sequence: CTC
catgacccagtaagatatga

SEQ ID NO: 188153 - DNA, 20 bp, Artificial Sequence
  Description of Artificial Sequence: Synthetic oligonucleotide
  Target: ATXN1; (-) strand; PAM type: YTN; PAM sequence: TTC
tccatgacccagtaagatat

SEQ ID NO: 188154 - DNA, 20 bp, Artificial Sequence
  Description of Artificial Sequence: Synthetic oligonucleotide
  Target: ATXN1; (-) strand; PAM type: YTN; PAM sequence: CTT
ctccatgacccagtaagata

SEQ ID NO: 188155 - DNA, 20 bp, Artificial Sequence
  Description of Artificial Sequence: Synthetic oligonucleotide
  Target: ATXN1; (-) strand; PAM type: YTN; PAM sequence: TTG
atcttctccatgacccagta

SEQ ID NO: 188156 - DNA, 20 bp, Artificial Sequence
  Description of Artificial Sequence: Synthetic oligonucleotide
  Target: ATXN1; (-) strand; PAM type: YTN; PAM sequence: CTT
gatcttctccatgacccagt

SEQ ID NO: 188157 - DNA, 20 bp, Artificial Sequence
  Description of Artificial Sequence: Synthetic oligonucleotide
  Target: ATXN1; (-) strand; PAM type: YTN; PAM sequence: TTC
ttgatcttctccatgaccca

SEQ ID NO: 188158 - DNA, 20 bp, Artificial Sequence
  Description of Artificial Sequence: Synthetic oligonucleotide
  Target: ATXN1; (-) strand; PAM type: YTN; PAM sequence: CTT
cttgatcttctccatgaccc

SEQ ID NO: 188159 - DNA, 20 bp, Artificial Sequence
  Description of Artificial Sequence: Synthetic oligonucleotide
  Target: ATXN1; (-) strand; PAM type: YTN; PAM sequence: TTG
caagaatgatcttcttgatc

SEQ ID NO: 188160 - DNA, 20 bp, Artificial Sequence
  Description of Artificial Sequence: Synthetic oligonucleotide
  Target: ATXN1; (-) strand; PAM type: YTN; PAM sequence: TTT
gcaagaatgatcttcttgat

SEQ ID NO: 188161 - DNA, 20 bp, Artificial Sequence
  Description of Artificial Sequence: Synthetic oligonucleotide
  Target: ATXN1; (-) strand; PAM type: YTN; PAM sequence: CTT
tgcaagaatgatcttcttga

SEQ ID NO: 188162 - DNA, 20 bp, Artificial Sequence
  Description of Artificial Sequence: Synthetic oligonucleotide
  Target: ATXN1; (-) strand; PAM type: YTN; PAM sequence: CTG
tgtgtgctttgcaagaatga

SEQ ID NO: 188163 - DNA, 20 bp, Artificial Sequence
  Description of Artificial Sequence: Synthetic oligonucleotide
  Target: ATXN1; (-) strand; PAM type: YTN; PAM sequence: CTC
gggaactgtgtgtgctttgc

SEQ ID NO: 188164 - DNA, 20 bp, Artificial Sequence
  Description of Artificial Sequence: Synthetic oligonucleotide
  Target: ATXN1; (-) strand; PAM type: YTN; PAM sequence: TTC
tcgggaactgtgtgtgcttt

SEQ ID NO: 188165 - DNA, 20 bp, Artificial Sequence
  Description of Artificial Sequence: Synthetic oligonucleotide
  Target: ATXN1; (-) strand; PAM type: YTN; PAM sequence: CTT
ctcgggaactgtgtgtgctt

SEQ ID NO: 188166 - DNA, 20 bp, Artificial Sequence
  Description of Artificial Sequence: Synthetic oligonucleotide
  Target: ATXN1; (-) strand; PAM type: YTN; PAM sequence: TTC
ttctcgggaactgtgtgtgc

SEQ ID NO: 188167 - DNA, 20 bp, Artificial Sequence
  Description of Artificial Sequence: Synthetic oligonucleotide
  Target: ATXN1; (-) strand; PAM type: YTN; PAM sequence: TTT
cttctcgggaactgtgtgtg

SEQ ID NO: 188168 - DNA, 20 bp, Artificial Sequence
  Description of Artificial Sequence: Synthetic oligonucleotide
  Target: ATXN1; (-) strand; PAM type: YTN; PAM sequence: TTA
acatagtggatttcttctcg

SEQ ID NO: 188169 - DNA, 20 bp, Artificial Sequence
  Description of Artificial Sequence: Synthetic oligonucleotide
  Target: ATXN1; (-) strand; PAM type: YTN; PAM sequence: TTG
cattaacatagtggatttct

SEQ ID NO: 188170 - DNA, 20 bp, Artificial Sequence
  Description of Artificial Sequence: Synthetic oligonucleotide
  Target: ATXN1; (-) strand; PAM type: YTN; PAM sequence: TTT
gcattaacatagtggatttc

SEQ ID NO: 188171 - DNA, 20 bp, Artificial Sequence
  Description of Artificial Sequence: Synthetic oligonucleotide
  Target: ATXN1; (-) strand; PAM type: YTN; PAM sequence: CTT
tgcattaacatagtggattt

SEQ ID NO: 188172 - DNA, 20 bp, Artificial Sequence
  Description of Artificial Sequence: Synthetic oligonucleotide
  Target: ATXN1; (-) strand; PAM type: YTN; PAM sequence: TTA
tgaccaccaacaacgctttg

SEQ ID NO: 188173 - DNA, 20 bp, Artificial Sequence
  Description of Artificial Sequence: Synthetic oligonucleotide
  Target: ATXN1; (-) strand; PAM type: YTN; PAM sequence: CTT
atgaccaccaacaacgcttt

SEQ ID NO: 188174 - DNA, 20 bp, Artificial Sequence
  Description of Artificial Sequence: Synthetic oligonucleotide
  Target: ATXN1; (-) strand; PAM type: YTN; PAM sequence: CTC
aggaacaggcttatgaccac

SEQ ID NO: 188175 - DNA, 20 bp, Artificial Sequence
  Description of Artificial Sequence: Synthetic oligonucleotide
  Target: ATXN1; (-) strand; PAM type: YTN; PAM sequence: CTC
cagagctcaggaacaggctt

SEQ ID NO: 188176 - DNA, 20 bp, Artificial Sequence
  Description of Artificial Sequence: Synthetic oligonucleotide
  Target: ATXN1; (-) strand; PAM type: YTN; PAM sequence: CTG
gctccagagctcaggaacag

SEQ ID NO: 188177 - DNA, 20 bp, Artificial Sequence
  Description of Artificial Sequence: Synthetic oligonucleotide
  Target: ATXN1; (-) strand; PAM type: YTN; PAM sequence: TTC
tggctccagagctcaggaac

SEQ ID NO: 188178 - DNA, 20 bp, Artificial Sequence
  Description of Artificial Sequence: Synthetic oligonucleotide
  Target: ATXN1; (-) strand; PAM type: YTN; PAM sequence: TTG
tattctggctccagagctca

SEQ ID NO: 188179 - DNA, 20 bp, Artificial Sequence
  Description of Artificial Sequence: Synthetic oligonucleotide
  Target: ATXN1; (-) strand; PAM type: YTN; PAM sequence: TTT
gtattctggctccagagctc

SEQ ID NO: 188180 - DNA, 20 bp, Artificial Sequence
  Description of Artificial Sequence: Synthetic oligonucleotide
  Target: ATXN1; (-) strand; PAM type: YTN; PAM sequence: TTT
tgtattctggctccagagct

SEQ ID NO: 188181 - DNA, 20 bp, Artificial Sequence
  Description of Artificial Sequence: Synthetic oligonucleotide
  Target: ATXN1; (-) strand; PAM type: YTN; PAM sequence: CTT
ttgtattctggctccagagc

SEQ ID NO: 188182 - DNA, 20 bp, Artificial Sequence
  Description of Artificial Sequence: Synthetic oligonucleotide
  Target: ATXN1; (-) strand; PAM type: YTN; PAM sequence: CTG
gcttttgtattctggctcca

SEQ ID NO: 188183 - DNA, 20 bp, Artificial Sequence
  Description of Artificial Sequence: Synthetic oligonucleotide
  Target: ATXN1; (-) strand; PAM type: YTN; PAM sequence: TTA
ccagtgctggcttttgtatt

SEQ ID NO: 188184 - DNA, 20 bp, Artificial Sequence
  Description of Artificial Sequence: Synthetic oligonucleotide
  Target: ATXN1; (-) strand; PAM type: YTN; PAM sequence: CTT
accagtgctggcttttgtat

SEQ ID NO: 188185 - DNA, 20 bp, Artificial Sequence
  Description of Artificial Sequence: Synthetic oligonucleotide
  Target: ATXN1; (-) strand; PAM type: YTN; PAM sequence: TTG
gtgccttaccagtgctggct

SEQ ID NO: 188186 - DNA, 20 bp, Artificial Sequence
  Description of Artificial Sequence: Synthetic oligonucleotide
  Target: ATXN1; (-) strand; PAM type: YTN; PAM sequence: TTG
atgattggtgccttaccagt

SEQ ID NO: 188187 - DNA, 20 bp, Artificial Sequence
  Description of Artificial Sequence: Synthetic oligonucleotide
  Target: ATXN1; (-) strand; PAM type: YTN; PAM sequence: CTC
ccgggatagttgatgattgg

SEQ ID NO: 188188 - DNA, 20 bp, Artificial Sequence
  Description of Artificial Sequence: Synthetic oligonucleotide
  Target: ATXN1; (-) strand; PAM type: YTN; PAM sequence: TTG
gatgctcccgggatagttga

SEQ ID NO: 188189 - DNA, 20 bp, Artificial Sequence
  Description of Artificial Sequence: Synthetic oligonucleotide
  Target: ATXN1; (-) strand; PAM type: YTN; PAM sequence: TTT
ggatgctcccgggatagttg

SEQ ID NO: 188190 - DNA, 20 bp, Artificial Sequence
  Description of Artificial Sequence: Synthetic oligonucleotide
  Target: ATXN1; (-) strand; PAM type: YTN; PAM sequence: CTC
agcacagtagggcatgcaga

SEQ ID NO: 188191 - DNA, 20 bp, Artificial Sequence
  Description of Artificial Sequence: Synthetic oligonucleotide
  Target: ATXN1; (-) strand; PAM type: YTN; PAM sequence: CTG
aaactcagcacagtagggca

SEQ ID NO: 188192 - DNA, 20 bp, Artificial Sequence
  Description of Artificial Sequence: Synthetic oligonucleotide
  Target: ATXN1; (-) strand; PAM type: YTN; PAM sequence: TTC
ctgaaactcagcacagtagg

SEQ ID NO: 188193 - DNA, 20 bp, Artificial Sequence
  Description of Artificial Sequence: Synthetic oligonucleotide
  Target: ATXN1; (-) strand; PAM type: YTN; PAM sequence: TTT
cctgaaactcagcacagtag

SEQ ID NO: 188194 - DNA, 20 bp, Artificial Sequence
  Description of Artificial Sequence: Synthetic oligonucleotide
  Target: ATXN1; (-) strand; PAM type: YTN; PAM sequence: CTT
tcctgaaactcagcacagta

SEQ ID NO: 188195 - DNA, 20 bp, Artificial Sequence
  Description of Artificial Sequence: Synthetic oligonucleotide
  Target: ATXN1; (-) strand; PAM type: YTN; PAM sequence: TTC
tttcctgaaactcagcacag

SEQ ID NO: 188196 - DNA, 20 bp, Artificial Sequence
  Description of Artificial Sequence: Synthetic oligonucleotide
  Target: ATXN1; (-) strand; PAM type: YTN; PAM sequence: CTA
ttctttcctgaaactcagca

SEQ ID NO: 188197 - DNA, 20 bp, Artificial Sequence
  Description of Artificial Sequence: Synthetic oligonucleotide
  Target: ATXN1; (-) strand; PAM type: YTN; PAM sequence: TTC
ctattctttcctgaaactca

SEQ ID NO: 188198 - DNA, 20 bp, Artificial Sequence
  Description of Artificial Sequence: Synthetic oligonucleotide
  Target: ATXN1; (-) strand; PAM type: YTN; PAM sequence: CTG
ttcctattctttcctgaaac

SEQ ID NO: 188199 - DNA, 20 bp, Artificial Sequence
  Description of Artificial Sequence: Synthetic oligonucleotide
  Target: ATXN1; (-) strand; PAM type: YTN; PAM sequence: TTC
tgttcctattctttcctgaa

SEQ ID NO: 188200 - DNA, 20 bp, Artificial Sequence
  Description of Artificial Sequence: Synthetic oligonucleotide
  Target: ATXN1; (-) strand; PAM type: YTN; PAM sequence: TTT
ctgttcctattctttcctga

SEQ ID NO: 188201 - DNA, 20 bp, Artificial Sequence
  Description of Artificial Sequence: Synthetic oligonucleotide
  Target: ATXN1; (-) strand; PAM type: YTN; PAM sequence: TTC
gtttctgttcctattctttc

SEQ ID NO: 188202 - DNA, 20 bp, Artificial Sequence
  Description of Artificial Sequence: Synthetic oligonucleotide
  Target: ATXN1; (-) strand; PAM type: YTN; PAM sequence: CTT
cgtttctgttcctattcttt

SEQ ID NO: 188203 - DNA, 20 bp, Artificial Sequence
  Description of Artificial Sequence: Synthetic oligonucleotide
  Target: ATXN1; (-) strand; PAM type: YTN; PAM sequence: TTC
ttcgtttctgttcctattct

SEQ ID NO: 188204 - DNA, 20 bp, Artificial Sequence
  Description of Artificial Sequence: Synthetic oligonucleotide
  Target: ATXN1; (-) strand; PAM type: YTN; PAM sequence: TTC
cagattcttcgtttctgttc

SEQ ID NO: 188205 - DNA, 20 bp, Artificial Sequence
  Description of Artificial Sequence: Synthetic oligonucleotide
  Target: ATXN1; (-) strand; PAM type: YTN; PAM sequence: TTC
ccggagattccagattcttc

SEQ ID NO: 188206 - DNA, 20 bp, Artificial Sequence
  Description of Artificial Sequence: Synthetic oligonucleotide
  Target: ATXN1; (-) strand; PAM type: YTN; PAM sequence: TTT
cccggagattccagattctt

SEQ ID NO: 188207 - DNA, 20 bp, Artificial Sequence
  Description of Artificial Sequence: Synthetic oligonucleotide
  Target: ATXN1; (-) strand; PAM type: YTN; PAM sequence: TTT
tcccggagattccagattct

SEQ ID NO: 188208 - DNA, 20 bp, Artificial Sequence
  Description of Artificial Sequence: Synthetic oligonucleotide
  Target: ATXN1; (-) strand; PAM type: YTN; PAM sequence: TTT
ttcccggagattccagattc

SEQ ID NO: 188209 - DNA, 20 bp, Artificial Sequence
  Description of Artificial Sequence: Synthetic oligonucleotide
  Target: ATXN1; (-) strand; PAM type: YTN; PAM sequence: CTT
tttcccggagattccagatt

SEQ ID NO: 188210 - DNA, 20 bp, Artificial Sequence
  Description of Artificial Sequence: Synthetic oligonucleotide
  Target: ATXN1; (-) strand; PAM type: YTN; PAM sequence: TTC
tttttcccggagattccaga

SEQ ID NO: 188211 - DNA, 20 bp, Artificial Sequence
  Description of Artificial Sequence: Synthetic oligonucleotide
  Target: ATXN1; (-) strand; PAM type: YTN; PAM sequence: TTT
ctttttcccggagattccag

SEQ ID NO: 188212 - DNA, 20 bp, Artificial Sequence
  Description of Artificial Sequence: Synthetic oligonucleotide
  Target: ATXN1; (-) strand; PAM type: YTN; PAM sequence: CTT
tctttttcccggagattcca

SEQ ID NO: 188213 - DNA, 20 bp, Artificial Sequence
  Description of Artificial Sequence: Synthetic oligonucleotide
  Target: ATXN1; (-) strand; PAM type: YTN; PAM sequence: TTC
actttctttttcccggagat

SEQ ID NO: 188214 - DNA, 20 bp, Artificial Sequence
  Description of Artificial Sequence: Synthetic oligonucleotide
  Target: ATXN1; (-) strand; PAM type: YTN; PAM sequence: CTT
cactttctttttcccggaga

SEQ ID NO: 188215 - DNA, 20 bp, Artificial Sequence
  Description of Artificial Sequence: Synthetic oligonucleotide
  Target: ATXN1; (-) strand; PAM type: YTN; PAM sequence: CTG
cgtgatgccttcactttctt

SEQ ID NO: 188216 - DNA, 20 bp, Artificial Sequence
  Description of Artificial Sequence: Synthetic oligonucleotide
  Target: ATXN1; (-) strand; PAM type: YTN; PAM sequence: TTC
ctgcgtgatgccttcacttt

SEQ ID NO: 188217 - DNA, 20 bp, Artificial Sequence
  Description of Artificial Sequence: Synthetic oligonucleotide
  Target: ATXN1; (-) strand; PAM type: YTN; PAM sequence: CTT
cctgcgtgatgccttcactt

SEQ ID NO: 188218 - DNA, 20 bp, Artificial Sequence
  Description of Artificial Sequence: Synthetic oligonucleotide
  Target: ATXN1; (-) strand; PAM type: YTN; PAM sequence: CTA
gcttcctgcgtgatgccttc

SEQ ID NO: 188219 - DNA, 20 bp, Artificial Sequence
  Description of Artificial Sequence: Synthetic oligonucleotide
  Target: ATXN1; (-) strand; PAM type: YTN; PAM sequence: CTC
ctagcttcctgcgtgatgcc

SEQ ID NO: 188220 - DNA, 20 bp, Artificial Sequence
  Description of Artificial Sequence: Synthetic oligonucleotide
  Target: ATXN1; (-) strand; PAM type: YTN; PAM sequence: TTC
tcctagcttcctgcgtgatg

SEQ ID NO: 188221 - DNA, 20 bp, Artificial Sequence
  Description of Artificial Sequence: Synthetic oligonucleotide
  Target: ATXN1; (-) strand; PAM type: YTN; PAM sequence: TTT
ctcctagcttcctgcgtgat

SEQ ID NO: 188222 - DNA, 20 bp, Artificial Sequence
  Description of Artificial Sequence: Synthetic oligonucleotide
  Target: ATXN1; (-) strand; PAM type: YTN; PAM sequence: CTT
tctcctagcttcctgcgtga

SEQ ID NO: 188223 - DNA, 20 bp, Artificial Sequence
  Description of Artificial Sequence: Synthetic oligonucleotide
  Target: ATXN1; (-) strand; PAM type: YTN; PAM sequence: CTC
tttctcctagcttcctgcgt

SEQ ID NO: 188224 - DNA, 20 bp, Artificial Sequence
  Description of Artificial Sequence: Synthetic oligonucleotide
  Target: ATXN1; (-) strand; PAM type: YTN; PAM sequence: TTA
cactctttctcctagcttcc

SEQ ID NO: 188225 - DNA, 20 bp, Artificial Sequence
  Description of Artificial Sequence: Synthetic oligonucleotide
  Target: ATXN1; (-) strand; PAM type: YTN; PAM sequence: CTT
acactctttctcctagcttc

SEQ ID NO: 188226 - DNA, 20 bp, Artificial Sequence
  Description of Artificial Sequence: Synthetic oligonucleotide
  Target: ATXN1; (-) strand; PAM type: YTN; PAM sequence: CTG
cccaccttacactctttctc

SEQ ID NO: 188227 - DNA, 20 bp, Artificial Sequence
  Description of Artificial Sequence: Synthetic oligonucleotide
  Target: ATXN1; (-) strand; PAM type: YTN; PAM sequence: CTA
ctgcccaccttacactcttt

SEQ ID NO: 188228 - DNA, 20 bp, Artificial Sequence
  Description of Artificial Sequence: Synthetic oligonucleotide
  Target: ATXN1; (-) strand; PAM type: YTN; PAM sequence: CTG
catgtgccctactgcccacc

SEQ ID NO: 188229 - DNA, 20 bp, Artificial Sequence
  Description of Artificial Sequence: Synthetic oligonucleotide
  Target: ATXN1; (-) strand; PAM type: YTN; PAM sequence: CTC
ctgcatgtgccctactgccc

SEQ ID NO: 188230 - DNA, 20 bp, Artificial Sequence
  Description of Artificial Sequence: Synthetic oligonucleotide
  Target: ATXN1; (-) strand; PAM type: YTN; PAM sequence: CTG
agggagccgtgtaccaaata

SEQ ID NO: 188231 - DNA, 20 bp, Artificial Sequence
  Description of Artificial Sequence: Synthetic oligonucleotide
  Target: ATXN1; (-) strand; PAM type: YTN; PAM sequence: CTG
caaaccagcaatctgaggga

SEQ ID NO: 188232 - DNA, 20 bp, Artificial Sequence
  Description of Artificial Sequence: Synthetic oligonucleotide
  Target: ATXN1; (-) strand; PAM type: YTN; PAM sequence: TTC
agtgcacgaaacgctgcaaa

SEQ ID NO: 188233 - DNA, 20 bp, Artificial Sequence
  Description of Artificial Sequence: Synthetic oligonucleotide
  Target: ATXN1; (-) strand; PAM type: YTN; PAM sequence: TTC
acagtgtcgcaaacattcag

SEQ ID NO: 188234 - DNA, 20 bp, Artificial Sequence
  Description of Artificial Sequence: Synthetic oligonucleotide
  Target: ATXN1; (-) strand; PAM type: YTN; PAM sequence: TTT
cacagtgtcgcaaacattca

SEQ ID NO: 188235 - DNA, 20 bp, Artificial Sequence
  Description of Artificial Sequence: Synthetic oligonucleotide
  Target: ATXN1; (-) strand; PAM type: YTN; PAM sequence: TTC
ggtgggcggaaatggcagac

SEQ ID NO: 188236 - DNA, 20 bp, Artificial Sequence
  Description of Artificial Sequence: Synthetic oligonucleotide
  Target: ATXN1; (-) strand; PAM type: YTN; PAM sequence: CTT
cggtgggcggaaatggcaga

SEQ ID NO: 188237 - DNA, 20 bp, Artificial Sequence
  Description of Artificial Sequence: Synthetic oligonucleotide
  Target: ATXN1; (-) strand; PAM type: YTN; PAM sequence: TTG
tcttcggtgggcggaaatgg

SEQ ID NO: 188238 - DNA, 20 bp, Artificial Sequence
  Description of Artificial Sequence: Synthetic oligonucleotide
  Target: ATXN1; (-) strand; PAM type: YTN; PAM sequence: CTG
gtgggtgtaagtgttgtctt

SEQ ID NO: 188239 - DNA, 20 bp, Artificial Sequence
  Description of Artificial Sequence: Synthetic oligonucleotide
  Target: ATXN1; (-) strand; PAM type: YTN; PAM sequence: CTC
tggtgggtgtaagtgttgtc

SEQ ID NO: 188240 - DNA, 20 bp, Artificial Sequence
  Description of Artificial Sequence: Synthetic oligonucleotide
  Target: ATXN1; (-) strand; PAM type: YTN; PAM sequence: CTG
tgccactctggtgggtgtaa

SEQ ID NO: 188241 - DNA, 20 bp, Artificial Sequence
  Description of Artificial Sequence: Synthetic oligonucleotide
  Target: ATXN1; (-) strand; PAM type: YTN; PAM sequence: CTC
gctgtgccactctggtgggt

SEQ ID NO: 188242 - DNA, 20 bp, Artificial Sequence
  Description of Artificial Sequence: Synthetic oligonucleotide
  Target: ATXN1; (-) strand; PAM type: YTN; PAM sequence: TTC
cagcagggcctcgctgtgcc

SEQ ID NO: 188243 - DNA, 20 bp, Artificial Sequence
  Description of Artificial Sequence: Synthetic oligonucleotide
  Target: ATXN1; (-) strand; PAM type: YTN; PAM sequence: TTT
ccagcagggcctcgctgtgc

SEQ ID NO: 188244 - DNA, 20 bp, Artificial Sequence
  Description of Artificial Sequence: Synthetic oligonucleotide
  Target: ATXN1; (-) strand; PAM type: YTN; PAM sequence: TTT
tccagcagggcctcgctgtg

SEQ ID NO: 188245 - DNA, 20 bp, Artificial Sequence
  Description of Artificial Sequence: Synthetic oligonucleotide
  Target: ATXN1; (-) strand; PAM type: YTN; PAM sequence: CTT
ttccagcagggcctcgctgt

SEQ ID NO: 188246 - DNA, 20 bp, Artificial Sequence
  Description of Artificial Sequence: Synthetic oligonucleotide
  Target: ATXN1; (-) strand; PAM type: YTN; PAM sequence: TTA
tccaatccttttccagcagg

SEQ ID NO: 188247 - DNA, 20 bp, Artificial Sequence
  Description of Artificial Sequence: Synthetic oligonucleotide
  Target: ATXN1; (-) strand; PAM type: YTN; PAM sequence: TTA
aaagcaacagcaaataaaca

SEQ ID NO: 188248 - DNA, 20 bp, Artificial Sequence
  Description of Artificial Sequence: Synthetic oligonucleotide
  Target: ATXN1; (-) strand; PAM type: YTN; PAM sequence: TTC
attaaaagcaacagcaaata

SEQ ID NO: 188249 - DNA, 20 bp, Artificial Sequence
  Description of Artificial Sequence: Synthetic oligonucleotide
  Target: ATXN1; (-) strand; PAM type: YTN; PAM sequence: TTT
cattaaaagcaacagcaaat

SEQ ID NO: 188250 - DNA, 20 bp, Artificial Sequence
  Description of Artificial Sequence: Synthetic oligonucleotide
  Target: ATXN1; (-) strand; PAM type: YTN; PAM sequence: TTT
tcattaaaagcaacagcaaa

SEQ ID NO: 188251 - DNA, 20 bp, Artificial Sequence
  Description of Artificial Sequence: Synthetic oligonucleotide
  Target: ATXN1; (-) strand; PAM type: YTN; PAM sequence: CTT
ttcattaaaagcaacagcaa

SEQ ID NO: 188252 - DNA, 20 bp, Artificial Sequence
  Description of Artificial Sequence: Synthetic oligonucleotide
  Target: ATXN1; (-) strand; PAM type: YTN; PAM sequence: TTA
atgatcaggatatgaataag

SEQ ID NO: 188253 - DNA, 20 bp, Artificial Sequence
  Description of Artificial Sequence: Synthetic oligonucleotide
  Target: ATXN1; (-) strand; PAM type: YTN; PAM sequence: TTG
aaagggggaaaaaaatcaag

SEQ ID NO: 188254 - DNA, 20 bp, Artificial Sequence
  Description of Artificial Sequence: Synthetic oligonucleotide
  Target: ATXN1; (-) strand; PAM type: YTN; PAM sequence: CTT
gaaagggggaaaaaaatcaa

SEQ ID NO: 188255 - DNA, 20 bp, Artificial Sequence
  Description of Artificial Sequence: Synthetic oligonucleotide
  Target: ATXN1; (-) strand; PAM type: YTN; PAM sequence: CTG
ggtcagccttgaaaggggga

SEQ ID NO: 188256 - DNA, 20 bp, Artificial Sequence
  Description of Artificial Sequence: Synthetic oligonucleotide
  Target: ATXN1; (-) strand; PAM type: YTN; PAM sequence: TTC
ctgggtcagccttgaaaggg

SEQ ID NO: 188257 - DNA, 20 bp, Artificial Sequence
  Description of Artificial Sequence: Synthetic oligonucleotide
  Target: ATXN1; (-) strand; PAM type: YTN; PAM sequence: CTG
ttcctgggtcagccttgaaa

SEQ ID NO: 188258 - DNA, 20 bp, Artificial Sequence
  Description of Artificial Sequence: Synthetic oligonucleotide
  Target: ATXN1; (-) strand; PAM type: YTN; PAM sequence: TTC
caggagaagctgttcctggg

SEQ ID NO: 188259 - DNA, 20 bp, Artificial Sequence
  Description of Artificial Sequence: Synthetic oligonucleotide
  Target: ATXN1; (-) strand; PAM type: YTN; PAM sequence: TTG
atagtatcgttccaggagaa

SEQ ID NO: 188260 - DNA, 20 bp, Artificial Sequence
  Description of Artificial Sequence: Synthetic oligonucleotide
  Target: ATXN1; (-) strand; PAM type: YTN; PAM sequence: CTC
aaaagtatacaaggcgaaat

SEQ ID NO: 188261 - DNA, 20 bp, Artificial Sequence
  Description of Artificial Sequence: Synthetic oligonucleotide
  Target: ATXN1; (-) strand; PAM type: YTN; PAM sequence: TTC
tcaaaagtatacaaggcgaa

SEQ ID NO: 188262 - DNA, 20 bp, Artificial Sequence
  Description of Artificial Sequence: Synthetic oligonucleotide
  Target: ATXN1; (-) strand; PAM type: YTN; PAM sequence: CTT
ctcaaaagtatacaaggcga

SEQ ID NO: 188263 - DNA, 20 bp, Artificial Sequence
  Description of Artificial Sequence: Synthetic oligonucleotide
  Target: ATXN1; (-) strand; PAM type: YTN; PAM sequence: CTC
aagtgtgcttctcaaaagta

SEQ ID NO: 188264 - DNA, 20 bp, Artificial Sequence
  Description of Artificial Sequence: Synthetic oligonucleotide
  Target: ATXN1; (-) strand; PAM type: YTN; PAM sequence: TTG
cctcaagtgtgcttctcaaa

SEQ ID NO: 188265 - DNA, 20 bp, Artificial Sequence
  Description of Artificial Sequence: Synthetic oligonucleotide
  Target: ATXN1; (-) strand; PAM type: YTN; PAM sequence: TTT
gcctcaagtgtgcttctcaa

SEQ ID NO: 188266 - DNA, 20 bp, Artificial Sequence
  Description of Artificial Sequence: Synthetic oligonucleotide
  Target: ATXN1; (-) strand; PAM type: YTN; PAM sequence: CTT
tgcctcaagtgtgcttctca

SEQ ID NO: 188267 - DNA, 20 bp, Artificial Sequence
  Description of Artificial Sequence: Synthetic oligonucleotide
  Target: ATXN1; (-) strand; PAM type: YTN; PAM sequence: TTC
ctttgcctcaagtgtgcttc

SEQ ID NO: 188268 - DNA, 20 bp, Artificial Sequence
  Description of Artificial Sequence: Synthetic oligonucleotide
  Target: ATXN1; (-) strand; PAM type: YTN; PAM sequence: CTA
atacaagttcctttgcctca

SEQ ID NO: 188269 - DNA, 20 bp, Artificial Sequence
  Description of Artificial Sequence: Synthetic oligonucleotide
  Target: ATXN1; (-) strand; PAM type: YTN; PAM sequence: CTG
ctaatacaagttcctttgcc

SEQ ID NO: 188270 - DNA, 20 bp, Artificial Sequence
  Description of Artificial Sequence: Synthetic oligonucleotide
  Target: ATXN1; (-) strand; PAM type: YTN; PAM sequence: CTC
aaagctgctaatacaagttc

SEQ ID NO: 188271 - DNA, 20 bp, Artificial Sequence
  Description of Artificial Sequence: Synthetic oligonucleotide
  Target: ATXN1; (-) strand; PAM type: YTN; PAM sequence: TTG
tcatcctcaaagctgctaat

SEQ ID NO: 188272 - DNA, 20 bp, Artificial Sequence
  Description of Artificial Sequence: Synthetic oligonucleotide
  Target: ATXN1; (-) strand; PAM type: YTN; PAM sequence: CTT
gtcatcctcaaagctgctaa

SEQ ID NO: 188273 - DNA, 20 bp, Artificial Sequence
  Description of Artificial Sequence: Synthetic oligonucleotide
  Target: ATXN1; (-) strand; PAM type: YTN; PAM sequence: TTC
ttgtcatcctcaaagctgct

SEQ ID NO: 188274 - DNA, 20 bp, Artificial Sequence
  Description of Artificial Sequence: Synthetic oligonucleotide
  Target: ATXN1; (-) strand; PAM type: YTN; PAM sequence: TTT
cttgtcatcctcaaagctgc

SEQ ID NO: 188275 - DNA, 20 bp, Artificial Sequence
  Description of Artificial Sequence: Synthetic oligonucleotide
  Target: ATXN1; (-) strand; PAM type: YTN; PAM sequence: CTG
tttcttgtcatcctcaaagc

SEQ ID NO: 188276 - DNA, 20 bp, Artificial Sequence
  Description of Artificial Sequence: Synthetic oligonucleotide
  Target: ATXN1; (-) strand; PAM type: YTN; PAM sequence: TTC
tgtttcttgtcatcctcaaa

SEQ ID NO: 188277 - DNA, 20 bp, Artificial Sequence
  Description of Artificial Sequence: Synthetic oligonucleotide
  Target: ATXN1; (-) strand; PAM type: YTN; PAM sequence: TTA
aattctgtttcttgtcatcc

SEQ ID NO: 188278 - DNA, 20 bp, Artificial Sequence
  Description of Artificial Sequence: Synthetic oligonucleotide
  Target: ATXN1; (-) strand; PAM type: YTN; PAM sequence: CTT
aaattctgtttcttgtcatc

SEQ ID NO: 188279 - DNA, 20 bp, Artificial Sequence
  Description of Artificial Sequence: Synthetic oligonucleotide
  Target: ATXN1; (-) strand; PAM type: YTN; PAM sequence: CTA
gtgtagcacttaaattctgt

SEQ ID NO: 188280 - DNA, 20 bp, Artificial Sequence
  Description of Artificial Sequence: Synthetic oligonucleotide
  Target: ATXN1; (-) strand; PAM type: YTN; PAM sequence: TTC
tagtgtagcacttaaattct

SEQ ID NO: 188281 - DNA, 20 bp, Artificial Sequence
  Description of Artificial Sequence: Synthetic oligonucleotide
  Target: ATXN1; (-) strand; PAM type: YTN; PAM sequence: TTG
ggaagcaacaagattctagt

SEQ ID NO: 188282 - DNA, 20 bp, Artificial Sequence
  Description of Artificial Sequence: Synthetic oligonucleotide
  Target: ATXN1; (-) strand; PAM type: YTN; PAM sequence: TTT
gggaagcaacaagattctag

SEQ ID NO: 188283 - DNA, 20 bp, Artificial Sequence
  Description of Artificial Sequence: Synthetic oligonucleotide
  Target: ATXN1; (-) strand; PAM type: YTN; PAM sequence: TTG
tcgatgatgtatttgggaag

SEQ ID NO: 188284 - DNA, 20 bp, Artificial Sequence
  Description of Artificial Sequence: Synthetic oligonucleotide
  Target: ATXN1; (-) strand; PAM type: YTN; PAM sequence: TTT
gtcgatgatgtatttgggaa

SEQ ID NO: 188285 - DNA, 20 bp, Artificial Sequence
  Description of Artificial Sequence: Synthetic oligonucleotide
  Target: ATXN1; (-) strand; PAM type: YTN; PAM sequence: CTT
tgtcgatgatgtatttggga

SEQ ID NO: 188286 - DNA, 20 bp, Artificial Sequence
  Description of Artificial Sequence: Synthetic oligonucleotide
  Target: ATXN1; (-) strand; PAM type: YTN; PAM sequence: CTG
gcctttgtcgatgatgtatt

SEQ ID NO: 188287 - DNA, 20 bp, Artificial Sequence
  Description of Artificial Sequence: Synthetic oligonucleotide
  Target: ATXN1; (-) strand; PAM type: YTN; PAM sequence: TTG
aaaggaaaaacatgactggc

SEQ ID NO: 188288 - DNA, 20 bp, Artificial Sequence
  Description of Artificial Sequence: Synthetic oligonucleotide
  Target: ATXN1; (-) strand; PAM type: YTN; PAM sequence: TTT
gaaaggaaaaacatgactgg

SEQ ID NO: 188289 - DNA, 20 bp, Artificial Sequence
  Description of Artificial Sequence: Synthetic oligonucleotide
  Target: ATXN1; (-) strand; PAM type: YTN; PAM sequence: CTC
atgatttgaaaggaaaaaca

SEQ ID NO: 188290 - DNA, 20 bp, Artificial Sequence
  Description of Artificial Sequence: Synthetic oligonucleotide
  Target: ATXN1; (-) strand; PAM type: YTN; PAM sequence: CTG
tgcatgctcatgatttgaaa

SEQ ID NO: 188291 - DNA, 20 bp, Artificial Sequence
  Description of Artificial Sequence: Synthetic oligonucleotide
  Target: ATXN1; (-) strand; PAM type: YTN; PAM sequence: TTC
tgtgcatgctcatgatttga

SEQ ID NO: 188292 - DNA, 20 bp, Artificial Sequence
  Description of Artificial Sequence: Synthetic oligonucleotide
  Target: ATXN1; (-) strand; PAM type: YTN; PAM sequence: TTT
ctgtgcatgctcatgatttg

SEQ ID NO: 188293 - DNA, 20 bp, Artificial Sequence
  Description of Artificial Sequence: Synthetic oligonucleotide
  Target: ATXN1; (-) strand; PAM type: YTN; PAM sequence: TTT
tctgtgcatgctcatgattt

SEQ ID NO: 188294 - DNA, 20 bp, Artificial Sequence
  Description of Artificial Sequence: Synthetic oligonucleotide
  Target: ATXN1; (-) strand; PAM type: YTN; PAM sequence: TTT
ttctgtgcatgctcatgatt

SEQ ID NO: 188295 - DNA, 20 bp, Artificial Sequence
  Description of Artificial Sequence: Synthetic oligonucleotide
  Target: ATXN1; (-) strand; PAM type: YTN; PAM sequence: TTT
tttctgtgcatgctcatgat

SEQ ID NO: 188296 - DNA, 20 bp, Artificial Sequence
  Description of Artificial Sequence: Synthetic oligonucleotide
  Target: ATXN1; (-) strand; PAM type: YTN; PAM sequence: CTG
ttttttctgtgcatgctcat

SEQ ID NO: 188297 - DNA, 20 bp, Artificial Sequence
  Description of Artificial Sequence: Synthetic oligonucleotide
  Target: ATXN1; (-) strand; PAM type: YTN; PAM sequence: CTA
caactgttttttctgtgcat

SEQ ID NO: 188298 - DNA, 20 bp, Artificial Sequence
  Description of Artificial Sequence: Synthetic oligonucleotide
  Target: ATXN1; (-) strand; PAM type: YTN; PAM sequence: CTA
atactacaactgttttttct

SEQ ID NO: 188299 - DNA, 20 bp, Artificial Sequence
  Description of Artificial Sequence: Synthetic oligonucleotide
  Target: ATXN1; (-) strand; PAM type: YTN; PAM sequence: TTA
atgacacccacaatgctaat

SEQ ID NO: 188300 - DNA, 20 bp, Artificial Sequence
  Description of Artificial Sequence: Synthetic oligonucleotide
  Target: ATXN1; (-) strand; PAM type: YTN; PAM sequence: CTA
ttaatgacacccacaatgct

SEQ ID NO: 188301 - DNA, 20 bp, Artificial Sequence
  Description of Artificial Sequence: Synthetic oligonucleotide
  Target: ATXN1; (-) strand; PAM type: YTN; PAM sequence: CTC
agaaatgctattaatgacac

SEQ ID NO: 188302 - DNA, 20 bp, Artificial Sequence
  Description of Artificial Sequence: Synthetic oligonucleotide
  Target: ATXN1; (-) strand; PAM type: YTN; PAM sequence: TTC
ctcagaaatgctattaatga

SEQ ID NO: 188303 - DNA, 20 bp, Artificial Sequence
  Description of Artificial Sequence: Synthetic oligonucleotide
  Target: ATXN1; (-) strand; PAM type: YTN; PAM sequence: TTT
cctcagaaatgctattaatg

SEQ ID NO: 188304 - DNA, 20 bp, Artificial Sequence
  Description of Artificial Sequence: Synthetic oligonucleotide
  Target: ATXN1; (-) strand; PAM type: YTN; PAM sequence: TTT
tcctcagaaatgctattaat

SEQ ID NO: 188305 - DNA, 20 bp, Artificial Sequence
  Description of Artificial Sequence: Synthetic oligonucleotide
  Target: ATXN1; (-) strand; PAM type: YTN; PAM sequence: TTT
ttcctcagaaatgctattaa

SEQ ID NO: 188306 - DNA, 20 bp, Artificial Sequence
  Description of Artificial Sequence: Synthetic oligonucleotide
  Target: ATXN1; (-) strand; PAM type: YTN; PAM sequence: TTT
tttcctcagaaatgctatta

SEQ ID NO: 188307 - DNA, 20 bp, Artificial Sequence
  Description of Artificial Sequence: Synthetic oligonucleotide
  Target: ATXN1; (-) strand; PAM type: YTN; PAM sequence: TTT
ttttcctcagaaatgctatt

SEQ ID NO: 188308 - DNA, 20 bp, Artificial Sequence
  Description of Artificial Sequence: Synthetic oligonucleotide
  Target: ATXN1; (-) strand; PAM type: YTN; PAM sequence: TTT
tttttcctcagaaatgctat

SEQ ID NO: 188309 - DNA, 20 bp, Artificial Sequence
  Description of Artificial Sequence: Synthetic oligonucleotide
  Target: ATXN1; (-) strand; PAM type: YTN; PAM sequence: TTG
ttttttttcctcagaaatgc

SEQ ID NO: 188310 - DNA, 20 bp, Artificial Sequence
  Description of Artificial Sequence: Synthetic oligonucleotide
  Target: ATXN1; (-) strand; PAM type: YTN; PAM sequence: TTT
gttttttttcctcagaaatg

SEQ ID NO: 188311 - DNA, 20 bp, Artificial Sequence
  Description of Artificial Sequence: Synthetic oligonucleotide
  Target: ATXN1; (-) strand; PAM type: YTN; PAM sequence: TTT
tgttttttttcctcagaaat

SEQ ID NO: 188312 - DNA, 20 bp, Artificial Sequence
  Description of Artificial Sequence: Synthetic oligonucleotide
  Target: ATXN1; (-) strand; PAM type: YTN; PAM sequence: TTT
ttgttttttttcctcagaaa

SEQ ID NO: 188313 - DNA, 20 bp, Artificial Sequence
  Description of Artificial Sequence: Synthetic oligonucleotide
  Target: ATXN1; (-) strand; PAM type: YTN; PAM sequence: TTT
tttgttttttttcctcagaa

SEQ ID NO: 188314 - DNA, 20 bp, Artificial Sequence
  Description of Artificial Sequence: Synthetic oligonucleotide
  Target: ATXN1; (-) strand; PAM type: YTN; PAM sequence: CTT
ttttgttttttttcctcaga

SEQ ID NO: 188315 - DNA, 20 bp, Artificial Sequence
  Description of Artificial Sequence: Synthetic oligonucleotide
  Target: ATXN1; (-) strand; PAM type: YTN; PAM sequence: CTC
ttttttgttttttttcctca

SEQ ID NO: 188316 - DNA, 20 bp, Artificial Sequence
  Description of Artificial Sequence: Synthetic oligonucleotide
  Target: ATXN1; (-) strand; PAM type: YTN; PAM sequence: TTA
gagataaaggaccactcttt

SEQ ID NO: 188317 - DNA, 20 bp, Artificial Sequence
  Description of Artificial Sequence: Synthetic oligonucleotide
  Target: ATXN1; (-) strand; PAM type: YTN; PAM sequence: TTT
agagataaaggaccactctt

SEQ ID NO: 188318 - DNA, 20 bp, Artificial Sequence
  Description of Artificial Sequence: Synthetic oligonucleotide
  Target: ATXN1; (-) strand; PAM type: YTN; PAM sequence: TTT
tagagataaaggaccactct

SEQ ID NO: 188319 - DNA, 20 bp, Artificial Sequence
  Description of Artificial Sequence: Synthetic oligonucleotide
  Target: ATXN1; (-) strand; PAM type: YTN; PAM sequence: TTT
ttagagataaaggaccactc

SEQ ID NO: 188320 - DNA, 20 bp, Artificial Sequence
  Description of Artificial Sequence: Synthetic oligonucleotide
  Target: ATXN1; (-) strand; PAM type: YTN; PAM sequence: TTT
tttagagataaaggaccact

SEQ ID NO: 188321 - DNA, 20 bp, Artificial Sequence
  Description of Artificial Sequence: Synthetic oligonucleotide
  Target: ATXN1; (-) strand; PAM type: YTN; PAM sequence: TTT
ttttagagataaaggaccac

SEQ ID NO: 188322 - DNA, 20 bp, Artificial Sequence
  Description of Artificial Sequence: Synthetic oligonucleotide
  Target: ATXN1; (-) strand; PAM type: YTN; PAM sequence: CTT
tttttagagataaaggacca

SEQ ID NO: 188323 - DNA, 20 bp, Artificial Sequence
  Description of Artificial Sequence: Synthetic oligonucleotide
  Target: ATXN1; (-) strand; PAM type: YTN; PAM sequence: TTG
cctttttttagagataaagg

SEQ ID NO: 188324 - DNA, 20 bp, Artificial Sequence
  Description of Artificial Sequence: Synthetic oligonucleotide
  Target: ATXN1; (-) strand; PAM type: YTN; PAM sequence: CTT
gcctttttttagagataaag

SEQ ID NO: 188325 - DNA, 20 bp, Artificial Sequence
  Description of Artificial Sequence: Synthetic oligonucleotide
  Target: ATXN1; (-) strand; PAM type: YTN; PAM sequence: TTC
ttgcctttttttagagataa

SEQ ID NO: 188326 - DNA, 20 bp, Artificial Sequence
  Description of Artificial Sequence: Synthetic oligonucleotide
  Target: ATXN1; (-) strand; PAM type: YTN; PAM sequence: TTC
attcttgcctttttttagag

SEQ ID NO: 188327 - DNA, 20 bp, Artificial Sequence
  Description of Artificial Sequence: Synthetic oligonucleotide
  Target: ATXN1; (-) strand; PAM type: YTN; PAM sequence: TTA
ttcattcttgccttttttta

SEQ ID NO: 188328 - DNA, 20 bp, Artificial Sequence
  Description of Artificial Sequence: Synthetic oligonucleotide
  Target: ATXN1; (-) strand; PAM type: YTN; PAM sequence: TTA
ttattcattcttgccttttt

SEQ ID NO: 188329 - DNA, 20 bp, Artificial Sequence
  Description of Artificial Sequence: Synthetic oligonucleotide
  Target: ATXN1; (-) strand; PAM type: YTN; PAM sequence: TTG
ttattattcattcttgcctt

SEQ ID NO: 188330 - DNA, 20 bp, Artificial Sequence
  Description of Artificial Sequence: Synthetic oligonucleotide
  Target: ATXN1; (-) strand; PAM type: YTN; PAM sequence: TTT
gttattattcattcttgcct

SEQ ID NO: 188331 - DNA, 20 bp, Artificial Sequence
  Description of Artificial Sequence: Synthetic oligonucleotide
  Target: ATXN1; (-) strand; PAM type: YTN; PAM sequence: CTA
agatttgttattattcattc

SEQ ID NO: 188332 - DNA, 20 bp, Artificial Sequence
  Description of Artificial Sequence: Synthetic oligonucleotide
  Target: ATXN1; (-) strand; PAM type: YTN; PAM sequence: TTC
caaatctaagatttgttatt

SEQ ID NO: 188333 - DNA, 20 bp, Artificial Sequence
  Description of Artificial Sequence: Synthetic oligonucleotide
  Target: ATXN1; (-) strand; PAM type: YTN; PAM sequence: TTA
ccaattccaaatctaagatt

SEQ ID NO: 188334 - DNA, 20 bp, Artificial Sequence
  Description of Artificial Sequence: Synthetic oligonucleotide
  Target: ATXN1; (-) strand; PAM type: YTN; PAM sequence: TTG
tcagtgtgttaccaattcca

SEQ ID NO: 188335 - DNA, 20 bp, Artificial Sequence
  Description of Artificial Sequence: Synthetic oligonucleotide
  Target: ATXN1; (-) strand; PAM type: YTN; PAM sequence: CTT
gtcagtgtgttaccaattcc

SEQ ID NO: 188336 - DNA, 20 bp, Artificial Sequence
  Description of Artificial Sequence: Synthetic oligonucleotide
  Target: ATXN1; (-) strand; PAM type: YTN; PAM sequence: TTG
agatatacttgtcagtgtgt

SEQ ID NO: 188337 - DNA, 20 bp, Artificial Sequence
  Description of Artificial Sequence: Synthetic oligonucleotide
  Target: ATXN1; (-) strand; PAM type: YTN; PAM sequence: TTT
gagatatacttgtcagtgtg

SEQ ID NO: 188338 - DNA, 20 bp, Artificial Sequence
  Description of Artificial Sequence: Synthetic oligonucleotide
  Target: ATXN1; (-) strand; PAM type: YTN; PAM sequence: TTT
tgagatatacttgtcagtgt

SEQ ID NO: 188339 - DNA, 20 bp, Artificial Sequence
  Description of Artificial Sequence: Synthetic oligonucleotide
  Target: ATXN1; (-) strand; PAM type: YTN; PAM sequence: TTA
ttttgagatatacttgtcag

SEQ ID NO: 188340 - DNA, 20 bp, Artificial Sequence
  Description of Artificial Sequence: Synthetic oligonucleotide
  Target: ATXN1; (-) strand; PAM type: YTN; PAM sequence: TTT
attttgagatatacttgtca

SEQ ID NO: 188341 - DNA, 20 bp, Artificial Sequence
  Description of Artificial Sequence: Synthetic oligonucleotide
  Target: ATXN1; (-) strand; PAM type: YTN; PAM sequence: CTT
tattttgagatatacttgtc

SEQ ID NO: 188342 - DNA, 20 bp, Artificial Sequence
  Description of Artificial Sequence: Synthetic oligonucleotide
  Target: ATXN1; (-) strand; PAM type: YTN; PAM sequence: TTC
tttattttgagatatacttg

SEQ ID NO: 188343 - DNA, 20 bp, Artificial Sequence
  Description of Artificial Sequence: Synthetic oligonucleotide
  Target: ATXN1; (-) strand; PAM type: YTN; PAM sequence: TTA
gttctttattttgagatata

SEQ ID NO: 188344 - DNA, 20 bp, Artificial Sequence
  Description of Artificial Sequence: Synthetic oligonucleotide
  Target: ATXN1; (-) strand; PAM type: YTN; PAM sequence: TTA
ttagttctttattttgagat

SEQ ID NO: 188345 - DNA, 20 bp, Artificial Sequence
  Description of Artificial Sequence: Synthetic oligonucleotide
  Target: ATXN1; (-) strand; PAM type: YTN; PAM sequence: TTT
attagttctttattttgaga

SEQ ID NO: 188346 - DNA, 20 bp, Artificial Sequence
  Description of Artificial Sequence: Synthetic oligonucleotide
  Target: ATXN1; (-) strand; PAM type: YTN; PAM sequence: TTT
tattagttctttattttgag

SEQ ID NO: 188347 - DNA, 20 bp, Artificial Sequence
  Description of Artificial Sequence: Synthetic oligonucleotide
  Target: ATXN1; (-) strand; PAM type: YTN; PAM sequence: TTT
ttattagttctttattttga

SEQ ID NO: 188348 - DNA, 20 bp, Artificial Sequence
  Description of Artificial Sequence: Synthetic oligonucleotide
  Target: ATXN1; (-) strand; PAM type: YTN; PAM sequence: TTT
tttattagttctttattttg

SEQ ID NO: 188349 - DNA, 20 bp, Artificial Sequence
  Description of Artificial Sequence: Synthetic oligonucleotide
  Target: ATXN1; (-) strand; PAM type: YTN; PAM sequence: CTC
cattttttattagttcttta

SEQ ID NO: 188350 - DNA, 20 bp, Artificial Sequence
  Description of Artificial Sequence: Synthetic oligonucleotide
  Target: ATXN1; (-) strand; PAM type: YTN; PAM sequence: CTC
tccattttttattagttctt

SEQ ID NO: 188351 - DNA, 20 bp, Artificial Sequence
  Description of Artificial Sequence: Synthetic oligonucleotide
  Target: ATXN1; (-) strand; PAM type: YTN; PAM sequence: TTG
tctctccattttttattagt

SEQ ID NO: 188352 - DNA, 20 bp, Artificial Sequence
  Description of Artificial Sequence: Synthetic oligonucleotide
  Target: ATXN1; (-) strand; PAM type: YTN; PAM sequence: TTT
gtctctccattttttattag

SEQ ID NO: 188353 - DNA, 20 bp, Artificial Sequence
  Description of Artificial Sequence: Synthetic oligonucleotide
  Target: ATXN1; (-) strand; PAM type: YTN; PAM sequence: TTT
tgtctctccattttttatta

SEQ ID NO: 188354 - DNA, 20 bp, Artificial Sequence
  Description of Artificial Sequence: Synthetic oligonucleotide
  Target: ATXN1; (-) strand; PAM type: YTN; PAM sequence: CTG
tcccaattttgtctctccat

SEQ ID NO: 188355 - DNA, 20 bp, Artificial Sequence
  Description of Artificial Sequence: Synthetic oligonucleotide
  Target: ATXN1; (-) strand; PAM type: YTN; PAM sequence: TTC
tgtcccaattttgtctctcc

SEQ ID NO: 188356 - DNA, 20 bp, Artificial Sequence
  Description of Artificial Sequence: Synthetic oligonucleotide
  Target: ATXN1; (-) strand; PAM type: YTN; PAM sequence: CTT
ctgtcccaattttgtctctc

SEQ ID NO: 188357 - DNA, 20 bp, Artificial Sequence
  Description of Artificial Sequence: Synthetic oligonucleotide
  Target: ATXN1; (-) strand; PAM type: YTN; PAM sequence: CTC
ttctgtcccaattttgtctc

SEQ ID NO: 188358 - DNA, 20 bp, Artificial Sequence
  Description of Artificial Sequence: Synthetic oligonucleotide
  Target: ATXN1; (-) strand; PAM type: YTN; PAM sequence: CTC
tcttctgtcccaattttgtc

SEQ ID NO: 188359 - DNA, 20 bp, Artificial Sequence
  Description of Artificial Sequence: Synthetic oligonucleotide
  Target: ATXN1; (-) strand; PAM type: YTN; PAM sequence: TTC
tctcttctgtcccaattttg

SEQ ID NO: 188360 - DNA, 20 bp, Artificial Sequence
  Description of Artificial Sequence: Synthetic oligonucleotide
  Target: ATXN1; (-) strand; PAM type: YTN; PAM sequence: TTT
ctctcttctgtcccaatttt

SEQ ID NO: 188361 - DNA, 20 bp, Artificial Sequence
  Description of Artificial Sequence: Synthetic oligonucleotide
  Target: ATXN1; (-) strand; PAM type: YTN; PAM sequence: CTT
tctctcttctgtcccaattt

SEQ ID NO: 188362 - DNA, 20 bp, Artificial Sequence
  Description of Artificial Sequence: Synthetic oligonucleotide
  Target: ATXN1; (-) strand; PAM type: YTN; PAM sequence: CTC
ctttctctcttctgtcccaa

SEQ ID NO: 188363 - DNA, 20 bp, Artificial Sequence
  Description of Artificial Sequence: Synthetic oligonucleotide
  Target: ATXN1; (-) strand; PAM type: YTN; PAM sequence: TTA
tgtgagtagcagacacctcc

SEQ ID NO: 188364 - DNA, 20 bp, Artificial Sequence
  Description of Artificial Sequence: Synthetic oligonucleotide
  Target: ATXN1; (-) strand; PAM type: YTN; PAM sequence: TTA
attatgtgagtagcagacac

SEQ ID NO: 188365 - DNA, 20 bp, Artificial Sequence
  Description of Artificial Sequence: Synthetic oligonucleotide
  Target: ATXN1; (-) strand; PAM type: YTN; PAM sequence: TTA
tgaaagtgatggttaattat

SEQ ID NO: 188366 - DNA, 20 bp, Artificial Sequence
  Description of Artificial Sequence: Synthetic oligonucleotide
  Target: ATXN1; (-) strand; PAM type: YTN; PAM sequence: TTC
attatgaaagtgatggttaa

SEQ ID NO: 188367 - DNA, 20 bp, Artificial Sequence
  Description of Artificial Sequence: Synthetic oligonucleotide
  Target: ATXN1; (-) strand; PAM type: YTN; PAM sequence: CTG
tattcattatgaaagtgatg

SEQ ID NO: 188368 - DNA, 20 bp, Artificial Sequence
  Description of Artificial Sequence: Synthetic oligonucleotide
  Target: ATXN1; (-) strand; PAM type: YTN; PAM sequence: TTG
gtaaactgtattcattatga

SEQ ID NO: 188369 - DNA, 20 bp, Artificial Sequence
  Description of Artificial Sequence: Synthetic oligonucleotide
  Target: ATXN1; (-) strand; PAM type: YTN; PAM sequence: CTT
ggtaaactgtattcattatg

SEQ ID NO: 188370 - DNA, 20 bp, Artificial Sequence
  Description of Artificial Sequence: Synthetic oligonucleotide
  Target: ATXN1; (-) strand; PAM type: YTN; PAM sequence: TTA
atgagaaagcacttggtaaa

SEQ ID NO: 188371 - DNA, 20 bp, Artificial Sequence
  Description of Artificial Sequence: Synthetic oligonucleotide
  Target: ATXN1; (-) strand; PAM type: YTN; PAM sequence: TTA
attaatgagaaagcacttgg

SEQ ID NO: 188372 - DNA, 20 bp, Artificial Sequence
  Description of Artificial Sequence: Synthetic oligonucleotide
  Target: ATXN1; (-) strand; PAM type: YTN; PAM sequence: TTT
aattaatgagaaagcacttg

SEQ ID NO: 188373 - DNA, 20 bp, Artificial Sequence
  Description of Artificial Sequence: Synthetic oligonucleotide
  Target: ATXN1; (-) strand; PAM type: YTN; PAM sequence: TTG
tatcaagcgaatgatttaat

SEQ ID NO: 188374 - DNA, 20 bp, Artificial Sequence
  Description of Artificial Sequence: Synthetic oligonucleotide
  Target: ATXN1; (-) strand; PAM type: YTN; PAM sequence: TTA
gcaagtaccaagtaaaattg

SEQ ID NO: 188375 - DNA, 20 bp, Artificial Sequence
  Description of Artificial Sequence: Synthetic oligonucleotide
  Target: ATXN1; (-) strand; PAM type: YTN; PAM sequence: TTT
agcaagtaccaagtaaaatt

SEQ ID NO: 188376 - DNA, 20 bp, Artificial Sequence
  Description of Artificial Sequence: Synthetic oligonucleotide
  Target: ATXN1; (-) strand; PAM type: YTN; PAM sequence: CTG
gtggatttagcaagtaccaa

SEQ ID NO: 188377 - DNA, 20 bp, Artificial Sequence
  Description of Artificial Sequence: Synthetic oligonucleotide
  Target: ATXN1; (-) strand; PAM type: YTN; PAM sequence: TTG
aacacagagcctggtggatt

SEQ ID NO: 188378 - DNA, 20 bp, Artificial Sequence
  Description of Artificial Sequence: Synthetic oligonucleotide
  Target: ATXN1; (-) strand; PAM type: YTN; PAM sequence: TTC
cccagttgaacacagagcct

SEQ ID NO: 188379 - DNA, 20 bp, Artificial Sequence
  Description of Artificial Sequence: Synthetic oligonucleotide
  Target: ATXN1; (-) strand; PAM type: YTN; PAM sequence: TTA
ccatgtattccccagttgaa

SEQ ID NO: 188380 - DNA, 20 bp, Artificial Sequence
  Description of Artificial Sequence: Synthetic oligonucleotide
  Target: ATXN1; (-) strand; PAM type: YTN; PAM sequence: TTT
accatgtattccccagttga

SEQ ID NO: 188381 - DNA, 20 bp, Artificial Sequence
  Description of Artificial Sequence: Synthetic oligonucleotide
  Target: ATXN1; (-) strand; PAM type: YTN; PAM sequence: TTG
tttaccatgtattccccagt

SEQ ID NO: 188382 - DNA, 20 bp, Artificial Sequence
  Description of Artificial Sequence: Synthetic oligonucleotide
  Target: ATXN1; (-) strand; PAM type: YTN; PAM sequence: TTT
gtttaccatgtattccccag

SEQ ID NO: 188383 - DNA, 20 bp, Artificial Sequence
  Description of Artificial Sequence: Synthetic oligonucleotide
  Target: ATXN1; (-) strand; PAM type: YTN; PAM sequence: TTT
tgtttaccatgtattcccca

SEQ ID NO: 188384 - DNA, 20 bp, Artificial Sequence
  Description of Artificial Sequence: Synthetic oligonucleotide
  Target: ATXN1; (-) strand; PAM type: YTN; PAM sequence: CTA
ttttgtttaccatgtattcc

SEQ ID NO: 188385 - DNA, 20 bp, Artificial Sequence
  Description of Artificial Sequence: Synthetic oligonucleotide
  Target: ATXN1; (-) strand; PAM type: YTN; PAM sequence: CTG
ggctattttgtttaccatgt

SEQ ID NO: 188386 - DNA, 20 bp, Artificial Sequence
  Description of Artificial Sequence: Synthetic oligonucleotide
  Target: ATXN1; (-) strand; PAM type: YTN; PAM sequence: TTG
ggtgcagggtcctgggctat

SEQ ID NO: 188387 - DNA, 20 bp, Artificial Sequence
  Description of Artificial Sequence: Synthetic oligonucleotide
  Target: ATXN1; (-) strand; PAM type: YTN; PAM sequence: CTT
gggtgcagggtcctgggcta

SEQ ID NO: 188388 - DNA, 20 bp, Artificial Sequence
  Description of Artificial Sequence: Synthetic oligonucleotide
  Target: ATXN1; (-) strand; PAM type: YTN; PAM sequence: CTC
cttgggtgcagggtcctggg

SEQ ID NO: 188389 - DNA, 20 bp, Artificial Sequence
  Description of Artificial Sequence: Synthetic oligonucleotide
  Target: ATXN1; (-) strand; PAM type: YTN; PAM sequence: TTG
aggcagtgagctccttgggt

SEQ ID NO: 188390 - DNA, 20 bp, Artificial Sequence
  Description of Artificial Sequence: Synthetic oligonucleotide
  Target: ATXN1; (-) strand; PAM type: YTN; PAM sequence: CTT
gaggcagtgagctccttggg

SEQ ID NO: 188391 - DNA, 20 bp, Artificial Sequence
  Description of Artificial Sequence: Synthetic oligonucleotide
  Target: ATXN1; (-) strand; PAM type: YTN; PAM sequence: CTC
ttgaggcagtgagctccttg

SEQ ID NO: 188392 - DNA, 20 bp, Artificial Sequence
  Description of Artificial Sequence: Synthetic oligonucleotide
  Target: ATXN1; (-) strand; PAM type: YTN; PAM sequence: CTG
tccctcttgaggcagtgagc

SEQ ID NO: 188393 - DNA, 20 bp, Artificial Sequence
  Description of Artificial Sequence: Synthetic oligonucleotide
  Target: ATXN1; (-) strand; PAM type: YTN; PAM sequence: TTC
tgtccctcttgaggcagtga

SEQ ID NO: 188394 - DNA, 20 bp, Artificial Sequence
  Description of Artificial Sequence: Synthetic oligonucleotide
  Target: ATXN1; (-) strand; PAM type: YTN; PAM sequence: TTA
attctgtccctcttgaggca

SEQ ID NO: 188395 - DNA, 20 bp, Artificial Sequence
  Description of Artificial Sequence: Synthetic oligonucleotide
  Target: ATXN1; (-) strand; PAM type: YTN; PAM sequence: TTT
aattctgtccctcttgaggc

SEQ ID NO: 188396 - DNA, 20 bp, Artificial Sequence
  Description of Artificial Sequence: Synthetic oligonucleotide
  Target: ATXN1; (-) strand; PAM type: YTN; PAM sequence: TTA
tttaattctgtccctcttga

SEQ ID NO: 188397 - DNA, 20 bp, Artificial Sequence
  Description of Artificial Sequence: Synthetic oligonucleotide
  Target: ATXN1; (-) strand; PAM type: YTN; PAM sequence: CTC
atataattatttaattctgt

SEQ ID NO: 188398 - DNA, 20 bp, Artificial Sequence
  Description of Artificial Sequence: Synthetic oligonucleotide
  Target: ATXN1; (-) strand; PAM type: YTN; PAM sequence: CTA
aaactcatataattatttaa

SEQ ID NO: 188399 - DNA, 20 bp, Artificial Sequence
  Description of Artificial Sequence: Synthetic oligonucleotide
  Target: ATXN1; (-) strand; PAM type: YTN; PAM sequence: CTC
ctaaaactcatataattatt

SEQ ID NO: 188400 - DNA, 20 bp, Artificial Sequence
  Description of Artificial Sequence: Synthetic oligonucleotide
  Target: ATXN1; (-) strand; PAM type: YTN; PAM sequence: TTA
tgcatctcctaaaactcata

SEQ ID NO: 188401 - DNA, 20 bp, Artificial Sequence
  Description of Artificial Sequence: Synthetic oligonucleotide
  Target: ATXN1; (-) strand; PAM type: YTN; PAM sequence: TTT
atgcatctcctaaaactcat

SEQ ID NO: 188402 - DNA, 20 bp, Artificial Sequence
  Description of Artificial Sequence: Synthetic oligonucleotide
  Target: ATXN1; (-) strand; PAM type: YTN; PAM sequence: TTT
tatgcatctcctaaaactca

SEQ ID NO: 188403 - DNA, 20 bp, Artificial Sequence
  Description of Artificial Sequence: Synthetic oligonucleotide
  Target: ATXN1; (-) strand; PAM type: YTN; PAM sequence: TTC
aaattttatgcatctcctaa

SEQ ID NO: 188404 - DNA, 20 bp, Artificial Sequence
  Description of Artificial Sequence: Synthetic oligonucleotide
  Target: ATXN1; (-) strand; PAM type: YTN; PAM sequence: TTT
caaattttatgcatctccta

SEQ ID NO: 188405 - DNA, 20 bp, Artificial Sequence
  Description of Artificial Sequence: Synthetic oligonucleotide
  Target: ATXN1; (-) strand; PAM type: YTN; PAM sequence: TTT
tcaaattttatgcatctcct

SEQ ID NO: 188406 - DNA, 20 bp, Artificial Sequence
  Description of Artificial Sequence: Synthetic oligonucleotide
  Target: ATXN1; (-) strand; PAM type: YTN; PAM sequence: CTA
tccagttttcaaattttatg

SEQ ID NO: 188407 - DNA, 20 bp, Artificial Sequence
  Description of Artificial Sequence: Synthetic oligonucleotide
  Target: ATXN1; (-) strand; PAM type: YTN; PAM sequence: TTG
cctatccagttttcaaattt

SEQ ID NO: 188408 - DNA, 20 bp, Artificial Sequence
  Description of Artificial Sequence: Synthetic oligonucleotide
  Target: ATXN1; (-) strand; PAM type: YTN; PAM sequence: TTC
atattgcctatccagttttc

SEQ ID NO: 188409 - DNA, 20 bp, Artificial Sequence
  Description of Artificial Sequence: Synthetic oligonucleotide
  Target: ATXN1; (-) strand; PAM type: YTN; PAM sequence: CTT
catattgcctatccagtttt

SEQ ID NO: 188410 - DNA, 20 bp, Artificial Sequence
  Description of Artificial Sequence: Synthetic oligonucleotide
  Target: ATXN1; (-) strand; PAM type: YTN; PAM sequence: TTC
cttcatattgcctatccagt

SEQ ID NO: 188411 - DNA, 20 bp, Artificial Sequence
  Description of Artificial Sequence: Synthetic oligonucleotide
  Target: ATXN1; (-) strand; PAM type: YTN; PAM sequence: TTT
ccttcatattgcctatccag

SEQ ID NO: 188412 - DNA, 20 bp, Artificial Sequence
  Description of Artificial Sequence: Synthetic oligonucleotide
  Target: ATXN1; (-) strand; PAM type: YTN; PAM sequence: TTT
tccttcatattgcctatcca

SEQ ID NO: 188413 - DNA, 20 bp, Artificial Sequence
  Description of Artificial Sequence: Synthetic oligonucleotide
  Target: ATXN1; (-) strand; PAM type: YTN; PAM sequence: TTT
ttccttcatattgcctatcc

SEQ ID NO: 188414 - DNA, 20 bp, Artificial Sequence
  Description of Artificial Sequence: Synthetic oligonucleotide
  Target: ATXN1; (-) strand; PAM type: YTN; PAM sequence: TTC
atttttccttcatattgcct

SEQ ID NO: 188415 - DNA, 20 bp, Artificial Sequence
  Description of Artificial Sequence: Synthetic oligonucleotide
  Target: ATXN1; (-) strand; PAM type: YTN; PAM sequence: CTA
caaatcacaatgttcatttt

SEQ ID NO: 188416 - DNA, 20 bp, Artificial Sequence
  Description of Artificial Sequence: Synthetic oligonucleotide
  Target: ATXN1; (-) strand; PAM type: YTN; PAM sequence: CTA
agtgaggtacccccatcatg

SEQ ID NO: 188417 - DNA, 20 bp, Artificial Sequence
  Description of Artificial Sequence: Synthetic oligonucleotide
  Target: ATXN1; (-) strand; PAM type: YTN; PAM sequence: TTC
taagtgaggtacccccatca

SEQ ID NO: 188418 - DNA, 20 bp, Artificial Sequence
  Description of Artificial Sequence: Synthetic oligonucleotide
  Target: ATXN1; (-) strand; PAM type: YTN; PAM sequence: CTT
ctaagtgaggtacccccatc

SEQ ID NO: 188419 - DNA, 20 bp, Artificial Sequence
  Description of Artificial Sequence: Synthetic oligonucleotide
  Target: ATXN1; (-) strand; PAM type: YTN; PAM sequence: CTC
cttctaagtgaggtaccccc

SEQ ID NO: 188420 - DNA, 20 bp, Artificial Sequence
  Description of Artificial Sequence: Synthetic oligonucleotide
  Target: ATXN1; (-) strand; PAM type: YTN; PAM sequence: CTG
agaccctccttctaagtgag

SEQ ID NO: 188421 - DNA, 20 bp, Artificial Sequence
  Description of Artificial Sequence: Synthetic oligonucleotide
  Target: ATXN1; (-) strand; PAM type: YTN; PAM sequence: TTC
ctgagaccctccttctaagt

SEQ ID NO: 188422 - DNA, 20 bp, Artificial Sequence
  Description of Artificial Sequence: Synthetic oligonucleotide
  Target: ATXN1; (-) strand; PAM type: YTN; PAM sequence: CTT
cctgagaccctccttctaag

SEQ ID NO: 188423 - DNA, 20 bp, Artificial Sequence
  Description of Artificial Sequence: Synthetic oligonucleotide
  Target: ATXN1; (-) strand; PAM type: YTN; PAM sequence: TTG
taagagaagccttcctgaga

SEQ ID NO: 188424 - DNA, 20 bp, Artificial Sequence
  Description of Artificial Sequence: Synthetic oligonucleotide
  Target: ATXN1; (-) strand; PAM type: YTN; PAM sequence: TTT
gtaagagaagccttcctgag

SEQ ID NO: 188425 - DNA, 20 bp, Artificial Sequence
  Description of Artificial Sequence: Synthetic oligonucleotide
  Target: ATXN1; (-) strand; PAM type: YTN; PAM sequence: TTT
tgtaagagaagccttcctga

SEQ ID NO: 188426 - DNA, 20 bp, Artificial Sequence
  Description of Artificial Sequence: Synthetic oligonucleotide
  Target: ATXN1; (-) strand; PAM type: YTN; PAM sequence: TTA
gttttgtaagagaagccttc

SEQ ID NO: 188427 - DNA, 20 bp, Artificial Sequence
  Description of Artificial Sequence: Synthetic oligonucleotide
  Target: ATXN1; (-) strand; PAM type: YTN; PAM sequence: TTC
gaatgttagttttgtaagag

SEQ ID NO: 188428 - DNA, 20 bp, Artificial Sequence
  Description of Artificial Sequence: Synthetic oligonucleotide
  Target: ATXN1; (-) strand; PAM type: YTN; PAM sequence: CTG
ttcgaatgttagttttgtaa

SEQ ID NO: 188429 - DNA, 20 bp, Artificial Sequence
  Description of Artificial Sequence: Synthetic oligonucleotide
  Target: ATXN1; (-) strand; PAM type: YTN; PAM sequence: TTC
ctgttcgaatgttagttttg

SEQ ID NO: 188430 - DNA, 20 bp, Artificial Sequence
  Description of Artificial Sequence: Synthetic oligonucleotide
  Target: ATXN1; (-) strand; PAM type: YTN; PAM sequence: TTT
cctgttcgaatgttagtttt

SEQ ID NO: 188431 - DNA, 20 bp, Artificial Sequence
  Description of Artificial Sequence: Synthetic oligonucleotide
  Target: ATXN1; (-) strand; PAM type: YTN; PAM sequence: CTT
tcctgttcgaatgttagttt

SEQ ID NO: 188432 - DNA, 20 bp, Artificial Sequence
  Description of Artificial Sequence: Synthetic oligonucleotide
  Target: ATXN1; (-) strand; PAM type: YTN; PAM sequence: TTG
actttcctgttcgaatgtta

SEQ ID NO: 188433 - DNA, 20 bp, Artificial Sequence
  Description of Artificial Sequence: Synthetic oligonucleotide
  Target: ATXN1; (-) strand; PAM type: YTN; PAM sequence: TTT
gactttcctgttcgaatgtt

SEQ ID NO: 188434 - DNA, 20 bp, Artificial Sequence
  Description of Artificial Sequence: Synthetic oligonucleotide
  Target: ATXN1; (-) strand; PAM type: YTN; PAM sequence: TTT
tgactttcctgttcgaatgt

SEQ ID NO: 188435 - DNA, 20 bp, Artificial Sequence
  Description of Artificial Sequence: Synthetic oligonucleotide
  Target: ATXN1; (-) strand; PAM type: YTN; PAM sequence: TTT
ttgactttcctgttcgaatg

SEQ ID NO: 188436 - DNA, 20 bp, Artificial Sequence
  Description of Artificial Sequence: Synthetic oligonucleotide
  Target: ATXN1; (-) strand; PAM type: YTN; PAM sequence: CTC
atttttgactttcctgttcg

SEQ ID NO: 188437 - DNA, 20 bp, Artificial Sequence
  Description of Artificial Sequence: Synthetic oligonucleotide
  Target: ATXN1; (-) strand; PAM type: YTN; PAM sequence: CTG
ctcatttttgactttcctgt

SEQ ID NO: 188438 - DNA, 20 bp, Artificial Sequence
  Description of Artificial Sequence: Synthetic oligonucleotide
  Target: ATXN1; (-) strand; PAM type: YTN; PAM sequence: TTC
tgctcatttttgactttcct

SEQ ID NO: 188439 - DNA, 20 bp, Artificial Sequence
  Description of Artificial Sequence: Synthetic oligonucleotide
  Target: ATXN1; (-) strand; PAM type: YTN; PAM sequence: CTT
ctgctcatttttgactttcc

SEQ ID NO: 188440 - DNA, 20 bp, Artificial Sequence
  Description of Artificial Sequence: Synthetic oligonucleotide
  Target: ATXN1; (-) strand; PAM type: YTN; PAM sequence: CTA
acttctgctcatttttgact

SEQ ID NO: 188441 - DNA, 20 bp, Artificial Sequence
  Description of Artificial Sequence: Synthetic oligonucleotide
  Target: ATXN1; (-) strand; PAM type: YTN; PAM sequence: CTG
gctaacttctgctcattttt

SEQ ID NO: 188442 - DNA, 20 bp, Artificial Sequence
  Description of Artificial Sequence: Synthetic oligonucleotide
  Target: ATXN1; (-) strand; PAM type: YTN; PAM sequence: CTG
atgcctggctaacttctgct

SEQ ID NO: 188443 - DNA, 20 bp, Artificial Sequence
  Description of Artificial Sequence: Synthetic oligonucleotide
  Target: ATXN1; (-) strand; PAM type: YTN; PAM sequence: CTG
gaaacctgatgcctggctaa

SEQ ID NO: 188444 - DNA, 20 bp, Artificial Sequence
  Description of Artificial Sequence: Synthetic oligonucleotide
  Target: ATXN1; (-) strand; PAM type: YTN; PAM sequence: CTA
cctggaaacctgatgcctgg

SEQ ID NO: 188445 - DNA, 20 bp, Artificial Sequence
  Description of Artificial Sequence: Synthetic oligonucleotide
  Target: ATXN1; (-) strand; PAM type: YTN; PAM sequence: CTC
tacctggaaacctgatgcct

SEQ ID NO: 188446 - DNA, 20 bp, Artificial Sequence
  Description of Artificial Sequence: Synthetic oligonucleotide
  Target: ATXN1; (-) strand; PAM type: YTN; PAM sequence: TTC
ctctacctggaaacctgatg

SEQ ID NO: 188447 - DNA, 20 bp, Artificial Sequence
  Description of Artificial Sequence: Synthetic oligonucleotide
  Target: ATXN1; (-) strand; PAM type: YTN; PAM sequence: TTT
cctctacctggaaacctgat

SEQ ID NO: 188448 - DNA, 20 bp, Artificial Sequence
  Description of Artificial Sequence: Synthetic oligonucleotide
  Target: ATXN1; (-) strand; PAM type: YTN; PAM sequence: CTG
tttcctctacctggaaacct

SEQ ID NO: 188449 - DNA, 20 bp, Artificial Sequence
  Description of Artificial Sequence: Synthetic oligonucleotide
  Target: ATXN1; (-) strand; PAM type: YTN; PAM sequence: TTC
gtataatacagactgtttcc

SEQ ID NO: 188450 - DNA, 20 bp, Artificial Sequence
  Description of Artificial Sequence: Synthetic oligonucleotide
  Target: ATXN1; (-) strand; PAM type: YTN; PAM sequence: CTA
gatcagttcgtataatacag

SEQ ID NO: 188451 - DNA, 20 bp, Artificial Sequence
  Description of Artificial Sequence: Synthetic oligonucleotide
  Target: ATXN1; (-) strand; PAM type: YTN; PAM sequence: TTG
tacatcactagatcagttcg

SEQ ID NO: 188452 - DNA, 20 bp, Artificial Sequence
  Description of Artificial Sequence: Synthetic oligonucleotide
  Target: ATXN1; (-) strand; PAM type: YTN; PAM sequence: TTG
aaatggcaaaataaaaaaga

SEQ ID NO: 188453 - DNA, 20 bp, Artificial Sequence
  Description of Artificial Sequence: Synthetic oligonucleotide
  Target: ATXN1; (-) strand; PAM type: YTN; PAM sequence: CTC
agttgaaatggcaaaataaa

SEQ ID NO: 188454 - DNA, 20 bp, Artificial Sequence
  Description of Artificial Sequence: Synthetic oligonucleotide
  Target: ATXN1; (-) strand; PAM type: YTN; PAM sequence: TTC
aaggagactcagttgaaatg

SEQ ID NO: 188455 - DNA, 20 bp, Artificial Sequence
  Description of Artificial Sequence: Synthetic oligonucleotide
  Target: ATXN1; (-) strand; PAM type: YTN; PAM sequence: TTT
caaggagactcagttgaaat

SEQ ID NO: 188456 - DNA, 20 bp, Artificial Sequence
  Description of Artificial Sequence: Synthetic oligonucleotide
  Target: ATXN1; (-) strand; PAM type: YTN; PAM sequence: TTT
tcaaggagactcagttgaaa

SEQ ID NO: 188457 - DNA, 20 bp, Artificial Sequence
  Description of Artificial Sequence: Synthetic oligonucleotide
  Target: ATXN1; (-) strand; PAM type: YTN; PAM sequence: TTT
ttcaaggagactcagttgaa

SEQ ID NO: 188458 - DNA, 20 bp, Artificial Sequence
  Description of Artificial Sequence: Synthetic oligonucleotide
  Target: ATXN1; (-) strand; PAM type: YTN; PAM sequence: CTT
tttcaaggagactcagttga

SEQ ID NO: 188459 - DNA, 20 bp, Artificial Sequence
  Description of Artificial Sequence: Synthetic oligonucleotide
  Target: ATXN1; (-) strand; PAM type: YTN; PAM sequence: TTC
tttttcaaggagactcagtt

SEQ ID NO: 188460 - DNA, 20 bp, Artificial Sequence
  Description of Artificial Sequence: Synthetic oligonucleotide
  Target: ATXN1; (-) strand; PAM type: YTN; PAM sequence: TTT
ctttttcaaggagactcagt

SEQ ID NO: 188461 - DNA, 20 bp, Artificial Sequence
  Description of Artificial Sequence: Synthetic oligonucleotide
  Target: ATXN1; (-) strand; PAM type: YTN; PAM sequence: CTC
atttctttttcaaggagact

SEQ ID NO: 188462 - DNA, 20 bp, Artificial Sequence
  Description of Artificial Sequence: Synthetic oligonucleotide
  Target: ATXN1; (-) strand; PAM type: YTN; PAM sequence: TTG
tgtcactcatttctttttca

SEQ ID NO: 188463 - DNA, 20 bp, Artificial Sequence
  Description of Artificial Sequence: Synthetic oligonucleotide
  Target: ATXN1; (-) strand; PAM type: YTN; PAM sequence: TTC
aaggtatggagaacagttgt

SEQ ID NO: 188464 - DNA, 20 bp, Artificial Sequence
  Description of Artificial Sequence: Synthetic oligonucleotide
  Target: ATXN1; (-) strand; PAM type: YTN; PAM sequence: TTT
caaggtatggagaacagttg

SEQ ID NO: 188465 - DNA, 20 bp, Artificial Sequence
  Description of Artificial Sequence: Synthetic oligonucleotide
  Target: ATXN1; (-) strand; PAM type: YTN; PAM sequence: TTA
tttcaaggtatggagaacag

SEQ ID NO: 188466 - DNA, 20 bp, Artificial Sequence
  Description of Artificial Sequence: Synthetic oligonucleotide
  Target: ATXN1; (-) strand; PAM type: YTN; PAM sequence: CTT
atttcaaggtatggagaaca

SEQ ID NO: 188467 - DNA, 20 bp, Artificial Sequence
  Description of Artificial Sequence: Synthetic oligonucleotide
  Target: ATXN1; (-) strand; PAM type: YTN; PAM sequence: CTC
ttatttcaaggtatggagaa

SEQ ID NO: 188468 - DNA, 20 bp, Artificial Sequence
  Description of Artificial Sequence: Synthetic oligonucleotide
  Target: ATXN1; (-) strand; PAM type: YTN; PAM sequence: CTA
gcagtcagaaagatgaatca

SEQ ID NO: 188469 - DNA, 20 bp, Artificial Sequence
  Description of Artificial Sequence: Synthetic oligonucleotide
  Target: ATXN1; (-) strand; PAM type: YTN; PAM sequence: CTG
atggcctagcagtcagaaag

SEQ ID NO: 188470 - DNA, 20 bp, Artificial Sequence
  Description of Artificial Sequence: Synthetic oligonucleotide
  Target: ATXN1; (-) strand; PAM type: YTN; PAM sequence: CTC
tgatggcctagcagtcagaa

SEQ ID NO: 188471 - DNA, 20 bp, Artificial Sequence
  Description of Artificial Sequence: Synthetic oligonucleotide
  Target: ATXN1; (-) strand; PAM type: YTN; PAM sequence: TTG
ctctgatggcctagcagtca

SEQ ID NO: 188472 - DNA, 20 bp, Artificial Sequence
  Description of Artificial Sequence: Synthetic oligonucleotide
  Target: ATXN1; (-) strand; PAM type: YTN; PAM sequence: TTA
atcacagagaaggtgtgtgt

SEQ ID NO: 188473 - DNA, 20 bp, Artificial Sequence
  Description of Artificial Sequence: Synthetic oligonucleotide
  Target: ATXN1; (-) strand; PAM type: YTN; PAM sequence: CTC
accgaaattaatcacagaga

SEQ ID NO: 188474 - DNA, 20 bp, Artificial Sequence
  Description of Artificial Sequence: Synthetic oligonucleotide
  Target: ATXN1; (-) strand; PAM type: YTN; PAM sequence: CTC
tcaccgaaattaatcacaga

SEQ ID NO: 188475 - DNA, 20 bp, Artificial Sequence
  Description of Artificial Sequence: Synthetic oligonucleotide
  Target: ATXN1; (-) strand; PAM type: YTN; PAM sequence: TTC
ctctcaccgaaattaatcac

SEQ ID NO: 188476 - DNA, 20 bp, Artificial Sequence
  Description of Artificial Sequence: Synthetic oligonucleotide
  Target: ATXN1; (-) strand; PAM type: YTN; PAM sequence: CTG
catcaggggtgttcctctca

SEQ ID NO: 188477 - DNA, 20 bp, Artificial Sequence
  Description of Artificial Sequence: Synthetic oligonucleotide
  Target: ATXN1; (-) strand; PAM type: YTN; PAM sequence: CTG
tcacatcaagaataatacct

SEQ ID NO: 188478 - DNA, 20 bp, Artificial Sequence
  Description of Artificial Sequence: Synthetic oligonucleotide
  Target: ATXN1; (-) strand; PAM type: YTN; PAM sequence: TTG
ctgtcacatcaagaataata

SEQ ID NO: 188479 - DNA, 20 bp, Artificial Sequence
  Description of Artificial Sequence: Synthetic oligonucleotide
  Target: ATXN1; (-) strand; PAM type: YTN; PAM sequence: TTT
gctgtcacatcaagaataat

SEQ ID NO: 188480 - DNA, 20 bp, Artificial Sequence
  Description of Artificial Sequence: Synthetic oligonucleotide
  Target: ATXN1; (-) strand; PAM type: YTN; PAM sequence: TTA
tttgctgtcacatcaagaat

SEQ ID NO: 188481 - DNA, 20 bp, Artificial Sequence
  Description of Artificial Sequence: Synthetic oligonucleotide
  Target: ATXN1; (-) strand; PAM type: YTN; PAM sequence: TTA
gagagcagggtcattatttg

SEQ ID NO: 188482 - DNA, 20 bp, Artificial Sequence
  Description of Artificial Sequence: Synthetic oligonucleotide
  Target: ATXN1; (-) strand; PAM type: YTN; PAM sequence: TTG
gggtgcattagagagcaggg

SEQ ID NO: 188483 - DNA, 20 bp, Artificial Sequence
  Description of Artificial Sequence: Synthetic oligonucleotide
  Target: ATXN1; (-) strand; PAM type: YTN; PAM sequence: CTT
ggggtgcattagagagcagg

SEQ ID NO: 188484 - DNA, 20 bp, Artificial Sequence
  Description of Artificial Sequence: Synthetic oligonucleotide
  Target: ATXN1; (-) strand; PAM type: YTN; PAM sequence: CTG
tgataacggagtgacttggg

SEQ ID NO: 188485 - DNA, 20 bp, Artificial Sequence
  Description of Artificial Sequence: Synthetic oligonucleotide
  Target: ATXN1; (-) strand; PAM type: YTN; PAM sequence: TTC
actgtgataacggagtgact

SEQ ID NO: 188486 - DNA, 20 bp, Artificial Sequence
  Description of Artificial Sequence: Synthetic oligonucleotide
  Target: ATXN1; (-) strand; PAM type: YTN; PAM sequence: CTT
cactgtgataacggagtgac

SEQ ID NO: 188487 - DNA, 20 bp, Artificial Sequence
  Description of Artificial Sequence: Synthetic oligonucleotide
  Target: ATXN1; (-) strand; PAM type: YTN; PAM sequence: TTA
cttcactgtgataacggagt

SEQ ID NO: 188488 - DNA, 20 bp, Artificial Sequence
  Description of Artificial Sequence: Synthetic oligonucleotide
  Target: ATXN1; (-) strand; PAM type: YTN; PAM sequence: TTT
acttcactgtgataacggag

SEQ ID NO: 188489 - DNA, 20 bp, Artificial Sequence
  Description of Artificial Sequence: Synthetic oligonucleotide
  Target: ATXN1; (-) strand; PAM type: YTN; PAM sequence: TTT
tacttcactgtgataacgga

SEQ ID NO: 188490 - DNA, 20 bp, Artificial Sequence
  Description of Artificial Sequence: Synthetic oligonucleotide
  Target: ATXN1; (-) strand; PAM type: YTN; PAM sequence: CTT
ttacttcactgtgataacgg

SEQ ID NO: 188491 - DNA, 20 bp, Artificial Sequence
  Description of Artificial Sequence: Synthetic oligonucleotide
  Target: ATXN1; (-) strand; PAM type: YTN; PAM sequence: TTC
cttttacttcactgtgataa

SEQ ID NO: 188492 - DNA, 20 bp, Artificial Sequence
  Description of Artificial Sequence: Synthetic oligonucleotide
  Target: ATXN1; (-) strand; PAM type: YTN; PAM sequence: CTT
ccttttacttcactgtgata

SEQ ID NO: 188493 - DNA, 20 bp, Artificial Sequence
  Description of Artificial Sequence: Synthetic oligonucleotide
  Target: ATXN1; (-) strand; PAM type: YTN; PAM sequence: CTG
tggcatgcaggtgtcaacaa

SEQ ID NO: 188494 - DNA, 20 bp, Artificial Sequence
  Description of Artificial Sequence: Synthetic oligonucleotide
  Target: ATXN1; (-) strand; PAM type: YTN; PAM sequence: TTC
agctgtggcatgcaggtgtc

SEQ ID NO: 188495 - DNA, 20 bp, Artificial Sequence
  Description of Artificial Sequence: Synthetic oligonucleotide
  Target: ATXN1; (-) strand; PAM type: YTN; PAM sequence: CTT
cagctgtggcatgcaggtgt

SEQ ID NO: 188496 - DNA, 20 bp, Artificial Sequence
  Description of Artificial Sequence: Synthetic oligonucleotide
  Target: ATXN1; (-) strand; PAM type: YTN; PAM sequence: TTA
acttcagctgtggcatgcag

SEQ ID NO: 188497 - DNA, 20 bp, Artificial Sequence
  Description of Artificial Sequence: Synthetic oligonucleotide
  Target: ATXN1; (-) strand; PAM type: YTN; PAM sequence: CTT
aacttcagctgtggcatgca

SEQ ID NO: 188498 - DNA, 20 bp, Artificial Sequence
  Description of Artificial Sequence: Synthetic oligonucleotide
  Target: ATXN1; (-) strand; PAM type: YTN; PAM sequence: TTC
ttaacttcagctgtggcatg

SEQ ID NO: 188499 - DNA, 20 bp, Artificial Sequence
  Description of Artificial Sequence: Synthetic oligonucleotide
  Target: ATXN1; (-) strand; PAM type: YTN; PAM sequence: TTT
cttaacttcagctgtggcat

SEQ ID NO: 188500 - DNA, 20 bp, Artificial Sequence
  Description of Artificial Sequence: Synthetic oligonucleotide
  Target: ATXN1; (-) strand; PAM type: YTN; PAM sequence: TTT
tcttaacttcagctgtggca

SEQ ID NO: 188501 - DNA, 20 bp, Artificial Sequence
  Description of Artificial Sequence: Synthetic oligonucleotide
  Target: ATXN1; (-) strand; PAM type: YTN; PAM sequence: TTG
ggggagggttttcttaactt

SEQ ID NO: 188502 - DNA, 20 bp, Artificial Sequence
  Description of Artificial Sequence: Synthetic oligonucleotide
  Target: ATXN1; (-) strand; PAM type: YTN; PAM sequence: TTT
gggggagggttttcttaact

SEQ ID NO: 188503 - DNA, 20 bp, Artificial Sequence
  Description of Artificial Sequence: Synthetic oligonucleotide
  Target: ATXN1; (-) strand; PAM type: YTN; PAM sequence: TTT
tgggggagggttttcttaac

SEQ ID NO: 188504 - DNA, 20 bp, Artificial Sequence
  Description of Artificial Sequence: Synthetic oligonucleotide
  Target: ATXN1; (-) strand; PAM type: YTN; PAM sequence: TTT
ttgggggagggttttcttaa

SEQ ID NO: 188505 - DNA, 20 bp, Artificial Sequence
  Description of Artificial Sequence: Synthetic oligonucleotide
  Target: ATXN1; (-) strand; PAM type: YTN; PAM sequence: CTT
tttgggggagggttttctta

SEQ ID NO: 188506 - DNA, 20 bp, Artificial Sequence
  Description of Artificial Sequence: Synthetic oligonucleotide
  Target: ATXN1; (-) strand; PAM type: YTN; PAM sequence: TTC
agtcctttttgggggagggt

SEQ ID NO: 188507 - DNA, 20 bp, Artificial Sequence
  Description of Artificial Sequence: Synthetic oligonucleotide
  Target: ATXN1; (-) strand; PAM type: YTN; PAM sequence: TTT
cagtcctttttgggggaggg

SEQ ID NO: 188508 - DNA, 20 bp, Artificial Sequence
  Description of Artificial Sequence: Synthetic oligonucleotide
  Target: ATXN1; (-) strand; PAM type: YTN; PAM sequence: TTT
tcagtcctttttgggggagg

SEQ ID NO: 188509 - DNA, 20 bp, Artificial Sequence
  Description of Artificial Sequence: Synthetic oligonucleotide
  Target: ATXN1; (-) strand; PAM type: YTN; PAM sequence: CTG
ttttcagtcctttttggggg

SEQ ID NO: 188510 - DNA, 20 bp, Artificial Sequence
  Description of Artificial Sequence: Synthetic oligonucleotide
  Target: ATXN1; (-) strand; PAM type: YTN; PAM sequence: CTA
caagtaatgtgatctgtttt

SEQ ID NO: 188511 - DNA, 20 bp, Artificial Sequence
  Description of Artificial Sequence: Synthetic oligonucleotide
  Target: ATXN1; (-) strand; PAM type: YTN; PAM sequence: TTC
agaagtctacaagtaatgtg

SEQ ID NO: 188512 - DNA, 20 bp, Artificial Sequence
  Description of Artificial Sequence: Synthetic oligonucleotide
  Target: ATXN1; (-) strand; PAM type: YTN; PAM sequence: TTT
cagaagtctacaagtaatgt

SEQ ID NO: 188513 - DNA, 20 bp, Artificial Sequence
  Description of Artificial Sequence: Synthetic oligonucleotide
  Target: ATXN1; (-) strand; PAM type: YTN; PAM sequence: TTT
tcagaagtctacaagtaatg

SEQ ID NO: 188514 - DNA, 20 bp, Artificial Sequence
  Description of Artificial Sequence: Synthetic oligonucleotide
  Target: ATXN1; (-) strand; PAM type: YTN; PAM sequence: TTT
ttcagaagtctacaagtaat

SEQ ID NO: 188515 - DNA, 20 bp, Artificial Sequence
  Description of Artificial Sequence: Synthetic oligonucleotide
  Target: ATXN1; (-) strand; PAM type: YTN; PAM sequence: CTA
aagatgtttttcagaagtct

SEQ ID NO: 188516 - DNA, 20 bp, Artificial Sequence
  Description of Artificial Sequence: Synthetic oligonucleotide
  Target: ATXN1; (-) strand; PAM type: YTN; PAM sequence: CTG
atccaaggtcctaaagatgt

SEQ ID NO: 188517 - DNA, 20 bp, Artificial Sequence
  Description of Artificial Sequence: Synthetic oligonucleotide
  Target: ATXN1; (-) strand; PAM type: YTN; PAM sequence: CTG
gtacctgatccaaggtccta

SEQ ID NO: 188518 - DNA, 20 bp, Artificial Sequence
  Description of Artificial Sequence: Synthetic oligonucleotide
  Target: ATXN1; (-) strand; PAM type: YTN; PAM sequence: TTA
agtccaagagagaaatagta

SEQ ID NO: 188519 - DNA, 20 bp, Artificial Sequence
  Description of Artificial Sequence: Synthetic oligonucleotide
  Target: ATXN1; (-) strand; PAM type: YTN; PAM sequence: TTT
aagtccaagagagaaatagt

SEQ ID NO: 188520 - DNA, 20 bp, Artificial Sequence
  Description of Artificial Sequence: Synthetic oligonucleotide
  Target: ATXN1; (-) strand; PAM type: YTN; PAM sequence: CTG
tttaagtccaagagagaaat

SEQ ID NO: 188521 - DNA, 20 bp, Artificial Sequence
  Description of Artificial Sequence: Synthetic oligonucleotide
  Target: ATXN1; (-) strand; PAM type: YTN; PAM sequence: TTA
acggtgggcataaaagctgt

SEQ ID NO: 188522 - DNA, 20 bp, Artificial Sequence
  Description of Artificial Sequence: Synthetic oligonucleotide
  Target: ATXN1; (-) strand; PAM type: YTN; PAM sequence: CTG
ttaacggtgggcataaaagc

SEQ ID NO: 188523 - DNA, 20 bp, Artificial Sequence
  Description of Artificial Sequence: Synthetic oligonucleotide
  Target: ATXN1; (-) strand; PAM type: YTN; PAM sequence: TTG
acggaacactgttaacggtg

SEQ ID NO: 188524 - DNA, 20 bp, Artificial Sequence
  Description of Artificial Sequence: Synthetic oligonucleotide
  Target: ATXN1; (-) strand; PAM type: YTN; PAM sequence: CTG
aaccaagaaccaagagagaa

SEQ ID NO: 188525 - DNA, 20 bp, Artificial Sequence
  Description of Artificial Sequence: Synthetic oligonucleotide
  Target: ATXN1; (-) strand; PAM type: YTN; PAM sequence: CTC
atgtgggtaagtaaacagac

SEQ ID NO: 188526 - DNA, 20 bp, Artificial Sequence
  Description of Artificial Sequence: Synthetic oligonucleotide
  Target: ATXN1; (-) strand; PAM type: YTN; PAM sequence: TTG
cggctcatgtgggtaagtaa

SEQ ID NO: 188527 - DNA, 20 bp, Artificial Sequence
  Description of Artificial Sequence: Synthetic oligonucleotide
  Target: ATXN1; (-) strand; PAM type: YTN; PAM sequence: CTT
gcggctcatgtgggtaagta

SEQ ID NO: 188528 - DNA, 20 bp, Artificial Sequence
  Description of Artificial Sequence: Synthetic oligonucleotide
  Target: ATXN1; (-) strand; PAM type: YTN; PAM sequence: TTG
cttgcggctcatgtgggtaa

SEQ ID NO: 188529 - DNA, 20 bp, Artificial Sequence
  Description of Artificial Sequence: Synthetic oligonucleotide
  Target: ATXN1; (-) strand; PAM type: YTN; PAM sequence: CTT
gcttgcggctcatgtgggta

SEQ ID NO: 188530 - DNA, 20 bp, Artificial Sequence
  Description of Artificial Sequence: Synthetic oligonucleotide
  Target: ATXN1; (-) strand; PAM type: YTN; PAM sequence: TTG
caccttgcttgcggctcatg

SEQ ID NO: 188531 - DNA, 20 bp, Artificial Sequence
  Description of Artificial Sequence: Synthetic oligonucleotide
  Target: ATXN1; (-) strand; PAM type: YTN; PAM sequence: TTT
gcaccttgcttgcggctcat

SEQ ID NO: 188532 - DNA, 20 bp, Artificial Sequence
  Description of Artificial Sequence: Synthetic oligonucleotide
  Target: ATXN1; (-) strand; PAM type: YTN; PAM sequence: CTT
tgcaccttgcttgcggctca

SEQ ID NO: 188533 - DNA, 20 bp, Artificial Sequence
  Description of Artificial Sequence: Synthetic oligonucleotide
  Target: ATXN1; (-) strand; PAM type: YTN; PAM sequence: TTC
tttgcaccttgcttgcggct

SEQ ID NO: 188534 - DNA, 20 bp, Artificial Sequence
  Description of Artificial Sequence: Synthetic oligonucleotide
  Target: ATXN1; (-) strand; PAM type: YTN; PAM sequence: TTT
ctttgcaccttgcttgcggc

SEQ ID NO: 188535 - DNA, 20 bp, Artificial Sequence
  Description of Artificial Sequence: Synthetic oligonucleotide
  Target: ATXN1; (-) strand; PAM type: YTN; PAM sequence: TTA
atttctttgcaccttgcttg

SEQ ID NO: 188536 - DNA, 20 bp, Artificial Sequence
  Description of Artificial Sequence: Synthetic oligonucleotide
  Target: ATXN1; (-) strand; PAM type: YTN; PAM sequence: TTT
aatttctttgcaccttgctt

SEQ ID NO: 188537 - DNA, 20 bp, Artificial Sequence
  Description of Artificial Sequence: Synthetic oligonucleotide
  Target: ATXN1; (-) strand; PAM type: YTN; PAM sequence: TTT
taatttctttgcaccttgct

SEQ ID NO: 188538 - DNA, 20 bp, Artificial Sequence
  Description of Artificial Sequence: Synthetic oligonucleotide
  Target: ATXN1; (-) strand; PAM type: YTN; PAM sequence: CTT
ttaatttctttgcaccttgc

SEQ ID NO: 188539 - DNA, 20 bp, Artificial Sequence
  Description of Artificial Sequence: Synthetic oligonucleotide
  Target: ATXN1; (-) strand; PAM type: YTN; PAM sequence: CTG
cttttaatttctttgcacct

SEQ ID NO: 188540 - DNA, 20 bp, Artificial Sequence
  Description of Artificial Sequence: Synthetic oligonucleotide
  Target: ATXN1; (-) strand; PAM type: YTN; PAM sequence: TTC
cactgcttttaatttctttg

SEQ ID NO: 188541 - DNA, 20 bp, Artificial Sequence
  Description of Artificial Sequence: Synthetic oligonucleotide
  Target: ATXN1; (-) strand; PAM type: YTN; PAM sequence: TTT
ccactgcttttaatttcttt

SEQ ID NO: 188542 - DNA, 20 bp, Artificial Sequence
  Description of Artificial Sequence: Synthetic oligonucleotide
  Target: ATXN1; (-) strand; PAM type: YTN; PAM sequence: TTC
agatgaacatgacatttcca

SEQ ID NO: 188543 - DNA, 20 bp, Artificial Sequence
  Description of Artificial Sequence: Synthetic oligonucleotide
  Target: ATXN1; (-) strand; PAM type: YTN; PAM sequence: CTT
cagatgaacatgacatttcc

SEQ ID NO: 188544 - DNA, 20 bp, Artificial Sequence
  Description of Artificial Sequence: Synthetic oligonucleotide
  Target: ATXN1; (-) strand; PAM type: YTN; PAM sequence: TTG
agccagatgtgggatgatag

SEQ ID NO: 188545 - DNA, 20 bp, Artificial Sequence
  Description of Artificial Sequence: Synthetic oligonucleotide
  Target: ATXN1; (-) strand; PAM type: YTN; PAM sequence: TTA
agttgagccagatgtgggat

SEQ ID NO: 188546 - DNA, 20 bp, Artificial Sequence
  Description of Artificial Sequence: Synthetic oligonucleotide
  Target: ATXN1; (-) strand; PAM type: YTN; PAM sequence: TTA
gtggaagaattaagttgagc

SEQ ID NO: 188547 - DNA, 20 bp, Artificial Sequence
  Description of Artificial Sequence: Synthetic oligonucleotide
  Target: ATXN1; (-) strand; PAM type: YTN; PAM sequence: CTT
agtggaagaattaagttgag

SEQ ID NO: 188548 - DNA, 20 bp, Artificial Sequence
  Description of Artificial Sequence: Synthetic oligonucleotide
  Target: ATXN1; (-) strand; PAM type: YTN; PAM sequence: TTC
cttagtggaagaattaagtt

SEQ ID NO: 188549 - DNA, 20 bp, Artificial Sequence
  Description of Artificial Sequence: Synthetic oligonucleotide
  Target: ATXN1; (-) strand; PAM type: YTN; PAM sequence: TTT
ccttagtggaagaattaagt

SEQ ID NO: 188550 - DNA, 20 bp, Artificial Sequence
  Description of Artificial Sequence: Synthetic oligonucleotide
  Target: ATXN1; (-) strand; PAM type: YTN; PAM sequence: TTT
tccttagtggaagaattaag

SEQ ID NO: 188551 - DNA, 20 bp, Artificial Sequence
  Description of Artificial Sequence: Synthetic oligonucleotide
  Target: ATXN1; (-) strand; PAM type: YTN; PAM sequence: CTG
attttccttagtggaagaat

SEQ ID NO: 188552 - DNA, 20 bp, Artificial Sequence
  Description of Artificial Sequence: Synthetic oligonucleotide
  Target: ATXN1; (-) strand; PAM type: YTN; PAM sequence: CTA
ctgattttccttagtggaag

SEQ ID NO: 188553 - DNA, 20 bp, Artificial Sequence
  Description of Artificial Sequence: Synthetic oligonucleotide
  Target: ATXN1; (-) strand; PAM type: YTN; PAM sequence: TTG
taggatgaagaaagcaaact

SEQ ID NO: 188554 - DNA, 20 bp, Artificial Sequence
  Description of Artificial Sequence: Synthetic oligonucleotide
  Target: ATXN1; (-) strand; PAM type: YTN; PAM sequence: TTA
atgttgtaggatgaagaaag

SEQ ID NO: 188555 - DNA, 20 bp, Artificial Sequence
  Description of Artificial Sequence: Synthetic oligonucleotide
  Target: ATXN1; (-) strand; PAM type: YTN; PAM sequence: TTT
aatgttgtaggatgaagaaa

SEQ ID NO: 188556 - DNA, 20 bp, Artificial Sequence
  Description of Artificial Sequence: Synthetic oligonucleotide
  Target: ATXN1; (-) strand; PAM type: YTN; PAM sequence: CTT
taatgttgtaggatgaagaa

SEQ ID NO: 188557 - DNA, 20 bp, Artificial Sequence
  Description of Artificial Sequence: Synthetic oligonucleotide
  Target: ATXN1; (-) strand; PAM type: YTN; PAM sequence: TTG
gatgatgctttaatgttgta

SEQ ID NO: 188558 - DNA, 20 bp, Artificial Sequence
  Description of Artificial Sequence: Synthetic oligonucleotide
  Target: ATXN1; (-) strand; PAM type: YTN; PAM sequence: CTG
ttggatgatgctttaatgtt

SEQ ID NO: 188559 - DNA, 20 bp, Artificial Sequence
  Description of Artificial Sequence: Synthetic oligonucleotide
  Target: ATXN1; (-) strand; PAM type: YTN; PAM sequence: TTC
atggggagaacatgaatgag

SEQ ID NO: 188560 - DNA, 20 bp, Artificial Sequence
  Description of Artificial Sequence: Synthetic oligonucleotide
  Target: ATXN1; (-) strand; PAM type: YTN; PAM sequence: CTC
cattcatggggagaacatga

SEQ ID NO: 188561 - DNA, 20 bp, Artificial Sequence
  Description of Artificial Sequence: Synthetic oligonucleotide
  Target: ATXN1; (-) strand; PAM type: YTN; PAM sequence: TTA
ctccattcatggggagaaca

SEQ ID NO: 188562 - DNA, 20 bp, Artificial Sequence
  Description of Artificial Sequence: Synthetic oligonucleotide
  Target: ATXN1; (-) strand; PAM type: YTN; PAM sequence: CTT
actccattcatggggagaac

SEQ ID NO: 188563 - DNA, 20 bp, Artificial Sequence
  Description of Artificial Sequence: Synthetic oligonucleotide
  Target: ATXN1; (-) strand; PAM type: YTN; PAM sequence: TTC
agacttactccattcatggg

SEQ ID NO: 188564 - DNA, 20 bp, Artificial Sequence
  Description of Artificial Sequence: Synthetic oligonucleotide
  Target: ATXN1; (-) strand; PAM type: YTN; PAM sequence: TTT
cagacttactccattcatgg

SEQ ID NO: 188565 - DNA, 20 bp, Artificial Sequence
  Description of Artificial Sequence: Synthetic oligonucleotide
  Target: ATXN1; (-) strand; PAM type: YTN; PAM sequence: CTT
tcagacttactccattcatg

SEQ ID NO: 188566 - DNA, 20 bp, Artificial Sequence
  Description of Artificial Sequence: Synthetic oligonucleotide
  Target: ATXN1; (-) strand; PAM type: YTN; PAM sequence: TTC
agacaggctttcagacttac

SEQ ID NO: 188567 - DNA, 20 bp, Artificial Sequence
  Description of Artificial Sequence: Synthetic oligonucleotide
  Target: ATXN1; (-) strand; PAM type: YTN; PAM sequence: TTT
cagacaggctttcagactta

SEQ ID NO: 188568 - DNA, 20 bp, Artificial Sequence
  Description of Artificial Sequence: Synthetic oligonucleotide
  Target: ATXN1; (-) strand; PAM type: YTN; PAM sequence: TTG
tttcagacaggctttcagac

SEQ ID NO: 188569 - DNA, 20 bp, Artificial Sequence
  Description of Artificial Sequence: Synthetic oligonucleotide
  Target: ATXN1; (-) strand; PAM type: YTN; PAM sequence: TTT
gtttcagacaggctttcaga

SEQ ID NO: 188570 - DNA, 20 bp, Artificial Sequence
  Description of Artificial Sequence: Synthetic oligonucleotide
  Target: ATXN1; (-) strand; PAM type: YTN; PAM sequence: TTG
gcatatttgtttcagacagg

SEQ ID NO: 188571 - DNA, 20 bp, Artificial Sequence
  Description of Artificial Sequence: Synthetic oligonucleotide
  Target: ATXN1; (-) strand; PAM type: YTN; PAM sequence: TTT
ggcatatttgtttcagacag

SEQ ID NO: 188572 - DNA, 20 bp, Artificial Sequence
  Description of Artificial Sequence: Synthetic oligonucleotide
  Target: ATXN1; (-) strand; PAM type: YTN; PAM sequence: CTC
aaatagaagtttggcatatt

SEQ ID NO: 188573 - DNA, 20 bp, Artificial Sequence
  Description of Artificial Sequence: Synthetic oligonucleotide
  Target: ATXN1; (-) strand; PAM type: YTN; PAM sequence: TTA
aatggaaagagactcaaata

SEQ ID NO: 188574 - DNA, 20 bp, Artificial Sequence
  Description of Artificial Sequence: Synthetic oligonucleotide
  Target: ATXN1; (-) strand; PAM type: YTN; PAM sequence: TTT
aaatggaaagagactcaaat

SEQ ID NO: 188575 - DNA, 20 bp, Artificial Sequence
  Description of Artificial Sequence: Synthetic oligonucleotide
  Target: ATXN1; (-) strand; PAM type: YTN; PAM sequence: TTT
taaatggaaagagactcaaa

SEQ ID NO: 188576 - DNA, 20 bp, Artificial Sequence
  Description of Artificial Sequence: Synthetic oligonucleotide
  Target: ATXN1; (-) strand; PAM type: YTN; PAM sequence: TTG
gacattttaaatggaaagag

SEQ ID NO: 188577 - DNA, 20 bp, Artificial Sequence
  Description of Artificial Sequence: Synthetic oligonucleotide
  Target: ATXN1; (-) strand; PAM type: YTN; PAM sequence: CTT
ggacattttaaatggaaaga

SEQ ID NO: 188578 - DNA, 20 bp, Artificial Sequence
  Description of Artificial Sequence: Synthetic oligonucleotide
  Target: ATXN1; (-) strand; PAM type: YTN; PAM sequence: TTA
tcttggacattttaaatgga

SEQ ID NO: 188579 - DNA, 20 bp, Artificial Sequence
  Description of Artificial Sequence: Synthetic oligonucleotide
  Target: ATXN1; (-) strand; PAM type: YTN; PAM sequence: TTT
atcttggacattttaaatgg

SEQ ID NO: 188580 - DNA, 20 bp, Artificial Sequence
  Description of Artificial Sequence: Synthetic oligonucleotide
  Target: ATXN1; (-) strand; PAM type: YTN; PAM sequence: TTT
tatcttggacattttaaatg

SEQ ID NO: 188581 - DNA, 20 bp, Artificial Sequence
  Description of Artificial Sequence: Synthetic oligonucleotide
  Target: ATXN1; (-) strand; PAM type: YTN; PAM sequence: TTA
cattttatcttggacatttt

SEQ ID NO: 188582 - DNA, 20 bp, Artificial Sequence
  Description of Artificial Sequence: Synthetic oligonucleotide
  Target: ATXN1; (-) strand; PAM type: YTN; PAM sequence: TTG
taggataaattacattttat

SEQ ID NO: 188583 - DNA, 20 bp, Artificial Sequence
  Description of Artificial Sequence: Synthetic oligonucleotide
  Target: ATXN1; (-) strand; PAM type: YTN; PAM sequence: CTT
gtaggataaattacatttta

SEQ ID NO: 188584 - DNA, 20 bp, Artificial Sequence
  Description of Artificial Sequence: Synthetic oligonucleotide
  Target: ATXN1; (-) strand; PAM type: YTN; PAM sequence: TTG
tataagaagcttgtaggata

SEQ ID NO: 188585 - DNA, 20 bp, Artificial Sequence
  Description of Artificial Sequence: Synthetic oligonucleotide
  Target: ATXN1; (-) strand; PAM type: YTN; PAM sequence: TTT
gtataagaagcttgtaggat

SEQ ID NO: 188586 - DNA, 20 bp, Artificial Sequence
  Description of Artificial Sequence: Synthetic oligonucleotide
  Target: ATXN1; (-) strand; PAM type: YTN; PAM sequence: TTG
tttgtataagaagcttgtag

SEQ ID NO: 188587 - DNA, 20 bp, Artificial Sequence
  Description of Artificial Sequence: Synthetic oligonucleotide
  Target: ATXN1; (-) strand; PAM type: YTN; PAM sequence: TTT
gtttgtataagaagcttgta

SEQ ID NO: 188588 - DNA, 20 bp, Artificial Sequence
  Description of Artificial Sequence: Synthetic oligonucleotide
  Target: ATXN1; (-) strand; PAM type: YTN; PAM sequence: TTT
tgtttgtataagaagcttgt

SEQ ID NO: 188589 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtataagaagcttg

SEQ ID NO: 188590 - DNA, 20 bp, Artificial Sequence
  Description of Artificial Sequence: Synthetic oligonucleotide
  Target: ATXN1; (-) strand; PAM type: YTN; PAM sequence: TTA
atatttttgtttgtataaga

SEQ ID NO: 188591 - DNA, 20 bp, Artificial Sequence
  Description of Artificial Sequence: Synthetic oligonucleotide
  Target: ATXN1; (-) strand; PAM type: YTN; PAM sequence: TTG
ttaatatttttgtttgtata

SEQ ID NO: 188592 - DNA, 20 bp, Artificial Sequence
  Description of Artificial Sequence: Synthetic oligonucleotide
  Target: ATXN1; (-) strand; PAM type: YTN; PAM sequence: TTG
aatgtggaatattgttaata

SEQ ID NO: 188593 - DNA, 20 bp, Artificial Sequence
  Description of Artificial Sequence: Synthetic oligonucleotide
  Target: ATXN1; (-) strand; PAM type: YTN; PAM sequence: TTT
gaatgtggaatattgttaat

SEQ ID NO: 188594 - DNA, 20 bp, Artificial Sequence
  Description of Artificial Sequence: Synthetic oligonucleotide
  Target: ATXN1; (-) strand; PAM type: YTN; PAM sequence: CTT
tgaatgtggaatattgttaa

SEQ ID NO: 188595 - DNA, 20 bp, Artificial Sequence
  Description of Artificial Sequence: Synthetic oligonucleotide
  Target: ATXN1; (-) strand; PAM type: YTN; PAM sequence: CTG
agactttgaatgtggaatat

SEQ ID NO: 188596 - DNA, 20 bp, Artificial Sequence
  Description of Artificial Sequence: Synthetic oligonucleotide
  Target: ATXN1; (-) strand; PAM type: YTN; PAM sequence: CTC
tgagactttgaatgtggaat

SEQ ID NO: 188597 - DNA, 20 bp, Artificial Sequence
  Description of Artificial Sequence: Synthetic oligonucleotide
  Target: ATXN1; (-) strand; PAM type: YTN; PAM sequence: TTA
tactctgagactttgaatgt

SEQ ID NO: 188598 - DNA, 20 bp, Artificial Sequence
  Description of Artificial Sequence: Synthetic oligonucleotide
  Target: ATXN1; (-) strand; PAM type: YTN; PAM sequence: TTT
atactctgagactttgaatg

SEQ ID NO: 188599 - DNA, 20 bp, Artificial Sequence
  Description of Artificial Sequence: Synthetic oligonucleotide
  Target: ATXN1; (-) strand; PAM type: YTN; PAM sequence: TTG
ccaggtcaaagtgaaggttt

SEQ ID NO: 188600 - DNA, 20 bp, Artificial Sequence
  Description of Artificial Sequence: Synthetic oligonucleotide
  Target: ATXN1; (-) strand; PAM type: YTN; PAM sequence: CTG
agtgtgtcaaagttgccagg

SEQ ID NO: 188601 - DNA, 20 bp, Artificial Sequence
  Description of Artificial Sequence: Synthetic oligonucleotide
  Target: ATXN1; (-) strand; PAM type: YTN; PAM sequence: TTC
tgagtgtgtcaaagttgcca

SEQ ID NO: 188602 - DNA, 20 bp, Artificial Sequence
  Description of Artificial Sequence: Synthetic oligonucleotide
  Target: ATXN1; (-) strand; PAM type: YTN; PAM sequence: TTT
ctgagtgtgtcaaagttgcc

SEQ ID NO: 188603 - DNA, 20 bp, Artificial Sequence
  Description of Artificial Sequence: Synthetic oligonucleotide
  Target: ATXN1; (-) strand; PAM type: YTN; PAM sequence: CTT
tctgagtgtgtcaaagttgc

SEQ ID NO: 188604 - DNA, 20 bp, Artificial Sequence
  Description of Artificial Sequence: Synthetic oligonucleotide
  Target: ATXN1; (-) strand; PAM type: YTN; PAM sequence: CTC
ctttctgagtgtgtcaaagt

SEQ ID NO: 188605 - DNA, 20 bp, Artificial Sequence
  Description of Artificial Sequence: Synthetic oligonucleotide
  Target: ATXN1; (-) strand; PAM type: YTN; PAM sequence: CTC
tcctttctgagtgtgtcaaa

SEQ ID NO: 188606 - DNA, 20 bp, Artificial Sequence
  Description of Artificial Sequence: Synthetic oligonucleotide
  Target: ATXN1; (-) strand; PAM type: YTN; PAM sequence: CTC
tctcctttctgagtgtgtca

SEQ ID NO: 188607 - DNA, 20 bp, Artificial Sequence
  Description of Artificial Sequence: Synthetic oligonucleotide
  Target: ATXN1; (-) strand; PAM type: YTN; PAM sequence: CTC
tctctcctttctgagtgtgt

SEQ ID NO: 188608 - DNA, 20 bp, Artificial Sequence
  Description of Artificial Sequence: Synthetic oligonucleotide
  Target: ATXN1; (-) strand; PAM type: YTN; PAM sequence: TTC
tctctctcctttctgagtgt

SEQ ID NO: 188609 - DNA, 20 bp, Artificial Sequence
  Description of Artificial Sequence: Synthetic oligonucleotide
  Target: ATXN1; (-) strand; PAM type: YTN; PAM sequence: TTG
ttctctctctcctttctgag

SEQ ID NO: 188610 - DNA, 20 bp, Artificial Sequence
  Description of Artificial Sequence: Synthetic oligonucleotide
  Target: ATXN1; (-) strand; PAM type: YTN; PAM sequence: CTT
gttctctctctcctttctga

SEQ ID NO: 188611 - DNA, 20 bp, Artificial Sequence
  Description of Artificial Sequence: Synthetic oligonucleotide
  Target: ATXN1; (-) strand; PAM type: YTN; PAM sequence: TTC
ttgttctctctctcctttct

SEQ ID NO: 188612 - DNA, 20 bp, Artificial Sequence
  Description of Artificial Sequence: Synthetic oligonucleotide
  Target: ATXN1; (-) strand; PAM type: YTN; PAM sequence: TTT
cttgttctctctctcctttc

SEQ ID NO: 188613 - DNA, 20 bp, Artificial Sequence
  Description of Artificial Sequence: Synthetic oligonucleotide
  Target: ATXN1; (-) strand; PAM type: YTN; PAM sequence: TTT
tcttgttctctctctccttt

SEQ ID NO: 188614 - DNA, 20 bp, Artificial Sequence
  Description of Artificial Sequence: Synthetic oligonucleotide
  Target: ATXN1; (-) strand; PAM type: YTN; PAM sequence: TTT
ttcttgttctctctctcctt

SEQ ID NO: 188615 - DNA, 20 bp, Artificial Sequence
  Description of Artificial Sequence: Synthetic oligonucleotide
  Target: ATXN1; (-) strand; PAM type: YTN; PAM sequence: CTT
tttcttgttctctctctcct

SEQ ID NO: 188616 - DNA, 20 bp, Artificial Sequence
  Description of Artificial Sequence: Synthetic oligonucleotide
  Target: ATXN1; (-) strand; PAM type: YTN; PAM sequence: TTC
aggaagtgctttttcttgtt

SEQ ID NO: 188617 - DNA, 20 bp, Artificial Sequence
  Description of Artificial Sequence: Synthetic oligonucleotide
  Target: ATXN1; (-) strand; PAM type: YTN; PAM sequence: CTT
caggaagtgctttttcttgt

SEQ ID NO: 188618 - DNA, 20 bp, Artificial Sequence
  Description of Artificial Sequence: Synthetic oligonucleotide
  Target: ATXN1; (-) strand; PAM type: YTN; PAM sequence: TTG
gcttcaggaagtgctttttc

SEQ ID NO: 188619 - DNA, 20 bp, Artificial Sequence
  Description of Artificial Sequence: Synthetic oligonucleotide
  Target: ATXN1; (-) strand; PAM type: YTN; PAM sequence: CTT
ggcttcaggaagtgcttttt

SEQ ID NO: 188620 - DNA, 20 bp, Artificial Sequence
  Description of Artificial Sequence: Synthetic oligonucleotide
  Target: ATXN1; (-) strand; PAM type: YTN; PAM sequence: TTG
gacaccttggcttcaggaag

SEQ ID NO: 188621 - DNA, 20 bp, Artificial Sequence
  Description of Artificial Sequence: Synthetic oligonucleotide
  Target: ATXN1; (-) strand; PAM type: YTN; PAM sequence: TTC
ccaggtccgatggcaagata

SEQ ID NO: 188622 - DNA, 20 bp, Artificial Sequence
  Description of Artificial Sequence: Synthetic oligonucleotide
  Target: ATXN1; (-) strand; PAM type: YTN; PAM sequence: TTT
cccaggtccgatggcaagat

SEQ ID NO: 188623 - DNA, 20 bp, Artificial Sequence
  Description of Artificial Sequence: Synthetic oligonucleotide
  Target: ATXN1; (-) strand; PAM type: YTN; PAM sequence: CTG
gcgtaatttcccaggtccga

SEQ ID NO: 188624 - DNA, 20 bp, Artificial Sequence
  Description of Artificial Sequence: Synthetic oligonucleotide
  Target: ATXN1; (-) strand; PAM type: YTN; PAM sequence: CTG
acagcctggcgtaatttccc

SEQ ID NO: 188625 - DNA, 20 bp, Artificial Sequence
  Description of Artificial Sequence: Synthetic oligonucleotide
  Target: ATXN1; (-) strand; PAM type: YTN; PAM sequence: CTA
ggcagaggatgaaactgaca

SEQ ID NO: 188626 - DNA, 20 bp, Artificial Sequence
  Description of Artificial Sequence: Synthetic oligonucleotide
  Target: ATXN1; (-) strand; PAM type: YTN; PAM sequence: CTC
taggcagaggatgaaactga

SEQ ID NO: 188627 - DNA, 20 bp, Artificial Sequence
  Description of Artificial Sequence: Synthetic oligonucleotide
  Target: ATXN1; (-) strand; PAM type: YTN; PAM sequence: CTC
ctctaggcagaggatgaaac

SEQ ID NO: 188628 - DNA, 20 bp, Artificial Sequence
  Description of Artificial Sequence: Synthetic oligonucleotide
  Target: ATXN1; (-) strand; PAM type: YTN; PAM sequence: TTC
tcctctaggcagaggatgaa

SEQ ID NO: 188629 - DNA, 20 bp, Artificial Sequence
  Description of Artificial Sequence: Synthetic oligonucleotide
  Target: ATXN1; (-) strand; PAM type: YTN; PAM sequence: TTT
ctcctctaggcagaggatga

SEQ ID NO: 188630 - DNA, 20 bp, Artificial Sequence
  Description of Artificial Sequence: Synthetic oligonucleotide
  Target: ATXN1; (-) strand; PAM type: YTN; PAM sequence: TTT
tctcctctaggcagaggatg

SEQ ID NO: 188631 - DNA, 20 bp, Artificial Sequence
  Description of Artificial Sequence: Synthetic oligonucleotide
  Target: ATXN1; (-) strand; PAM type: YTN; PAM sequence: TTG
tgtcattttctcctctaggc

SEQ ID NO: 188632 - DNA, 20 bp, Artificial Sequence
  Description of Artificial Sequence: Synthetic oligonucleotide
  Target: ATXN1; (-) strand; PAM type: YTN; PAM sequence: TTG
gcattgtgtcattttctcct

SEQ ID NO: 188633 - DNA, 20 bp, Artificial Sequence
  Description of Artificial Sequence: Synthetic oligonucleotide
  Target: ATXN1; (-) strand; PAM type: YTN; PAM sequence: CTG
tgggcagtcaggggaaggag

SEQ ID NO: 188634 - DNA, 20 bp, Artificial Sequence
  Description of Artificial Sequence: Synthetic oligonucleotide
  Target: ATXN1; (-) strand; PAM type: YTN; PAM sequence: CTG
taagtgctgtgggcagtcag

SEQ ID NO: 188635 - DNA, 20 bp, Artificial Sequence
  Description of Artificial Sequence: Synthetic oligonucleotide
  Target: ATXN1; (-) strand; PAM type: YTN; PAM sequence: TTG
ggtcagaatgtgtggtagag

SEQ ID NO: 188636 - DNA, 20 bp, Artificial Sequence
  Description of Artificial Sequence: Synthetic oligonucleotide
  Target: ATXN1; (-) strand; PAM type: YTN; PAM sequence: CTT
gggtcagaatgtgtggtaga

SEQ ID NO: 188637 - DNA, 20 bp, Artificial Sequence
  Description of Artificial Sequence: Synthetic oligonucleotide
  Target: ATXN1; (-) strand; PAM type: YTN; PAM sequence: CTG
aaaaggaccttgggtcagaa

SEQ ID NO: 188638 - DNA, 20 bp, Artificial Sequence
  Description of Artificial Sequence: Synthetic oligonucleotide
  Target: ATXN1; (-) strand; PAM type: YTN; PAM sequence: CTG
aactgaaaaggaccttgggt

SEQ ID NO: 188639 - DNA, 20 bp, Artificial Sequence
  Description of Artificial Sequence: Synthetic oligonucleotide
  Target: ATXN1; (-) strand; PAM type: YTN; PAM sequence: TTA
aataaatccagtggagtata

SEQ ID NO: 188640 - DNA, 20 bp, Artificial Sequence
  Description of Artificial Sequence: Synthetic oligonucleotide
  Target: ATXN1; (-) strand; PAM type: YTN; PAM sequence: CTT
aaataaatccagtggagtat

SEQ ID NO: 188641 - DNA, 20 bp, Artificial Sequence
  Description of Artificial Sequence: Synthetic oligonucleotide
  Target: ATXN1; (-) strand; PAM type: YTN; PAM sequence: TTC
aagacttaaataaatccagt

SEQ ID NO: 188642 - DNA, 20 bp, Artificial Sequence
  Description of Artificial Sequence: Synthetic oligonucleotide
  Target: ATXN1; (-) strand; PAM type: YTN; PAM sequence: CTT
caagacttaaataaatccag

SEQ ID NO: 188643 - DNA, 20 bp, Artificial Sequence
  Description of Artificial Sequence: Synthetic oligonucleotide
  Target: ATXN1; (-) strand; PAM type: YTN; PAM sequence: TTG
agccttcaagacttaaataa

SEQ ID NO: 188644 - DNA, 20 bp, Artificial Sequence
  Description of Artificial Sequence: Synthetic oligonucleotide
  Target: ATXN1; (-) strand; PAM type: YTN; PAM sequence: TTT
gagccttcaagacttaaata

SEQ ID NO: 188645 - DNA, 20 bp, Artificial Sequence
  Description of Artificial Sequence: Synthetic oligonucleotide
  Target: ATXN1; (-) strand; PAM type: YTN; PAM sequence: TTT
tgagccttcaagacttaaat

SEQ ID NO: 188646 - DNA, 20 bp, Artificial Sequence
  Description of Artificial Sequence: Synthetic oligonucleotide
  Target: ATXN1; (-) strand; PAM type: YTN; PAM sequence: TTT
ttgagccttcaagacttaaa

SEQ ID NO: 188647 - DNA, 20 bp, Artificial Sequence
  Description of Artificial Sequence: Synthetic oligonucleotide
  Target: ATXN1; (-) strand; PAM type: YTN; PAM sequence: CTT
tttgagccttcaagacttaa

SEQ ID NO: 188648 - DNA, 20 bp, Artificial Sequence
  Description of Artificial Sequence: Synthetic oligonucleotide
  Target: ATXN1; (-) strand; PAM type: YTN; PAM sequence: TTA
gaaactttttgagccttcaa

SEQ ID NO: 188649 - DNA, 20 bp, Artificial Sequence
  Description of Artificial Sequence: Synthetic oligonucleotide
  Target: ATXN1; (-) strand; PAM type: YTN; PAM sequence: CTT
agaaactttttgagccttca

SEQ ID NO: 188650 - DNA, 20 bp, Artificial Sequence
  Description of Artificial Sequence: Synthetic oligonucleotide
  Target: ATXN1; (-) strand; PAM type: YTN; PAM sequence: TTC
atcagagagcttagaaactt

SEQ ID NO: 188651 - DNA, 20 bp, Artificial Sequence
  Description of Artificial Sequence: Synthetic oligonucleotide
  Target: ATXN1; (-) strand; PAM type: YTN; PAM sequence: TTT
catcagagagcttagaaact

SEQ ID NO: 188652 - DNA, 20 bp, Artificial Sequence
  Description of Artificial Sequence: Synthetic oligonucleotide
  Target: ATXN1; (-) strand; PAM type: YTN; PAM sequence: CTT
tcatcagagagcttagaaac

SEQ ID NO: 188653 - DNA, 20 bp, Artificial Sequence
  Description of Artificial Sequence: Synthetic oligonucleotide
  Target: ATXN1; (-) strand; PAM type: YTN; PAM sequence: TTC
tttcatcagagagcttagaa

SEQ ID NO: 188654 - DNA, 20 bp, Artificial Sequence
  Description of Artificial Sequence: Synthetic oligonucleotide
  Target: ATXN1; (-) strand; PAM type: YTN; PAM sequence: TTT
ctttcatcagagagcttaga

SEQ ID NO: 188655 - DNA, 20 bp, Artificial Sequence
  Description of Artificial Sequence: Synthetic oligonucleotide
  Target: ATXN1; (-) strand; PAM type: YTN; PAM sequence: TTG
caaaagaagggcatggcaag

SEQ ID NO: 188656 - DNA, 20 bp, Artificial Sequence
  Description of Artificial Sequence: Synthetic oligonucleotide
  Target: ATXN1; (-) strand; PAM type: YTN; PAM sequence: TTA
ggaggttgcaaaagaagggc

SEQ ID NO: 188657 - DNA, 20 bp, Artificial Sequence
  Description of Artificial Sequence: Synthetic oligonucleotide
  Target: ATXN1; (-) strand; PAM type: YTN; PAM sequence: CTG
ttaggaggttgcaaaagaag

SEQ ID NO: 188658 - DNA, 20 bp, Artificial Sequence
  Description of Artificial Sequence: Synthetic oligonucleotide
  Target: ATXN1; (-) strand; PAM type: YTN; PAM sequence: CTA
gatgctgttaggaggttgca

SEQ ID NO: 188659 - DNA, 20 bp, Artificial Sequence
  Description of Artificial Sequence: Synthetic oligonucleotide
  Target: ATXN1; (-) strand; PAM type: YTN; PAM sequence: TTC
cactagatgctgttaggagg

SEQ ID NO: 188660 - DNA, 20 bp, Artificial Sequence
  Description of Artificial Sequence: Synthetic oligonucleotide
  Target: ATXN1; (-) strand; PAM type: YTN; PAM sequence: CTT
ccactagatgctgttaggag

SEQ ID NO: 188661 - DNA, 20 bp, Artificial Sequence
  Description of Artificial Sequence: Synthetic oligonucleotide
  Target: ATXN1; (-) strand; PAM type: YTN; PAM sequence: CTC
ttccactagatgctgttagg

SEQ ID NO: 188662 - DNA, 20 bp, Artificial Sequence
  Description of Artificial Sequence: Synthetic oligonucleotide
  Target: ATXN1; (-) strand; PAM type: YTN; PAM sequence: TTA
aatccaggctcttccactag

SEQ ID NO: 188663 - DNA, 20 bp, Artificial Sequence
  Description of Artificial Sequence: Synthetic oligonucleotide
  Target: ATXN1; (-) strand; PAM type: YTN; PAM sequence: TTA
agttaaatccaggctcttcc

SEQ ID NO: 188664 - DNA, 20 bp, Artificial Sequence
  Description of Artificial Sequence: Synthetic oligonucleotide
  Target: ATXN1; (-) strand; PAM type: YTN; PAM sequence: TTT
aagttaaatccaggctcttc

SEQ ID NO: 188665 - DNA, 20 bp, Artificial Sequence
  Description of Artificial Sequence: Synthetic oligonucleotide
  Target: ATXN1; (-) strand; PAM type: YTN; PAM sequence: TTG
gatatggatcatttaagtta

SEQ ID NO: 188666 - DNA, 20 bp, Artificial Sequence
  Description of Artificial Sequence: Synthetic oligonucleotide
  Target: ATXN1; (-) strand; PAM type: YTN; PAM sequence: TTT
ggatatggatcatttaagtt

SEQ ID NO: 188667 - DNA, 20 bp, Artificial Sequence
  Description of Artificial Sequence: Synthetic oligonucleotide
  Target: ATXN1; (-) strand; PAM type: YTN; PAM sequence: TTT
tggatatggatcatttaagt

SEQ ID NO: 188668 - DNA, 20 bp, Artificial Sequence
  Description of Artificial Sequence: Synthetic oligonucleotide
  Target: ATXN1; (-) strand; PAM type: YTN; PAM sequence: CTA
gaacaggttttggatatgga

SEQ ID NO: 188669 - DNA, 20 bp, Artificial Sequence
  Description of Artificial Sequence: Synthetic oligonucleotide
  Target: ATXN1; (-) strand; PAM type: YTN; PAM sequence: TTA
agtcctagaacaggttttgg

SEQ ID NO: 188670 - DNA, 20 bp, Artificial Sequence
  Description of Artificial Sequence: Synthetic oligonucleotide
  Target: ATXN1; (-) strand; PAM type: YTN; PAM sequence: TTG
gagtaagggttaagtcctag

SEQ ID NO: 188671 - DNA, 20 bp, Artificial Sequence
  Description of Artificial Sequence: Synthetic oligonucleotide
  Target: ATXN1; (-) strand; PAM type: YTN; PAM sequence: TTT
ggagtaagggttaagtccta

SEQ ID NO: 188672 - DNA, 20 bp, Artificial Sequence
  Description of Artificial Sequence: Synthetic oligonucleotide
  Target: ATXN1; (-) strand; PAM type: YTN; PAM sequence: TTT
tggagtaagggttaagtcct

SEQ ID NO: 188673 - DNA, 20 bp, Artificial Sequence
  Description of Artificial Sequence: Synthetic oligonucleotide
  Target: ATXN1; (-) strand; PAM type: YTN; PAM sequence: CTT
ttggagtaagggttaagtcc

SEQ ID NO: 188674 - DNA, 20 bp, Artificial Sequence
  Description of Artificial Sequence: Synthetic oligonucleotide
  Target: ATXN1; (-) strand; PAM type: YTN; PAM sequence: TTC
ttttggagtaagggttaagt

SEQ ID NO: 188675 - DNA, 20 bp, Artificial Sequence
  Description of Artificial Sequence: Synthetic oligonucleotide
  Target: ATXN1; (-) strand; PAM type: YTN; PAM sequence: CTG
gtgattcttttggagtaagg

SEQ ID NO: 188676 - DNA, 20 bp, Artificial Sequence
  Description of Artificial Sequence: Synthetic oligonucleotide
  Target: ATXN1; (-) strand; PAM type: YTN; PAM sequence: CTG
tagactggtgattcttttgg

SEQ ID NO: 188677 - DNA, 20 bp, Artificial Sequence
  Description of Artificial Sequence: Synthetic oligonucleotide
  Target: ATXN1; (-) strand; PAM type: YTN; PAM sequence: TTA
aagcatagctgtagactggt

SEQ ID NO: 188678 - DNA, 20 bp, Artificial Sequence
  Description of Artificial Sequence: Synthetic oligonucleotide
  Target: ATXN1; (-) strand; PAM type: YTN; PAM sequence: CTT
aaagcatagctgtagactgg

SEQ ID NO: 188679 - DNA, 20 bp, Artificial Sequence
  Description of Artificial Sequence: Synthetic oligonucleotide
  Target: ATXN1; (-) strand; PAM type: YTN; PAM sequence: CTG
gaagacagagaaaggtgaaa

SEQ ID NO: 188680 - DNA, 20 bp, Artificial Sequence
  Description of Artificial Sequence: Synthetic oligonucleotide
  Target: ATXN1; (-) strand; PAM type: YTN; PAM sequence: TTC
aagtccctggaagacagaga

SEQ ID NO: 188681 - DNA, 20 bp, Artificial Sequence
  Description of Artificial Sequence: Synthetic oligonucleotide
  Target: ATXN1; (-) strand; PAM type: YTN; PAM sequence: TTT
caagtccctggaagacagag

SEQ ID NO: 188682 - DNA, 20 bp, Artificial Sequence
  Description of Artificial Sequence: Synthetic oligonucleotide
  Target: ATXN1; (-) strand; PAM type: YTN; PAM sequence: CTT
tcaagtccctggaagacaga

SEQ ID NO: 188683 - DNA, 20 bp, Artificial Sequence
  Description of Artificial Sequence: Synthetic oligonucleotide
  Target: ATXN1; (-) strand; PAM type: YTN; PAM sequence: CTG
acacatgatgatgataggca

SEQ ID NO: 188684 - DNA, 20 bp, Artificial Sequence
  Description of Artificial Sequence: Synthetic oligonucleotide
  Target: ATXN1; (-) strand; PAM type: YTN; PAM sequence: TTG
tggagggctgacacatgatg

SEQ ID NO: 188685 - DNA, 20 bp, Artificial Sequence
  Description of Artificial Sequence: Synthetic oligonucleotide
  Target: ATXN1; (-) strand; PAM type: YTN; PAM sequence: TTT
gtggagggctgacacatgat

SEQ ID NO: 188686 - DNA, 20 bp, Artificial Sequence
  Description of Artificial Sequence: Synthetic oligonucleotide
  Target: ATXN1; (-) strand; PAM type: YTN; PAM sequence: TTG
agtttgtggagggctgacac

SEQ ID NO: 188687 - DNA, 20 bp, Artificial Sequence
  Description of Artificial Sequence: Synthetic oligonucleotide
  Target: ATXN1; (-) strand; PAM type: YTN; PAM sequence: TTT
gagtttgtggagggctgaca

SEQ ID NO: 188688 - DNA, 20 bp, Artificial Sequence
  Description of Artificial Sequence: Synthetic oligonucleotide
  Target: ATXN1; (-) strand; PAM type: YTN; PAM sequence: TTT
tgagtttgtggagggctgac

SEQ ID NO: 188689 - DNA, 20 bp, Artificial Sequence
  Description of Artificial Sequence: Synthetic oligonucleotide
  Target: ATXN1; (-) strand; PAM type: YTN; PAM sequence: TTT
ttgagtttgtggagggctga

SEQ ID NO: 188690 - DNA, 20 bp, Artificial Sequence
  Description of Artificial Sequence: Synthetic oligonucleotide
  Target: ATXN1; (-) strand; PAM type: YTN; PAM sequence: TTT
tttgagtttgtggagggctg

SEQ ID NO: 188691 - DNA, 20 bp, Artificial Sequence
  Description of Artificial Sequence: Synthetic oligonucleotide
  Target: ATXN1; (-) strand; PAM type: YTN; PAM sequence: TTT
ttttgagtttgtggagggct

SEQ ID NO: 188692 - DNA, 20 bp, Artificial Sequence
  Description of Artificial Sequence: Synthetic oligonucleotide
  Target: ATXN1; (-) strand; PAM type: YTN; PAM sequence: TTT
tttttgagtttgtggagggc

SEQ ID NO: 188693 - DNA, 20 bp, Artificial Sequence
  Description of Artificial Sequence: Synthetic oligonucleotide
  Target: ATXN1; (-) strand; PAM type: YTN; PAM sequence: TTA
attttttttgagtttgtgga

SEQ ID NO: 188694 - DNA, 20 bp, Artificial Sequence
  Description of Artificial Sequence: Synthetic oligonucleotide
  Target: ATXN1; (-) strand; PAM type: YTN; PAM sequence: TTT
aattttttttgagtttgtgg

SEQ ID NO: 188695 - DNA, 20 bp, Artificial Sequence
  Description of Artificial Sequence: Synthetic oligonucleotide
  Target: ATXN1; (-) strand; PAM type: YTN; PAM sequence: TTG
taatttaattttttttgagt

SEQ ID NO: 188696 - DNA, 20 bp, Artificial Sequence
  Description of Artificial Sequence: Synthetic oligonucleotide
  Target: ATXN1; (-) strand; PAM type: YTN; PAM sequence: CTA
agttgtaatttaattttttt

SEQ ID NO: 188697 - DNA, 20 bp, Artificial Sequence
  Description of Artificial Sequence: Synthetic oligonucleotide
  Target: ATXN1; (-) strand; PAM type: YTN; PAM sequence: TTG
gaagaacagaatagaaaggc

SEQ ID NO: 188698 - DNA, 20 bp, Artificial Sequence
  Description of Artificial Sequence: Synthetic oligonucleotide
  Target: ATXN1; (-) strand; PAM type: YTN; PAM sequence: TTA
agatgtaatggattggaaga

SEQ ID NO: 188699 - DNA, 20 bp, Artificial Sequence
  Description of Artificial Sequence: Synthetic oligonucleotide
  Target: ATXN1; (-) strand; PAM type: YTN; PAM sequence: CTT
aagatgtaatggattggaag

SEQ ID NO: 188700 - DNA, 20 bp, Artificial Sequence
  Description of Artificial Sequence: Synthetic oligonucleotide
  Target: ATXN1; (-) strand; PAM type: YTN; PAM sequence: CTA
atgacttaagatgtaatgga

SEQ ID NO: 188701 - DNA, 20 bp, Artificial Sequence
  Description of Artificial Sequence: Synthetic oligonucleotide
  Target: ATXN1; (-) strand; PAM type: YTN; PAM sequence: TTC
cactaatgacttaagatgta

SEQ ID NO: 188702 - DNA, 20 bp, Artificial Sequence
  Description of Artificial Sequence: Synthetic oligonucleotide
  Target: ATXN1; (-) strand; PAM type: YTN; PAM sequence: TTC
aaattccactaatgacttaa

SEQ ID NO: 188703 - DNA, 20 bp, Artificial Sequence
  Description of Artificial Sequence: Synthetic oligonucleotide
  Target: ATXN1; (-) strand; PAM type: YTN; PAM sequence: CTG
ttcaaattccactaatgact

SEQ ID NO: 188704 - DNA, 20 bp, Artificial Sequence
  Description of Artificial Sequence: Synthetic oligonucleotide
  Target: ATXN1; (-) strand; PAM type: YTN; PAM sequence: TTG
aaaggagatgacaactgttc

SEQ ID NO: 188705 - DNA, 20 bp, Artificial Sequence
  Description of Artificial Sequence: Synthetic oligonucleotide
  Target: ATXN1; (-) strand; PAM type: YTN; PAM sequence: CTT
gaaaggagatgacaactgtt

SEQ ID NO: 188706 - DNA, 20 bp, Artificial Sequence
  Description of Artificial Sequence: Synthetic oligonucleotide
  Target: ATXN1; (-) strand; PAM type: YTN; PAM sequence: TTG
taaatcttgaaaggagatga

SEQ ID NO: 188707 - DNA, 20 bp, Artificial Sequence
  Description of Artificial Sequence: Synthetic oligonucleotide
  Target: ATXN1; (-) strand; PAM type: YTN; PAM sequence: TTT
gtaaatcttgaaaggagatg

SEQ ID NO: 188708 - DNA, 20 bp, Artificial Sequence
  Description of Artificial Sequence: Synthetic oligonucleotide
  Target: ATXN1; (-) strand; PAM type: YTN; PAM sequence: CTG
gtgatgaggaaatgggggag

SEQ ID NO: 188709 - DNA, 20 bp, Artificial Sequence
  Description of Artificial Sequence: Synthetic oligonucleotide
  Target: ATXN1; (-) strand; PAM type: YTN; PAM sequence: CTG
ctggtgatgaggaaatgggg

SEQ ID NO: 188710 - DNA, 20 bp, Artificial Sequence
  Description of Artificial Sequence: Synthetic oligonucleotide
  Target: ATXN1; (-) strand; PAM type: YTN; PAM sequence: CTA
gtgatgtaagctgctggtga

SEQ ID NO: 188711 - DNA, 20 bp, Artificial Sequence
  Description of Artificial Sequence: Synthetic oligonucleotide
  Target: ATXN1; (-) strand; PAM type: YTN; PAM sequence: CTA
tgagagctagtgatgtaagc

SEQ ID NO: 188712 - DNA, 20 bp, Artificial Sequence
  Description of Artificial Sequence: Synthetic oligonucleotide
  Target: ATXN1; (-) strand; PAM type: YTN; PAM sequence: TTG
agaagctatgagagctagtg

SEQ ID NO: 188713 - DNA, 20 bp, Artificial Sequence
  Description of Artificial Sequence: Synthetic oligonucleotide
  Target: ATXN1; (-) strand; PAM type: YTN; PAM sequence: TTT
gagaagctatgagagctagt

SEQ ID NO: 188714 - DNA, 20 bp, Artificial Sequence
  Description of Artificial Sequence: Synthetic oligonucleotide
  Target: ATXN1; (-) strand; PAM type: YTN; PAM sequence: CTT
tgagaagctatgagagctag

SEQ ID NO: 188715 - DNA, 20 bp, Artificial Sequence
  Description of Artificial Sequence: Synthetic oligonucleotide
  Target: ATXN1; (-) strand; PAM type: YTN; PAM sequence: TTA
atagtggctttgagaagcta

SEQ ID NO: 188716 - DNA, 20 bp, Artificial Sequence
  Description of Artificial Sequence: Synthetic oligonucleotide
  Target: ATXN1; (-) strand; PAM type: YTN; PAM sequence: CTT
aatagtggctttgagaagct

SEQ ID NO: 188717 - DNA, 20 bp, Artificial Sequence
  Description of Artificial Sequence: Synthetic oligonucleotide
  Target: ATXN1; (-) strand; PAM type: YTN; PAM sequence: TTC
cttaatagtggctttgagaa

SEQ ID NO: 188718 - DNA, 20 bp, Artificial Sequence
  Description of Artificial Sequence: Synthetic oligonucleotide
  Target: ATXN1; (-) strand; PAM type: YTN; PAM sequence: TTT
ccttaatagtggctttgaga

SEQ ID NO: 188719 - DNA, 20 bp, Artificial Sequence
  Description of Artificial Sequence: Synthetic oligonucleotide
  Target: ATXN1; (-) strand; PAM type: YTN; PAM sequence: CTC
cacatgccatgaaggtttcc

SEQ ID NO: 188720 - DNA, 20 bp, Artificial Sequence
  Description of Artificial Sequence: Synthetic oligonucleotide
  Target: ATXN1; (-) strand; PAM type: YTN; PAM sequence: CTC
ccctccacatgccatgaagg

SEQ ID NO: 188721 - DNA, 20 bp, Artificial Sequence
  Description of Artificial Sequence: Synthetic oligonucleotide
  Target: ATXN1; (-) strand; PAM type: YTN; PAM sequence: CTG
catctcccctccacatgcca

SEQ ID NO: 188722 - DNA, 20 bp, Artificial Sequence
  Description of Artificial Sequence: Synthetic oligonucleotide
  Target: ATXN1; (-) strand; PAM type: YTN; PAM sequence: CTC
agaggtctgcatctcccctc

SEQ ID NO: 188723 - DNA, 20 bp, Artificial Sequence
  Description of Artificial Sequence: Synthetic oligonucleotide
  Target: ATXN1; (-) strand; PAM type: YTN; PAM sequence: CTG
cctcagaggtctgcatctcc

SEQ ID NO: 188724 - DNA, 20 bp, Artificial Sequence
  Description of Artificial Sequence: Synthetic oligonucleotide
  Target: ATXN1; (-) strand; PAM type: YTN; PAM sequence: TTG
aatatcactgcctcagaggt

SEQ ID NO: 188725 - DNA, 20 bp, Artificial Sequence
  Description of Artificial Sequence: Synthetic oligonucleotide
  Target: ATXN1; (-) strand; PAM type: YTN; PAM sequence: TTT
gaatatcactgcctcagagg

SEQ ID NO: 188726 - DNA, 20 bp, Artificial Sequence
  Description of Artificial Sequence: Synthetic oligonucleotide
  Target: ATXN1; (-) strand; PAM type: YTN; PAM sequence: TTC
aagtttgaatatcactgcct

SEQ ID NO: 188727 - DNA, 20 bp, Artificial Sequence
  Description of Artificial Sequence: Synthetic oligonucleotide
  Target: ATXN1; (-) strand; PAM type: YTN; PAM sequence: CTT
caagtttgaatatcactgcc

SEQ ID NO: 188728 - DNA, 20 bp, Artificial Sequence
  Description of Artificial Sequence: Synthetic oligonucleotide
  Target: ATXN1; (-) strand; PAM type: YTN; PAM sequence: CTG
cttcaagtttgaatatcact

SEQ ID NO: 188729 - DNA, 20 bp, Artificial Sequence
  Description of Artificial Sequence: Synthetic oligonucleotide
  Target: ATXN1; (-) strand; PAM type: YTN; PAM sequence: CTG
atgctgcttcaagtttgaat

SEQ ID NO: 188730 - DNA, 20 bp, Artificial Sequence
  Description of Artificial Sequence: Synthetic oligonucleotide
  Target: ATXN1; (-) strand; PAM type: YTN; PAM sequence: TTC
tgatgctgcttcaagtttga

SEQ ID NO: 188731 - DNA, 20 bp, Artificial Sequence
  Description of Artificial Sequence: Synthetic oligonucleotide
  Target: ATXN1; (-) strand; PAM type: YTN; PAM sequence: TTT
ctgatgctgcttcaagtttg

SEQ ID NO: 188732 - DNA, 20 bp, Artificial Sequence
  Description of Artificial Sequence: Synthetic oligonucleotide
  Target: ATXN1; (-) strand; PAM type: YTN; PAM sequence: CTC
cagccatttctgatgctgct

SEQ ID NO: 188733 - DNA, 20 bp, Artificial Sequence
  Description of Artificial Sequence: Synthetic oligonucleotide
  Target: ATXN1; (-) strand; PAM type: YTN; PAM sequence: TTC
tccagccatttctgatgctg

SEQ ID NO: 188734 - DNA, 20 bp, Artificial Sequence
  Description of Artificial Sequence: Synthetic oligonucleotide
  Target: ATXN1; (-) strand; PAM type: YTN; PAM sequence: CTT
ctccagccatttctgatgct

SEQ ID NO: 188735 - DNA, 20 bp, Artificial Sequence
  Description of Artificial Sequence: Synthetic oligonucleotide
  Target: ATXN1; (-) strand; PAM type: YTN; PAM sequence: CTG
gccttctccagccatttctg

SEQ ID NO: 188736 - DNA, 20 bp, Artificial Sequence
  Description of Artificial Sequence: Synthetic oligonucleotide
  Target: ATXN1; (-) strand; PAM type: YTN; PAM sequence: CTG
cacctggccttctccagcca

SEQ ID NO: 188737 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgcacc

SEQ ID NO: 188738 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 188739 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 188740 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 188741 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaaagtgct

SEQ ID NO: 188742 - DNA, 20 bp, Artificial Sequence
  Description of Artificial Sequence: Synthetic oligonucleotide
  Target: ATXN1; (-) strand; PAM type: YTN; PAM sequence: TTC
ctgcctcagcctcccaaagt

SEQ ID NO: 188743 - DNA, 20 bp, Artificial Sequence
  Description of Artificial Sequence: Synthetic oligonucleotide
  Target: ATXN1; (-) strand; PAM type: YTN; PAM sequence: CTT
cctgcctcagcctcccaaag

SEQ ID NO: 188744 - DNA, 20 bp, Artificial Sequence
  Description of Artificial Sequence: Synthetic oligonucleotide
  Target: ATXN1; (-) strand; PAM type: YTN; PAM sequence: CTC
aagccaccttcctgcctcag

SEQ ID NO: 188745 - DNA, 20 bp, Artificial Sequence
  Description of Artificial Sequence: Synthetic oligonucleotide
  Target: ATXN1; (-) strand; PAM type: YTN; PAM sequence: CTG
agctcaagccaccttcctgc

SEQ ID NO: 188746 - DNA, 20 bp, Artificial Sequence
  Description of Artificial Sequence: Synthetic oligonucleotide
  Target: ATXN1; (-) strand; PAM type: YTN; PAM sequence: CTC
ctgagctcaagccaccttcc

SEQ ID NO: 188747 - DNA, 20 bp, Artificial Sequence
  Description of Artificial Sequence: Synthetic oligonucleotide
  Target: ATXN1; (-) strand; PAM type: YTN; PAM sequence: TTG
aactcctgagctcaagccac

SEQ ID NO: 188748 - DNA, 20 bp, Artificial Sequence
  Description of Artificial Sequence: Synthetic oligonucleotide
  Target: ATXN1; (-) strand; PAM type: YTN; PAM sequence: CTT
gaactcctgagctcaagcca

SEQ ID NO: 188749 - DNA, 20 bp, Artificial Sequence
  Description of Artificial Sequence: Synthetic oligonucleotide
  Target: ATXN1; (-) strand; PAM type: YTN; PAM sequence: TTG
cagccttgaactcctgagct

SEQ ID NO: 188750 - DNA, 20 bp, Artificial Sequence
  Description of Artificial Sequence: Synthetic oligonucleotide
  Target: ATXN1; (-) strand; PAM type: YTN; PAM sequence: CTG
gggtacagtggcgtgatcat

SEQ ID NO: 188751 - DNA, 20 bp, Artificial Sequence
  Description of Artificial Sequence: Synthetic oligonucleotide
  Target: ATXN1; (-) strand; PAM type: YTN; PAM sequence: TTC
gcccaggctggggtacagtg

SEQ ID NO: 188752 - DNA, 20 bp, Artificial Sequence
  Description of Artificial Sequence: Synthetic oligonucleotide
  Target: ATXN1; (-) strand; PAM type: YTN; PAM sequence: TTT
cgcccaggctggggtacagt

SEQ ID NO: 188753 - DNA, 20 bp, Artificial Sequence
  Description of Artificial Sequence: Synthetic oligonucleotide
  Target: ATXN1; (-) strand; PAM type: YTN; PAM sequence: CTT
tcgcccaggctggggtacag

SEQ ID NO: 188754 - DNA, 20 bp, Artificial Sequence
  Description of Artificial Sequence: Synthetic oligonucleotide
  Target: ATXN1; (-) strand; PAM type: YTN; PAM sequence: TTC
tttcgcccaggctggggtac

SEQ ID NO: 188755 - DNA, 20 bp, Artificial Sequence
  Description of Artificial Sequence: Synthetic oligonucleotide
  Target: ATXN1; (-) strand; PAM type: YTN; PAM sequence: TTG
ttctttcgcccaggctgggg

SEQ ID NO: 188756 - DNA, 20 bp, Artificial Sequence
  Description of Artificial Sequence: Synthetic oligonucleotide
  Target: ATXN1; (-) strand; PAM type: YTN; PAM sequence: CTT
gttctttcgcccaggctggg

SEQ ID NO: 188757 - DNA, 20 bp, Artificial Sequence
  Description of Artificial Sequence: Synthetic oligonucleotide
  Target: ATXN1; (-) strand; PAM type: YTN; PAM sequence: TTG
agtcggagtcttgttctttc

SEQ ID NO: 188758 - DNA, 20 bp, Artificial Sequence
  Description of Artificial Sequence: Synthetic oligonucleotide
  Target: ATXN1; (-) strand; PAM type: YTN; PAM sequence: TTT
gagtcggagtcttgttcttt

SEQ ID NO: 188759 - DNA, 20 bp, Artificial Sequence
  Description of Artificial Sequence: Synthetic oligonucleotide
  Target: ATXN1; (-) strand; PAM type: YTN; PAM sequence: TTT
tgagtcggagtcttgttctt

SEQ ID NO: 188760 - DNA, 20 bp, Artificial Sequence
  Description of Artificial Sequence: Synthetic oligonucleotide
  Target: ATXN1; (-) strand; PAM type: YTN; PAM sequence: TTT
ttgagtcggagtcttgttct

SEQ ID NO: 188761 - DNA, 20 bp, Artificial Sequence
  Description of Artificial Sequence: Synthetic oligonucleotide
  Target: ATXN1; (-) strand; PAM type: YTN; PAM sequence: TTT
tttgagtcggagtcttgttc

SEQ ID NO: 188762 - DNA, 20 bp, Artificial Sequence
  Description of Artificial Sequence: Synthetic oligonucleotide
  Target: ATXN1; (-) strand; PAM type: YTN; PAM sequence: TTT
ttttgagtcggagtcttgtt

SEQ ID NO: 188763 - DNA, 20 bp, Artificial Sequence
  Description of Artificial Sequence: Synthetic oligonucleotide
  Target: ATXN1; (-) strand; PAM type: YTN; PAM sequence: CTT
tttttgagtcggagtcttgt

SEQ ID NO: 188764 - DNA, 20 bp, Artificial Sequence
  Description of Artificial Sequence: Synthetic oligonucleotide
  Target: ATXN1; (-) strand; PAM type: YTN; PAM sequence: TTC
ctttttttgagtcggagtct

SEQ ID NO: 188765 - DNA, 20 bp, Artificial Sequence
  Description of Artificial Sequence: Synthetic oligonucleotide
  Target: ATXN1; (-) strand; PAM type: YTN; PAM sequence: TTT
cctttttttgagtcggagtc

SEQ ID NO: 188766 - DNA, 20 bp, Artificial Sequence
  Description of Artificial Sequence: Synthetic oligonucleotide
  Target: ATXN1; (-) strand; PAM type: YTN; PAM sequence: CTT
tcctttttttgagtcggagt

SEQ ID NO: 188767 - DNA, 20 bp, Artificial Sequence
  Description of Artificial Sequence: Synthetic oligonucleotide
  Target: ATXN1; (-) strand; PAM type: YTN; PAM sequence: TTC
tttcctttttttgagtcgga

SEQ ID NO: 188768 - DNA, 20 bp, Artificial Sequence
  Description of Artificial Sequence: Synthetic oligonucleotide
  Target: ATXN1; (-) strand; PAM type: YTN; PAM sequence: TTT
ctttcctttttttgagtcgg

SEQ ID NO: 188769 - DNA, 20 bp, Artificial Sequence
  Description of Artificial Sequence: Synthetic oligonucleotide
  Target: ATXN1; (-) strand; PAM type: YTN; PAM sequence: TTC
gtttctttcctttttttgag

SEQ ID NO: 188770 - DNA, 20 bp, Artificial Sequence
  Description of Artificial Sequence: Synthetic oligonucleotide
  Target: ATXN1; (-) strand; PAM type: YTN; PAM sequence: CTA
ttcgtttctttccttttttt

SEQ ID NO: 188771 - DNA, 20 bp, Artificial Sequence
  Description of Artificial Sequence: Synthetic oligonucleotide
  Target: ATXN1; (-) strand; PAM type: YTN; PAM sequence: TTC
tattcgtttctttccttttt

SEQ ID NO: 188772 - DNA, 20 bp, Artificial Sequence
  Description of Artificial Sequence: Synthetic oligonucleotide
  Target: ATXN1; (-) strand; PAM type: YTN; PAM sequence: TTT
ctattcgtttctttcctttt

SEQ ID NO: 188773 - DNA, 20 bp, Artificial Sequence
  Description of Artificial Sequence: Synthetic oligonucleotide
  Target: ATXN1; (-) strand; PAM type: YTN; PAM sequence: CTA
gccatttctattcgtttctt

SEQ ID NO: 188774 - DNA, 20 bp, Artificial Sequence
  Description of Artificial Sequence: Synthetic oligonucleotide
  Target: ATXN1; (-) strand; PAM type: YTN; PAM sequence: CTC
tagccatttctattcgtttc

SEQ ID NO: 188775 - DNA, 20 bp, Artificial Sequence
  Description of Artificial Sequence: Synthetic oligonucleotide
  Target: ATXN1; (-) strand; PAM type: YTN; PAM sequence: TTA
acaagaccctctagccattt

SEQ ID NO: 188776 - DNA, 20 bp, Artificial Sequence
  Description of Artificial Sequence: Synthetic oligonucleotide
  Target: ATXN1; (-) strand; PAM type: YTN; PAM sequence: TTT
aacaagaccctctagccatt

SEQ ID NO: 188777 - DNA, 20 bp, Artificial Sequence
  Description of Artificial Sequence: Synthetic oligonucleotide
  Target: ATXN1; (-) strand; PAM type: YTN; PAM sequence: CTG
atttaacaagaccctctagc

SEQ ID NO: 188778 - DNA, 20 bp, Artificial Sequence
  Description of Artificial Sequence: Synthetic oligonucleotide
  Target: ATXN1; (-) strand; PAM type: YTN; PAM sequence: CTC
tgatttaacaagaccctcta

SEQ ID NO: 188779 - DNA, 20 bp, Artificial Sequence
  Description of Artificial Sequence: Synthetic oligonucleotide
  Target: ATXN1; (-) strand; PAM type: YTN; PAM sequence: TTC
tctgatttaacaagaccctc

SEQ ID NO: 188780 - DNA, 20 bp, Artificial Sequence
  Description of Artificial Sequence: Synthetic oligonucleotide
  Target: ATXN1; (-) strand; PAM type: YTN; PAM sequence: TTA
gcattctctgatttaacaag

SEQ ID NO: 188781 - DNA, 20 bp, Artificial Sequence
  Description of Artificial Sequence: Synthetic oligonucleotide
  Target: ATXN1; (-) strand; PAM type: YTN; PAM sequence: CTT
agcattctctgatttaacaa

SEQ ID NO: 188782 - DNA, 20 bp, Artificial Sequence
  Description of Artificial Sequence: Synthetic oligonucleotide
  Target: ATXN1; (-) strand; PAM type: YTN; PAM sequence: CTA
cagatgggtcttagcattct

SEQ ID NO: 188783 - DNA, 20 bp, Artificial Sequence
  Description of Artificial Sequence: Synthetic oligonucleotide
  Target: ATXN1; (-) strand; PAM type: YTN; PAM sequence: TTC
tacagatgggtcttagcatt

SEQ ID NO: 188784 - DNA, 20 bp, Artificial Sequence
  Description of Artificial Sequence: Synthetic oligonucleotide
  Target: ATXN1; (-) strand; PAM type: YTN; PAM sequence: CTG
aatcagaaattctacagatg

SEQ ID NO: 188785 - DNA, 20 bp, Artificial Sequence
  Description of Artificial Sequence: Synthetic oligonucleotide
  Target: ATXN1; (-) strand; PAM type: YTN; PAM sequence: CTA
ctgaatcagaaattctacag

SEQ ID NO: 188786 - DNA, 20 bp, Artificial Sequence
  Description of Artificial Sequence: Synthetic oligonucleotide
  Target: ATXN1; (-) strand; PAM type: YTN; PAM sequence: CTG
accccaccccaagcctactg

SEQ ID NO: 188787 - DNA, 20 bp, Artificial Sequence
  Description of Artificial Sequence: Synthetic oligonucleotide
  Target: ATXN1; (-) strand; PAM type: YTN; PAM sequence: TTA
tctgaccccaccccaagcct

SEQ ID NO: 188788 - DNA, 20 bp, Artificial Sequence
  Description of Artificial Sequence: Synthetic oligonucleotide
  Target: ATXN1; (-) strand; PAM type: YTN; PAM sequence: TTG
tcagaaatacaaattatctg

SEQ ID NO: 188789 - DNA, 20 bp, Artificial Sequence
  Description of Artificial Sequence: Synthetic oligonucleotide
  Target: ATXN1; (-) strand; PAM type: YTN; PAM sequence: CTT
gtcagaaatacaaattatct

SEQ ID NO: 188790 - DNA, 20 bp, Artificial Sequence
  Description of Artificial Sequence: Synthetic oligonucleotide
  Target: ATXN1; (-) strand; PAM type: YTN; PAM sequence: CTG
ggaacttgtcagaaatacaa

SEQ ID NO: 188791 - DNA, 20 bp, Artificial Sequence
  Description of Artificial Sequence: Synthetic oligonucleotide
  Target: ATXN1; (-) strand; PAM type: YTN; PAM sequence: CTG
gaccagcagtatcagcatca

SEQ ID NO: 188792 - DNA, 20 bp, Artificial Sequence
  Description of Artificial Sequence: Synthetic oligonucleotide
  Target: ATXN1; (-) strand; PAM type: YTN; PAM sequence: CTG
gtccctggaccagcagtatc

SEQ ID NO: 188793 - DNA, 20 bp, Artificial Sequence
  Description of Artificial Sequence: Synthetic oligonucleotide
  Target: ATXN1; (-) strand; PAM type: YTN; PAM sequence: CTC
aaagtctggtccctggacca

SEQ ID NO: 188794 - DNA, 20 bp, Artificial Sequence
  Description of Artificial Sequence: Synthetic oligonucleotide
  Target: ATXN1; (-) strand; PAM type: YTN; PAM sequence: TTC
tcaaagtctggtccctggac

SEQ ID NO: 188795 - DNA, 20 bp, Artificial Sequence
  Description of Artificial Sequence: Synthetic oligonucleotide
  Target: ATXN1; (-) strand; PAM type: YTN; PAM sequence: TTA
gagaagtggttctcaaagtc

SEQ ID NO: 188796 - DNA, 20 bp, Artificial Sequence
  Description of Artificial Sequence: Synthetic oligonucleotide
  Target: ATXN1; (-) strand; PAM type: YTN; PAM sequence: CTT
agagaagtggttctcaaagt

SEQ ID NO: 188797 - DNA, 20 bp, Artificial Sequence
  Description of Artificial Sequence: Synthetic oligonucleotide
  Target: ATXN1; (-) strand; PAM type: YTN; PAM sequence: TTA
accttagagaagtggttctc

SEQ ID NO: 188798 - DNA, 20 bp, Artificial Sequence
  Description of Artificial Sequence: Synthetic oligonucleotide
  Target: ATXN1; (-) strand; PAM type: YTN; PAM sequence: TTT
aaccttagagaagtggttct

SEQ ID NO: 188799 - DNA, 20 bp, Artificial Sequence
  Description of Artificial Sequence: Synthetic oligonucleotide
  Target: ATXN1; (-) strand; PAM type: YTN; PAM sequence: TTG
acagaaacatttaaccttag

SEQ ID NO: 188800 - DNA, 20 bp, Artificial Sequence
  Description of Artificial Sequence: Synthetic oligonucleotide
  Target: ATXN1; (-) strand; PAM type: YTN; PAM sequence: CTG
taattgacagaaacatttaa

SEQ ID NO: 188801 - DNA, 20 bp, Artificial Sequence
  Description of Artificial Sequence: Synthetic oligonucleotide
  Target: ATXN1; (-) strand; PAM type: YTN; PAM sequence: CTG
gccctgtaattgacagaaac

SEQ ID NO: 188802 - DNA, 20 bp, Artificial Sequence
  Description of Artificial Sequence: Synthetic oligonucleotide
  Target: ATXN1; (-) strand; PAM type: YTN; PAM sequence: CTC
tggccctgtaattgacagaa

SEQ ID NO: 188803 - DNA, 20 bp, Artificial Sequence
  Description of Artificial Sequence: Synthetic oligonucleotide
  Target: ATXN1; (-) strand; PAM type: YTN; PAM sequence: CTC
tctggccctgtaattgacag

SEQ ID NO: 188804 - DNA, 20 bp, Artificial Sequence
  Description of Artificial Sequence: Synthetic oligonucleotide
  Target: ATXN1; (-) strand; PAM type: YTN; PAM sequence: CTC
agcatctctctggccctgta

SEQ ID NO: 188805 - DNA, 20 bp, Artificial Sequence
  Description of Artificial Sequence: Synthetic oligonucleotide
  Target: ATXN1; (-) strand; PAM type: YTN; PAM sequence: CTC
aaaagatcctcagcatctct

SEQ ID NO: 188806 - DNA, 20 bp, Artificial Sequence
  Description of Artificial Sequence: Synthetic oligonucleotide
  Target: ATXN1; (-) strand; PAM type: YTN; PAM sequence: TTA
aatgtactcaaaagatcctc

SEQ ID NO: 188807 - DNA, 20 bp, Artificial Sequence
  Description of Artificial Sequence: Synthetic oligonucleotide
  Target: ATXN1; (-) strand; PAM type: YTN; PAM sequence: CTA
tcaaatggtgattaaatgta

SEQ ID NO: 188808 - DNA, 20 bp, Artificial Sequence
  Description of Artificial Sequence: Synthetic oligonucleotide
  Target: ATXN1; (-) strand; PAM type: YTN; PAM sequence: TTC
aatgtagctatcaaatggtg

SEQ ID NO: 188809 - DNA, 20 bp, Artificial Sequence
  Description of Artificial Sequence: Synthetic oligonucleotide
  Target: ATXN1; (-) strand; PAM type: YTN; PAM sequence: TTT
caatgtagctatcaaatggt

SEQ ID NO: 188810 - DNA, 20 bp, Artificial Sequence
  Description of Artificial Sequence: Synthetic oligonucleotide
  Target: ATXN1; (-) strand; PAM type: YTN; PAM sequence: CTT
tcaatgtagctatcaaatgg

SEQ ID NO: 188811 - DNA, 20 bp, Artificial Sequence
  Description of Artificial Sequence: Synthetic oligonucleotide
  Target: ATXN1; (-) strand; PAM type: YTN; PAM sequence: TTG
ctttcaatgtagctatcaaa

SEQ ID NO: 188812 - DNA, 20 bp, Artificial Sequence
  Description of Artificial Sequence: Synthetic oligonucleotide
  Target: ATXN1; (-) strand; PAM type: YTN; PAM sequence: TTG
aaatagacaggtatcattgc

SEQ ID NO: 188813 - DNA, 20 bp, Artificial Sequence
  Description of Artificial Sequence: Synthetic oligonucleotide
  Target: ATXN1; (-) strand; PAM type: YTN; PAM sequence: TTT
gaaatagacaggtatcattg

SEQ ID NO: 188814 - DNA, 20 bp, Artificial Sequence
  Description of Artificial Sequence: Synthetic oligonucleotide
  Target: ATXN1; (-) strand; PAM type: YTN; PAM sequence: CTT
tgaaatagacaggtatcatt

SEQ ID NO: 188815 - DNA, 20 bp, Artificial Sequence
  Description of Artificial Sequence: Synthetic oligonucleotide
  Target: ATXN1; (-) strand; PAM type: YTN; PAM sequence: TTC
tttgaaatagacaggtatca

SEQ ID NO: 188816 - DNA, 20 bp, Artificial Sequence
  Description of Artificial Sequence: Synthetic oligonucleotide
  Target: ATXN1; (-) strand; PAM type: YTN; PAM sequence: CTT
ctttgaaatagacaggtatc

SEQ ID NO: 188817 - DNA, 20 bp, Artificial Sequence
  Description of Artificial Sequence: Synthetic oligonucleotide
  Target: ATXN1; (-) strand; PAM type: YTN; PAM sequence: TTG
tcgcttctttgaaatagaca

SEQ ID NO: 188818 - DNA, 20 bp, Artificial Sequence
  Description of Artificial Sequence: Synthetic oligonucleotide
  Target: ATXN1; (-) strand; PAM type: YTN; PAM sequence: TTT
gtcgcttctttgaaatagac

SEQ ID NO: 188819 - DNA, 20 bp, Artificial Sequence
  Description of Artificial Sequence: Synthetic oligonucleotide
  Target: ATXN1; (-) strand; PAM type: YTN; PAM sequence: TTG
gtcatttgtcgcttctttga

SEQ ID NO: 188820 - DNA, 20 bp, Artificial Sequence
  Description of Artificial Sequence: Synthetic oligonucleotide
  Target: ATXN1; (-) strand; PAM type: YTN; PAM sequence: TTT
ggtcatttgtcgcttctttg

SEQ ID NO: 188821 - DNA, 20 bp, Artificial Sequence
  Description of Artificial Sequence: Synthetic oligonucleotide
  Target: ATXN1; (-) strand; PAM type: YTN; PAM sequence: TTT
tggtcatttgtcgcttcttt

SEQ ID NO: 188822 - DNA, 20 bp, Artificial Sequence
  Description of Artificial Sequence: Synthetic oligonucleotide
  Target: ATXN1; (-) strand; PAM type: YTN; PAM sequence: TTT
ttggtcatttgtcgcttctt

SEQ ID NO: 188823 - DNA, 20 bp, Artificial Sequence
  Description of Artificial Sequence: Synthetic oligonucleotide
  Target: ATXN1; (-) strand; PAM type: YTN; PAM sequence: TTT
tttggtcatttgtcgcttct

SEQ ID NO: 188824 - DNA, 20 bp, Artificial Sequence
  Description of Artificial Sequence: Synthetic oligonucleotide
  Target: ATXN1; (-) strand; PAM type: YTN; PAM sequence: TTT
ttttggtcatttgtcgcttc

SEQ ID NO: 188825 - DNA, 20 bp, Artificial Sequence
  Description of Artificial Sequence: Synthetic oligonucleotide
  Target: ATXN1; (-) strand; PAM type: YTN; PAM sequence: TTT
tttttggtcatttgtcgctt

SEQ ID NO: 188826 - DNA, 20 bp, Artificial Sequence
  Description of Artificial Sequence: Synthetic oligonucleotide
  Target: ATXN1; (-) strand; PAM type: YTN; PAM sequence: TTT
ttttttggtcatttgtcgct

SEQ ID NO: 188827 - DNA, 20 bp, Artificial Sequence
  Description of Artificial Sequence: Synthetic oligonucleotide
  Target: ATXN1; (-) strand; PAM type: YTN; PAM sequence: TTT
tttttttggtcatttgtcgc

SEQ ID NO: 188828 - DNA, 20 bp, Artificial Sequence
  Description of Artificial Sequence: Synthetic oligonucleotide
  Target: ATXN1; (-) strand; PAM type: YTN; PAM sequence: TTT
ttttttttggtcatttgtcg

SEQ ID NO: 188829 - DNA, 20 bp, Artificial Sequence
  Description of Artificial Sequence: Synthetic oligonucleotide
  Target: ATXN1; (-) strand; PAM type: YTN; PAM sequence: TTT
tttttttttggtcatttgtc

SEQ ID NO: 188830 - DNA, 20 bp, Artificial Sequence
  Description of Artificial Sequence: Synthetic oligonucleotide
  Target: ATXN1; (-) strand; PAM type: YTN; PAM sequence: TTT
ttttttttttggtcatttgt

SEQ ID NO: 188831 - DNA, 20 bp, Artificial Sequence
  Description of Artificial Sequence: Synthetic oligonucleotide
  Target: ATXN1; (-) strand; PAM type: YTN; PAM sequence: TTT
tttttttttttggtcatttg

SEQ ID NO: 188832 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttggtcattt

SEQ ID NO: 188833 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttggtcatt

SEQ ID NO: 188834 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttggtcat

SEQ ID NO: 188835 - DNA, 20 bp, Artificial Sequence
  Description of Artificial Sequence: Synthetic oligonucleotide
  Target: ATXN1; (-) strand; PAM type: YTN; PAM sequence: TTG
gtttttttttttttttttgg

SEQ ID NO: 188836 - DNA, 20 bp, Artificial Sequence
  Description of Artificial Sequence: Synthetic oligonucleotide
  Target: ATXN1; (-) strand; PAM type: YTN; PAM sequence: TTT
ggtttttttttttttttttg

SEQ ID NO: 188837 - DNA, 20 bp, Artificial Sequence
  Description of Artificial Sequence: Synthetic oligonucleotide
  Target: ATXN1; (-) strand; PAM type: YTN; PAM sequence: TTT
tggttttttttttttttttt

SEQ ID NO: 188838 - DNA, 20 bp, Artificial Sequence
  Description of Artificial Sequence: Synthetic oligonucleotide
  Target: ATXN1; (-) strand; PAM type: YTN; PAM sequence: TTT
ttggtttttttttttttttt

SEQ ID NO: 188839 - DNA, 20 bp, Artificial Sequence
  Description of Artificial Sequence: Synthetic oligonucleotide
  Target: ATXN1; (-) strand; PAM type: YTN; PAM sequence: TTG
gtttttggtttttttttttt

SEQ ID NO: 188840 - DNA, 20 bp, Artificial Sequence
  Description of Artificial Sequence: Synthetic oligonucleotide
  Target: ATXN1; (-) strand; PAM type: YTN; PAM sequence: TTT
ggtttttggttttttttttt

SEQ ID NO: 188841 - DNA, 20 bp, Artificial Sequence
  Description of Artificial Sequence: Synthetic oligonucleotide
  Target: ATXN1; (-) strand; PAM type: YTN; PAM sequence: TTG
tttggtttttggtttttttt

SEQ ID NO: 188842 - DNA, 20 bp, Artificial Sequence
  Description of Artificial Sequence: Synthetic oligonucleotide
  Target: ATXN1; (-) strand; PAM type: YTN; PAM sequence: TTG
ttgtttggtttttggttttt

SEQ ID NO: 188843 - DNA, 20 bp, Artificial Sequence
  Description of Artificial Sequence: Synthetic oligonucleotide
  Target: ATXN1; (-) strand; PAM type: YTN; PAM sequence: TTT
gttgtttggtttttggtttt

SEQ ID NO: 188844 - DNA, 20 bp, Artificial Sequence
  Description of Artificial Sequence: Synthetic oligonucleotide
  Target: ATXN1; (-) strand; PAM type: YTN; PAM sequence: TTT
tgttgtttggtttttggttt

SEQ ID NO: 188845 - DNA, 20 bp, Artificial Sequence
  Description of Artificial Sequence: Synthetic oligonucleotide
  Target: ATXN1; (-) strand; PAM type: YTN; PAM sequence: TTT
ttgttgtttggtttttggtt

SEQ ID NO: 188846 - DNA, 20 bp, Artificial Sequence
  Description of Artificial Sequence: Synthetic oligonucleotide
  Target: ATXN1; (-) strand; PAM type: YTN; PAM sequence: TTT
tttgttgtttggtttttggt

SEQ ID NO: 188847 - DNA, 20 bp, Artificial Sequence
  Description of Artificial Sequence: Synthetic oligonucleotide
  Target: ATXN1; (-) strand; PAM type: YTN; PAM sequence: CTG
ggtaatatagtgtgtgaagt

SEQ ID NO: 188848 - DNA, 20 bp, Artificial Sequence
  Description of Artificial Sequence: Synthetic oligonucleotide
  Target: ATXN1; (-) strand; PAM type: YTN; PAM sequence: CTC
caagtagagaggccacacac

SEQ ID NO: 188849 - DNA, 20 bp, Artificial Sequence
  Description of Artificial Sequence: Synthetic oligonucleotide
  Target: ATXN1; (-) strand; PAM type: YTN; PAM sequence: TTC
agactccaagtagagaggcc

SEQ ID NO: 188850 - DNA, 20 bp, Artificial Sequence
  Description of Artificial Sequence: Synthetic oligonucleotide
  Target: ATXN1; (-) strand; PAM type: YTN; PAM sequence: CTG
gaaccagtaggaggagaatg

SEQ ID NO: 188851 - DNA, 20 bp, Artificial Sequence
  Description of Artificial Sequence: Synthetic oligonucleotide
  Target: ATXN1; (-) strand; PAM type: YTN; PAM sequence: TTG
accccagcaggatctggaac

SEQ ID NO: 188852 - DNA, 20 bp, Artificial Sequence
  Description of Artificial Sequence: Synthetic oligonucleotide
  Target: ATXN1; (-) strand; PAM type: YTN; PAM sequence: TTG
ggagcagagttgaccccagc

SEQ ID NO: 188853 - DNA, 20 bp, Artificial Sequence
  Description of Artificial Sequence: Synthetic oligonucleotide
  Target: ATXN1; (-) strand; PAM type: YTN; PAM sequence: CTG
aagggaagttgggagcagag

SEQ ID NO: 188854 - DNA, 20 bp, Artificial Sequence
  Description of Artificial Sequence: Synthetic oligonucleotide
  Target: ATXN1; (-) strand; PAM type: YTN; PAM sequence: TTC
cagtagagaggaaaaagact

SEQ ID NO: 188855 - DNA, 20 bp, Artificial Sequence
  Description of Artificial Sequence: Synthetic oligonucleotide
  Target: ATXN1; (-) strand; PAM type: YTN; PAM sequence: TTT
ccagtagagaggaaaaagac

SEQ ID NO: 188856 - DNA, 20 bp, Artificial Sequence
  Description of Artificial Sequence: Synthetic oligonucleotide
  Target: ATXN1; (-) strand; PAM type: YTN; PAM sequence: TTG
gagtgtgagaaatttccagt

SEQ ID NO: 188857 - DNA, 20 bp, Artificial Sequence
  Description of Artificial Sequence: Synthetic oligonucleotide
  Target: ATXN1; (-) strand; PAM type: YTN; PAM sequence: CTT
ggagtgtgagaaatttccag

SEQ ID NO: 188858 - DNA, 20 bp, Artificial Sequence
  Description of Artificial Sequence: Synthetic oligonucleotide
  Target: ATXN1; (-) strand; PAM type: YTN; PAM sequence: CTG
agtatgcttggagtgtgaga

SEQ ID NO: 188859 - DNA, 20 bp, Artificial Sequence
  Description of Artificial Sequence: Synthetic oligonucleotide
  Target: ATXN1; (-) strand; PAM type: YTN; PAM sequence: TTA
ggaatagcagtgactgagta

SEQ ID NO: 188860 - DNA, 20 bp, Artificial Sequence
  Description of Artificial Sequence: Synthetic oligonucleotide
  Target: ATXN1; (-) strand; PAM type: YTN; PAM sequence: TTT
aggaatagcagtgactgagt

SEQ ID NO: 188861 - DNA, 20 bp, Artificial Sequence
  Description of Artificial Sequence: Synthetic oligonucleotide
  Target: ATXN1; (-) strand; PAM type: YTN; PAM sequence: TTT
taggaatagcagtgactgag

SEQ ID NO: 188862 - DNA, 20 bp, Artificial Sequence
  Description of Artificial Sequence: Synthetic oligonucleotide
  Target: ATXN1; (-) strand; PAM type: YTN; PAM sequence: CTT
ttaggaatagcagtgactga

SEQ ID NO: 188863 - DNA, 20 bp, Artificial Sequence
  Description of Artificial Sequence: Synthetic oligonucleotide
  Target: ATXN1; (-) strand; PAM type: YTN; PAM sequence: TTC
ttttaggaatagcagtgact

SEQ ID NO: 188864 - DNA, 20 bp, Artificial Sequence
  Description of Artificial Sequence: Synthetic oligonucleotide
  Target: ATXN1; (-) strand; PAM type: YTN; PAM sequence: TTA
gggtatggataaattctttt

SEQ ID NO: 188865 - DNA, 20 bp, Artificial Sequence
  Description of Artificial Sequence: Synthetic oligonucleotide
  Target: ATXN1; (-) strand; PAM type: YTN; PAM sequence: CTG
tattagggtatggataaatt

SEQ ID NO: 188866 - DNA, 20 bp, Artificial Sequence
  Description of Artificial Sequence: Synthetic oligonucleotide
  Target: ATXN1; (-) strand; PAM type: YTN; PAM sequence: TTG
ggactgtattagggtatgga

SEQ ID NO: 188867 - DNA, 20 bp, Artificial Sequence
  Description of Artificial Sequence: Synthetic oligonucleotide
  Target: ATXN1; (-) strand; PAM type: YTN; PAM sequence: TTT
gggactgtattagggtatgg

SEQ ID NO: 188868 - DNA, 20 bp, Artificial Sequence
  Description of Artificial Sequence: Synthetic oligonucleotide
  Target: ATXN1; (-) strand; PAM type: YTN; PAM sequence: TTG
gtaaacagaagagagaggac

SEQ ID NO: 188869 - DNA, 20 bp, Artificial Sequence
  Description of Artificial Sequence: Synthetic oligonucleotide
  Target: ATXN1; (-) strand; PAM type: YTN; PAM sequence: TTG
ttggtaaacagaagagagag

SEQ ID NO: 188870 - DNA, 20 bp, Artificial Sequence
  Description of Artificial Sequence: Synthetic oligonucleotide
  Target: ATXN1; (-) strand; PAM type: YTN; PAM sequence: TTT
gttggtaaacagaagagaga

SEQ ID NO: 188871 - DNA, 20 bp, Artificial Sequence
  Description of Artificial Sequence: Synthetic oligonucleotide
  Target: ATXN1; (-) strand; PAM type: YTN; PAM sequence: CTG
tttgttggtaaacagaagag

SEQ ID NO: 188872 - DNA, 20 bp, Artificial Sequence
  Description of Artificial Sequence: Synthetic oligonucleotide
  Target: ATXN1; (-) strand; PAM type: YTN; PAM sequence: TTG
aatgtatagtacaactgttt

SEQ ID NO: 188873 - DNA, 20 bp, Artificial Sequence
  Description of Artificial Sequence: Synthetic oligonucleotide
  Target: ATXN1; (-) strand; PAM type: YTN; PAM sequence: CTG
gcattgaatgtatagtacaa

SEQ ID NO: 188874 - DNA, 20 bp, Artificial Sequence
  Description of Artificial Sequence: Synthetic oligonucleotide
  Target: ATXN1; (-) strand; PAM type: YTN; PAM sequence: TTA
agatgtaggcggtgaaatac

SEQ ID NO: 188875 - DNA, 20 bp, Artificial Sequence
  Description of Artificial Sequence: Synthetic oligonucleotide
  Target: ATXN1; (-) strand; PAM type: YTN; PAM sequence: TTT
aagatgtaggcggtgaaata

SEQ ID NO: 188876 - DNA, 20 bp, Artificial Sequence
  Description of Artificial Sequence: Synthetic oligonucleotide
  Target: ATXN1; (-) strand; PAM type: YTN; PAM sequence: TTT
taagatgtaggcggtgaaat

SEQ ID NO: 188877 - DNA, 20 bp, Artificial Sequence
  Description of Artificial Sequence: Synthetic oligonucleotide
  Target: ATXN1; (-) strand; PAM type: YTN; PAM sequence: CTC
cagagttttaagatgtaggc

SEQ ID NO: 188878 - DNA, 20 bp, Artificial Sequence
  Description of Artificial Sequence: Synthetic oligonucleotide
  Target: ATXN1; (-) strand; PAM type: YTN; PAM sequence: CTA
acacagagaaaagtggtgga

SEQ ID NO: 188879 - DNA, 20 bp, Artificial Sequence
  Description of Artificial Sequence: Synthetic oligonucleotide
  Target: ATXN1; (-) strand; PAM type: YTN; PAM sequence: TTA
ctaacacagagaaaagtggt

SEQ ID NO: 188880 - DNA, 20 bp, Artificial Sequence
  Description of Artificial Sequence: Synthetic oligonucleotide
  Target: ATXN1; (-) strand; PAM type: YTN; PAM sequence: TTG
gaggagaaggaaggttacta

SEQ ID NO: 188881 - DNA, 20 bp, Artificial Sequence
  Description of Artificial Sequence: Synthetic oligonucleotide
  Target: ATXN1; (-) strand; PAM type: YTN; PAM sequence: TTT
ggaggagaaggaaggttact

SEQ ID NO: 188882 - DNA, 20 bp, Artificial Sequence
  Description of Artificial Sequence: Synthetic oligonucleotide
  Target: ATXN1; (-) strand; PAM type: YTN; PAM sequence: CTT
tggaggagaaggaaggttac

SEQ ID NO: 188883 - DNA, 20 bp, Artificial Sequence
  Description of Artificial Sequence: Synthetic oligonucleotide
  Target: ATXN1; (-) strand; PAM type: YTN; PAM sequence: TTG
acctttggaggagaaggaag

SEQ ID NO: 188884 - DNA, 20 bp, Artificial Sequence
  Description of Artificial Sequence: Synthetic oligonucleotide
  Target: ATXN1; (-) strand; PAM type: YTN; PAM sequence: CTT
gacctttggaggagaaggaa

SEQ ID NO: 188885 - DNA, 20 bp, Artificial Sequence
  Description of Artificial Sequence: Synthetic oligonucleotide
  Target: ATXN1; (-) strand; PAM type: YTN; PAM sequence: TTC
ttgacctttggaggagaagg

SEQ ID NO: 188886 - DNA, 20 bp, Artificial Sequence
  Description of Artificial Sequence: Synthetic oligonucleotide
  Target: ATXN1; (-) strand; PAM type: YTN; PAM sequence: TTA
gaaggcaggaaaccattctt

SEQ ID NO: 188887 - DNA, 20 bp, Artificial Sequence
  Description of Artificial Sequence: Synthetic oligonucleotide
  Target: ATXN1; (-) strand; PAM type: YTN; PAM sequence: TTT
agaaggcaggaaaccattct

SEQ ID NO: 188888 - DNA, 20 bp, Artificial Sequence
  Description of Artificial Sequence: Synthetic oligonucleotide
  Target: ATXN1; (-) strand; PAM type: YTN; PAM sequence: CTG
catttagaaggcaggaaacc

SEQ ID NO: 188889 - DNA, 20 bp, Artificial Sequence
  Description of Artificial Sequence: Synthetic oligonucleotide
  Target: ATXN1; (-) strand; PAM type: YTN; PAM sequence: CTC
agcaaaggtcactgcattta

SEQ ID NO: 188890 - DNA, 20 bp, Artificial Sequence
  Description of Artificial Sequence: Synthetic oligonucleotide
  Target: ATXN1; (-) strand; PAM type: YTN; PAM sequence: TTA
agaggaggactcagcaaagg

SEQ ID NO: 188891 - DNA, 20 bp, Artificial Sequence
  Description of Artificial Sequence: Synthetic oligonucleotide
  Target: ATXN1; (-) strand; PAM type: YTN; PAM sequence: TTA
gagaagttaagaggaggact

SEQ ID NO: 188892 - DNA, 20 bp, Artificial Sequence
  Description of Artificial Sequence: Synthetic oligonucleotide
  Target: ATXN1; (-) strand; PAM type: YTN; PAM sequence: TTG
ttagagaagttaagaggagg

SEQ ID NO: 188893 - DNA, 20 bp, Artificial Sequence
  Description of Artificial Sequence: Synthetic oligonucleotide
  Target: ATXN1; (-) strand; PAM type: YTN; PAM sequence: CTG
tatcagacattgttagagaa

SEQ ID NO: 188894 - DNA, 20 bp, Artificial Sequence
  Description of Artificial Sequence: Synthetic oligonucleotide
  Target: ATXN1; (-) strand; PAM type: YTN; PAM sequence: CTA
gtgaactgtatcagacattg

SEQ ID NO: 188895 - DNA, 20 bp, Artificial Sequence
  Description of Artificial Sequence: Synthetic oligonucleotide
  Target: ATXN1; (-) strand; PAM type: YTN; PAM sequence: TTA
ctagtgaactgtatcagaca

SEQ ID NO: 188896 - DNA, 20 bp, Artificial Sequence
  Description of Artificial Sequence: Synthetic oligonucleotide
  Target: ATXN1; (-) strand; PAM type: YTN; PAM sequence: CTA
ttactagtgaactgtatcag

SEQ ID NO: 188897 - DNA, 20 bp, Artificial Sequence
  Description of Artificial Sequence: Synthetic oligonucleotide
  Target: ATXN1; (-) strand; PAM type: YTN; PAM sequence: CTA
aataaaaggaaaagaaaatg

SEQ ID NO: 188898 - DNA, 20 bp, Artificial Sequence
  Description of Artificial Sequence: Synthetic oligonucleotide
  Target: ATXN1; (-) strand; PAM type: YTN; PAM sequence: CTA
ctaaataaaaggaaaagaaa

SEQ ID NO: 188899 - DNA, 20 bp, Artificial Sequence
  Description of Artificial Sequence: Synthetic oligonucleotide
  Target: ATXN1; (-) strand; PAM type: YTN; PAM sequence: CTA
gtctactaaataaaaggaaa

SEQ ID NO: 188900 - DNA, 20 bp, Artificial Sequence
  Description of Artificial Sequence: Synthetic oligonucleotide
  Target: ATXN1; (-) strand; PAM type: YTN; PAM sequence: TTC
aggcaaaaatgctagtctac

SEQ ID NO: 188901 - DNA, 20 bp, Artificial Sequence
  Description of Artificial Sequence: Synthetic oligonucleotide
  Target: ATXN1; (-) strand; PAM type: YTN; PAM sequence: CTG
ttcaggcaaaaatgctagtc

SEQ ID NO: 188902 - DNA, 20 bp, Artificial Sequence
  Description of Artificial Sequence: Synthetic oligonucleotide
  Target: ATXN1; (-) strand; PAM type: YTN; PAM sequence: TTC
cagaaaagatgctgttcagg

SEQ ID NO: 188903 - DNA, 20 bp, Artificial Sequence
  Description of Artificial Sequence: Synthetic oligonucleotide
  Target: ATXN1; (-) strand; PAM type: YTN; PAM sequence: TTC
caggccaatgtgtgaagtca

SEQ ID NO: 188904 - DNA, 20 bp, Artificial Sequence
  Description of Artificial Sequence: Synthetic oligonucleotide
  Target: ATXN1; (-) strand; PAM type: YTN; PAM sequence: CTT
ccaggccaatgtgtgaagtc

SEQ ID NO: 188905 - DNA, 20 bp, Artificial Sequence
  Description of Artificial Sequence: Synthetic oligonucleotide
  Target: ATXN1; (-) strand; PAM type: YTN; PAM sequence: CTG
ggtcatatgtccatcttcca

SEQ ID NO: 188906 - DNA, 20 bp, Artificial Sequence
  Description of Artificial Sequence: Synthetic oligonucleotide
  Target: ATXN1; (-) strand; PAM type: YTN; PAM sequence: TTG
cccagacctgggtcatatgt

SEQ ID NO: 188907 - DNA, 20 bp, Artificial Sequence
  Description of Artificial Sequence: Synthetic oligonucleotide
  Target: ATXN1; (-) strand; PAM type: YTN; PAM sequence: TTA
cgattgcccagacctgggtc

SEQ ID NO: 188908 - DNA, 20 bp, Artificial Sequence
  Description of Artificial Sequence: Synthetic oligonucleotide
  Target: ATXN1; (-) strand; PAM type: YTN; PAM sequence: TTG
tattacgattgcccagacct

SEQ ID NO: 188909 - DNA, 20 bp, Artificial Sequence
  Description of Artificial Sequence: Synthetic oligonucleotide
  Target: ATXN1; (-) strand; PAM type: YTN; PAM sequence: TTG
ttgtattacgattgcccaga

SEQ ID NO: 188910 - DNA, 20 bp, Artificial Sequence
  Description of Artificial Sequence: Synthetic oligonucleotide
  Target: ATXN1; (-) strand; PAM type: YTN; PAM sequence: CTG
gagggttgttgtattacgat

SEQ ID NO: 188911 - DNA, 20 bp, Artificial Sequence
  Description of Artificial Sequence: Synthetic oligonucleotide
  Target: ATXN1; (-) strand; PAM type: YTN; PAM sequence: CTG
tggctggagggttgttgtat

SEQ ID NO: 188912 - DNA, 20 bp, Artificial Sequence
  Description of Artificial Sequence: Synthetic oligonucleotide
  Target: ATXN1; (-) strand; PAM type: YTN; PAM sequence: CTA
ggccagtcactgtggctgga

SEQ ID NO: 188913 - DNA, 20 bp, Artificial Sequence
  Description of Artificial Sequence: Synthetic oligonucleotide
  Target: ATXN1; (-) strand; PAM type: YTN; PAM sequence: CTA
cccctaggccagtcactgtg

SEQ ID NO: 188914 - DNA, 20 bp, Artificial Sequence
  Description of Artificial Sequence: Synthetic oligonucleotide
  Target: ATXN1; (-) strand; PAM type: YTN; PAM sequence: TTG
ggtacatgcctacccctagg

SEQ ID NO: 188915 - DNA, 20 bp, Artificial Sequence
  Description of Artificial Sequence: Synthetic oligonucleotide
  Target: ATXN1; (-) strand; PAM type: YTN; PAM sequence: CTT
gggtacatgcctacccctag

SEQ ID NO: 188916 - DNA, 20 bp, Artificial Sequence
  Description of Artificial Sequence: Synthetic oligonucleotide
  Target: ATXN1; (-) strand; PAM type: YTN; PAM sequence: TTG
ccttgggtacatgcctaccc

SEQ ID NO: 188917 - DNA, 20 bp, Artificial Sequence
  Description of Artificial Sequence: Synthetic oligonucleotide
  Target: ATXN1; (-) strand; PAM type: YTN; PAM sequence: CTT
gccttgggtacatgcctacc

SEQ ID NO: 188918 - DNA, 20 bp, Artificial Sequence
  Description of Artificial Sequence: Synthetic oligonucleotide
  Target: ATXN1; (-) strand; PAM type: YTN; PAM sequence: TTG
gcttgccttgggtacatgcc

SEQ ID NO: 188919 - DNA, 20 bp, Artificial Sequence
  Description of Artificial Sequence: Synthetic oligonucleotide
  Target: ATXN1; (-) strand; PAM type: YTN; PAM sequence: TTG
attggcttgccttgggtaca

SEQ ID NO: 188920 - DNA, 20 bp, Artificial Sequence
  Description of Artificial Sequence: Synthetic oligonucleotide
  Target: ATXN1; (-) strand; PAM type: YTN; PAM sequence: TTT
gattggcttgccttgggtac

SEQ ID NO: 188921 - DNA, 20 bp, Artificial Sequence
  Description of Artificial Sequence: Synthetic oligonucleotide
  Target: ATXN1; (-) strand; PAM type: YTN; PAM sequence: CTT
tgattggcttgccttgggta

SEQ ID NO: 188922 - DNA, 20 bp, Artificial Sequence
  Description of Artificial Sequence: Synthetic oligonucleotide
  Target: ATXN1; (-) strand; PAM type: YTN; PAM sequence: CTG
agagaggcctttgattggct

SEQ ID NO: 188923 - DNA, 20 bp, Artificial Sequence
  Description of Artificial Sequence: Synthetic oligonucleotide
  Target: ATXN1; (-) strand; PAM type: YTN; PAM sequence: TTC
caggtagtctgagagaggcc

SEQ ID NO: 188924 - DNA, 20 bp, Artificial Sequence
  Description of Artificial Sequence: Synthetic oligonucleotide
  Target: ATXN1; (-) strand; PAM type: YTN; PAM sequence: TTA
gttccaggtagtctgagaga

SEQ ID NO: 188925 - DNA, 20 bp, Artificial Sequence
  Description of Artificial Sequence: Synthetic oligonucleotide
  Target: ATXN1; (-) strand; PAM type: YTN; PAM sequence: CTT
agttccaggtagtctgagag

SEQ ID NO: 188926 - DNA, 20 bp, Artificial Sequence
  Description of Artificial Sequence: Synthetic oligonucleotide
  Target: ATXN1; (-) strand; PAM type: YTN; PAM sequence: CTC
ttagttccaggtagtctgag

SEQ ID NO: 188927 - DNA, 20 bp, Artificial Sequence
  Description of Artificial Sequence: Synthetic oligonucleotide
  Target: ATXN1; (-) strand; PAM type: YTN; PAM sequence: CTC
ctcttagttccaggtagtct

SEQ ID NO: 188928 - DNA, 20 bp, Artificial Sequence
  Description of Artificial Sequence: Synthetic oligonucleotide
  Target: ATXN1; (-) strand; PAM type: YTN; PAM sequence: TTG
ctcctcttagttccaggtag

SEQ ID NO: 188929 - DNA, 20 bp, Artificial Sequence
  Description of Artificial Sequence: Synthetic oligonucleotide
  Target: ATXN1; (-) strand; PAM type: YTN; PAM sequence: CTA
ggaaagagtgtgttgctcct

SEQ ID NO: 188930 - DNA, 20 bp, Artificial Sequence
  Description of Artificial Sequence: Synthetic oligonucleotide
  Target: ATXN1; (-) strand; PAM type: YTN; PAM sequence: CTC
actaggaaagagtgtgttgc

SEQ ID NO: 188931 - DNA, 20 bp, Artificial Sequence
  Description of Artificial Sequence: Synthetic oligonucleotide
  Target: ATXN1; (-) strand; PAM type: YTN; PAM sequence: CTC
ccgtggtctcactaggaaag

SEQ ID NO: 188932 - DNA, 20 bp, Artificial Sequence
  Description of Artificial Sequence: Synthetic oligonucleotide
  Target: ATXN1; (-) strand; PAM type: YTN; PAM sequence: TTA
gtagcatcatgctcccgtgg

SEQ ID NO: 188933 - DNA, 20 bp, Artificial Sequence
  Description of Artificial Sequence: Synthetic oligonucleotide
  Target: ATXN1; (-) strand; PAM type: YTN; PAM sequence: CTG
ttagtagcatcatgctcccg

SEQ ID NO: 188934 - DNA, 20 bp, Artificial Sequence
  Description of Artificial Sequence: Synthetic oligonucleotide
  Target: ATXN1; (-) strand; PAM type: YTN; PAM sequence: CTA
aagaaaccagctgttagtag

SEQ ID NO: 188935 - DNA, 20 bp, Artificial Sequence
  Description of Artificial Sequence: Synthetic oligonucleotide
  Target: ATXN1; (-) strand; PAM type: YTN; PAM sequence: CTG
taagaggtggctaaagaaac

SEQ ID NO: 188936 - DNA, 20 bp, Artificial Sequence
  Description of Artificial Sequence: Synthetic oligonucleotide
  Target: ATXN1; (-) strand; PAM type: YTN; PAM sequence: TTC
tgtaagaggtggctaaagaa

SEQ ID NO: 188937 - DNA, 20 bp, Artificial Sequence
  Description of Artificial Sequence: Synthetic oligonucleotide
  Target: ATXN1; (-) strand; PAM type: YTN; PAM sequence: TTT
ctgtaagaggtggctaaaga

SEQ ID NO: 188938 - DNA, 20 bp, Artificial Sequence
  Description of Artificial Sequence: Synthetic oligonucleotide
  Target: ATXN1; (-) strand; PAM type: YTN; PAM sequence: CTT
tctgtaagaggtggctaaag

SEQ ID NO: 188939 - DNA, 20 bp, Artificial Sequence
  Description of Artificial Sequence: Synthetic oligonucleotide
  Target: ATXN1; (-) strand; PAM type: YTN; PAM sequence: CTC
cagtgggctttctgtaagag

SEQ ID NO: 188940 - DNA, 20 bp, Artificial Sequence
  Description of Artificial Sequence: Synthetic oligonucleotide
  Target: ATXN1; (-) strand; PAM type: YTN; PAM sequence: TTC
tccagtgggctttctgtaag

SEQ ID NO: 188941 - DNA, 20 bp, Artificial Sequence
  Description of Artificial Sequence: Synthetic oligonucleotide
  Target: ATXN1; (-) strand; PAM type: YTN; PAM sequence: CTT
ctccagtgggctttctgtaa

SEQ ID NO: 188942 - DNA, 20 bp, Artificial Sequence
  Description of Artificial Sequence: Synthetic oligonucleotide
  Target: ATXN1; (-) strand; PAM type: YTN; PAM sequence: TTC
cttctccagtgggctttctg

SEQ ID NO: 188943 - DNA, 20 bp, Artificial Sequence
  Description of Artificial Sequence: Synthetic oligonucleotide
  Target: ATXN1; (-) strand; PAM type: YTN; PAM sequence: CTT
ccttctccagtgggctttct

SEQ ID NO: 188944 - DNA, 20 bp, Artificial Sequence
  Description of Artificial Sequence: Synthetic oligonucleotide
  Target: ATXN1; (-) strand; PAM type: YTN; PAM sequence: CTG
ggaagcttccttctccagtg

SEQ ID NO: 188945 - DNA, 20 bp, Artificial Sequence
  Description of Artificial Sequence: Synthetic oligonucleotide
  Target: ATXN1; (-) strand; PAM type: YTN; PAM sequence: CTG
tactgggaagcttccttctc

SEQ ID NO: 188946 - DNA, 20 bp, Artificial Sequence
  Description of Artificial Sequence: Synthetic oligonucleotide
  Target: ATXN1; (-) strand; PAM type: YTN; PAM sequence: CTC
tgtactgggaagcttccttc

SEQ ID NO: 188947 - DNA, 20 bp, Artificial Sequence
  Description of Artificial Sequence: Synthetic oligonucleotide
  Target: ATXN1; (-) strand; PAM type: YTN; PAM sequence: TTC
tctgtactgggaagcttcct

SEQ ID NO: 188948 - DNA, 20 bp, Artificial Sequence
  Description of Artificial Sequence: Synthetic oligonucleotide
  Target: ATXN1; (-) strand; PAM type: YTN; PAM sequence: TTT
ctctgtactgggaagcttcc

SEQ ID NO: 188949 - DNA, 20 bp, Artificial Sequence
  Description of Artificial Sequence: Synthetic oligonucleotide
  Target: ATXN1; (-) strand; PAM type: YTN; PAM sequence: TTT
tctctgtactgggaagcttc

SEQ ID NO: 188950 - DNA, 20 bp, Artificial Sequence
  Description of Artificial Sequence: Synthetic oligonucleotide
  Target: ATXN1; (-) strand; PAM type: YTN; PAM sequence: CTT
ttctctgtactgggaagctt

SEQ ID NO: 188951 - DNA, 20 bp, Artificial Sequence
  Description of Artificial Sequence: Synthetic oligonucleotide
  Target: ATXN1; (-) strand; PAM type: YTN; PAM sequence: TTC
agcttttctctgtactggga

SEQ ID NO: 188952 - DNA, 20 bp, Artificial Sequence
  Description of Artificial Sequence: Synthetic oligonucleotide
  Target: ATXN1; (-) strand; PAM type: YTN; PAM sequence: TTT
cagcttttctctgtactggg

SEQ ID NO: 188953 - DNA, 20 bp, Artificial Sequence
  Description of Artificial Sequence: Synthetic oligonucleotide
  Target: ATXN1; (-) strand; PAM type: YTN; PAM sequence: CTT
tcagcttttctctgtactgg

SEQ ID NO: 188954 - DNA, 20 bp, Artificial Sequence
  Description of Artificial Sequence: Synthetic oligonucleotide
  Target: ATXN1; (-) strand; PAM type: YTN; PAM sequence: CTG
tctttcagcttttctctgta

SEQ ID NO: 188955 - DNA, 20 bp, Artificial Sequence
  Description of Artificial Sequence: Synthetic oligonucleotide
  Target: ATXN1; (-) strand; PAM type: YTN; PAM sequence: TTC
tgtctttcagcttttctctg

SEQ ID NO: 188956 - DNA, 20 bp, Artificial Sequence
  Description of Artificial Sequence: Synthetic oligonucleotide
  Target: ATXN1; (-) strand; PAM type: YTN; PAM sequence: TTT
ctgtctttcagcttttctct

SEQ ID NO: 188957 - DNA, 20 bp, Artificial Sequence
  Description of Artificial Sequence: Synthetic oligonucleotide
  Target: ATXN1; (-) strand; PAM type: YTN; PAM sequence: TTT
tctgtctttcagcttttctc

SEQ ID NO: 188958 - DNA, 20 bp, Artificial Sequence
  Description of Artificial Sequence: Synthetic oligonucleotide
  Target: ATXN1; (-) strand; PAM type: YTN; PAM sequence: CTC
agattttctgtctttcagct

SEQ ID NO: 188959 - DNA, 20 bp, Artificial Sequence
  Description of Artificial Sequence: Synthetic oligonucleotide
  Target: ATXN1; (-) strand; PAM type: YTN; PAM sequence: CTG
tcatcaggactcagattttc

SEQ ID NO: 188960 - DNA, 20 bp, Artificial Sequence
  Description of Artificial Sequence: Synthetic oligonucleotide
  Target: ATXN1; (-) strand; PAM type: YTN; PAM sequence: TTA
ctgtcatcaggactcagatt

SEQ ID NO: 188961 - DNA, 20 bp, Artificial Sequence
  Description of Artificial Sequence: Synthetic oligonucleotide
  Target: ATXN1; (-) strand; PAM type: YTN; PAM sequence: TTT
actgtcatcaggactcagat

SEQ ID NO: 188962 - DNA, 20 bp, Artificial Sequence
  Description of Artificial Sequence: Synthetic oligonucleotide
  Target: ATXN1; (-) strand; PAM type: YTN; PAM sequence: CTT
tactgtcatcaggactcaga

SEQ ID NO: 188963 - DNA, 20 bp, Artificial Sequence
  Description of Artificial Sequence: Synthetic oligonucleotide
  Target: ATXN1; (-) strand; PAM type: YTN; PAM sequence: CTA
aatccaagggactttactgt

SEQ ID NO: 188964 - DNA, 20 bp, Artificial Sequence
  Description of Artificial Sequence: Synthetic oligonucleotide
  Target: ATXN1; (-) strand; PAM type: YTN; PAM sequence: CTG
gcatggctaaatccaaggga

SEQ ID NO: 188965 - DNA, 20 bp, Artificial Sequence
  Description of Artificial Sequence: Synthetic oligonucleotide
  Target: ATXN1; (-) strand; PAM type: YTN; PAM sequence: TTC
tggcatggctaaatccaagg

SEQ ID NO: 188966 - DNA, 20 bp, Artificial Sequence
  Description of Artificial Sequence: Synthetic oligonucleotide
  Target: ATXN1; (-) strand; PAM type: YTN; PAM sequence: CTT
ctggcatggctaaatccaag

SEQ ID NO: 188967 - DNA, 20 bp, Artificial Sequence
  Description of Artificial Sequence: Synthetic oligonucleotide
  Target: ATXN1; (-) strand; PAM type: YTN; PAM sequence: CTA
acttctggcatggctaaatc

SEQ ID NO: 188968 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 188969 - DNA, 20 bp, Artificial Sequence
  Description of Artificial Sequence: Synthetic oligonucleotide
  Target: ATXN1; (-) strand; PAM type: YTN; PAM sequence: TTC
gtctcaaaaaaaaaaaaaaa

SEQ ID NO: 188970 - DNA, 20 bp, Artificial Sequence
  Description of Artificial Sequence: Synthetic oligonucleotide
  Target: ATXN1; (-) strand; PAM type: YTN; PAM sequence: CTT
cgtctcaaaaaaaaaaaaaa

SEQ ID NO: 188971 - DNA, 20 bp, Artificial Sequence
  Description of Artificial Sequence: Synthetic oligonucleotide
  Target: ATXN1; (-) strand; PAM type: YTN; PAM sequence: CTG
ggtgatggagcaagacttcg

SEQ ID NO: 188972 - DNA, 20 bp, Artificial Sequence
  Description of Artificial Sequence: Synthetic oligonucleotide
  Target: ATXN1; (-) strand; PAM type: YTN; PAM sequence: CTG
tctgggtgatggagcaagac

SEQ ID NO: 188973 - DNA, 20 bp, Artificial Sequence
  Description of Artificial Sequence: Synthetic oligonucleotide
  Target: ATXN1; (-) strand; PAM type: YTN; PAM sequence: CTC
tgtctgggtgatggagcaag

SEQ ID NO: 188974 - DNA, 20 bp, Artificial Sequence
  Description of Artificial Sequence: Synthetic oligonucleotide
  Target: ATXN1; (-) strand; PAM type: YTN; PAM sequence: CTG
ctctgtctgggtgatggagc

SEQ ID NO: 188975 - DNA, 20 bp, Artificial Sequence
  Description of Artificial Sequence: Synthetic oligonucleotide
  Target: ATXN1; (-) strand; PAM type: YTN; PAM sequence: TTG
cagtgagtgagaccgtgcca

SEQ ID NO: 188976 - DNA, 20 bp, Artificial Sequence
  Description of Artificial Sequence: Synthetic oligonucleotide
  Target: ATXN1; (-) strand; PAM type: YTN; PAM sequence: CTC
ggagtcagaggttgcagtga

SEQ ID NO: 188977 - DNA, 20 bp, Artificial Sequence
  Description of Artificial Sequence: Synthetic oligonucleotide
  Target: ATXN1; (-) strand; PAM type: YTN; PAM sequence: TTG
aactcggagtcagaggttgc

SEQ ID NO: 188978 - DNA, 20 bp, Artificial Sequence
  Description of Artificial Sequence: Synthetic oligonucleotide
  Target: ATXN1; (-) strand; PAM type: YTN; PAM sequence: CTT
gaactcggagtcagaggttg

SEQ ID NO: 188979 - DNA, 20 bp, Artificial Sequence
  Description of Artificial Sequence: Synthetic oligonucleotide
  Target: ATXN1; (-) strand; PAM type: YTN; PAM sequence: TTG
cttgaactcggagtcagagg

SEQ ID NO: 188980 - DNA, 20 bp, Artificial Sequence
  Description of Artificial Sequence: Synthetic oligonucleotide
  Target: ATXN1; (-) strand; PAM type: YTN; PAM sequence: CTG
agtcaggagtattgcttgaa

SEQ ID NO: 188981 - DNA, 20 bp, Artificial Sequence
  Description of Artificial Sequence: Synthetic oligonucleotide
  Target: ATXN1; (-) strand; PAM type: YTN; PAM sequence: CTC
gggaggctgagtcaggagta

SEQ ID NO: 188982 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgagtcagga

SEQ ID NO: 188983 - DNA, 20 bp, Artificial Sequence
  Description of Artificial Sequence: Synthetic oligonucleotide
  Target: ATXN1; (-) strand; PAM type: YTN; PAM sequence: CTA
taatcccagctactcgggag

SEQ ID NO: 188984 - DNA, 20 bp, Artificial Sequence
  Description of Artificial Sequence: Synthetic oligonucleotide
  Target: ATXN1; (-) strand; PAM type: YTN; PAM sequence: TTA
gccaggtgtggtggcatatg

SEQ ID NO: 188985 - DNA, 20 bp, Artificial Sequence
  Description of Artificial Sequence: Synthetic oligonucleotide
  Target: ATXN1; (-) strand; PAM type: YTN; PAM sequence: TTG
tatcaaaaaaaaaaaaaaaa

SEQ ID NO: 188986 - DNA, 20 bp, Artificial Sequence
  Description of Artificial Sequence: Synthetic oligonucleotide
  Target: ATXN1; (-) strand; PAM type: YTN; PAM sequence: CTT
gtatcaaaaaaaaaaaaaaa

SEQ ID NO: 188987 - DNA, 20 bp, Artificial Sequence
  Description of Artificial Sequence: Synthetic oligonucleotide
  Target: ATXN1; (-) strand; PAM type: YTN; PAM sequence: CTG
ggcaacaagagcgaaacctt

SEQ ID NO: 188988 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacaagagcg

SEQ ID NO: 188989 - DNA, 20 bp, Artificial Sequence
  Description of Artificial Sequence: Synthetic oligonucleotide
  Target: ATXN1; (-) strand; PAM type: YTN; PAM sequence: TTG
cactccagcctgggcaacaa

SEQ ID NO: 188990 - DNA, 20 bp, Artificial Sequence
  Description of Artificial Sequence: Synthetic oligonucleotide
  Target: ATXN1; (-) strand; PAM type: YTN; PAM sequence: TTG
cgccattgcactccagcctg

SEQ ID NO: 188991 - DNA, 20 bp, Artificial Sequence
  Description of Artificial Sequence: Synthetic oligonucleotide
  Target: ATXN1; (-) strand; PAM type: YTN; PAM sequence: CTG
agattgcgccattgcactcc

SEQ ID NO: 188992 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagattgcgcc

SEQ ID NO: 188993 - DNA, 20 bp, Artificial Sequence
  Description of Artificial Sequence: Synthetic oligonucleotide
  Target: ATXN1; (-) strand; PAM type: YTN; PAM sequence: CTG
ggaggcagaggttgcagtga

SEQ ID NO: 188994 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcagaggttg

SEQ ID NO: 188995 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcagaggtt

SEQ ID NO: 188996 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgggaggcagag

SEQ ID NO: 188997 - DNA, 20 bp, Artificial Sequence
  Description of Artificial Sequence: Synthetic oligonucleotide
  Target: ATXN1; (-) strand; PAM type: YTN; PAM sequence: CTG
agacaggagaattgcttgaa

SEQ ID NO: 188998 - DNA, 20 bp, Artificial Sequence
  Description of Artificial Sequence: Synthetic oligonucleotide
  Target: ATXN1; (-) strand; PAM type: YTN; PAM sequence: CTC
aggaggctgagacaggagaa

SEQ ID NO: 188999 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgagacagga

SEQ ID NO: 189000 - DNA, 20 bp, Artificial Sequence
  Description of Artificial Sequence: Synthetic oligonucleotide
  Target: ATXN1; (-) strand; PAM type: YTN; PAM sequence: CTG
cagtcccagctactcaggag

SEQ ID NO: 189001 - DNA, 20 bp, Artificial Sequence
  Description of Artificial Sequence: Synthetic oligonucleotide
  Target: ATXN1; (-) strand; PAM type: YTN; PAM sequence: CTG
gtgcctgcagtcccagctac

SEQ ID NO: 189002 - DNA, 20 bp, Artificial Sequence
  Description of Artificial Sequence: Synthetic oligonucleotide
  Target: ATXN1; (-) strand; PAM type: YTN; PAM sequence: TTA
gccgggcgtagtggctggtg

SEQ ID NO: 189003 - DNA, 20 bp, Artificial Sequence
  Description of Artificial Sequence: Synthetic oligonucleotide
  Target: ATXN1; (-) strand; PAM type: YTN; PAM sequence: CTA
aaaataccaaaaattagccg

SEQ ID NO: 189004 - DNA, 20 bp, Artificial Sequence
  Description of Artificial Sequence: Synthetic oligonucleotide
  Target: ATXN1; (-) strand; PAM type: YTN; PAM sequence: CTA
ctaaaaataccaaaaattag

SEQ ID NO: 189005 - DNA, 20 bp, Artificial Sequence
  Description of Artificial Sequence: Synthetic oligonucleotide
  Target: ATXN1; (-) strand; PAM type: YTN; PAM sequence: CTC
tactaaaaataccaaaaatt

SEQ ID NO: 189006 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaataccaaa

SEQ ID NO: 189007 - DNA, 20 bp, Artificial Sequence
  Description of Artificial Sequence: Synthetic oligonucleotide
  Target: ATXN1; (-) strand; PAM type: YTN; PAM sequence: TTG
aacatggccaacatggtgaa

SEQ ID NO: 189008 - DNA, 20 bp, Artificial Sequence
  Description of Artificial Sequence: Synthetic oligonucleotide
  Target: ATXN1; (-) strand; PAM type: YTN; PAM sequence: CTT
gaacatggccaacatggtga

SEQ ID NO: 189009 - DNA, 20 bp, Artificial Sequence
  Description of Artificial Sequence: Synthetic oligonucleotide
  Target: ATXN1; (-) strand; PAM type: YTN; PAM sequence: CTG
tcttgaacatggccaacatg

SEQ ID NO: 189010 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctgtcttgaac

SEQ ID NO: 189011 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttcaagacca

SEQ ID NO: 189012 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttcaagacc

SEQ ID NO: 189013 - DNA, 20 bp, Artificial Sequence
  Description of Artificial Sequence: Synthetic oligonucleotide
  Target: ATXN1; (-) strand; PAM type: YTN; PAM sequence: CTG
aggcaggtggatcacttgag

SEQ ID NO: 189014 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggtggat

SEQ ID NO: 189015 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaggtgga

SEQ ID NO: 189016 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaggtgg

SEQ ID NO: 189017 - DNA, 20 bp, Artificial Sequence
  Description of Artificial Sequence: Synthetic oligonucleotide
  Target: ATXN1; (-) strand; PAM type: YTN; PAM sequence: CTG
taatcccggcactttgggag

SEQ ID NO: 189018 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccggcact

SEQ ID NO: 189019 - DNA, 20 bp, Artificial Sequence
  Description of Artificial Sequence: Synthetic oligonucleotide
  Target: ATXN1; (-) strand; PAM type: YTN; PAM sequence: TTC
cagggatcaggccgggcgcc

SEQ ID NO: 189020 - DNA, 20 bp, Artificial Sequence
  Description of Artificial Sequence: Synthetic oligonucleotide
  Target: ATXN1; (-) strand; PAM type: YTN; PAM sequence: CTA
aaaattccagggatcaggcc

SEQ ID NO: 189021 - DNA, 20 bp, Artificial Sequence
  Description of Artificial Sequence: Synthetic oligonucleotide
  Target: ATXN1; (-) strand; PAM type: YTN; PAM sequence: CTA
tcataatataactaaaaatt

SEQ ID NO: 189022 - DNA, 20 bp, Artificial Sequence
  Description of Artificial Sequence: Synthetic oligonucleotide
  Target: ATXN1; (-) strand; PAM type: YTN; PAM sequence: TTG
gtctatcataatataactaa

SEQ ID NO: 189023 - DNA, 20 bp, Artificial Sequence
  Description of Artificial Sequence: Synthetic oligonucleotide
  Target: ATXN1; (-) strand; PAM type: YTN; PAM sequence: TTT
ggtctatcataatataacta

SEQ ID NO: 189024 - DNA, 20 bp, Artificial Sequence
  Description of Artificial Sequence: Synthetic oligonucleotide
  Target: ATXN1; (-) strand; PAM type: YTN; PAM sequence: TTA
gaatttggtctatcataata

SEQ ID NO: 189025 - DNA, 20 bp, Artificial Sequence
  Description of Artificial Sequence: Synthetic oligonucleotide
  Target: ATXN1; (-) strand; PAM type: YTN; PAM sequence: CTA
cgttagaatttggtctatca

SEQ ID NO: 189026 - DNA, 20 bp, Artificial Sequence
  Description of Artificial Sequence: Synthetic oligonucleotide
  Target: ATXN1; (-) strand; PAM type: YTN; PAM sequence: TTG
tgggctacgttagaatttgg

SEQ ID NO: 189027 - DNA, 20 bp, Artificial Sequence
  Description of Artificial Sequence: Synthetic oligonucleotide
  Target: ATXN1; (-) strand; PAM type: YTN; PAM sequence: CTT
gtgggctacgttagaatttg

SEQ ID NO: 189028 - DNA, 20 bp, Artificial Sequence
  Description of Artificial Sequence: Synthetic oligonucleotide
  Target: ATXN1; (-) strand; PAM type: YTN; PAM sequence: CTG
gcaggggacatggcaatctt

SEQ ID NO: 189029 - DNA, 20 bp, Artificial Sequence
  Description of Artificial Sequence: Synthetic oligonucleotide
  Target: ATXN1; (-) strand; PAM type: YTN; PAM sequence: CTG
ggaagaggtgtgtgtctggc

SEQ ID NO: 189030 - DNA, 20 bp, Artificial Sequence
  Description of Artificial Sequence: Synthetic oligonucleotide
  Target: ATXN1; (-) strand; PAM type: YTN; PAM sequence: CTA
actgggaagaggtgtgtgtc

SEQ ID NO: 189031 - DNA, 20 bp, Artificial Sequence
  Description of Artificial Sequence: Synthetic oligonucleotide
  Target: ATXN1; (-) strand; PAM type: YTN; PAM sequence: CTG
actaactgggaagaggtgtg

SEQ ID NO: 189032 - DNA, 20 bp, Artificial Sequence
  Description of Artificial Sequence: Synthetic oligonucleotide
  Target: ATXN1; (-) strand; PAM type: YTN; PAM sequence: CTG
tcccactgactaactgggaa

SEQ ID NO: 189033 - DNA, 20 bp, Artificial Sequence
  Description of Artificial Sequence: Synthetic oligonucleotide
  Target: ATXN1; (-) strand; PAM type: YTN; PAM sequence: TTA
ctgtcccactgactaactgg

SEQ ID NO: 189034 - DNA, 20 bp, Artificial Sequence
  Description of Artificial Sequence: Synthetic oligonucleotide
  Target: ATXN1; (-) strand; PAM type: YTN; PAM sequence: TTG
attactgtcccactgactaa

SEQ ID NO: 189035 - DNA, 20 bp, Artificial Sequence
  Description of Artificial Sequence: Synthetic oligonucleotide
  Target: ATXN1; (-) strand; PAM type: YTN; PAM sequence: CTT
gattactgtcccactgacta

SEQ ID NO: 189036 - DNA, 20 bp, Artificial Sequence
  Description of Artificial Sequence: Synthetic oligonucleotide
  Target: ATXN1; (-) strand; PAM type: YTN; PAM sequence: TTC
acaacagcagaaccttgatt

SEQ ID NO: 189037 - DNA, 20 bp, Artificial Sequence
  Description of Artificial Sequence: Synthetic oligonucleotide
  Target: ATXN1; (-) strand; PAM type: YTN; PAM sequence: CTT
cacaacagcagaaccttgat

SEQ ID NO: 189038 - DNA, 20 bp, Artificial Sequence
  Description of Artificial Sequence: Synthetic oligonucleotide
  Target: ATXN1; (-) strand; PAM type: YTN; PAM sequence: TTG
caaaatcccttcacaacagc

SEQ ID NO: 189039 - DNA, 20 bp, Artificial Sequence
  Description of Artificial Sequence: Synthetic oligonucleotide
  Target: ATXN1; (-) strand; PAM type: YTN; PAM sequence: TTT
gcaaaatcccttcacaacag

SEQ ID NO: 189040 - DNA, 20 bp, Artificial Sequence
  Description of Artificial Sequence: Synthetic oligonucleotide
  Target: ATXN1; (-) strand; PAM type: YTN; PAM sequence: TTA
tatttgcaaaatcccttcac

SEQ ID NO: 189041 - DNA, 20 bp, Artificial Sequence
  Description of Artificial Sequence: Synthetic oligonucleotide
  Target: ATXN1; (-) strand; PAM type: YTN; PAM sequence: CTT
atatttgcaaaatcccttca

SEQ ID NO: 189042 - DNA, 20 bp, Artificial Sequence
  Description of Artificial Sequence: Synthetic oligonucleotide
  Target: ATXN1; (-) strand; PAM type: YTN; PAM sequence: CTC
acttatatttgcaaaatccc

SEQ ID NO: 189043 - DNA, 20 bp, Artificial Sequence
  Description of Artificial Sequence: Synthetic oligonucleotide
  Target: ATXN1; (-) strand; PAM type: YTN; PAM sequence: TTG
gacctcacttatatttgcaa

SEQ ID NO: 189044 - DNA, 20 bp, Artificial Sequence
  Description of Artificial Sequence: Synthetic oligonucleotide
  Target: ATXN1; (-) strand; PAM type: YTN; PAM sequence: TTT
ggacctcacttatatttgca

SEQ ID NO: 189045 - DNA, 20 bp, Artificial Sequence
  Description of Artificial Sequence: Synthetic oligonucleotide
  Target: ATXN1; (-) strand; PAM type: YTN; PAM sequence: CTT
tggacctcacttatatttgc

SEQ ID NO: 189046 - DNA, 20 bp, Artificial Sequence
  Description of Artificial Sequence: Synthetic oligonucleotide
  Target: ATXN1; (-) strand; PAM type: YTN; PAM sequence: TTG
actttggacctcacttatat

SEQ ID NO: 189047 - DNA, 20 bp, Artificial Sequence
  Description of Artificial Sequence: Synthetic oligonucleotide
  Target: ATXN1; (-) strand; PAM type: YTN; PAM sequence: TTG
gttgactttggacctcactt

SEQ ID NO: 189048 - DNA, 20 bp, Artificial Sequence
  Description of Artificial Sequence: Synthetic oligonucleotide
  Target: ATXN1; (-) strand; PAM type: YTN; PAM sequence: TTA
aggttggttgactttggacc

SEQ ID NO: 189049 - DNA, 20 bp, Artificial Sequence
  Description of Artificial Sequence: Synthetic oligonucleotide
  Target: ATXN1; (-) strand; PAM type: YTN; PAM sequence: TTT
aaggttggttgactttggac

SEQ ID NO: 189050 - DNA, 20 bp, Artificial Sequence
  Description of Artificial Sequence: Synthetic oligonucleotide
  Target: ATXN1; (-) strand; PAM type: YTN; PAM sequence: TTT
taaggttggttgactttgga

SEQ ID NO: 189051 - DNA, 20 bp, Artificial Sequence
  Description of Artificial Sequence: Synthetic oligonucleotide
  Target: ATXN1; (-) strand; PAM type: YTN; PAM sequence: CTA
ttttaaggttggttgacttt

SEQ ID NO: 189052 - DNA, 20 bp, Artificial Sequence
  Description of Artificial Sequence: Synthetic oligonucleotide
  Target: ATXN1; (-) strand; PAM type: YTN; PAM sequence: CTC
tattttaaggttggttgact

SEQ ID NO: 189053 - DNA, 20 bp, Artificial Sequence
  Description of Artificial Sequence: Synthetic oligonucleotide
  Target: ATXN1; (-) strand; PAM type: YTN; PAM sequence: CTC
tctattttaaggttggttga

SEQ ID NO: 189054 - DNA, 20 bp, Artificial Sequence
  Description of Artificial Sequence: Synthetic oligonucleotide
  Target: ATXN1; (-) strand; PAM type: YTN; PAM sequence: CTC
accaagataatctctctatt

SEQ ID NO: 189055 - DNA, 20 bp, Artificial Sequence
  Description of Artificial Sequence: Synthetic oligonucleotide
  Target: ATXN1; (-) strand; PAM type: YTN; PAM sequence: TTA
gatcaggctcaccaagataa

SEQ ID NO: 189056 - DNA, 20 bp, Artificial Sequence
  Description of Artificial Sequence: Synthetic oligonucleotide
  Target: ATXN1; (-) strand; PAM type: YTN; PAM sequence: TTA
attagatcaggctcaccaag

SEQ ID NO: 189057 - DNA, 20 bp, Artificial Sequence
  Description of Artificial Sequence: Synthetic oligonucleotide
  Target: ATXN1; (-) strand; PAM type: YTN; PAM sequence: CTT
aattagatcaggctcaccaa

SEQ ID NO: 189058 - DNA, 20 bp, Artificial Sequence
  Description of Artificial Sequence: Synthetic oligonucleotide
  Target: ATXN1; (-) strand; PAM type: YTN; PAM sequence: CTC
ttaattagatcaggctcacc

SEQ ID NO: 189059 - DNA, 20 bp, Artificial Sequence
  Description of Artificial Sequence: Synthetic oligonucleotide
  Target: ATXN1; (-) strand; PAM type: YTN; PAM sequence: TTC
tcttaattagatcaggctca

SEQ ID NO: 189060 - DNA, 20 bp, Artificial Sequence
  Description of Artificial Sequence: Synthetic oligonucleotide
  Target: ATXN1; (-) strand; PAM type: YTN; PAM sequence: TTA
gggttctcttaattagatca

SEQ ID NO: 189061 - DNA, 20 bp, Artificial Sequence
  Description of Artificial Sequence: Synthetic oligonucleotide
  Target: ATXN1; (-) strand; PAM type: YTN; PAM sequence: TTT
agggttctcttaattagatc

SEQ ID NO: 189062 - DNA, 20 bp, Artificial Sequence
  Description of Artificial Sequence: Synthetic oligonucleotide
  Target: ATXN1; (-) strand; PAM type: YTN; PAM sequence: TTT
tagggttctcttaattagat

SEQ ID NO: 189063 - DNA, 20 bp, Artificial Sequence
  Description of Artificial Sequence: Synthetic oligonucleotide
  Target: ATXN1; (-) strand; PAM type: YTN; PAM sequence: CTT
ttagggttctcttaattaga

SEQ ID NO: 189064 - DNA, 20 bp, Artificial Sequence
  Description of Artificial Sequence: Synthetic oligonucleotide
  Target: ATXN1; (-) strand; PAM type: YTN; PAM sequence: CTG
gtaaagccccatccctttta

SEQ ID NO: 189065 - DNA, 20 bp, Artificial Sequence
  Description of Artificial Sequence: Synthetic oligonucleotide
  Target: ATXN1; (-) strand; PAM type: YTN; PAM sequence: TTC
ctggtaaagccccatccctt

SEQ ID NO: 189066 - DNA, 20 bp, Artificial Sequence
  Description of Artificial Sequence: Synthetic oligonucleotide
  Target: ATXN1; (-) strand; PAM type: YTN; PAM sequence: CTC
attcctggtaaagccccatc

SEQ ID NO: 189067 - DNA, 20 bp, Artificial Sequence
  Description of Artificial Sequence: Synthetic oligonucleotide
  Target: ATXN1; (-) strand; PAM type: YTN; PAM sequence: TTG
aatctcattcctggtaaagc

SEQ ID NO: 189068 - DNA, 20 bp, Artificial Sequence
  Description of Artificial Sequence: Synthetic oligonucleotide
  Target: ATXN1; (-) strand; PAM type: YTN; PAM sequence: TTT
gaatctcattcctggtaaag

SEQ ID NO: 189069 - DNA, 20 bp, Artificial Sequence
  Description of Artificial Sequence: Synthetic oligonucleotide
  Target: ATXN1; (-) strand; PAM type: YTN; PAM sequence: CTT
tgaatctcattcctggtaaa

SEQ ID NO: 189070 - DNA, 20 bp, Artificial Sequence
  Description of Artificial Sequence: Synthetic oligonucleotide
  Target: ATXN1; (-) strand; PAM type: YTN; PAM sequence: CTC
actttgaatctcattcctgg

SEQ ID NO: 189071 - DNA, 20 bp, Artificial Sequence
  Description of Artificial Sequence: Synthetic oligonucleotide
  Target: ATXN1; (-) strand; PAM type: YTN; PAM sequence: CTC
tcactttgaatctcattcct

SEQ ID NO: 189072 - DNA, 20 bp, Artificial Sequence
  Description of Artificial Sequence: Synthetic oligonucleotide
  Target: ATXN1; (-) strand; PAM type: YTN; PAM sequence: CTC
tctcactttgaatctcattc

SEQ ID NO: 189073 - DNA, 20 bp, Artificial Sequence
  Description of Artificial Sequence: Synthetic oligonucleotide
  Target: ATXN1; (-) strand; PAM type: YTN; PAM sequence: CTC
catcaacatgtcctctctca

SEQ ID NO: 189074 - DNA, 20 bp, Artificial Sequence
  Description of Artificial Sequence: Synthetic oligonucleotide
  Target: ATXN1; (-) strand; PAM type: YTN; PAM sequence: CTC
ctccatcaacatgtcctctc

SEQ ID NO: 189075 - DNA, 20 bp, Artificial Sequence
  Description of Artificial Sequence: Synthetic oligonucleotide
  Target: ATXN1; (-) strand; PAM type: YTN; PAM sequence: TTG
cctcctccatcaacatgtcc

SEQ ID NO: 189076 - DNA, 20 bp, Artificial Sequence
  Description of Artificial Sequence: Synthetic oligonucleotide
  Target: ATXN1; (-) strand; PAM type: YTN; PAM sequence: CTT
gcctcctccatcaacatgtc

SEQ ID NO: 189077 - DNA, 20 bp, Artificial Sequence
  Description of Artificial Sequence: Synthetic oligonucleotide
  Target: ATXN1; (-) strand; PAM type: YTN; PAM sequence: TTG
ccatatgacttgcctcctcc

SEQ ID NO: 189078 - DNA, 20 bp, Artificial Sequence
  Description of Artificial Sequence: Synthetic oligonucleotide
  Target: ATXN1; (-) strand; PAM type: YTN; PAM sequence: CTT
gccatatgacttgcctcctc

SEQ ID NO: 189079 - DNA, 20 bp, Artificial Sequence
  Description of Artificial Sequence: Synthetic oligonucleotide
  Target: ATXN1; (-) strand; PAM type: YTN; PAM sequence: TTC
cttgccatatgacttgcctc

SEQ ID NO: 189080 - DNA, 20 bp, Artificial Sequence
  Description of Artificial Sequence: Synthetic oligonucleotide
  Target: ATXN1; (-) strand; PAM type: YTN; PAM sequence: TTC
agttccttgccatatgactt

SEQ ID NO: 189081 - DNA, 20 bp, Artificial Sequence
  Description of Artificial Sequence: Synthetic oligonucleotide
  Target: ATXN1; (-) strand; PAM type: YTN; PAM sequence: CTT
cagttccttgccatatgact

SEQ ID NO: 189082 - DNA, 20 bp, Artificial Sequence
  Description of Artificial Sequence: Synthetic oligonucleotide
  Target: ATXN1; (-) strand; PAM type: YTN; PAM sequence: TTC
accttcagttccttgccata

SEQ ID NO: 189083 - DNA, 20 bp, Artificial Sequence
  Description of Artificial Sequence: Synthetic oligonucleotide
  Target: ATXN1; (-) strand; PAM type: YTN; PAM sequence: CTG
gcattcaccttcagttcctt

SEQ ID NO: 189084 - DNA, 20 bp, Artificial Sequence
  Description of Artificial Sequence: Synthetic oligonucleotide
  Target: ATXN1; (-) strand; PAM type: YTN; PAM sequence: CTC
aggtcctggcattcaccttc

SEQ ID NO: 189085 - DNA, 20 bp, Artificial Sequence
  Description of Artificial Sequence: Synthetic oligonucleotide
  Target: ATXN1; (-) strand; PAM type: YTN; PAM sequence: CTC
tcaggtcctggcattcacct

SEQ ID NO: 189086 - DNA, 20 bp, Artificial Sequence
  Description of Artificial Sequence: Synthetic oligonucleotide
  Target: ATXN1; (-) strand; PAM type: YTN; PAM sequence: CTG
ggggccactctcaggtcctg

SEQ ID NO: 189087 - DNA, 20 bp, Artificial Sequence
  Description of Artificial Sequence: Synthetic oligonucleotide
  Target: ATXN1; (-) strand; PAM type: YTN; PAM sequence: CTG
tgagctgggggccactctca

SEQ ID NO: 189088 - DNA, 20 bp, Artificial Sequence
  Description of Artificial Sequence: Synthetic oligonucleotide
  Target: ATXN1; (-) strand; PAM type: YTN; PAM sequence: CTG
gctgtgagctgggggccact

SEQ ID NO: 189089 - DNA, 20 bp, Artificial Sequence
  Description of Artificial Sequence: Synthetic oligonucleotide
  Target: ATXN1; (-) strand; PAM type: YTN; PAM sequence: TTG
ctggctgtgagctgggggcc

SEQ ID NO: 189090 - DNA, 20 bp, Artificial Sequence
  Description of Artificial Sequence: Synthetic oligonucleotide
  Target: ATXN1; (-) strand; PAM type: YTN; PAM sequence: TTC
cattgctggctgtgagctgg

SEQ ID NO: 189091 - DNA, 20 bp, Artificial Sequence
  Description of Artificial Sequence: Synthetic oligonucleotide
  Target: ATXN1; (-) strand; PAM type: YTN; PAM sequence: TTG
tggtcgtaggaccaaggtcc

SEQ ID NO: 189092 - DNA, 20 bp, Artificial Sequence
  Description of Artificial Sequence: Synthetic oligonucleotide
  Target: ATXN1; (-) strand; PAM type: YTN; PAM sequence: CTT
gtggtcgtaggaccaaggtc

SEQ ID NO: 189093 - DNA, 20 bp, Artificial Sequence
  Description of Artificial Sequence: Synthetic oligonucleotide
  Target: ATXN1; (-) strand; PAM type: YTN; PAM sequence: TTC
ttgtggtcgtaggaccaagg

SEQ ID NO: 189094 - DNA, 20 bp, Artificial Sequence
  Description of Artificial Sequence: Synthetic oligonucleotide
  Target: ATXN1; (-) strand; PAM type: YTN; PAM sequence: TTT
cttgtggtcgtaggaccaag

SEQ ID NO: 189095 - DNA, 20 bp, Artificial Sequence
  Description of Artificial Sequence: Synthetic oligonucleotide
  Target: ATXN1; (-) strand; PAM type: YTN; PAM sequence: TTA
gtttcttgtggtcgtaggac

SEQ ID NO: 189096 - DNA, 20 bp, Artificial Sequence
  Description of Artificial Sequence: Synthetic oligonucleotide
  Target: ATXN1; (-) strand; PAM type: YTN; PAM sequence: TTT
agtttcttgtggtcgtagga

SEQ ID NO: 189097 - DNA, 20 bp, Artificial Sequence
  Description of Artificial Sequence: Synthetic oligonucleotide
  Target: ATXN1; (-) strand; PAM type: YTN; PAM sequence: TTG
tatttagtttcttgtggtcg

SEQ ID NO: 189098 - DNA, 20 bp, Artificial Sequence
  Description of Artificial Sequence: Synthetic oligonucleotide
  Target: ATXN1; (-) strand; PAM type: YTN; PAM sequence: TTT
gtatttagtttcttgtggtc

SEQ ID NO: 189099 - DNA, 20 bp, Artificial Sequence
  Description of Artificial Sequence: Synthetic oligonucleotide
  Target: ATXN1; (-) strand; PAM type: YTN; PAM sequence: TTT
tgtatttagtttcttgtggt

SEQ ID NO: 189100 - DNA, 20 bp, Artificial Sequence
  Description of Artificial Sequence: Synthetic oligonucleotide
  Target: ATXN1; (-) strand; PAM type: YTN; PAM sequence: TTT
ttgtatttagtttcttgtgg

SEQ ID NO: 189101 - DNA, 20 bp, Artificial Sequence
  Description of Artificial Sequence: Synthetic oligonucleotide
  Target: ATXN1; (-) strand; PAM type: YTN; PAM sequence: TTT
tttgtatttagtttcttgtg

SEQ ID NO: 189102 - DNA, 20 bp, Artificial Sequence
  Description of Artificial Sequence: Synthetic oligonucleotide
  Target: ATXN1; (-) strand; PAM type: YTN; PAM sequence: CTC
acatggttttttgtatttag

SEQ ID NO: 189103 - DNA, 20 bp, Artificial Sequence
  Description of Artificial Sequence: Synthetic oligonucleotide
  Target: ATXN1; (-) strand; PAM type: YTN; PAM sequence: TTC
aagctcacatggttttttgt

SEQ ID NO: 189104 - DNA, 20 bp, Artificial Sequence
  Description of Artificial Sequence: Synthetic oligonucleotide
  Target: ATXN1; (-) strand; PAM type: YTN; PAM sequence: TTT
caagctcacatggttttttg

SEQ ID NO: 189105 - DNA, 20 bp, Artificial Sequence
  Description of Artificial Sequence: Synthetic oligonucleotide
  Target: ATXN1; (-) strand; PAM type: YTN; PAM sequence: TTT
tcaagctcacatggtttttt

SEQ ID NO: 189106 - DNA, 20 bp, Artificial Sequence
  Description of Artificial Sequence: Synthetic oligonucleotide
  Target: ATXN1; (-) strand; PAM type: YTN; PAM sequence: TTT
ttcaagctcacatggttttt

SEQ ID NO: 189107 - DNA, 20 bp, Artificial Sequence
  Description of Artificial Sequence: Synthetic oligonucleotide
  Target: ATXN1; (-) strand; PAM type: YTN; PAM sequence: CTT
tttcaagctcacatggtttt

SEQ ID NO: 189108 - DNA, 20 bp, Artificial Sequence
  Description of Artificial Sequence: Synthetic oligonucleotide
  Target: ATXN1; (-) strand; PAM type: YTN; PAM sequence: CTC
atggtcctttttcaagctca

SEQ ID NO: 189109 - DNA, 20 bp, Artificial Sequence
  Description of Artificial Sequence: Synthetic oligonucleotide
  Target: ATXN1; (-) strand; PAM type: YTN; PAM sequence: CTG
gagctcatggtcctttttca

SEQ ID NO: 189110 - DNA, 20 bp, Artificial Sequence
  Description of Artificial Sequence: Synthetic oligonucleotide
  Target: ATXN1; (-) strand; PAM type: YTN; PAM sequence: TTA
tctggagctcatggtccttt

SEQ ID NO: 189111 - DNA, 20 bp, Artificial Sequence
  Description of Artificial Sequence: Synthetic oligonucleotide
  Target: ATXN1; (-) strand; PAM type: YTN; PAM sequence: TTA
ttatctggagctcatggtcc

SEQ ID NO: 189112 - DNA, 20 bp, Artificial Sequence
  Description of Artificial Sequence: Synthetic oligonucleotide
  Target: ATXN1; (-) strand; PAM type: YTN; PAM sequence: CTT
attatctggagctcatggtc

SEQ ID NO: 189113 - DNA, 20 bp, Artificial Sequence
  Description of Artificial Sequence: Synthetic oligonucleotide
  Target: ATXN1; (-) strand; PAM type: YTN; PAM sequence: CTG
ccttattatctggagctcat

SEQ ID NO: 189114 - DNA, 20 bp, Artificial Sequence
  Description of Artificial Sequence: Synthetic oligonucleotide
  Target: ATXN1; (-) strand; PAM type: YTN; PAM sequence: TTG
aggtgtcaacagggctgcct

SEQ ID NO: 189115 - DNA, 20 bp, Artificial Sequence
  Description of Artificial Sequence: Synthetic oligonucleotide
  Target: ATXN1; (-) strand; PAM type: YTN; PAM sequence: CTG
aaattgaggtgtcaacaggg

SEQ ID NO: 189116 - DNA, 20 bp, Artificial Sequence
  Description of Artificial Sequence: Synthetic oligonucleotide
  Target: ATXN1; (-) strand; PAM type: YTN; PAM sequence: TTC
ataagactgaaattgaggtg

SEQ ID NO: 189117 - DNA, 20 bp, Artificial Sequence
  Description of Artificial Sequence: Synthetic oligonucleotide
  Target: ATXN1; (-) strand; PAM type: YTN; PAM sequence: TTT
cataagactgaaattgaggt

SEQ ID NO: 189118 - DNA, 20 bp, Artificial Sequence
  Description of Artificial Sequence: Synthetic oligonucleotide
  Target: ATXN1; (-) strand; PAM type: YTN; PAM sequence: TTC
agggtttcataagactgaaa

SEQ ID NO: 189119 - DNA, 20 bp, Artificial Sequence
  Description of Artificial Sequence: Synthetic oligonucleotide
  Target: ATXN1; (-) strand; PAM type: YTN; PAM sequence: CTG
ttcagggtttcataagactg

SEQ ID NO: 189120 - DNA, 20 bp, Artificial Sequence
  Description of Artificial Sequence: Synthetic oligonucleotide
  Target: ATXN1; (-) strand; PAM type: YTN; PAM sequence: TTA
tctgttcagggtttcataag

SEQ ID NO: 189121 - DNA, 20 bp, Artificial Sequence
  Description of Artificial Sequence: Synthetic oligonucleotide
  Target: ATXN1; (-) strand; PAM type: YTN; PAM sequence: CTG
aattatctgttcagggtttc

SEQ ID NO: 189122 - DNA, 20 bp, Artificial Sequence
  Description of Artificial Sequence: Synthetic oligonucleotide
  Target: ATXN1; (-) strand; PAM type: YTN; PAM sequence: TTA
gctgaattatctgttcaggg

SEQ ID NO: 189123 - DNA, 20 bp, Artificial Sequence
  Description of Artificial Sequence: Synthetic oligonucleotide
  Target: ATXN1; (-) strand; PAM type: YTN; PAM sequence: CTT
agctgaattatctgttcagg

SEQ ID NO: 189124 - DNA, 20 bp, Artificial Sequence
  Description of Artificial Sequence: Synthetic oligonucleotide
  Target: ATXN1; (-) strand; PAM type: YTN; PAM sequence: TTG
gaggtccgaagtccaggcat

SEQ ID NO: 189125 - DNA, 20 bp, Artificial Sequence
  Description of Artificial Sequence: Synthetic oligonucleotide
  Target: ATXN1; (-) strand; PAM type: YTN; PAM sequence: CTG
ttggaggtccgaagtccagg

SEQ ID NO: 189126 - DNA, 20 bp, Artificial Sequence
  Description of Artificial Sequence: Synthetic oligonucleotide
  Target: ATXN1; (-) strand; PAM type: YTN; PAM sequence: TTA
tctgttggaggtccgaagtc

SEQ ID NO: 189127 - DNA, 20 bp, Artificial Sequence
  Description of Artificial Sequence: Synthetic oligonucleotide
  Target: ATXN1; (-) strand; PAM type: YTN; PAM sequence: TTG
aattatctgttggaggtccg

SEQ ID NO: 189128 - DNA, 20 bp, Artificial Sequence
  Description of Artificial Sequence: Synthetic oligonucleotide
  Target: ATXN1; (-) strand; PAM type: YTN; PAM sequence: TTA
gttgaattatctgttggagg

SEQ ID NO: 189129 - DNA, 20 bp, Artificial Sequence
  Description of Artificial Sequence: Synthetic oligonucleotide
  Target: ATXN1; (-) strand; PAM type: YTN; PAM sequence: CTT
agttgaattatctgttggag

SEQ ID NO: 189130 - DNA, 20 bp, Artificial Sequence
  Description of Artificial Sequence: Synthetic oligonucleotide
  Target: ATXN1; (-) strand; PAM type: YTN; PAM sequence: CTG
gaggtgcgaagtccaggcat

SEQ ID NO: 189131 - DNA, 20 bp, Artificial Sequence
  Description of Artificial Sequence: Synthetic oligonucleotide
  Target: ATXN1; (-) strand; PAM type: YTN; PAM sequence: TTC
tggaggtgcgaagtccaggc

SEQ ID NO: 189132 - DNA, 20 bp, Artificial Sequence
  Description of Artificial Sequence: Synthetic oligonucleotide
  Target: ATXN1; (-) strand; PAM type: YTN; PAM sequence: TTT
ctggaggtgcgaagtccagg

SEQ ID NO: 189133 - DNA, 20 bp, Artificial Sequence
  Description of Artificial Sequence: Synthetic oligonucleotide
  Target: ATXN1; (-) strand; PAM type: YTN; PAM sequence: CTC
acagtttctggaggtgcgaa

SEQ ID NO: 189134 - DNA, 20 bp, Artificial Sequence
  Description of Artificial Sequence: Synthetic oligonucleotide
  Target: ATXN1; (-) strand; PAM type: YTN; PAM sequence: TTA
tctcacagtttctggaggtg

SEQ ID NO: 189135 - DNA, 20 bp, Artificial Sequence
  Description of Artificial Sequence: Synthetic oligonucleotide
  Target: ATXN1; (-) strand; PAM type: YTN; PAM sequence: TTA
ttatctcacagtttctggag

SEQ ID NO: 189136 - DNA, 20 bp, Artificial Sequence
  Description of Artificial Sequence: Synthetic oligonucleotide
  Target: ATXN1; (-) strand; PAM type: YTN; PAM sequence: TTT
attatctcacagtttctgga

SEQ ID NO: 189137 - DNA, 20 bp, Artificial Sequence
  Description of Artificial Sequence: Synthetic oligonucleotide
  Target: ATXN1; (-) strand; PAM type: YTN; PAM sequence: CTA
tttattatctcacagtttct

SEQ ID NO: 189138 - DNA, 20 bp, Artificial Sequence
  Description of Artificial Sequence: Synthetic oligonucleotide
  Target: ATXN1; (-) strand; PAM type: YTN; PAM sequence: CTA
taacaatacctatttattat

SEQ ID NO: 189139 - DNA, 20 bp, Artificial Sequence
  Description of Artificial Sequence: Synthetic oligonucleotide
  Target: ATXN1; (-) strand; PAM type: YTN; PAM sequence: TTC
ccacctataacaatacctat

SEQ ID NO: 189140 - DNA, 20 bp, Artificial Sequence
  Description of Artificial Sequence: Synthetic oligonucleotide
  Target: ATXN1; (-) strand; PAM type: YTN; PAM sequence: TTC
aattcccacctataacaata

SEQ ID NO: 189141 - DNA, 20 bp, Artificial Sequence
  Description of Artificial Sequence: Synthetic oligonucleotide
  Target: ATXN1; (-) strand; PAM type: YTN; PAM sequence: TTG
ttcaattcccacctataaca

SEQ ID NO: 189142 - DNA, 20 bp, Artificial Sequence
  Description of Artificial Sequence: Synthetic oligonucleotide
  Target: ATXN1; (-) strand; PAM type: YTN; PAM sequence: CTC
attgttcaattcccacctat

SEQ ID NO: 189143 - DNA, 20 bp, Artificial Sequence
  Description of Artificial Sequence: Synthetic oligonucleotide
  Target: ATXN1; (-) strand; PAM type: YTN; PAM sequence: TTC
tcattgttcaattcccacct

SEQ ID NO: 189144 - DNA, 20 bp, Artificial Sequence
  Description of Artificial Sequence: Synthetic oligonucleotide
  Target: ATXN1; (-) strand; PAM type: YTN; PAM sequence: CTG
tgtccatgtgttctcattgt

SEQ ID NO: 189145 - DNA, 20 bp, Artificial Sequence
  Description of Artificial Sequence: Synthetic oligonucleotide
  Target: ATXN1; (-) strand; PAM type: YTN; PAM sequence: TTC
ctgtgtccatgtgttctcat

SEQ ID NO: 189146 - DNA, 20 bp, Artificial Sequence
  Description of Artificial Sequence: Synthetic oligonucleotide
  Target: ATXN1; (-) strand; PAM type: YTN; PAM sequence: CTT
cctgtgtccatgtgttctca

SEQ ID NO: 189147 - DNA, 20 bp, Artificial Sequence
  Description of Artificial Sequence: Synthetic oligonucleotide
  Target: ATXN1; (-) strand; PAM type: YTN; PAM sequence: TTC
cccttcctgtgtccatgtgt

SEQ ID NO: 189148 - DNA, 20 bp, Artificial Sequence
  Description of Artificial Sequence: Synthetic oligonucleotide
  Target: ATXN1; (-) strand; PAM type: YTN; PAM sequence: CTA
cagtccccagagtgtgatgt

SEQ ID NO: 189149 - DNA, 20 bp, Artificial Sequence
  Description of Artificial Sequence: Synthetic oligonucleotide
  Target: ATXN1; (-) strand; PAM type: YTN; PAM sequence: CTC
cccccaccccactacagtcc

SEQ ID NO: 189150 - DNA, 20 bp, Artificial Sequence
  Description of Artificial Sequence: Synthetic oligonucleotide
  Target: ATXN1; (-) strand; PAM type: YTN; PAM sequence: CTC
cccgctccccccaccccact

SEQ ID NO: 189151 - DNA, 20 bp, Artificial Sequence
  Description of Artificial Sequence: Synthetic oligonucleotide
  Target: ATXN1; (-) strand; PAM type: YTN; PAM sequence: CTA
tccctccccgctccccccac

SEQ ID NO: 189152 - DNA, 20 bp, Artificial Sequence
  Description of Artificial Sequence: Synthetic oligonucleotide
  Target: ATXN1; (-) strand; PAM type: YTN; PAM sequence: CTA
atgctatccctccccgctcc

SEQ ID NO: 189153 - DNA, 20 bp, Artificial Sequence
  Description of Artificial Sequence: Synthetic oligonucleotide
  Target: ATXN1; (-) strand; PAM type: YTN; PAM sequence: CTC
ctaatgctatccctccccgc

SEQ ID NO: 189154 - DNA, 20 bp, Artificial Sequence
  Description of Artificial Sequence: Synthetic oligonucleotide
  Target: ATXN1; (-) strand; PAM type: YTN; PAM sequence: TTA
ggtatatctcctaatgctat

SEQ ID NO: 189155 - DNA, 20 bp, Artificial Sequence
  Description of Artificial Sequence: Synthetic oligonucleotide
  Target: ATXN1; (-) strand; PAM type: YTN; PAM sequence: CTA
gcattaggtatatctcctaa

SEQ ID NO: 189156 - DNA, 20 bp, Artificial Sequence
  Description of Artificial Sequence: Synthetic oligonucleotide
  Target: ATXN1; (-) strand; PAM type: YTN; PAM sequence: CTC
gtcatctagcattaggtata

SEQ ID NO: 189157 - DNA, 20 bp, Artificial Sequence
  Description of Artificial Sequence: Synthetic oligonucleotide
  Target: ATXN1; (-) strand; PAM type: YTN; PAM sequence: TTA
actcgtcatctagcattagg

SEQ ID NO: 189158 - DNA, 20 bp, Artificial Sequence
  Description of Artificial Sequence: Synthetic oligonucleotide
  Target: ATXN1; (-) strand; PAM type: YTN; PAM sequence: CTG
cacccattaactcgtcatct

SEQ ID NO: 189159 - DNA, 20 bp, Artificial Sequence
  Description of Artificial Sequence: Synthetic oligonucleotide
  Target: ATXN1; (-) strand; PAM type: YTN; PAM sequence: CTG
gtgtgctgcacccattaact

SEQ ID NO: 189160 - DNA, 20 bp, Artificial Sequence
  Description of Artificial Sequence: Synthetic oligonucleotide
  Target: ATXN1; (-) strand; PAM type: YTN; PAM sequence: TTA
catatgtatacatgtgccat

SEQ ID NO: 189161 - DNA, 20 bp, Artificial Sequence
  Description of Artificial Sequence: Synthetic oligonucleotide
  Target: ATXN1; (-) strand; PAM type: YTN; PAM sequence: TTA
gttacatatgtatacatgtg

SEQ ID NO: 189162 - DNA, 20 bp, Artificial Sequence
  Description of Artificial Sequence: Synthetic oligonucleotide
  Target: ATXN1; (-) strand; PAM type: YTN; PAM sequence: TTA
gggtacatgtgcacaatgtg

SEQ ID NO: 189163 - DNA, 20 bp, Artificial Sequence
  Description of Artificial Sequence: Synthetic oligonucleotide
  Target: ATXN1; (-) strand; PAM type: YTN; PAM sequence: TTT
agggtacatgtgcacaatgt

SEQ ID NO: 189164 - DNA, 20 bp, Artificial Sequence
  Description of Artificial Sequence: Synthetic oligonucleotide
  Target: ATXN1; (-) strand; PAM type: YTN; PAM sequence: TTT
tagggtacatgtgcacaatg

SEQ ID NO: 189165 - DNA, 20 bp, Artificial Sequence
  Description of Artificial Sequence: Synthetic oligonucleotide
  Target: ATXN1; (-) strand; PAM type: YTN; PAM sequence: TTA
ggttttagggtacatgtgca

SEQ ID NO: 189166 - DNA, 20 bp, Artificial Sequence
  Description of Artificial Sequence: Synthetic oligonucleotide
  Target: ATXN1; (-) strand; PAM type: YTN; PAM sequence: TTT
aggttttagggtacatgtgc

SEQ ID NO: 189167 - DNA, 20 bp, Artificial Sequence
  Description of Artificial Sequence: Synthetic oligonucleotide
  Target: ATXN1; (-) strand; PAM type: YTN; PAM sequence: CTT
taggttttagggtacatgtg

SEQ ID NO: 189168 - DNA, 20 bp, Artificial Sequence
  Description of Artificial Sequence: Synthetic oligonucleotide
  Target: ATXN1; (-) strand; PAM type: YTN; PAM sequence: TTA
tactttaggttttagggtac

SEQ ID NO: 189169 - DNA, 20 bp, Artificial Sequence
  Description of Artificial Sequence: Synthetic oligonucleotide
  Target: ATXN1; (-) strand; PAM type: YTN; PAM sequence: TTA
ttatactttaggttttaggg

SEQ ID NO: 189170 - DNA, 20 bp, Artificial Sequence
  Description of Artificial Sequence: Synthetic oligonucleotide
  Target: ATXN1; (-) strand; PAM type: YTN; PAM sequence: TTA
ttattatactttaggtttta

SEQ ID NO: 189171 - DNA, 20 bp, Artificial Sequence
  Description of Artificial Sequence: Synthetic oligonucleotide
  Target: ATXN1; (-) strand; PAM type: YTN; PAM sequence: TTA
ttattattatactttaggtt

SEQ ID NO: 189172 - DNA, 20 bp, Artificial Sequence
  Description of Artificial Sequence: Synthetic oligonucleotide
  Target: ATXN1; (-) strand; PAM type: YTN; PAM sequence: TTA
tgttattattattatacttt

SEQ ID NO: 189173 - DNA, 20 bp, Artificial Sequence
  Description of Artificial Sequence: Synthetic oligonucleotide
  Target: ATXN1; (-) strand; PAM type: YTN; PAM sequence: TTT
atgttattattattatactt

SEQ ID NO: 189174 - DNA, 20 bp, Artificial Sequence
  Description of Artificial Sequence: Synthetic oligonucleotide
  Target: ATXN1; (-) strand; PAM type: YTN; PAM sequence: TTT
tatgttattattattatact

SEQ ID NO: 189175 - DNA, 20 bp, Artificial Sequence
  Description of Artificial Sequence: Synthetic oligonucleotide
  Target: ATXN1; (-) strand; PAM type: YTN; PAM sequence: TTT
ttatgttattattattatac

SEQ ID NO: 189176 - DNA, 20 bp, Artificial Sequence
  Description of Artificial Sequence: Synthetic oligonucleotide
  Target: ATXN1; (-) strand; PAM type: YTN; PAM sequence: TTT
tttatgttattattattata

SEQ ID NO: 189177 - DNA, 20 bp, Artificial Sequence
  Description of Artificial Sequence: Synthetic oligonucleotide
  Target: ATXN1; (-) strand; PAM type: YTN; PAM sequence: TTA
ttttttatgttattattatt

SEQ ID NO: 189178 - DNA, 20 bp, Artificial Sequence
  Description of Artificial Sequence: Synthetic oligonucleotide
  Target: ATXN1; (-) strand; PAM type: YTN; PAM sequence: TTT
attttttatgttattattat

SEQ ID NO: 189179 - DNA, 20 bp, Artificial Sequence
  Description of Artificial Sequence: Synthetic oligonucleotide
  Target: ATXN1; (-) strand; PAM type: YTN; PAM sequence: TTT
tattttttatgttattatta

SEQ ID NO: 189180 - DNA, 20 bp, Artificial Sequence
  Description of Artificial Sequence: Synthetic oligonucleotide
  Target: ATXN1; (-) strand; PAM type: YTN; PAM sequence: TTT
ttattttttatgttattatt

SEQ ID NO: 189181 - DNA, 20 bp, Artificial Sequence
  Description of Artificial Sequence: Synthetic oligonucleotide
  Target: ATXN1; (-) strand; PAM type: YTN; PAM sequence: TTT
tttattttttatgttattat

SEQ ID NO: 189182 - DNA, 20 bp, Artificial Sequence
  Description of Artificial Sequence: Synthetic oligonucleotide
  Target: ATXN1; (-) strand; PAM type: YTN; PAM sequence: TTT
ttttattttttatgttatta

SEQ ID NO: 189183 - DNA, 20 bp, Artificial Sequence
  Description of Artificial Sequence: Synthetic oligonucleotide
  Target: ATXN1; (-) strand; PAM type: YTN; PAM sequence: CTT
tttttattttttatgttatt

SEQ ID NO: 189184 - DNA, 20 bp, Artificial Sequence
  Description of Artificial Sequence: Synthetic oligonucleotide
  Target: ATXN1; (-) strand; PAM type: YTN; PAM sequence: TTC
tttttttattttttatgtta

SEQ ID NO: 189185 - DNA, 20 bp, Artificial Sequence
  Description of Artificial Sequence: Synthetic oligonucleotide
  Target: ATXN1; (-) strand; PAM type: YTN; PAM sequence: TTT
ctttttttattttttatgtt

SEQ ID NO: 189186 - DNA, 20 bp, Artificial Sequence
  Description of Artificial Sequence: Synthetic oligonucleotide
  Target: ATXN1; (-) strand; PAM type: YTN; PAM sequence: TTT
tctttttttattttttatgt

SEQ ID NO: 189187 - DNA, 20 bp, Artificial Sequence
  Description of Artificial Sequence: Synthetic oligonucleotide
  Target: ATXN1; (-) strand; PAM type: YTN; PAM sequence: CTT
ttctttttttattttttatg

SEQ ID NO: 189188 - DNA, 20 bp, Artificial Sequence
  Description of Artificial Sequence: Synthetic oligonucleotide
  Target: ATXN1; (-) strand; PAM type: YTN; PAM sequence: TTG
tgtgtgcatcttttcttttt

SEQ ID NO: 189189 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgcatcttttctttt

SEQ ID NO: 189190 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtgcatcttttcttt

SEQ ID NO: 189191 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgtgcatcttttctt

SEQ ID NO: 189192 - DNA, 20 bp, Artificial Sequence
  Description of Artificial Sequence: Synthetic oligonucleotide
  Target: ATXN1; (-) strand; PAM type: YTN; PAM sequence: TTT
tttgtgtgtgcatcttttct

SEQ ID NO: 189193 - DNA, 20 bp, Artificial Sequence
  Description of Artificial Sequence: Synthetic oligonucleotide
  Target: ATXN1; (-) strand; PAM type: YTN; PAM sequence: TTT
ttttgtgtgtgcatcttttc

SEQ ID NO: 189194 - DNA, 20 bp, Artificial Sequence
  Description of Artificial Sequence: Synthetic oligonucleotide
  Target: ATXN1; (-) strand; PAM type: YTN; PAM sequence: TTT
tttttgtgtgtgcatctttt

SEQ ID NO: 189195 - DNA, 20 bp, Artificial Sequence
  Description of Artificial Sequence: Synthetic oligonucleotide
  Target: ATXN1; (-) strand; PAM type: YTN; PAM sequence: TTT
ttttttgtgtgtgcatcttt

SEQ ID NO: 189196 - DNA, 20 bp, Artificial Sequence
  Description of Artificial Sequence: Synthetic oligonucleotide
  Target: ATXN1; (-) strand; PAM type: YTN; PAM sequence: TTA
tttttttttgtgtgtgcatc

SEQ ID NO: 189197 - DNA, 20 bp, Artificial Sequence
  Description of Artificial Sequence: Synthetic oligonucleotide
  Target: ATXN1; (-) strand; PAM type: YTN; PAM sequence: TTT
atttttttttgtgtgtgcat

SEQ ID NO: 189198 - DNA, 20 bp, Artificial Sequence
  Description of Artificial Sequence: Synthetic oligonucleotide
  Target: ATXN1; (-) strand; PAM type: YTN; PAM sequence: CTA
tttatttttttttgtgtgtg

SEQ ID NO: 189199 - DNA, 20 bp, Artificial Sequence
  Description of Artificial Sequence: Synthetic oligonucleotide
  Target: ATXN1; (-) strand; PAM type: YTN; PAM sequence: TTA
aacaacacctatttattttt

SEQ ID NO: 189200 - DNA, 20 bp, Artificial Sequence
  Description of Artificial Sequence: Synthetic oligonucleotide
  Target: ATXN1; (-) strand; PAM type: YTN; PAM sequence: CTT
aaacaacacctatttatttt

SEQ ID NO: 189201 - DNA, 20 bp, Artificial Sequence
  Description of Artificial Sequence: Synthetic oligonucleotide
  Target: ATXN1; (-) strand; PAM type: YTN; PAM sequence: CTA
caaatatagtgacttaaaca

SEQ ID NO: 189202 - DNA, 20 bp, Artificial Sequence
  Description of Artificial Sequence: Synthetic oligonucleotide
  Target: ATXN1; (-) strand; PAM type: YTN; PAM sequence: CTG
tatgacaaactacaaatata

SEQ ID NO: 189203 - DNA, 20 bp, Artificial Sequence
  Description of Artificial Sequence: Synthetic oligonucleotide
  Target: ATXN1; (-) strand; PAM type: YTN; PAM sequence: TTG
ctgtatgacaaactacaaat

SEQ ID NO: 189204 - DNA, 20 bp, Artificial Sequence
  Description of Artificial Sequence: Synthetic oligonucleotide
  Target: ATXN1; (-) strand; PAM type: YTN; PAM sequence: CTA
ttgctgtatgacaaactaca

SEQ ID NO: 189205 - DNA, 20 bp, Artificial Sequence
  Description of Artificial Sequence: Synthetic oligonucleotide
  Target: ATXN1; (-) strand; PAM type: YTN; PAM sequence: TTC
tattgctgtatgacaaacta

SEQ ID NO: 189206 - DNA, 20 bp, Artificial Sequence
  Description of Artificial Sequence: Synthetic oligonucleotide
  Target: ATXN1; (-) strand; PAM type: YTN; PAM sequence: TTT
ctattgctgtatgacaaact

SEQ ID NO: 189207 - DNA, 20 bp, Artificial Sequence
  Description of Artificial Sequence: Synthetic oligonucleotide
  Target: ATXN1; (-) strand; PAM type: YTN; PAM sequence: TTT
tctattgctgtatgacaaac

SEQ ID NO: 189208 - DNA, 20 bp, Artificial Sequence
  Description of Artificial Sequence: Synthetic oligonucleotide
  Target: ATXN1; (-) strand; PAM type: YTN; PAM sequence: TTG
gttttctattgctgtatgac

SEQ ID NO: 189209 - DNA, 20 bp, Artificial Sequence
  Description of Artificial Sequence: Synthetic oligonucleotide
  Target: ATXN1; (-) strand; PAM type: YTN; PAM sequence: TTA
tatgtggattggttttctat

SEQ ID NO: 189210 - DNA, 20 bp, Artificial Sequence
  Description of Artificial Sequence: Synthetic oligonucleotide
  Target: ATXN1; (-) strand; PAM type: YTN; PAM sequence: TTG
tattatatgtggattggttt

SEQ ID NO: 189211 - DNA, 20 bp, Artificial Sequence
  Description of Artificial Sequence: Synthetic oligonucleotide
  Target: ATXN1; (-) strand; PAM type: YTN; PAM sequence: TTC
aagcaaaaaaaaaaagaaat

SEQ ID NO: 189212 - DNA, 20 bp, Artificial Sequence
  Description of Artificial Sequence: Synthetic oligonucleotide
  Target: ATXN1; (-) strand; PAM type: YTN; PAM sequence: CTC
aaagtgattcaagcaaaaaa

SEQ ID NO: 189213 - DNA, 20 bp, Artificial Sequence
  Description of Artificial Sequence: Synthetic oligonucleotide
  Target: ATXN1; (-) strand; PAM type: YTN; PAM sequence: TTA
aactcaaagtgattcaagca

SEQ ID NO: 189214 - DNA, 20 bp, Artificial Sequence
  Description of Artificial Sequence: Synthetic oligonucleotide
  Target: ATXN1; (-) strand; PAM type: YTN; PAM sequence: TTA
caatagacaaattaaactca

SEQ ID NO: 189215 - DNA, 20 bp, Artificial Sequence
  Description of Artificial Sequence: Synthetic oligonucleotide
  Target: ATXN1; (-) strand; PAM type: YTN; PAM sequence: TTG
gttacaatagacaaattaaa

SEQ ID NO: 189216 - DNA, 20 bp, Artificial Sequence
  Description of Artificial Sequence: Synthetic oligonucleotide
  Target: ATXN1; (-) strand; PAM type: YTN; PAM sequence: TTT
ggttacaatagacaaattaa

SEQ ID NO: 189217 - DNA, 20 bp, Artificial Sequence
  Description of Artificial Sequence: Synthetic oligonucleotide
  Target: ATXN1; (-) strand; PAM type: YTN; PAM sequence: TTT
tggttacaatagacaaatta

SEQ ID NO: 189218 - DNA, 20 bp, Artificial Sequence
  Description of Artificial Sequence: Synthetic oligonucleotide
  Target: ATXN1; (-) strand; PAM type: YTN; PAM sequence: TTA
ttttggttacaatagacaaa

SEQ ID NO: 189219 - DNA, 20 bp, Artificial Sequence
  Description of Artificial Sequence: Synthetic oligonucleotide
  Target: ATXN1; (-) strand; PAM type: YTN; PAM sequence: TTT
attttggttacaatagacaa

SEQ ID NO: 189220 - DNA, 20 bp, Artificial Sequence
  Description of Artificial Sequence: Synthetic oligonucleotide
  Target: ATXN1; (-) strand; PAM type: YTN; PAM sequence: TTG
tttattttggttacaataga

SEQ ID NO: 189221 - DNA, 20 bp, Artificial Sequence
  Description of Artificial Sequence: Synthetic oligonucleotide
  Target: ATXN1; (-) strand; PAM type: YTN; PAM sequence: TTT
gtttattttggttacaatag

SEQ ID NO: 189222 - DNA, 20 bp, Artificial Sequence
  Description of Artificial Sequence: Synthetic oligonucleotide
  Target: ATXN1; (-) strand; PAM type: YTN; PAM sequence: TTA
agaatatttgtttattttgg

SEQ ID NO: 189223 - DNA, 20 bp, Artificial Sequence
  Description of Artificial Sequence: Synthetic oligonucleotide
  Target: ATXN1; (-) strand; PAM type: YTN; PAM sequence: CTC
agagaaattaagaatatttg

SEQ ID NO: 189224 - DNA, 20 bp, Artificial Sequence
  Description of Artificial Sequence: Synthetic oligonucleotide
  Target: ATXN1; (-) strand; PAM type: YTN; PAM sequence: CTG
cagaggggccataaggagta

SEQ ID NO: 189225 - DNA, 20 bp, Artificial Sequence
  Description of Artificial Sequence: Synthetic oligonucleotide
  Target: ATXN1; (-) strand; PAM type: YTN; PAM sequence: TTA
gaaagaacagagagagcaaa

SEQ ID NO: 189226 - DNA, 20 bp, Artificial Sequence
  Description of Artificial Sequence: Synthetic oligonucleotide
  Target: ATXN1; (-) strand; PAM type: YTN; PAM sequence: CTA
gagttagaaagaacagagag

SEQ ID NO: 189227 - DNA, 20 bp, Artificial Sequence
  Description of Artificial Sequence: Synthetic oligonucleotide
  Target: ATXN1; (-) strand; PAM type: YTN; PAM sequence: CTG
tcccctagagttagaaagaa

SEQ ID NO: 189228 - DNA, 20 bp, Artificial Sequence
  Description of Artificial Sequence: Synthetic oligonucleotide
  Target: ATXN1; (-) strand; PAM type: YTN; PAM sequence: TTA
ggaaatctgtcccctagagt

SEQ ID NO: 189229 - DNA, 20 bp, Artificial Sequence
  Description of Artificial Sequence: Synthetic oligonucleotide
  Target: ATXN1; (-) strand; PAM type: YTN; PAM sequence: CTT
aggaaatctgtcccctagag

SEQ ID NO: 189230 - DNA, 20 bp, Artificial Sequence
  Description of Artificial Sequence: Synthetic oligonucleotide
  Target: ATXN1; (-) strand; PAM type: YTN; PAM sequence: CTG
agcagatagccttaggaaat

SEQ ID NO: 189231 - DNA, 20 bp, Artificial Sequence
  Description of Artificial Sequence: Synthetic oligonucleotide
  Target: ATXN1; (-) strand; PAM type: YTN; PAM sequence: TTA
tagaaagtgaatagaactga

SEQ ID NO: 189232 - DNA, 20 bp, Artificial Sequence
  Description of Artificial Sequence: Synthetic oligonucleotide
  Target: ATXN1; (-) strand; PAM type: YTN; PAM sequence: TTA
agaacgataaacagtagaag

SEQ ID NO: 189233 - DNA, 20 bp, Artificial Sequence
  Description of Artificial Sequence: Synthetic oligonucleotide
  Target: ATXN1; (-) strand; PAM type: YTN; PAM sequence: TTT
aagaacgataaacagtagaa

SEQ ID NO: 189234 - DNA, 20 bp, Artificial Sequence
  Description of Artificial Sequence: Synthetic oligonucleotide
  Target: ATXN1; (-) strand; PAM type: YTN; PAM sequence: TTG
tagggggagataccagggac

SEQ ID NO: 189235 - DNA, 20 bp, Artificial Sequence
  Description of Artificial Sequence: Synthetic oligonucleotide
  Target: ATXN1; (-) strand; PAM type: YTN; PAM sequence: TTT
gtagggggagataccaggga

SEQ ID NO: 189236 - DNA, 20 bp, Artificial Sequence
  Description of Artificial Sequence: Synthetic oligonucleotide
  Target: ATXN1; (-) strand; PAM type: YTN; PAM sequence: CTG
catatatccaggagtttgta

SEQ ID NO: 189237 - DNA, 20 bp, Artificial Sequence
  Description of Artificial Sequence: Synthetic oligonucleotide
  Target: ATXN1; (-) strand; PAM type: YTN; PAM sequence: TTC
cactgcatatatccaggagt

SEQ ID NO: 189238 - DNA, 20 bp, Artificial Sequence
  Description of Artificial Sequence: Synthetic oligonucleotide
  Target: ATXN1; (-) strand; PAM type: YTN; PAM sequence: TTT
ccactgcatatatccaggag

SEQ ID NO: 189239 - DNA, 20 bp, Artificial Sequence
  Description of Artificial Sequence: Synthetic oligonucleotide
  Target: ATXN1; (-) strand; PAM type: YTN; PAM sequence: TTG
tttccactgcatatatccag

SEQ ID NO: 189240 - DNA, 20 bp, Artificial Sequence
  Description of Artificial Sequence: Synthetic oligonucleotide
  Target: ATXN1; (-) strand; PAM type: YTN; PAM sequence: TTT
gtttccactgcatatatcca

SEQ ID NO: 189241 - DNA, 20 bp, Artificial Sequence
  Description of Artificial Sequence: Synthetic oligonucleotide
  Target: ATXN1; (-) strand; PAM type: YTN; PAM sequence: TTG
aaataaacataatttgtttc

SEQ ID NO: 189242 - DNA, 20 bp, Artificial Sequence
  Description of Artificial Sequence: Synthetic oligonucleotide
  Target: ATXN1; (-) strand; PAM type: YTN; PAM sequence: TTT
gaaataaacataatttgttt

SEQ ID NO: 189243 - DNA, 20 bp, Artificial Sequence
  Description of Artificial Sequence: Synthetic oligonucleotide
  Target: ATXN1; (-) strand; PAM type: YTN; PAM sequence: CTG
ggaaagtttgaaataaacat

SEQ ID NO: 189244 - DNA, 20 bp, Artificial Sequence
  Description of Artificial Sequence: Synthetic oligonucleotide
  Target: ATXN1; (-) strand; PAM type: YTN; PAM sequence: TTG
gagcaagggactgggaaagt

SEQ ID NO: 189245 - DNA, 20 bp, Artificial Sequence
  Description of Artificial Sequence: Synthetic oligonucleotide
  Target: ATXN1; (-) strand; PAM type: YTN; PAM sequence: TTT
ggagcaagggactgggaaag

SEQ ID NO: 189246 - DNA, 20 bp, Artificial Sequence
  Description of Artificial Sequence: Synthetic oligonucleotide
  Target: ATXN1; (-) strand; PAM type: YTN; PAM sequence: CTG
ggtttggagcaagggactgg

SEQ ID NO: 189247 - DNA, 20 bp, Artificial Sequence
  Description of Artificial Sequence: Synthetic oligonucleotide
  Target: ATXN1; (-) strand; PAM type: YTN; PAM sequence: TTA
aagaggaggagctgggtttg

SEQ ID NO: 189248 - DNA, 20 bp, Artificial Sequence
  Description of Artificial Sequence: Synthetic oligonucleotide
  Target: ATXN1; (-) strand; PAM type: YTN; PAM sequence: TTC
catcagaaattaaagaggag

SEQ ID NO: 189249 - DNA, 20 bp, Artificial Sequence
  Description of Artificial Sequence: Synthetic oligonucleotide
  Target: ATXN1; (-) strand; PAM type: YTN; PAM sequence: CTT
ccatcagaaattaaagagga

SEQ ID NO: 189250 - DNA, 20 bp, Artificial Sequence
  Description of Artificial Sequence: Synthetic oligonucleotide
  Target: ATXN1; (-) strand; PAM type: YTN; PAM sequence: CTG
tcagcttccatcagaaatta

SEQ ID NO: 189251 - DNA, 20 bp, Artificial Sequence
  Description of Artificial Sequence: Synthetic oligonucleotide
  Target: ATXN1; (-) strand; PAM type: YTN; PAM sequence: TTG
gaaaccgatggaatgtggga

SEQ ID NO: 189252 - DNA, 20 bp, Artificial Sequence
  Description of Artificial Sequence: Synthetic oligonucleotide
  Target: ATXN1; (-) strand; PAM type: YTN; PAM sequence: CTT
ggaaaccgatggaatgtggg

SEQ ID NO: 189253 - DNA, 20 bp, Artificial Sequence
  Description of Artificial Sequence: Synthetic oligonucleotide
  Target: ATXN1; (-) strand; PAM type: YTN; PAM sequence: TTG
gtaggacttggaaaccgatg

SEQ ID NO: 189254 - DNA, 20 bp, Artificial Sequence
  Description of Artificial Sequence: Synthetic oligonucleotide
  Target: ATXN1; (-) strand; PAM type: YTN; PAM sequence: CTA
gcatggggcggtgaagatag

SEQ ID NO: 189255 - DNA, 20 bp, Artificial Sequence
  Description of Artificial Sequence: Synthetic oligonucleotide
  Target: ATXN1; (-) strand; PAM type: YTN; PAM sequence: CTG
agctagcatggggcggtgaa

SEQ ID NO: 189256 - DNA, 20 bp, Artificial Sequence
  Description of Artificial Sequence: Synthetic oligonucleotide
  Target: ATXN1; (-) strand; PAM type: YTN; PAM sequence: TTC
agtctgagctagcatggggc

SEQ ID NO: 189257 - DNA, 20 bp, Artificial Sequence
  Description of Artificial Sequence: Synthetic oligonucleotide
  Target: ATXN1; (-) strand; PAM type: YTN; PAM sequence: CTG
tgagaggaattcagtctgag

SEQ ID NO: 189258 - DNA, 20 bp, Artificial Sequence
  Description of Artificial Sequence: Synthetic oligonucleotide
  Target: ATXN1; (-) strand; PAM type: YTN; PAM sequence: CTG
ctgtgagaggaattcagtct

SEQ ID NO: 189259 - DNA, 20 bp, Artificial Sequence
  Description of Artificial Sequence: Synthetic oligonucleotide
  Target: ATXN1; (-) strand; PAM type: YTN; PAM sequence: TTG
acaagaagaccaatgagcag

SEQ ID NO: 189260 - DNA, 20 bp, Artificial Sequence
  Description of Artificial Sequence: Synthetic oligonucleotide
  Target: ATXN1; (-) strand; PAM type: YTN; PAM sequence: TTA
gagagagaaagcattgacaa

SEQ ID NO: 189261 - DNA, 20 bp, Artificial Sequence
  Description of Artificial Sequence: Synthetic oligonucleotide
  Target: ATXN1; (-) strand; PAM type: YTN; PAM sequence: TTT
agagagagaaagcattgaca

SEQ ID NO: 189262 - DNA, 20 bp, Artificial Sequence
  Description of Artificial Sequence: Synthetic oligonucleotide
  Target: ATXN1; (-) strand; PAM type: YTN; PAM sequence: CTC
aaatggtttagagagagaaa

SEQ ID NO: 189263 - DNA, 20 bp, Artificial Sequence
  Description of Artificial Sequence: Synthetic oligonucleotide
  Target: ATXN1; (-) strand; PAM type: YTN; PAM sequence: TTC
gatccaacagggatgactca

SEQ ID NO: 189264 - DNA, 20 bp, Artificial Sequence
  Description of Artificial Sequence: Synthetic oligonucleotide
  Target: ATXN1; (-) strand; PAM type: YTN; PAM sequence: TTA
ggaagttcgatccaacaggg

SEQ ID NO: 189265 - DNA, 20 bp, Artificial Sequence
  Description of Artificial Sequence: Synthetic oligonucleotide
  Target: ATXN1; (-) strand; PAM type: YTN; PAM sequence: TTT
aggaagttcgatccaacagg

SEQ ID NO: 189266 - DNA, 20 bp, Artificial Sequence
  Description of Artificial Sequence: Synthetic oligonucleotide
  Target: ATXN1; (-) strand; PAM type: YTN; PAM sequence: CTT
taggaagttcgatccaacag

SEQ ID NO: 189267 - DNA, 20 bp, Artificial Sequence
  Description of Artificial Sequence: Synthetic oligonucleotide
  Target: ATXN1; (-) strand; PAM type: YTN; PAM sequence: CTA
ctttaggaagttcgatccaa

SEQ ID NO: 189268 - DNA, 20 bp, Artificial Sequence
  Description of Artificial Sequence: Synthetic oligonucleotide
  Target: ATXN1; (-) strand; PAM type: YTN; PAM sequence: TTA
tatctactttaggaagttcg

SEQ ID NO: 189269 - DNA, 20 bp, Artificial Sequence
  Description of Artificial Sequence: Synthetic oligonucleotide
  Target: ATXN1; (-) strand; PAM type: YTN; PAM sequence: TTG
tgttatatctactttaggaa

SEQ ID NO: 189270 - DNA, 20 bp, Artificial Sequence
  Description of Artificial Sequence: Synthetic oligonucleotide
  Target: ATXN1; (-) strand; PAM type: YTN; PAM sequence: CTG
taggaaccaatgaaggtatg

SEQ ID NO: 189271 - DNA, 20 bp, Artificial Sequence
  Description of Artificial Sequence: Synthetic oligonucleotide
  Target: ATXN1; (-) strand; PAM type: YTN; PAM sequence: TTC
agtaagctgtaggaaccaat

SEQ ID NO: 189272 - DNA, 20 bp, Artificial Sequence
  Description of Artificial Sequence: Synthetic oligonucleotide
  Target: ATXN1; (-) strand; PAM type: YTN; PAM sequence: TTC
gaagatgttcagtaagctgt

SEQ ID NO: 189273 - DNA, 20 bp, Artificial Sequence
  Description of Artificial Sequence: Synthetic oligonucleotide
  Target: ATXN1; (-) strand; PAM type: YTN; PAM sequence: TTT
cgaagatgttcagtaagctg

SEQ ID NO: 189274 - DNA, 20 bp, Artificial Sequence
  Description of Artificial Sequence: Synthetic oligonucleotide
  Target: ATXN1; (-) strand; PAM type: YTN; PAM sequence: TTC
agcatcaaataaagaatttc

SEQ ID NO: 189275 - DNA, 20 bp, Artificial Sequence
  Description of Artificial Sequence: Synthetic oligonucleotide
  Target: ATXN1; (-) strand; PAM type: YTN; PAM sequence: CTT
cagcatcaaataaagaattt

SEQ ID NO: 189276 - DNA, 20 bp, Artificial Sequence
  Description of Artificial Sequence: Synthetic oligonucleotide
  Target: ATXN1; (-) strand; PAM type: YTN; PAM sequence: TTG
tgaagatcttcagcatcaaa

SEQ ID NO: 189277 - DNA, 20 bp, Artificial Sequence
  Description of Artificial Sequence: Synthetic oligonucleotide
  Target: ATXN1; (-) strand; PAM type: YTN; PAM sequence: CTG
gggccagattgtgaagatct

SEQ ID NO: 189278 - DNA, 20 bp, Artificial Sequence
  Description of Artificial Sequence: Synthetic oligonucleotide
  Target: ATXN1; (-) strand; PAM type: YTN; PAM sequence: TTG
gaaaagcatgctggggccag

SEQ ID NO: 189279 - DNA, 20 bp, Artificial Sequence
  Description of Artificial Sequence: Synthetic oligonucleotide
  Target: ATXN1; (-) strand; PAM type: YTN; PAM sequence: TTC
agtgtgcatgaggggagaag

SEQ ID NO: 189280 - DNA, 20 bp, Artificial Sequence
  Description of Artificial Sequence: Synthetic oligonucleotide
  Target: ATXN1; (-) strand; PAM type: YTN; PAM sequence: CTT
cagtgtgcatgaggggagaa

SEQ ID NO: 189281 - DNA, 20 bp, Artificial Sequence
  Description of Artificial Sequence: Synthetic oligonucleotide
  Target: ATXN1; (-) strand; PAM type: YTN; PAM sequence: CTG
cttcagtgtgcatgagggga

SEQ ID NO: 189282 - DNA, 20 bp, Artificial Sequence
  Description of Artificial Sequence: Synthetic oligonucleotide
  Target: ATXN1; (-) strand; PAM type: YTN; PAM sequence: CTG
tggctgcttcagtgtgcatg

SEQ ID NO: 189283 - DNA, 20 bp, Artificial Sequence
  Description of Artificial Sequence: Synthetic oligonucleotide
  Target: ATXN1; (-) strand; PAM type: YTN; PAM sequence: CTC
actgtggctgcttcagtgtg

SEQ ID NO: 189284 - DNA, 20 bp, Artificial Sequence
  Description of Artificial Sequence: Synthetic oligonucleotide
  Target: ATXN1; (-) strand; PAM type: YTN; PAM sequence: CTC
agagaggaagtgagaagctc

SEQ ID NO: 189285 - DNA, 20 bp, Artificial Sequence
  Description of Artificial Sequence: Synthetic oligonucleotide
  Target: ATXN1; (-) strand; PAM type: YTN; PAM sequence: CTC
tcagagaggaagtgagaagc

SEQ ID NO: 189286 - DNA, 20 bp, Artificial Sequence
  Description of Artificial Sequence: Synthetic oligonucleotide
  Target: ATXN1; (-) strand; PAM type: YTN; PAM sequence: TTG
acacgtggagtagaaatgcg

SEQ ID NO: 189287 - DNA, 20 bp, Artificial Sequence
  Description of Artificial Sequence: Synthetic oligonucleotide
  Target: ATXN1; (-) strand; PAM type: YTN; PAM sequence: TTT
gacacgtggagtagaaatgc

SEQ ID NO: 189288 - DNA, 20 bp, Artificial Sequence
  Description of Artificial Sequence: Synthetic oligonucleotide
  Target: ATXN1; (-) strand; PAM type: YTN; PAM sequence: TTT
tgacacgtggagtagaaatg

SEQ ID NO: 189289 - DNA, 20 bp, Artificial Sequence
  Description of Artificial Sequence: Synthetic oligonucleotide
  Target: ATXN1; (-) strand; PAM type: YTN; PAM sequence: TTA
cattttgacacgtggagtag

SEQ ID NO: 189290 - DNA, 20 bp, Artificial Sequence
  Description of Artificial Sequence: Synthetic oligonucleotide
  Target: ATXN1; (-) strand; PAM type: YTN; PAM sequence: CTT
acattttgacacgtggagta

SEQ ID NO: 189291 - DNA, 20 bp, Artificial Sequence
  Description of Artificial Sequence: Synthetic oligonucleotide
  Target: ATXN1; (-) strand; PAM type: YTN; PAM sequence: CTG
gcttacattttgacacgtgg

SEQ ID NO: 189292 - DNA, 20 bp, Artificial Sequence
  Description of Artificial Sequence: Synthetic oligonucleotide
  Target: ATXN1; (-) strand; PAM type: YTN; PAM sequence: TTG
ggaggtctggcttacatttt

SEQ ID NO: 189293 - DNA, 20 bp, Artificial Sequence
  Description of Artificial Sequence: Synthetic oligonucleotide
  Target: ATXN1; (-) strand; PAM type: YTN; PAM sequence: CTT
gggaggtctggcttacattt

SEQ ID NO: 189294 - DNA, 20 bp, Artificial Sequence
  Description of Artificial Sequence: Synthetic oligonucleotide
  Target: ATXN1; (-) strand; PAM type: YTN; PAM sequence: CTG
gtcttgggaggtctggctta

SEQ ID NO: 189295 - DNA, 20 bp, Artificial Sequence
  Description of Artificial Sequence: Synthetic oligonucleotide
  Target: ATXN1; (-) strand; PAM type: YTN; PAM sequence: TTG
agctggtcttgggaggtctg

SEQ ID NO: 189296 - DNA, 20 bp, Artificial Sequence
  Description of Artificial Sequence: Synthetic oligonucleotide
  Target: ATXN1; (-) strand; PAM type: YTN; PAM sequence: TTT
gagctggtcttgggaggtct

SEQ ID NO: 189297 - DNA, 20 bp, Artificial Sequence
  Description of Artificial Sequence: Synthetic oligonucleotide
  Target: ATXN1; (-) strand; PAM type: YTN; PAM sequence: TTG
tagaaaaagtgggatttgag

SEQ ID NO: 189298 - DNA, 20 bp, Artificial Sequence
  Description of Artificial Sequence: Synthetic oligonucleotide
  Target: ATXN1; (-) strand; PAM type: YTN; PAM sequence: TTG
tagaataagaggataaaaga

SEQ ID NO: 189299 - DNA, 20 bp, Artificial Sequence
  Description of Artificial Sequence: Synthetic oligonucleotide
  Target: ATXN1; (-) strand; PAM type: YTN; PAM sequence: TTG
agaaagttgtagaataagag

SEQ ID NO: 189300 - DNA, 20 bp, Artificial Sequence
  Description of Artificial Sequence: Synthetic oligonucleotide
  Target: ATXN1; (-) strand; PAM type: YTN; PAM sequence: CTG
attgagaaagttgtagaata

SEQ ID NO: 189301 - DNA, 20 bp, Artificial Sequence
  Description of Artificial Sequence: Synthetic oligonucleotide
  Target: ATXN1; (-) strand; PAM type: YTN; PAM sequence: TTC
tgattgagaaagttgtagaa

SEQ ID NO: 189302 - DNA, 20 bp, Artificial Sequence
  Description of Artificial Sequence: Synthetic oligonucleotide
  Target: ATXN1; (-) strand; PAM type: YTN; PAM sequence: CTT
ctgattgagaaagttgtaga

SEQ ID NO: 189303 - DNA, 20 bp, Artificial Sequence
  Description of Artificial Sequence: Synthetic oligonucleotide
  Target: ATXN1; (-) strand; PAM type: YTN; PAM sequence: TTC
acatgcaaaaacaaaacaac

SEQ ID NO: 189304 - DNA, 20 bp, Artificial Sequence
  Description of Artificial Sequence: Synthetic oligonucleotide
  Target: ATXN1; (-) strand; PAM type: YTN; PAM sequence: TTA
aaaccataggcattcacatg

SEQ ID NO: 189305 - DNA, 20 bp, Artificial Sequence
  Description of Artificial Sequence: Synthetic oligonucleotide
  Target: ATXN1; (-) strand; PAM type: YTN; PAM sequence: TTT
aaaaccataggcattcacat

SEQ ID NO: 189306 - DNA, 20 bp, Artificial Sequence
  Description of Artificial Sequence: Synthetic oligonucleotide
  Target: ATXN1; (-) strand; PAM type: YTN; PAM sequence: TTT
taaaaccataggcattcaca

SEQ ID NO: 189307 - DNA, 20 bp, Artificial Sequence
  Description of Artificial Sequence: Synthetic oligonucleotide
  Target: ATXN1; (-) strand; PAM type: YTN; PAM sequence: TTA
gtaacataaggaaaatgaat

SEQ ID NO: 189308 - DNA, 20 bp, Artificial Sequence
  Description of Artificial Sequence: Synthetic oligonucleotide
  Target: ATXN1; (-) strand; PAM type: YTN; PAM sequence: TTG
taggataaggaataaaatgg

SEQ ID NO: 189309 - DNA, 20 bp, Artificial Sequence
  Description of Artificial Sequence: Synthetic oligonucleotide
  Target: ATXN1; (-) strand; PAM type: YTN; PAM sequence: CTA
ttgtaggataaggaataaaa

SEQ ID NO: 189310 - DNA, 20 bp, Artificial Sequence
  Description of Artificial Sequence: Synthetic oligonucleotide
  Target: ATXN1; (-) strand; PAM type: YTN; PAM sequence: TTG
gggagatgacacctattgta

SEQ ID NO: 189311 - DNA, 20 bp, Artificial Sequence
  Description of Artificial Sequence: Synthetic oligonucleotide
  Target: ATXN1; (-) strand; PAM type: YTN; PAM sequence: CTT
ggggagatgacacctattgt

SEQ ID NO: 189312 - DNA, 20 bp, Artificial Sequence
  Description of Artificial Sequence: Synthetic oligonucleotide
  Target: ATXN1; (-) strand; PAM type: YTN; PAM sequence: TTC
cacttggggagatgacacct

SEQ ID NO: 189313 - DNA, 20 bp, Artificial Sequence
  Description of Artificial Sequence: Synthetic oligonucleotide
  Target: ATXN1; (-) strand; PAM type: YTN; PAM sequence: TTA
ccacattccacttggggaga

SEQ ID NO: 189314 - DNA, 20 bp, Artificial Sequence
  Description of Artificial Sequence: Synthetic oligonucleotide
  Target: ATXN1; (-) strand; PAM type: YTN; PAM sequence: TTA
cggaagttaccacattccac

SEQ ID NO: 189315 - DNA, 20 bp, Artificial Sequence
  Description of Artificial Sequence: Synthetic oligonucleotide
  Target: ATXN1; (-) strand; PAM type: YTN; PAM sequence: TTT
acggaagttaccacattcca

SEQ ID NO: 189316 - DNA, 20 bp, Artificial Sequence
  Description of Artificial Sequence: Synthetic oligonucleotide
  Target: ATXN1; (-) strand; PAM type: YTN; PAM sequence: CTT
tacggaagttaccacattcc

SEQ ID NO: 189317 - DNA, 20 bp, Artificial Sequence
  Description of Artificial Sequence: Synthetic oligonucleotide
  Target: ATXN1; (-) strand; PAM type: YTN; PAM sequence: CTA
cctttacggaagttaccaca

SEQ ID NO: 189318 - DNA, 20 bp, Artificial Sequence
  Description of Artificial Sequence: Synthetic oligonucleotide
  Target: ATXN1; (-) strand; PAM type: YTN; PAM sequence: TTA
caaaaagaagacagacataa

SEQ ID NO: 189319 - DNA, 20 bp, Artificial Sequence
  Description of Artificial Sequence: Synthetic oligonucleotide
  Target: ATXN1; (-) strand; PAM type: YTN; PAM sequence: CTT
acaaaaagaagacagacata

SEQ ID NO: 189320 - DNA, 20 bp, Artificial Sequence
  Description of Artificial Sequence: Synthetic oligonucleotide
  Target: ATXN1; (-) strand; PAM type: YTN; PAM sequence: TTG
cgaaagccccgtgaagctta

SEQ ID NO: 189321 - DNA, 20 bp, Artificial Sequence
  Description of Artificial Sequence: Synthetic oligonucleotide
  Target: ATXN1; (-) strand; PAM type: YTN; PAM sequence: TTT
gcgaaagccccgtgaagctt

SEQ ID NO: 189322 - DNA, 20 bp, Artificial Sequence
  Description of Artificial Sequence: Synthetic oligonucleotide
  Target: ATXN1; (-) strand; PAM type: YTN; PAM sequence: TTA
tcatttgcgaaagccccgtg

SEQ ID NO: 189323 - DNA, 20 bp, Artificial Sequence
  Description of Artificial Sequence: Synthetic oligonucleotide
  Target: ATXN1; (-) strand; PAM type: YTN; PAM sequence: TTG
atcaaagagttatcatttgc

SEQ ID NO: 189324 - DNA, 20 bp, Artificial Sequence
  Description of Artificial Sequence: Synthetic oligonucleotide
  Target: ATXN1; (-) strand; PAM type: YTN; PAM sequence: TTA
atcaacaaatattgatcaaa

SEQ ID NO: 189325 - DNA, 20 bp, Artificial Sequence
  Description of Artificial Sequence: Synthetic oligonucleotide
  Target: ATXN1; (-) strand; PAM type: YTN; PAM sequence: TTA
tcaatcagttaatcaacaaa

SEQ ID NO: 189326 - DNA, 20 bp, Artificial Sequence
  Description of Artificial Sequence: Synthetic oligonucleotide
  Target: ATXN1; (-) strand; PAM type: YTN; PAM sequence: TTC
aagtataatgtaatataata

SEQ ID NO: 189327 - DNA, 20 bp, Artificial Sequence
  Description of Artificial Sequence: Synthetic oligonucleotide
  Target: ATXN1; (-) strand; PAM type: YTN; PAM sequence: CTT
caagtataatgtaatataat

SEQ ID NO: 189328 - DNA, 20 bp, Artificial Sequence
  Description of Artificial Sequence: Synthetic oligonucleotide
  Target: ATXN1; (-) strand; PAM type: YTN; PAM sequence: CTC
aaagacatataacgtcttca

SEQ ID NO: 189329 - DNA, 20 bp, Artificial Sequence
  Description of Artificial Sequence: Synthetic oligonucleotide
  Target: ATXN1; (-) strand; PAM type: YTN; PAM sequence: TTC
catggaggacagagactcaa

SEQ ID NO: 189330 - DNA, 20 bp, Artificial Sequence
  Description of Artificial Sequence: Synthetic oligonucleotide
  Target: ATXN1; (-) strand; PAM type: YTN; PAM sequence: CTT
ccatggaggacagagactca

SEQ ID NO: 189331 - DNA, 20 bp, Artificial Sequence
  Description of Artificial Sequence: Synthetic oligonucleotide
  Target: ATXN1; (-) strand; PAM type: YTN; PAM sequence: CTC
ttccatggaggacagagact

SEQ ID NO: 189332 - DNA, 20 bp, Artificial Sequence
  Description of Artificial Sequence: Synthetic oligonucleotide
  Target: ATXN1; (-) strand; PAM type: YTN; PAM sequence: CTG
tcctcttccatggaggacag

SEQ ID NO: 189333 - DNA, 20 bp, Artificial Sequence
  Description of Artificial Sequence: Synthetic oligonucleotide
  Target: ATXN1; (-) strand; PAM type: YTN; PAM sequence: TTG
aacacctgtcctcttccatg

SEQ ID NO: 189334 - DNA, 20 bp, Artificial Sequence
  Description of Artificial Sequence: Synthetic oligonucleotide
  Target: ATXN1; (-) strand; PAM type: YTN; PAM sequence: TTT
gaacacctgtcctcttccat

SEQ ID NO: 189335 - DNA, 20 bp, Artificial Sequence
  Description of Artificial Sequence: Synthetic oligonucleotide
  Target: ATXN1; (-) strand; PAM type: YTN; PAM sequence: TTC
catttgaacacctgtcctct

SEQ ID NO: 189336 - DNA, 20 bp, Artificial Sequence
  Description of Artificial Sequence: Synthetic oligonucleotide
  Target: ATXN1; (-) strand; PAM type: YTN; PAM sequence: CTT
ccatttgaacacctgtcctc

SEQ ID NO: 189337 - DNA, 20 bp, Artificial Sequence
  Description of Artificial Sequence: Synthetic oligonucleotide
  Target: ATXN1; (-) strand; PAM type: YTN; PAM sequence: TTC
ttccatttgaacacctgtcc

SEQ ID NO: 189338 - DNA, 20 bp, Artificial Sequence
  Description of Artificial Sequence: Synthetic oligonucleotide
  Target: ATXN1; (-) strand; PAM type: YTN; PAM sequence: CTC
caagtcacccaaaagggtgt

SEQ ID NO: 189339 - DNA, 20 bp, Artificial Sequence
  Description of Artificial Sequence: Synthetic oligonucleotide
  Target: ATXN1; (-) strand; PAM type: YTN; PAM sequence: TTC
tccaagtcacccaaaagggt

SEQ ID NO: 189340 - DNA, 20 bp, Artificial Sequence
  Description of Artificial Sequence: Synthetic oligonucleotide
  Target: ATXN1; (-) strand; PAM type: YTN; PAM sequence: TTT
ctccaagtcacccaaaaggg

SEQ ID NO: 189341 - DNA, 20 bp, Artificial Sequence
  Description of Artificial Sequence: Synthetic oligonucleotide
  Target: ATXN1; (-) strand; PAM type: YTN; PAM sequence: TTT
tctccaagtcacccaaaagg

SEQ ID NO: 189342 - DNA, 20 bp, Artificial Sequence
  Description of Artificial Sequence: Synthetic oligonucleotide
  Target: ATXN1; (-) strand; PAM type: YTN; PAM sequence: TTT
ttctccaagtcacccaaaag

SEQ ID NO: 189343 - DNA, 20 bp, Artificial Sequence
  Description of Artificial Sequence: Synthetic oligonucleotide
  Target: ATXN1; (-) strand; PAM type: YTN; PAM sequence: TTA
tgtgatgatttttctccaag

SEQ ID NO: 189344 - DNA, 20 bp, Artificial Sequence
  Description of Artificial Sequence: Synthetic oligonucleotide
  Target: ATXN1; (-) strand; PAM type: YTN; PAM sequence: CTT
atgtgatgatttttctccaa

SEQ ID NO: 189345 - DNA, 20 bp, Artificial Sequence
  Description of Artificial Sequence: Synthetic oligonucleotide
  Target: ATXN1; (-) strand; PAM type: YTN; PAM sequence: TTA
gagacttatgtgatgatttt

SEQ ID NO: 189346 - DNA, 20 bp, Artificial Sequence
  Description of Artificial Sequence: Synthetic oligonucleotide
  Target: ATXN1; (-) strand; PAM type: YTN; PAM sequence: CTT
agagacttatgtgatgattt

SEQ ID NO: 189347 - DNA, 20 bp, Artificial Sequence
  Description of Artificial Sequence: Synthetic oligonucleotide
  Target: ATXN1; (-) strand; PAM type: YTN; PAM sequence: TTC
cttagagacttatgtgatga

SEQ ID NO: 189348 - DNA, 20 bp, Artificial Sequence
  Description of Artificial Sequence: Synthetic oligonucleotide
  Target: ATXN1; (-) strand; PAM type: YTN; PAM sequence: TTT
ccttagagacttatgtgatg

SEQ ID NO: 189349 - DNA, 20 bp, Artificial Sequence
  Description of Artificial Sequence: Synthetic oligonucleotide
  Target: ATXN1; (-) strand; PAM type: YTN; PAM sequence: CTG
cacagtttccttagagactt

SEQ ID NO: 189350 - DNA, 20 bp, Artificial Sequence
  Description of Artificial Sequence: Synthetic oligonucleotide
  Target: ATXN1; (-) strand; PAM type: YTN; PAM sequence: TTG
agggactgcacagtttcctt

SEQ ID NO: 189351 - DNA, 20 bp, Artificial Sequence
  Description of Artificial Sequence: Synthetic oligonucleotide
  Target: ATXN1; (-) strand; PAM type: YTN; PAM sequence: TTC
attgagggactgcacagttt

SEQ ID NO: 189352 - DNA, 20 bp, Artificial Sequence
  Description of Artificial Sequence: Synthetic oligonucleotide
  Target: ATXN1; (-) strand; PAM type: YTN; PAM sequence: TTT
cattgagggactgcacagtt

SEQ ID NO: 189353 - DNA, 20 bp, Artificial Sequence
  Description of Artificial Sequence: Synthetic oligonucleotide
  Target: ATXN1; (-) strand; PAM type: YTN; PAM sequence: TTG
tggaacatttcattgaggga

SEQ ID NO: 189354 - DNA, 20 bp, Artificial Sequence
  Description of Artificial Sequence: Synthetic oligonucleotide
  Target: ATXN1; (-) strand; PAM type: YTN; PAM sequence: CTG
ttgtggaacatttcattgag

SEQ ID NO: 189355 - DNA, 20 bp, Artificial Sequence
  Description of Artificial Sequence: Synthetic oligonucleotide
  Target: ATXN1; (-) strand; PAM type: YTN; PAM sequence: TTG
gaaaaagaggctgttgtgga

SEQ ID NO: 189356 - DNA, 20 bp, Artificial Sequence
  Description of Artificial Sequence: Synthetic oligonucleotide
  Target: ATXN1; (-) strand; PAM type: YTN; PAM sequence: CTG
agttggaaaaagaggctgtt

SEQ ID NO: 189357 - DNA, 20 bp, Artificial Sequence
  Description of Artificial Sequence: Synthetic oligonucleotide
  Target: ATXN1; (-) strand; PAM type: YTN; PAM sequence: TTC
tgagttggaaaaagaggctg

SEQ ID NO: 189358 - DNA, 20 bp, Artificial Sequence
  Description of Artificial Sequence: Synthetic oligonucleotide
  Target: ATXN1; (-) strand; PAM type: YTN; PAM sequence: TTA
gttctgagttggaaaaagag

SEQ ID NO: 189359 - DNA, 20 bp, Artificial Sequence
  Description of Artificial Sequence: Synthetic oligonucleotide
  Target: ATXN1; (-) strand; PAM type: YTN; PAM sequence: TTT
agttctgagttggaaaaaga

SEQ ID NO: 189360 - DNA, 20 bp, Artificial Sequence
  Description of Artificial Sequence: Synthetic oligonucleotide
  Target: ATXN1; (-) strand; PAM type: YTN; PAM sequence: CTT
tagttctgagttggaaaaag

SEQ ID NO: 189361 - DNA, 20 bp, Artificial Sequence
  Description of Artificial Sequence: Synthetic oligonucleotide
  Target: ATXN1; (-) strand; PAM type: YTN; PAM sequence: TTA
cctttagttctgagttggaa

SEQ ID NO: 189362 - DNA, 20 bp, Artificial Sequence
  Description of Artificial Sequence: Synthetic oligonucleotide
  Target: ATXN1; (-) strand; PAM type: YTN; PAM sequence: CTC
agaaaggaaatacaaagagt

SEQ ID NO: 189363 - DNA, 20 bp, Artificial Sequence
  Description of Artificial Sequence: Synthetic oligonucleotide
  Target: ATXN1; (-) strand; PAM type: YTN; PAM sequence: TTC
ctcagaaaggaaatacaaag

SEQ ID NO: 189364 - DNA, 20 bp, Artificial Sequence
  Description of Artificial Sequence: Synthetic oligonucleotide
  Target: ATXN1; (-) strand; PAM type: YTN; PAM sequence: TTA
ttcctcagaaaggaaataca

SEQ ID NO: 189365 - DNA, 20 bp, Artificial Sequence
  Description of Artificial Sequence: Synthetic oligonucleotide
  Target: ATXN1; (-) strand; PAM type: YTN; PAM sequence: TTT
attcctcagaaaggaaatac

SEQ ID NO: 189366 - DNA, 20 bp, Artificial Sequence
  Description of Artificial Sequence: Synthetic oligonucleotide
  Target: ATXN1; (-) strand; PAM type: YTN; PAM sequence: CTT
tattcctcagaaaggaaata

SEQ ID NO: 189367 - DNA, 20 bp, Artificial Sequence
  Description of Artificial Sequence: Synthetic oligonucleotide
  Target: ATXN1; (-) strand; PAM type: YTN; PAM sequence: CTC
tttattcctcagaaaggaaa

SEQ ID NO: 189368 - DNA, 20 bp, Artificial Sequence
  Description of Artificial Sequence: Synthetic oligonucleotide
  Target: ATXN1; (-) strand; PAM type: YTN; PAM sequence: TTC
tctttattcctcagaaagga

SEQ ID NO: 189369 - DNA, 20 bp, Artificial Sequence
  Description of Artificial Sequence: Synthetic oligonucleotide
  Target: ATXN1; (-) strand; PAM type: YTN; PAM sequence: CTT
ctctttattcctcagaaagg

SEQ ID NO: 189370 - DNA, 20 bp, Artificial Sequence
  Description of Artificial Sequence: Synthetic oligonucleotide
  Target: ATXN1; (-) strand; PAM type: YTN; PAM sequence: CTG
gcagcttctctttattcctc

SEQ ID NO: 189371 - DNA, 20 bp, Artificial Sequence
  Description of Artificial Sequence: Synthetic oligonucleotide
  Target: ATXN1; (-) strand; PAM type: YTN; PAM sequence: TTG
ccagcagccctggcagcttc

SEQ ID NO: 189372 - DNA, 20 bp, Artificial Sequence
  Description of Artificial Sequence: Synthetic oligonucleotide
  Target: ATXN1; (-) strand; PAM type: YTN; PAM sequence: CTG
caattgccagcagccctggc

SEQ ID NO: 189373 - DNA, 20 bp, Artificial Sequence
  Description of Artificial Sequence: Synthetic oligonucleotide
  Target: ATXN1; (-) strand; PAM type: YTN; PAM sequence: CTC
tgcaattgccagcagccctg

SEQ ID NO: 189374 - DNA, 20 bp, Artificial Sequence
  Description of Artificial Sequence: Synthetic oligonucleotide
  Target: ATXN1; (-) strand; PAM type: YTN; PAM sequence: CTG
aactctgcaattgccagcag

SEQ ID NO: 189375 - DNA, 20 bp, Artificial Sequence
  Description of Artificial Sequence: Synthetic oligonucleotide
  Target: ATXN1; (-) strand; PAM type: YTN; PAM sequence: TTC
tgaactctgcaattgccagc

SEQ ID NO: 189376 - DNA, 20 bp, Artificial Sequence
  Description of Artificial Sequence: Synthetic oligonucleotide
  Target: ATXN1; (-) strand; PAM type: YTN; PAM sequence: TTT
ctgaactctgcaattgccag

SEQ ID NO: 189377 - DNA, 20 bp, Artificial Sequence
  Description of Artificial Sequence: Synthetic oligonucleotide
  Target: ATXN1; (-) strand; PAM type: YTN; PAM sequence: TTC
agaggaagcatttctgaact

SEQ ID NO: 189378 - DNA, 20 bp, Artificial Sequence
  Description of Artificial Sequence: Synthetic oligonucleotide
  Target: ATXN1; (-) strand; PAM type: YTN; PAM sequence: CTC
attcagaggaagcatttctg

SEQ ID NO: 189379 - DNA, 20 bp, Artificial Sequence
  Description of Artificial Sequence: Synthetic oligonucleotide
  Target: ATXN1; (-) strand; PAM type: YTN; PAM sequence: CTG
agtgtgctcattcagaggaa

SEQ ID NO: 189380 - DNA, 20 bp, Artificial Sequence
  Description of Artificial Sequence: Synthetic oligonucleotide
  Target: ATXN1; (-) strand; PAM type: YTN; PAM sequence: CTG
ggctgagtgtgctcattcag

SEQ ID NO: 189381 - DNA, 20 bp, Artificial Sequence
  Description of Artificial Sequence: Synthetic oligonucleotide
  Target: ATXN1; (-) strand; PAM type: YTN; PAM sequence: CTG
ctgggctgagtgtgctcatt

SEQ ID NO: 189382 - DNA, 20 bp, Artificial Sequence
  Description of Artificial Sequence: Synthetic oligonucleotide
  Target: ATXN1; (-) strand; PAM type: YTN; PAM sequence: CTG
caccctgctgggctgagtgt

SEQ ID NO: 189383 - DNA, 20 bp, Artificial Sequence
  Description of Artificial Sequence: Synthetic oligonucleotide
  Target: ATXN1; (-) strand; PAM type: YTN; PAM sequence: CTC
tgcaccctgctgggctgagt

SEQ ID NO: 189384 - DNA, 20 bp, Artificial Sequence
  Description of Artificial Sequence: Synthetic oligonucleotide
  Target: ATXN1; (-) strand; PAM type: YTN; PAM sequence: TTG
gtgggcagggtggagacagg

SEQ ID NO: 189385 - DNA, 20 bp, Artificial Sequence
  Description of Artificial Sequence: Synthetic oligonucleotide
  Target: ATXN1; (-) strand; PAM type: YTN; PAM sequence: CTT
ggtgggcagggtggagacag

SEQ ID NO: 189386 - DNA, 20 bp, Artificial Sequence
  Description of Artificial Sequence: Synthetic oligonucleotide
  Target: ATXN1; (-) strand; PAM type: YTN; PAM sequence: CTC
cttggtgggcagggtggaga

SEQ ID NO: 189387 - DNA, 20 bp, Artificial Sequence
  Description of Artificial Sequence: Synthetic oligonucleotide
  Target: ATXN1; (-) strand; PAM type: YTN; PAM sequence: TTA
agctccttggtgggcagggt

SEQ ID NO: 189388 - DNA, 20 bp, Artificial Sequence
  Description of Artificial Sequence: Synthetic oligonucleotide
  Target: ATXN1; (-) strand; PAM type: YTN; PAM sequence: CTT
aagctccttggtgggcaggg

SEQ ID NO: 189389 - DNA, 20 bp, Artificial Sequence
  Description of Artificial Sequence: Synthetic oligonucleotide
  Target: ATXN1; (-) strand; PAM type: YTN; PAM sequence: CTG
ccacttaagctccttggtgg

SEQ ID NO: 189390 - DNA, 20 bp, Artificial Sequence
  Description of Artificial Sequence: Synthetic oligonucleotide
  Target: ATXN1; (-) strand; PAM type: YTN; PAM sequence: TTG
cctgccacttaagctccttg

SEQ ID NO: 189391 - DNA, 20 bp, Artificial Sequence
  Description of Artificial Sequence: Synthetic oligonucleotide
  Target: ATXN1; (-) strand; PAM type: YTN; PAM sequence: TTT
gcctgccacttaagctcctt

SEQ ID NO: 189392 - DNA, 20 bp, Artificial Sequence
  Description of Artificial Sequence: Synthetic oligonucleotide
  Target: ATXN1; (-) strand; PAM type: YTN; PAM sequence: TTG
gcccagtttgcctgccactt

SEQ ID NO: 189393 - DNA, 20 bp, Artificial Sequence
  Description of Artificial Sequence: Synthetic oligonucleotide
  Target: ATXN1; (-) strand; PAM type: YTN; PAM sequence: TTT
ggcccagtttgcctgccact

SEQ ID NO: 189394 - DNA, 20 bp, Artificial Sequence
  Description of Artificial Sequence: Synthetic oligonucleotide
  Target: ATXN1; (-) strand; PAM type: YTN; PAM sequence: TTT
tggcccagtttgcctgccac

SEQ ID NO: 189395 - DNA, 20 bp, Artificial Sequence
  Description of Artificial Sequence: Synthetic oligonucleotide
  Target: ATXN1; (-) strand; PAM type: YTN; PAM sequence: TTT
ttggcccagtttgcctgcca

SEQ ID NO: 189396 - DNA, 20 bp, Artificial Sequence
  Description of Artificial Sequence: Synthetic oligonucleotide
  Target: ATXN1; (-) strand; PAM type: YTN; PAM sequence: CTC
catgggaaaggggtgttttt

SEQ ID NO: 189397 - DNA, 20 bp, Artificial Sequence
  Description of Artificial Sequence: Synthetic oligonucleotide
  Target: ATXN1; (-) strand; PAM type: YTN; PAM sequence: CTC
tccatgggaaaggggtgttt

SEQ ID NO: 189398 - DNA, 20 bp, Artificial Sequence
  Description of Artificial Sequence: Synthetic oligonucleotide
  Target: ATXN1; (-) strand; PAM type: YTN; PAM sequence: CTG
gagatgcctctccatgggaa

SEQ ID NO: 189399 - DNA, 20 bp, Artificial Sequence
  Description of Artificial Sequence: Synthetic oligonucleotide
  Target: ATXN1; (-) strand; PAM type: YTN; PAM sequence: CTG
cactggagatgcctctccat

SEQ ID NO: 189400 - DNA, 20 bp, Artificial Sequence
  Description of Artificial Sequence: Synthetic oligonucleotide
  Target: ATXN1; (-) strand; PAM type: YTN; PAM sequence: CTC
agtccagccctgcactggag

SEQ ID NO: 189401 - DNA, 20 bp, Artificial Sequence
  Description of Artificial Sequence: Synthetic oligonucleotide
  Target: ATXN1; (-) strand; PAM type: YTN; PAM sequence: CTC
tcagtccagccctgcactgg

SEQ ID NO: 189402 - DNA, 20 bp, Artificial Sequence
  Description of Artificial Sequence: Synthetic oligonucleotide
  Target: ATXN1; (-) strand; PAM type: YTN; PAM sequence: CTG
gagatgcctctcagtccagc

SEQ ID NO: 189403 - DNA, 20 bp, Artificial Sequence
  Description of Artificial Sequence: Synthetic oligonucleotide
  Target: ATXN1; (-) strand; PAM type: YTN; PAM sequence: CTG
cactggagatgcctctcagt

SEQ ID NO: 189404 - DNA, 20 bp, Artificial Sequence
  Description of Artificial Sequence: Synthetic oligonucleotide
  Target: ATXN1; (-) strand; PAM type: YTN; PAM sequence: CTC
agtccagccctgcactggag

SEQ ID NO: 189405 - DNA, 20 bp, Artificial Sequence
  Description of Artificial Sequence: Synthetic oligonucleotide
  Target: ATXN1; (-) strand; PAM type: YTN; PAM sequence: CTC
tcagtccagccctgcactgg

SEQ ID NO: 189406 - DNA, 20 bp, Artificial Sequence
  Description of Artificial Sequence: Synthetic oligonucleotide
  Target: ATXN1; (-) strand; PAM type: YTN; PAM sequence: CTG
gagatgcctctcagtccagc

SEQ ID NO: 189407 - DNA, 20 bp, Artificial Sequence
  Description of Artificial Sequence: Synthetic oligonucleotide
  Target: ATXN1; (-) strand; PAM type: YTN; PAM sequence: CTG
cactggagatgcctctcagt

SEQ ID NO: 189408 - DNA, 20 bp, Artificial Sequence
  Description of Artificial Sequence: Synthetic oligonucleotide
  Target: ATXN1; (-) strand; PAM type: YTN; PAM sequence: CTC
agtccagccctgcactggag

SEQ ID NO: 189409 - DNA, 20 bp, Artificial Sequence
  Description of Artificial Sequence: Synthetic oligonucleotide
  Target: ATXN1; (-) strand; PAM type: YTN; PAM sequence: CTC
tcagtccagccctgcactgg

SEQ ID NO: 189410 - DNA, 20 bp, Artificial Sequence
  Description of Artificial Sequence: Synthetic oligonucleotide
  Target: ATXN1; (-) strand; PAM type: YTN; PAM sequence: CTG
gactctcagtccagccctgc

SEQ ID NO: 189411 - DNA, 20 bp, Artificial Sequence
  Description of Artificial Sequence: Synthetic oligonucleotide
  Target: ATXN1; (-) strand; PAM type: YTN; PAM sequence: CTA
actggactctcagtccagcc

SEQ ID NO: 189412 - DNA, 20 bp, Artificial Sequence
  Description of Artificial Sequence: Synthetic oligonucleotide
  Target: ATXN1; (-) strand; PAM type: YTN; PAM sequence: TTG
aggtctaactggactctcag

SEQ ID NO: 189413 - DNA, 20 bp, Artificial Sequence
  Description of Artificial Sequence: Synthetic oligonucleotide
  Target: ATXN1; (-) strand; PAM type: YTN; PAM sequence: CTT
gaggtctaactggactctca

SEQ ID NO: 189414 - DNA, 20 bp, Artificial Sequence
  Description of Artificial Sequence: Synthetic oligonucleotide
  Target: ATXN1; (-) strand; PAM type: YTN; PAM sequence: TTC
ttgaggtctaactggactct

SEQ ID NO: 189415 - DNA, 20 bp, Artificial Sequence
  Description of Artificial Sequence: Synthetic oligonucleotide
  Target: ATXN1; (-) strand; PAM type: YTN; PAM sequence: CTT
cttgaggtctaactggactc

SEQ ID NO: 189416 - DNA, 20 bp, Artificial Sequence
  Description of Artificial Sequence: Synthetic oligonucleotide
  Target: ATXN1; (-) strand; PAM type: YTN; PAM sequence: CTC
ttcttgaggtctaactggac

SEQ ID NO: 189417 - DNA, 20 bp, Artificial Sequence
  Description of Artificial Sequence: Synthetic oligonucleotide
  Target: ATXN1; (-) strand; PAM type: YTN; PAM sequence: CTC
caactcttcttgaggtctaa

SEQ ID NO: 189418 - DNA, 20 bp, Artificial Sequence
  Description of Artificial Sequence: Synthetic oligonucleotide
  Target: ATXN1; (-) strand; PAM type: YTN; PAM sequence: CTC
cctccaactcttcttgaggt

SEQ ID NO: 189419 - DNA, 20 bp, Artificial Sequence
  Description of Artificial Sequence: Synthetic oligonucleotide
  Target: ATXN1; (-) strand; PAM type: YTN; PAM sequence: CTG
acctccctccaactcttctt

SEQ ID NO: 189420 - DNA, 20 bp, Artificial Sequence
  Description of Artificial Sequence: Synthetic oligonucleotide
  Target: ATXN1; (-) strand; PAM type: YTN; PAM sequence: CTC
ccacgctgacctccctccaa

SEQ ID NO: 189421 - DNA, 20 bp, Artificial Sequence
  Description of Artificial Sequence: Synthetic oligonucleotide
  Target: ATXN1; (-) strand; PAM type: YTN; PAM sequence: CTA
cctcccacgctgacctccct

SEQ ID NO: 189422 - DNA, 20 bp, Artificial Sequence
  Description of Artificial Sequence: Synthetic oligonucleotide
  Target: ATXN1; (-) strand; PAM type: YTN; PAM sequence: TTG
gcctacctcccacgctgacc

SEQ ID NO: 189423 - DNA, 20 bp, Artificial Sequence
  Description of Artificial Sequence: Synthetic oligonucleotide
  Target: ATXN1; (-) strand; PAM type: YTN; PAM sequence: TTT
ggcctacctcccacgctgac

SEQ ID NO: 189424 - DNA, 20 bp, Artificial Sequence
  Description of Artificial Sequence: Synthetic oligonucleotide
  Target: ATXN1; (-) strand; PAM type: YTN; PAM sequence: TTT
tggcctacctcccacgctga

SEQ ID NO: 189425 - DNA, 20 bp, Artificial Sequence
  Description of Artificial Sequence: Synthetic oligonucleotide
  Target: ATXN1; (-) strand; PAM type: YTN; PAM sequence: TTG
agttttggcctacctcccac

SEQ ID NO: 189426 - DNA, 20 bp, Artificial Sequence
  Description of Artificial Sequence: Synthetic oligonucleotide
  Target: ATXN1; (-) strand; PAM type: YTN; PAM sequence: CTT
gagttttggcctacctccca

SEQ ID NO: 189427 - DNA, 20 bp, Artificial Sequence
  Description of Artificial Sequence: Synthetic oligonucleotide
  Target: ATXN1; (-) strand; PAM type: YTN; PAM sequence: TTC
agaataccttgagttttggc

SEQ ID NO: 189428 - DNA, 20 bp, Artificial Sequence
  Description of Artificial Sequence: Synthetic oligonucleotide
  Target: ATXN1; (-) strand; PAM type: YTN; PAM sequence: CTT
cagaataccttgagttttgg

SEQ ID NO: 189429 - DNA, 20 bp, Artificial Sequence
  Description of Artificial Sequence: Synthetic oligonucleotide
  Target: ATXN1; (-) strand; PAM type: YTN; PAM sequence: TTC
ttcagaataccttgagtttt

SEQ ID NO: 189430 - DNA, 20 bp, Artificial Sequence
  Description of Artificial Sequence: Synthetic oligonucleotide
  Target: ATXN1; (-) strand; PAM type: YTN; PAM sequence: TTG
tgaataaatcatattcttca

SEQ ID NO: 189431 - DNA, 20 bp, Artificial Sequence
  Description of Artificial Sequence: Synthetic oligonucleotide
  Target: ATXN1; (-) strand; PAM type: YTN; PAM sequence: CTG
aacagggaacgcatgatatt

SEQ ID NO: 189432 - DNA, 20 bp, Artificial Sequence
  Description of Artificial Sequence: Synthetic oligonucleotide
  Target: ATXN1; (-) strand; PAM type: YTN; PAM sequence: TTG
actgaacagggaacgcatga

SEQ ID NO: 189433 - DNA, 20 bp, Artificial Sequence
  Description of Artificial Sequence: Synthetic oligonucleotide
  Target: ATXN1; (-) strand; PAM type: YTN; PAM sequence: CTC
ccataaatgatcaaatgttg

SEQ ID NO: 189434 - DNA, 20 bp, Artificial Sequence
  Description of Artificial Sequence: Synthetic oligonucleotide
  Target: ATXN1; (-) strand; PAM type: YTN; PAM sequence: TTA
caatggataactcccataaa

SEQ ID NO: 189435 - DNA, 20 bp, Artificial Sequence
  Description of Artificial Sequence: Synthetic oligonucleotide
  Target: ATXN1; (-) strand; PAM type: YTN; PAM sequence: TTT
acaatggataactcccataa

SEQ ID NO: 189436 - DNA, 20 bp, Artificial Sequence
  Description of Artificial Sequence: Synthetic oligonucleotide
  Target: ATXN1; (-) strand; PAM type: YTN; PAM sequence: TTT
tacaatggataactcccata

SEQ ID NO: 189437 - DNA, 20 bp, Artificial Sequence
  Description of Artificial Sequence: Synthetic oligonucleotide
  Target: ATXN1; (-) strand; PAM type: YTN; PAM sequence: TTG
taagaaattttacaatggat

SEQ ID NO: 189438 - DNA, 20 bp, Artificial Sequence
  Description of Artificial Sequence: Synthetic oligonucleotide
  Target: ATXN1; (-) strand; PAM type: YTN; PAM sequence: TTT
gtaagaaattttacaatgga

SEQ ID NO: 189439 - DNA, 20 bp, Artificial Sequence
  Description of Artificial Sequence: Synthetic oligonucleotide
  Target: ATXN1; (-) strand; PAM type: YTN; PAM sequence: CTG
ccagtttgtaagaaatttta

SEQ ID NO: 189440 - DNA, 20 bp, Artificial Sequence
  Description of Artificial Sequence: Synthetic oligonucleotide
  Target: ATXN1; (-) strand; PAM type: YTN; PAM sequence: CTA
ggtatccaaggactgccagt

SEQ ID NO: 189441 - DNA, 20 bp, Artificial Sequence
  Description of Artificial Sequence: Synthetic oligonucleotide
  Target: ATXN1; (-) strand; PAM type: YTN; PAM sequence: CTG
agtgcatgctaggtatccaa

SEQ ID NO: 189442 - DNA, 20 bp, Artificial Sequence
  Description of Artificial Sequence: Synthetic oligonucleotide
  Target: ATXN1; (-) strand; PAM type: YTN; PAM sequence: TTC
tgagtgcatgctaggtatcc

SEQ ID NO: 189443 - DNA, 20 bp, Artificial Sequence
  Description of Artificial Sequence: Synthetic oligonucleotide
  Target: ATXN1; (-) strand; PAM type: YTN; PAM sequence: TTA
atatacacagagaatattct

SEQ ID NO: 189444 - DNA, 20 bp, Artificial Sequence
  Description of Artificial Sequence: Synthetic oligonucleotide
  Target: ATXN1; (-) strand; PAM type: YTN; PAM sequence: TTG
aacacaaaccagttaatata

SEQ ID NO: 189445 - DNA, 20 bp, Artificial Sequence
  Description of Artificial Sequence: Synthetic oligonucleotide
  Target: ATXN1; (-) strand; PAM type: YTN; PAM sequence: CTT
gaacacaaaccagttaatat

SEQ ID NO: 189446 - DNA, 20 bp, Artificial Sequence
  Description of Artificial Sequence: Synthetic oligonucleotide
  Target: ATXN1; (-) strand; PAM type: YTN; PAM sequence: TTC
cttgaacacaaaccagttaa

SEQ ID NO: 189447 - DNA, 20 bp, Artificial Sequence
  Description of Artificial Sequence: Synthetic oligonucleotide
  Target: ATXN1; (-) strand; PAM type: YTN; PAM sequence: TTA
ttccttgaacacaaaccagt

SEQ ID NO: 189448 - DNA, 20 bp, Artificial Sequence
  Description of Artificial Sequence: Synthetic oligonucleotide
  Target: ATXN1; (-) strand; PAM type: YTN; PAM sequence: TTT
attccttgaacacaaaccag

SEQ ID NO: 189449 - DNA, 20 bp, Artificial Sequence
  Description of Artificial Sequence: Synthetic oligonucleotide
  Target: ATXN1; (-) strand; PAM type: YTN; PAM sequence: TTT
tattccttgaacacaaacca

SEQ ID NO: 189450 - DNA, 20 bp, Artificial Sequence
  Description of Artificial Sequence: Synthetic oligonucleotide
  Target: ATXN1; (-) strand; PAM type: YTN; PAM sequence: TTG
gattttattccttgaacaca

SEQ ID NO: 189451 - DNA, 20 bp, Artificial Sequence
  Description of Artificial Sequence: Synthetic oligonucleotide
  Target: ATXN1; (-) strand; PAM type: YTN; PAM sequence: TTT
ggattttattccttgaacac

SEQ ID NO: 189452 - DNA, 20 bp, Artificial Sequence
  Description of Artificial Sequence: Synthetic oligonucleotide
  Target: ATXN1; (-) strand; PAM type: YTN; PAM sequence: TTT
tggattttattccttgaaca

SEQ ID NO: 189453 - DNA, 20 bp, Artificial Sequence
  Description of Artificial Sequence: Synthetic oligonucleotide
  Target: ATXN1; (-) strand; PAM type: YTN; PAM sequence: CTA
attttggattttattccttg

SEQ ID NO: 189454 - DNA, 20 bp, Artificial Sequence
  Description of Artificial Sequence: Synthetic oligonucleotide
  Target: ATXN1; (-) strand; PAM type: YTN; PAM sequence: TTA
ggccggtactaattttggat

SEQ ID NO: 189455 - DNA, 20 bp, Artificial Sequence
  Description of Artificial Sequence: Synthetic oligonucleotide
  Target: ATXN1; (-) strand; PAM type: YTN; PAM sequence: TTT
aggccggtactaattttgga

SEQ ID NO: 189456 - DNA, 20 bp, Artificial Sequence
  Description of Artificial Sequence: Synthetic oligonucleotide
  Target: ATXN1; (-) strand; PAM type: YTN; PAM sequence: CTT
taggccggtactaattttgg

SEQ ID NO: 189457 - DNA, 20 bp, Artificial Sequence
  Description of Artificial Sequence: Synthetic oligonucleotide
  Target: ATXN1; (-) strand; PAM type: YTN; PAM sequence: TTC
tttaggccggtactaatttt

SEQ ID NO: 189458 - DNA, 20 bp, Artificial Sequence
  Description of Artificial Sequence: Synthetic oligonucleotide
  Target: ATXN1; (-) strand; PAM type: YTN; PAM sequence: CTG
ataatgtgttctttaggccg

SEQ ID NO: 189459 - DNA, 20 bp, Artificial Sequence
  Description of Artificial Sequence: Synthetic oligonucleotide
  Target: ATXN1; (-) strand; PAM type: YTN; PAM sequence: CTC
tgataatgtgttctttaggc

SEQ ID NO: 189460 - DNA, 20 bp, Artificial Sequence
  Description of Artificial Sequence: Synthetic oligonucleotide
  Target: ATXN1; (-) strand; PAM type: YTN; PAM sequence: TTA
tctctgataatgtgttcttt

SEQ ID NO: 189461 - DNA, 20 bp, Artificial Sequence
  Description of Artificial Sequence: Synthetic oligonucleotide
  Target: ATXN1; (-) strand; PAM type: YTN; PAM sequence: TTT
atctctgataatgtgttctt

SEQ ID NO: 189462 - DNA, 20 bp, Artificial Sequence
  Description of Artificial Sequence: Synthetic oligonucleotide
  Target: ATXN1; (-) strand; PAM type: YTN; PAM sequence: TTC
cagcatatttatctctgata

SEQ ID NO: 189463 - DNA, 20 bp, Artificial Sequence
  Description of Artificial Sequence: Synthetic oligonucleotide
  Target: ATXN1; (-) strand; PAM type: YTN; PAM sequence: TTT
ccagcatatttatctctgat

SEQ ID NO: 189464 - DNA, 20 bp, Artificial Sequence
  Description of Artificial Sequence: Synthetic oligonucleotide
  Target: ATXN1; (-) strand; PAM type: YTN; PAM sequence: TTT
tccagcatatttatctctga

SEQ ID NO: 189465 - DNA, 20 bp, Artificial Sequence
  Description of Artificial Sequence: Synthetic oligonucleotide
  Target: ATXN1; (-) strand; PAM type: YTN; PAM sequence: TTT
ttccagcatatttatctctg

SEQ ID NO: 189466 - DNA, 20 bp, Artificial Sequence
  Description of Artificial Sequence: Synthetic oligonucleotide
  Target: ATXN1; (-) strand; PAM type: YTN; PAM sequence: TTG
aggatagacatttttccagc

SEQ ID NO: 189467 - DNA, 20 bp, Artificial Sequence
  Description of Artificial Sequence: Synthetic oligonucleotide
  Target: ATXN1; (-) strand; PAM type: YTN; PAM sequence: TTT
gaggatagacatttttccag

SEQ ID NO: 189468 - DNA, 20 bp, Artificial Sequence
  Description of Artificial Sequence: Synthetic oligonucleotide
  Target: ATXN1; (-) strand; PAM type: YTN; PAM sequence: CTT
tgaggatagacatttttcca

SEQ ID NO: 189469 - DNA, 20 bp, Artificial Sequence
  Description of Artificial Sequence: Synthetic oligonucleotide
  Target: ATXN1; (-) strand; PAM type: YTN; PAM sequence: TTA
aaaaacctttgaggatagac

SEQ ID NO: 189470 - DNA, 20 bp, Artificial Sequence
  Description of Artificial Sequence: Synthetic oligonucleotide
  Target: ATXN1; (-) strand; PAM type: YTN; PAM sequence: TTT
aaaaaacctttgaggataga

SEQ ID NO: 189471 - DNA, 20 bp, Artificial Sequence
  Description of Artificial Sequence: Synthetic oligonucleotide
  Target: ATXN1; (-) strand; PAM type: YTN; PAM sequence: TTT
taaaaaacctttgaggatag

SEQ ID NO: 189472 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaacctttgaggata

SEQ ID NO: 189473 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaacctttgaggat

SEQ ID NO: 189474 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaacctttgagga

SEQ ID NO: 189475 - DNA, 20 bp, Artificial Sequence
  Description of Artificial Sequence: Synthetic oligonucleotide
  Target: ATXN1; (-) strand; PAM type: YTN; PAM sequence: CTA
atgataagaagcagtgacat

SEQ ID NO: 189476 - DNA, 20 bp, Artificial Sequence
  Description of Artificial Sequence: Synthetic oligonucleotide
  Target: ATXN1; (-) strand; PAM type: YTN; PAM sequence: TTA
tgtgataagccatgctaatg

SEQ ID NO: 189477 - DNA, 20 bp, Artificial Sequence
  Description of Artificial Sequence: Synthetic oligonucleotide
  Target: ATXN1; (-) strand; PAM type: YTN; PAM sequence: TTT
atgtgataagccatgctaat

SEQ ID NO: 189478 - DNA, 20 bp, Artificial Sequence
  Description of Artificial Sequence: Synthetic oligonucleotide
  Target: ATXN1; (-) strand; PAM type: YTN; PAM sequence: CTT
tatgtgataagccatgctaa

SEQ ID NO: 189479 - DNA, 20 bp, Artificial Sequence
  Description of Artificial Sequence: Synthetic oligonucleotide
  Target: ATXN1; (-) strand; PAM type: YTN; PAM sequence: TTA
cctttatgtgataagccatg

SEQ ID NO: 189480 - DNA, 20 bp, Artificial Sequence
  Description of Artificial Sequence: Synthetic oligonucleotide
  Target: ATXN1; (-) strand; PAM type: YTN; PAM sequence: CTT
acctttatgtgataagccat

SEQ ID NO: 189481 - DNA, 20 bp, Artificial Sequence
  Description of Artificial Sequence: Synthetic oligonucleotide
  Target: ATXN1; (-) strand; PAM type: YTN; PAM sequence: CTG
tatgaataaatccttacctt

SEQ ID NO: 189482 - DNA, 20 bp, Artificial Sequence
  Description of Artificial Sequence: Synthetic oligonucleotide
  Target: ATXN1; (-) strand; PAM type: YTN; PAM sequence: CTC
tgtatgaataaatccttacc

SEQ ID NO: 189483 - DNA, 20 bp, Artificial Sequence
  Description of Artificial Sequence: Synthetic oligonucleotide
  Target: ATXN1; (-) strand; PAM type: YTN; PAM sequence: CTG
catacaaatacacacagcag

SEQ ID NO: 189484 - DNA, 20 bp, Artificial Sequence
  Description of Artificial Sequence: Synthetic oligonucleotide
  Target: ATXN1; (-) strand; PAM type: YTN; PAM sequence: CTA
cgtccataaggagatgtaac

SEQ ID NO: 189485 - DNA, 20 bp, Artificial Sequence
  Description of Artificial Sequence: Synthetic oligonucleotide
  Target: ATXN1; (-) strand; PAM type: YTN; PAM sequence: TTG
cactacgtccataaggagat

SEQ ID NO: 189486 - DNA, 20 bp, Artificial Sequence
  Description of Artificial Sequence: Synthetic oligonucleotide
  Target: ATXN1; (-) strand; PAM type: YTN; PAM sequence: TTT
gcactacgtccataaggaga

SEQ ID NO: 189487 - DNA, 20 bp, Artificial Sequence
  Description of Artificial Sequence: Synthetic oligonucleotide
  Target: ATXN1; (-) strand; PAM type: YTN; PAM sequence: CTT
tgcactacgtccataaggag

SEQ ID NO: 189488 - DNA, 20 bp, Artificial Sequence
  Description of Artificial Sequence: Synthetic oligonucleotide
  Target: ATXN1; (-) strand; PAM type: YTN; PAM sequence: TTC
atagcaaactttgcactacg

SEQ ID NO: 189489 - DNA, 20 bp, Artificial Sequence
  Description of Artificial Sequence: Synthetic oligonucleotide
  Target: ATXN1; (-) strand; PAM type: YTN; PAM sequence: TTT
catagcaaactttgcactac

SEQ ID NO: 189490 - DNA, 20 bp, Artificial Sequence
  Description of Artificial Sequence: Synthetic oligonucleotide
  Target: ATXN1; (-) strand; PAM type: YTN; PAM sequence: TTA
tatttcatagcaaactttgc

SEQ ID NO: 189491 - DNA, 20 bp, Artificial Sequence
  Description of Artificial Sequence: Synthetic oligonucleotide
  Target: ATXN1; (-) strand; PAM type: YTN; PAM sequence: CTC
caatgtataattatatttca

SEQ ID NO: 189492 - DNA, 20 bp, Artificial Sequence
  Description of Artificial Sequence: Synthetic oligonucleotide
  Target: ATXN1; (-) strand; PAM type: YTN; PAM sequence: TTC
tccaatgtataattatattt

SEQ ID NO: 189493 - DNA, 20 bp, Artificial Sequence
  Description of Artificial Sequence: Synthetic oligonucleotide
  Target: ATXN1; (-) strand; PAM type: YTN; PAM sequence: TTT
ctccaatgtataattatatt

SEQ ID NO: 189494 - DNA, 20 bp, Artificial Sequence
  Description of Artificial Sequence: Synthetic oligonucleotide
  Target: ATXN1; (-) strand; PAM type: YTN; PAM sequence: TTT
tctccaatgtataattatat

SEQ ID NO: 189495 - DNA, 20 bp, Artificial Sequence
  Description of Artificial Sequence: Synthetic oligonucleotide
  Target: ATXN1; (-) strand; PAM type: YTN; PAM sequence: CTT
ttctccaatgtataattata

SEQ ID NO: 189496 - DNA, 20 bp, Artificial Sequence
  Description of Artificial Sequence: Synthetic oligonucleotide
  Target: ATXN1; (-) strand; PAM type: YTN; PAM sequence: TTG
atatgcagacatacttttct

SEQ ID NO: 189497 - DNA, 20 bp, Artificial Sequence
  Description of Artificial Sequence: Synthetic oligonucleotide
  Target: ATXN1; (-) strand; PAM type: YTN; PAM sequence: CTT
gatatgcagacatacttttc

SEQ ID NO: 189498 - DNA, 20 bp, Artificial Sequence
  Description of Artificial Sequence: Synthetic oligonucleotide
  Target: ATXN1; (-) strand; PAM type: YTN; PAM sequence: TTC
ttgatatgcagacatacttt

SEQ ID NO: 189499 - DNA, 20 bp, Artificial Sequence
  Description of Artificial Sequence: Synthetic oligonucleotide
  Target: ATXN1; (-) strand; PAM type: YTN; PAM sequence: TTA
ttcttgatatgcagacatac

SEQ ID NO: 189500 - DNA, 20 bp, Artificial Sequence
  Description of Artificial Sequence: Synthetic oligonucleotide
  Target: ATXN1; (-) strand; PAM type: YTN; PAM sequence: TTT
attcttgatatgcagacata

SEQ ID NO: 189501 - DNA, 20 bp, Artificial Sequence
  Description of Artificial Sequence: Synthetic oligonucleotide
  Target: ATXN1; (-) strand; PAM type: YTN; PAM sequence: TTT
tattcttgatatgcagacat

SEQ ID NO: 189502 - DNA, 20 bp, Artificial Sequence
  Description of Artificial Sequence: Synthetic oligonucleotide
  Target: ATXN1; (-) strand; PAM type: YTN; PAM sequence: TTC
attttattcttgatatgcag

SEQ ID NO: 189503 - DNA, 20 bp, Artificial Sequence
  Description of Artificial Sequence: Synthetic oligonucleotide
  Target: ATXN1; (-) strand; PAM type: YTN; PAM sequence: TTT
cattttattcttgatatgca

SEQ ID NO: 189504 - DNA, 20 bp, Artificial Sequence
  Description of Artificial Sequence: Synthetic oligonucleotide
  Target: ATXN1; (-) strand; PAM type: YTN; PAM sequence: TTT
tcattttattcttgatatgc

SEQ ID NO: 189505 - DNA, 20 bp, Artificial Sequence
  Description of Artificial Sequence: Synthetic oligonucleotide
  Target: ATXN1; (-) strand; PAM type: YTN; PAM sequence: TTA
ttttcattttattcttgata

SEQ ID NO: 189506 - DNA, 20 bp, Artificial Sequence
  Description of Artificial Sequence: Synthetic oligonucleotide
  Target: ATXN1; (-) strand; PAM type: YTN; PAM sequence: TTT
attttcattttattcttgat

SEQ ID NO: 189507 - DNA, 20 bp, Artificial Sequence
  Description of Artificial Sequence: Synthetic oligonucleotide
  Target: ATXN1; (-) strand; PAM type: YTN; PAM sequence: TTT
tattttcattttattcttga

SEQ ID NO: 189508 - DNA, 20 bp, Artificial Sequence
  Description of Artificial Sequence: Synthetic oligonucleotide
  Target: ATXN1; (-) strand; PAM type: YTN; PAM sequence: TTA
cattttattttcattttatt

SEQ ID NO: 189509 - DNA, 20 bp, Artificial Sequence
  Description of Artificial Sequence: Synthetic oligonucleotide
  Target: ATXN1; (-) strand; PAM type: YTN; PAM sequence: CTT
acattttattttcattttat

SEQ ID NO: 189510 - DNA, 20 bp, Artificial Sequence
  Description of Artificial Sequence: Synthetic oligonucleotide
  Target: ATXN1; (-) strand; PAM type: YTN; PAM sequence: TTC
aacttacattttattttcat

SEQ ID NO: 189511 - DNA, 20 bp, Artificial Sequence
  Description of Artificial Sequence: Synthetic oligonucleotide
  Target: ATXN1; (-) strand; PAM type: YTN; PAM sequence: CTA
tatgttcaacttacatttta

SEQ ID NO: 189512 - DNA, 20 bp, Artificial Sequence
  Description of Artificial Sequence: Synthetic oligonucleotide
  Target: ATXN1; (-) strand; PAM type: YTN; PAM sequence: TTA
tcatctatatgttcaactta

SEQ ID NO: 189513 - DNA, 20 bp, Artificial Sequence
  Description of Artificial Sequence: Synthetic oligonucleotide
  Target: ATXN1; (-) strand; PAM type: YTN; PAM sequence: TTT
atcatctatatgttcaactt

SEQ ID NO: 189514 - DNA, 20 bp, Artificial Sequence
  Description of Artificial Sequence: Synthetic oligonucleotide
  Target: ATXN1; (-) strand; PAM type: YTN; PAM sequence: TTG
ggtatttatcatctatatgt

SEQ ID NO: 189515 - DNA, 20 bp, Artificial Sequence
  Description of Artificial Sequence: Synthetic oligonucleotide
  Target: ATXN1; (-) strand; PAM type: YTN; PAM sequence: CTC
agcacagattgggtatttat

SEQ ID NO: 189516 - DNA, 20 bp, Artificial Sequence
  Description of Artificial Sequence: Synthetic oligonucleotide
  Target: ATXN1; (-) strand; PAM type: YTN; PAM sequence: CTG
ctcagcacagattgggtatt

SEQ ID NO: 189517 - DNA, 20 bp, Artificial Sequence
  Description of Artificial Sequence: Synthetic oligonucleotide
  Target: ATXN1; (-) strand; PAM type: YTN; PAM sequence: CTA
cagctgctcagcacagattg

SEQ ID NO: 189518 - DNA, 20 bp, Artificial Sequence
  Description of Artificial Sequence: Synthetic oligonucleotide
  Target: ATXN1; (-) strand; PAM type: YTN; PAM sequence: TTC
tacagctgctcagcacagat

SEQ ID NO: 189519 - DNA, 20 bp, Artificial Sequence
  Description of Artificial Sequence: Synthetic oligonucleotide
  Target: ATXN1; (-) strand; PAM type: YTN; PAM sequence: CTG
agacgtcgttctacagctgc

SEQ ID NO: 189520 - DNA, 20 bp, Artificial Sequence
  Description of Artificial Sequence: Synthetic oligonucleotide
  Target: ATXN1; (-) strand; PAM type: YTN; PAM sequence: TTC
ctgagacgtcgttctacagc

SEQ ID NO: 189521 - DNA, 20 bp, Artificial Sequence
  Description of Artificial Sequence: Synthetic oligonucleotide
  Target: ATXN1; (-) strand; PAM type: YTN; PAM sequence: TTT
cctgagacgtcgttctacag

SEQ ID NO: 189522 - DNA, 20 bp, Artificial Sequence
  Description of Artificial Sequence: Synthetic oligonucleotide
  Target: ATXN1; (-) strand; PAM type: YTN; PAM sequence: CTA
atttcctgagacgtcgttct

SEQ ID NO: 189523 - DNA, 20 bp, Artificial Sequence
  Description of Artificial Sequence: Synthetic oligonucleotide
  Target: ATXN1; (-) strand; PAM type: YTN; PAM sequence: TTA
aaatactaatttcctgagac

SEQ ID NO: 189524 - DNA, 20 bp, Artificial Sequence
  Description of Artificial Sequence: Synthetic oligonucleotide
  Target: ATXN1; (-) strand; PAM type: YTN; PAM sequence: TTT
aaaatactaatttcctgaga

SEQ ID NO: 189525 - DNA, 20 bp, Artificial Sequence
  Description of Artificial Sequence: Synthetic oligonucleotide
  Target: ATXN1; (-) strand; PAM type: YTN; PAM sequence: CTT
taaaatactaatttcctgag

SEQ ID NO: 189526 - DNA, 20 bp, Artificial Sequence
  Description of Artificial Sequence: Synthetic oligonucleotide
  Target: ATXN1; (-) strand; PAM type: YTN; PAM sequence: TTG
tctttaaaatactaatttcc

SEQ ID NO: 189527 - DNA, 20 bp, Artificial Sequence
  Description of Artificial Sequence: Synthetic oligonucleotide
  Target: ATXN1; (-) strand; PAM type: YTN; PAM sequence: CTT
gtctttaaaatactaatttc

SEQ ID NO: 189528 - DNA, 20 bp, Artificial Sequence
  Description of Artificial Sequence: Synthetic oligonucleotide
  Target: ATXN1; (-) strand; PAM type: YTN; PAM sequence: TTG
tcaataggagcacatgacat

SEQ ID NO: 189529 - DNA, 20 bp, Artificial Sequence
  Description of Artificial Sequence: Synthetic oligonucleotide
  Target: ATXN1; (-) strand; PAM type: YTN; PAM sequence: TTG
aacaaataaggccaggaata

SEQ ID NO: 189530 - DNA, 20 bp, Artificial Sequence
  Description of Artificial Sequence: Synthetic oligonucleotide
  Target: ATXN1; (-) strand; PAM type: YTN; PAM sequence: CTG
cgtgttgaacaaataaggcc

SEQ ID NO: 189531 - DNA, 20 bp, Artificial Sequence
  Description of Artificial Sequence: Synthetic oligonucleotide
  Target: ATXN1; (-) strand; PAM type: YTN; PAM sequence: CTG
aaggacctgcgtgttgaaca

SEQ ID NO: 189532 - DNA, 20 bp, Artificial Sequence
  Description of Artificial Sequence: Synthetic oligonucleotide
  Target: ATXN1; (-) strand; PAM type: YTN; PAM sequence: CTA
cagcaatacctgaaggacct

SEQ ID NO: 189533 - DNA, 20 bp, Artificial Sequence
  Description of Artificial Sequence: Synthetic oligonucleotide
  Target: ATXN1; (-) strand; PAM type: YTN; PAM sequence: TTG
tgctacagcaatacctgaag

SEQ ID NO: 189534 - DNA, 20 bp, Artificial Sequence
  Description of Artificial Sequence: Synthetic oligonucleotide
  Target: ATXN1; (-) strand; PAM type: YTN; PAM sequence: CTG
ttgtgctacagcaatacctg

SEQ ID NO: 189535 - DNA, 20 bp, Artificial Sequence
  Description of Artificial Sequence: Synthetic oligonucleotide
  Target: ATXN1; (-) strand; PAM type: YTN; PAM sequence: TTC
tgttgtgctacagcaatacc

SEQ ID NO: 189536 - DNA, 20 bp, Artificial Sequence
  Description of Artificial Sequence: Synthetic oligonucleotide
  Target: ATXN1; (-) strand; PAM type: YTN; PAM sequence: TTT
ctgttgtgctacagcaatac

SEQ ID NO: 189537 - DNA, 20 bp, Artificial Sequence
  Description of Artificial Sequence: Synthetic oligonucleotide
  Target: ATXN1; (-) strand; PAM type: YTN; PAM sequence: CTT
tctgttgtgctacagcaata

SEQ ID NO: 189538 - DNA, 20 bp, Artificial Sequence
  Description of Artificial Sequence: Synthetic oligonucleotide
  Target: ATXN1; (-) strand; PAM type: YTN; PAM sequence: TTC
tttctgttgtgctacagcaa

SEQ ID NO: 189539 - DNA, 20 bp, Artificial Sequence
  Description of Artificial Sequence: Synthetic oligonucleotide
  Target: ATXN1; (-) strand; PAM type: YTN; PAM sequence: CTG
ttctttctgttgtgctacag

SEQ ID NO: 189540 - DNA, 20 bp, Artificial Sequence
  Description of Artificial Sequence: Synthetic oligonucleotide
  Target: ATXN1; (-) strand; PAM type: YTN; PAM sequence: CTG
gcccactgttctttctgttg

SEQ ID NO: 189541 - DNA, 20 bp, Artificial Sequence
  Description of Artificial Sequence: Synthetic oligonucleotide
  Target: ATXN1; (-) strand; PAM type: YTN; PAM sequence: TTC
tggcccactgttctttctgt

SEQ ID NO: 189542 - DNA, 20 bp, Artificial Sequence
  Description of Artificial Sequence: Synthetic oligonucleotide
  Target: ATXN1; (-) strand; PAM type: YTN; PAM sequence: CTT
ctggcccactgttctttctg

SEQ ID NO: 189543 - DNA, 20 bp, Artificial Sequence
  Description of Artificial Sequence: Synthetic oligonucleotide
  Target: ATXN1; (-) strand; PAM type: YTN; PAM sequence: CTG
tcttctggcccactgttctt

SEQ ID NO: 189544 - DNA, 20 bp, Artificial Sequence
  Description of Artificial Sequence: Synthetic oligonucleotide
  Target: ATXN1; (-) strand; PAM type: YTN; PAM sequence: CTC
cctgtcttctggcccactgt

SEQ ID NO: 189545 - DNA, 20 bp, Artificial Sequence
  Description of Artificial Sequence: Synthetic oligonucleotide
  Target: ATXN1; (-) strand; PAM type: YTN; PAM sequence: CTA
gacccagacctccctgtctt

SEQ ID NO: 189546 - DNA, 20 bp, Artificial Sequence
  Description of Artificial Sequence: Synthetic oligonucleotide
  Target: ATXN1; (-) strand; PAM type: YTN; PAM sequence: TTC
tagacccagacctccctgtc

SEQ ID NO: 189547 - DNA, 20 bp, Artificial Sequence
  Description of Artificial Sequence: Synthetic oligonucleotide
  Target: ATXN1; (-) strand; PAM type: YTN; PAM sequence: CTT
ctagacccagacctccctgt

SEQ ID NO: 189548 - DNA, 20 bp, Artificial Sequence
  Description of Artificial Sequence: Synthetic oligonucleotide
  Target: ATXN1; (-) strand; PAM type: YTN; PAM sequence: CTG
ggcttctagacccagacctc

SEQ ID NO: 189549 - DNA, 20 bp, Artificial Sequence
  Description of Artificial Sequence: Synthetic oligonucleotide
  Target: ATXN1; (-) strand; PAM type: YTN; PAM sequence: CTC
tgggcttctagacccagacc

SEQ ID NO: 189550 - DNA, 20 bp, Artificial Sequence
  Description of Artificial Sequence: Synthetic oligonucleotide
  Target: ATXN1; (-) strand; PAM type: YTN; PAM sequence: CTC
gggatgtggagtctctgggc

SEQ ID NO: 189551 - DNA, 20 bp, Artificial Sequence
  Description of Artificial Sequence: Synthetic oligonucleotide
  Target: ATXN1; (-) strand; PAM type: YTN; PAM sequence: CTC
atggcaaccagaaaggggat

SEQ ID NO: 189552 - DNA, 20 bp, Artificial Sequence
  Description of Artificial Sequence: Synthetic oligonucleotide
  Target: ATXN1; (-) strand; PAM type: YTN; PAM sequence: CTG
ggcagaaggtgcgtgatgac

SEQ ID NO: 189553 - DNA, 20 bp, Artificial Sequence
  Description of Artificial Sequence: Synthetic oligonucleotide
  Target: ATXN1; (-) strand; PAM type: YTN; PAM sequence: CTC
tgggcagaaggtgcgtgatg

SEQ ID NO: 189554 - DNA, 20 bp, Artificial Sequence
  Description of Artificial Sequence: Synthetic oligonucleotide
  Target: ATXN1; (-) strand; PAM type: YTN; PAM sequence: CTC
ctctgggcagaaggtgcgtg

SEQ ID NO: 189555 - DNA, 20 bp, Artificial Sequence
  Description of Artificial Sequence: Synthetic oligonucleotide
  Target: ATXN1; (-) strand; PAM type: YTN; PAM sequence: CTC
tcctctgggcagaaggtgcg

SEQ ID NO: 189556 - DNA, 20 bp, Artificial Sequence
  Description of Artificial Sequence: Synthetic oligonucleotide
  Target: ATXN1; (-) strand; PAM type: YTN; PAM sequence: TTC
aagcaggcatgaataaaact

SEQ ID NO: 189557 - DNA, 20 bp, Artificial Sequence
  Description of Artificial Sequence: Synthetic oligonucleotide
  Target: ATXN1; (-) strand; PAM type: YTN; PAM sequence: TTT
caagcaggcatgaataaaac

SEQ ID NO: 189558 - DNA, 20 bp, Artificial Sequence
  Description of Artificial Sequence: Synthetic oligonucleotide
  Target: ATXN1; (-) strand; PAM type: YTN; PAM sequence: TTT
tcaagcaggcatgaataaaa

SEQ ID NO: 189559 - DNA, 20 bp, Artificial Sequence
  Description of Artificial Sequence: Synthetic oligonucleotide
  Target: ATXN1; (-) strand; PAM type: YTN; PAM sequence: CTT
ttcaagcaggcatgaataaa

SEQ ID NO: 189560 - DNA, 20 bp, Artificial Sequence
  Description of Artificial Sequence: Synthetic oligonucleotide
  Target: ATXN1; (-) strand; PAM type: YTN; PAM sequence: CTG
accttttcaagcaggcatga

SEQ ID NO: 189561 - DNA, 20 bp, Artificial Sequence
  Description of Artificial Sequence: Synthetic oligonucleotide
  Target: ATXN1; (-) strand; PAM type: YTN; PAM sequence: CTA
aacactgaccttttcaagca

SEQ ID NO: 189562 - DNA, 20 bp, Artificial Sequence
  Description of Artificial Sequence: Synthetic oligonucleotide
  Target: ATXN1; (-) strand; PAM type: YTN; PAM sequence: CTG
caacacctaaacactgacct

SEQ ID NO: 189563 - DNA, 20 bp, Artificial Sequence
  Description of Artificial Sequence: Synthetic oligonucleotide
  Target: ATXN1; (-) strand; PAM type: YTN; PAM sequence: TTC
tgcaacacctaaacactgac

SEQ ID NO: 189564 - DNA, 20 bp, Artificial Sequence
  Description of Artificial Sequence: Synthetic oligonucleotide
  Target: ATXN1; (-) strand; PAM type: YTN; PAM sequence: CTT
ctgcaacacctaaacactga

SEQ ID NO: 189565 - DNA, 20 bp, Artificial Sequence
  Description of Artificial Sequence: Synthetic oligonucleotide
  Target: ATXN1; (-) strand; PAM type: YTN; PAM sequence: TTC
accaagcacttctgcaacac

SEQ ID NO: 189566 - DNA, 20 bp, Artificial Sequence
  Description of Artificial Sequence: Synthetic oligonucleotide
  Target: ATXN1; (-) strand; PAM type: YTN; PAM sequence: TTT
caccaagcacttctgcaaca

SEQ ID NO: 189567 - DNA, 20 bp, Artificial Sequence
  Description of Artificial Sequence: Synthetic oligonucleotide
  Target: ATXN1; (-) strand; PAM type: YTN; PAM sequence: TTT
tcaccaagcacttctgcaac

SEQ ID NO: 189568 - DNA, 20 bp, Artificial Sequence
  Description of Artificial Sequence: Synthetic oligonucleotide
  Target: ATXN1; (-) strand; PAM type: YTN; PAM sequence: TTC
cccattttcaccaagcactt

SEQ ID NO: 189569 - DNA, 20 bp, Artificial Sequence
  Description of Artificial Sequence: Synthetic oligonucleotide
  Target: ATXN1; (-) strand; PAM type: YTN; PAM sequence: CTT
ccccattttcaccaagcact

SEQ ID NO: 189570 - DNA, 20 bp, Artificial Sequence
  Description of Artificial Sequence: Synthetic oligonucleotide
  Target: ATXN1; (-) strand; PAM type: YTN; PAM sequence: TTC
agccttccccattttcacca

SEQ ID NO: 189571 - DNA, 20 bp, Artificial Sequence
  Description of Artificial Sequence: Synthetic oligonucleotide
  Target: ATXN1; (-) strand; PAM type: YTN; PAM sequence: TTT
cagccttccccattttcacc

SEQ ID NO: 189572 - DNA, 20 bp, Artificial Sequence
  Description of Artificial Sequence: Synthetic oligonucleotide
  Target: ATXN1; (-) strand; PAM type: YTN; PAM sequence: CTG
tgtttcagccttccccattt

SEQ ID NO: 189573 - DNA, 20 bp, Artificial Sequence
  Description of Artificial Sequence: Synthetic oligonucleotide
  Target: ATXN1; (-) strand; PAM type: YTN; PAM sequence: TTA
tcaaagcatgaggcacaggc

SEQ ID NO: 189574 - DNA, 20 bp, Artificial Sequence
  Description of Artificial Sequence: Synthetic oligonucleotide
  Target: ATXN1; (-) strand; PAM type: YTN; PAM sequence: TTC
agaaattatcaaagcatgag

SEQ ID NO: 189575 - DNA, 20 bp, Artificial Sequence
  Description of Artificial Sequence: Synthetic oligonucleotide
  Target: ATXN1; (-) strand; PAM type: YTN; PAM sequence: CTT
cagaaattatcaaagcatga

SEQ ID NO: 189576 - DNA, 20 bp, Artificial Sequence
  Description of Artificial Sequence: Synthetic oligonucleotide
  Target: ATXN1; (-) strand; PAM type: YTN; PAM sequence: TTA
taaatgcttcagaaattatc

SEQ ID NO: 189577 - DNA, 20 bp, Artificial Sequence
  Description of Artificial Sequence: Synthetic oligonucleotide
  Target: ATXN1; (-) strand; PAM type: YTN; PAM sequence: TTT
ataaatgcttcagaaattat

SEQ ID NO: 189578 - DNA, 20 bp, Artificial Sequence
  Description of Artificial Sequence: Synthetic oligonucleotide
  Target: ATXN1; (-) strand; PAM type: YTN; PAM sequence: CTC
atgatttataaatgcttcag

SEQ ID NO: 189579 - DNA, 20 bp, Artificial Sequence
  Description of Artificial Sequence: Synthetic oligonucleotide
  Target: ATXN1; (-) strand; PAM type: YTN; PAM sequence: CTG
ctcatgatttataaatgctt

SEQ ID NO: 189580 - DNA, 20 bp, Artificial Sequence
  Description of Artificial Sequence: Synthetic oligonucleotide
  Target: ATXN1; (-) strand; PAM type: YTN; PAM sequence: TTA
gctgctcatgatttataaat

SEQ ID NO: 189581 - DNA, 20 bp, Artificial Sequence
  Description of Artificial Sequence: Synthetic oligonucleotide
  Target: ATXN1; (-) strand; PAM type: YTN; PAM sequence: CTT
agctgctcatgatttataaa

SEQ ID NO: 189582 - DNA, 20 bp, Artificial Sequence
  Description of Artificial Sequence: Synthetic oligonucleotide
  Target: ATXN1; (-) strand; PAM type: YTN; PAM sequence: TTG
cagaccttagctgctcatga

SEQ ID NO: 189583 - DNA, 20 bp, Artificial Sequence
  Description of Artificial Sequence: Synthetic oligonucleotide
  Target: ATXN1; (-) strand; PAM type: YTN; PAM sequence: CTT
gcagaccttagctgctcatg

SEQ ID NO: 189584 - DNA, 20 bp, Artificial Sequence
  Description of Artificial Sequence: Synthetic oligonucleotide
  Target: ATXN1; (-) strand; PAM type: YTN; PAM sequence: TTA
gcatcttgcagaccttagct

SEQ ID NO: 189585 - DNA, 20 bp, Artificial Sequence
  Description of Artificial Sequence: Synthetic oligonucleotide
  Target: ATXN1; (-) strand; PAM type: YTN; PAM sequence: CTG
cacacattagcatcttgcag

SEQ ID NO: 189586 - DNA, 20 bp, Artificial Sequence
  Description of Artificial Sequence: Synthetic oligonucleotide
  Target: ATXN1; (-) strand; PAM type: YTN; PAM sequence: CTG
gactgcacacattagcatct

SEQ ID NO: 189587 - DNA, 20 bp, Artificial Sequence
  Description of Artificial Sequence: Synthetic oligonucleotide
  Target: ATXN1; (-) strand; PAM type: YTN; PAM sequence: TTA
aagtcagaggactggactgc

SEQ ID NO: 189588 - DNA, 20 bp, Artificial Sequence
  Description of Artificial Sequence: Synthetic oligonucleotide
  Target: ATXN1; (-) strand; PAM type: YTN; PAM sequence: CTT
aaagtcagaggactggactg

SEQ ID NO: 189589 - DNA, 20 bp, Artificial Sequence
  Description of Artificial Sequence: Synthetic oligonucleotide
  Target: ATXN1; (-) strand; PAM type: YTN; PAM sequence: CTG
aaacagacttaaagtcagag

SEQ ID NO: 189590 - DNA, 20 bp, Artificial Sequence
  Description of Artificial Sequence: Synthetic oligonucleotide
  Target: ATXN1; (-) strand; PAM type: YTN; PAM sequence: TTA
aaaaggagcaaatagagcag

SEQ ID NO: 189591 - DNA, 20 bp, Artificial Sequence
  Description of Artificial Sequence: Synthetic oligonucleotide
  Target: ATXN1; (-) strand; PAM type: YTN; PAM sequence: TTA
ttaaaaaggagcaaatagag

SEQ ID NO: 189592 - DNA, 20 bp, Artificial Sequence
  Description of Artificial Sequence: Synthetic oligonucleotide
  Target: ATXN1; (-) strand; PAM type: YTN; PAM sequence: TTG
tgttattaaaaaggagcaaa

SEQ ID NO: 189593 - DNA, 20 bp, Artificial Sequence
  Description of Artificial Sequence: Synthetic oligonucleotide
  Target: ATXN1; (-) strand; PAM type: YTN; PAM sequence: CTA
attgtgttattaaaaaggag

SEQ ID NO: 189594 - DNA, 20 bp, Artificial Sequence
  Description of Artificial Sequence: Synthetic oligonucleotide
  Target: ATXN1; (-) strand; PAM type: YTN; PAM sequence: TTA
ctaattgtgttattaaaaag

SEQ ID NO: 189595 - DNA, 20 bp, Artificial Sequence
  Description of Artificial Sequence: Synthetic oligonucleotide
  Target: ATXN1; (-) strand; PAM type: YTN; PAM sequence: TTT
actaattgtgttattaaaaa

SEQ ID NO: 189596 - DNA, 20 bp, Artificial Sequence
  Description of Artificial Sequence: Synthetic oligonucleotide
  Target: ATXN1; (-) strand; PAM type: YTN; PAM sequence: TTT
tactaattgtgttattaaaa

SEQ ID NO: 189597 - DNA, 20 bp, Artificial Sequence
  Description of Artificial Sequence: Synthetic oligonucleotide
  Target: ATXN1; (-) strand; PAM type: YTN; PAM sequence: TTT
ttactaattgtgttattaaa

SEQ ID NO: 189598 - DNA, 20 bp, Artificial Sequence
  Description of Artificial Sequence: Synthetic oligonucleotide
  Target: ATXN1; (-) strand; PAM type: YTN; PAM sequence: TTA
ggatttttactaattgtgtt

SEQ ID NO: 189599 - DNA, 20 bp, Artificial Sequence
  Description of Artificial Sequence: Synthetic oligonucleotide
  Target: ATXN1; (-) strand; PAM type: YTN; PAM sequence: TTT
aggatttttactaattgtgt

SEQ ID NO: 189600 - DNA, 20 bp, Artificial Sequence
  Description of Artificial Sequence: Synthetic oligonucleotide
  Target: ATXN1; (-) strand; PAM type: YTN; PAM sequence: TTT
taggatttttactaattgtg

SEQ ID NO: 189601 - DNA, 20 bp, Artificial Sequence
  Description of Artificial Sequence: Synthetic oligonucleotide
  Target: ATXN1; (-) strand; PAM type: YTN; PAM sequence: TTT
ttaggatttttactaattgt

SEQ ID NO: 189602 - DNA, 20 bp, Artificial Sequence
  Description of Artificial Sequence: Synthetic oligonucleotide
  Target: ATXN1; (-) strand; PAM type: YTN; PAM sequence: TTT
tttaggatttttactaattg

SEQ ID NO: 189603 - DNA, 20 bp, Artificial Sequence
  Description of Artificial Sequence: Synthetic oligonucleotide
  Target: ATXN1; (-) strand; PAM type: YTN; PAM sequence: CTT
ttttaggatttttactaatt

SEQ ID NO: 189604 - DNA, 20 bp, Artificial Sequence
  Description of Artificial Sequence: Synthetic oligonucleotide
  Target: ATXN1; (-) strand; PAM type: YTN; PAM sequence: TTC
ttttttaggatttttactaa

SEQ ID NO: 189605 - DNA, 20 bp, Artificial Sequence
  Description of Artificial Sequence: Synthetic oligonucleotide
  Target: ATXN1; (-) strand; PAM type: YTN; PAM sequence: TTT
cttttttaggatttttacta

SEQ ID NO: 189606 - DNA, 20 bp, Artificial Sequence
  Description of Artificial Sequence: Synthetic oligonucleotide
  Target: ATXN1; (-) strand; PAM type: YTN; PAM sequence: CTA
tttcttttttaggattttta

SEQ ID NO: 189607 - DNA, 20 bp, Artificial Sequence
  Description of Artificial Sequence: Synthetic oligonucleotide
  Target: ATXN1; (-) strand; PAM type: YTN; PAM sequence: TTA
gctatttcttttttaggatt

SEQ ID NO: 189608 - DNA, 20 bp, Artificial Sequence
  Description of Artificial Sequence: Synthetic oligonucleotide
  Target: ATXN1; (-) strand; PAM type: YTN; PAM sequence: TTT
agctatttcttttttaggat

SEQ ID NO: 189609 - DNA, 20 bp, Artificial Sequence
  Description of Artificial Sequence: Synthetic oligonucleotide
  Target: ATXN1; (-) strand; PAM type: YTN; PAM sequence: TTA
tggcaaaaagagaatgagag

SEQ ID NO: 189610 - DNA, 20 bp, Artificial Sequence
  Description of Artificial Sequence: Synthetic oligonucleotide
  Target: ATXN1; (-) strand; PAM type: YTN; PAM sequence: CTC
aatattatggcaaaaagaga

SEQ ID NO: 189611 - DNA, 20 bp, Artificial Sequence
  Description of Artificial Sequence: Synthetic oligonucleotide
  Target: ATXN1; (-) strand; PAM type: YTN; PAM sequence: CTC
tcaatattatggcaaaaaga

SEQ ID NO: 189612 - DNA, 20 bp, Artificial Sequence
  Description of Artificial Sequence: Synthetic oligonucleotide
  Target: ATXN1; (-) strand; PAM type: YTN; PAM sequence: CTA
tcatataactctcaatatta

SEQ ID NO: 189613 - DNA, 20 bp, Artificial Sequence
  Description of Artificial Sequence: Synthetic oligonucleotide
  Target: ATXN1; (-) strand; PAM type: YTN; PAM sequence: TTG
aagatactatcatataactc

SEQ ID NO: 189614 - DNA, 20 bp, Artificial Sequence
  Description of Artificial Sequence: Synthetic oligonucleotide
  Target: ATXN1; (-) strand; PAM type: YTN; PAM sequence: TTG
tgaagtcaggccaaataaaa

SEQ ID NO: 189615 - DNA, 20 bp, Artificial Sequence
  Description of Artificial Sequence: Synthetic oligonucleotide
  Target: ATXN1; (-) strand; PAM type: YTN; PAM sequence: TTT
gtgaagtcaggccaaataaa

SEQ ID NO: 189616 - DNA, 20 bp, Artificial Sequence
  Description of Artificial Sequence: Synthetic oligonucleotide
  Target: ATXN1; (-) strand; PAM type: YTN; PAM sequence: CTT
tgtgaagtcaggccaaataa

SEQ ID NO: 189617 - DNA, 20 bp, Artificial Sequence
  Description of Artificial Sequence: Synthetic oligonucleotide
  Target: ATXN1; (-) strand; PAM type: YTN; PAM sequence: TTG
gtactttgtgaagtcaggcc

SEQ ID NO: 189618 - DNA, 20 bp, Artificial Sequence
  Description of Artificial Sequence: Synthetic oligonucleotide
  Target: ATXN1; (-) strand; PAM type: YTN; PAM sequence: TTT
ggtactttgtgaagtcaggc

SEQ ID NO: 189619 - DNA, 20 bp, Artificial Sequence
  Description of Artificial Sequence: Synthetic oligonucleotide
  Target: ATXN1; (-) strand; PAM type: YTN; PAM sequence: CTC
cccgtttggtactttgtgaa

SEQ ID NO: 189620 - DNA, 20 bp, Artificial Sequence
  Description of Artificial Sequence: Synthetic oligonucleotide
  Target: ATXN1; (-) strand; PAM type: YTN; PAM sequence: TTC
actccccgtttggtactttg

SEQ ID NO: 189621 - DNA, 20 bp, Artificial Sequence
  Description of Artificial Sequence: Synthetic oligonucleotide
  Target: ATXN1; (-) strand; PAM type: YTN; PAM sequence: CTT
cactccccgtttggtacttt

SEQ ID NO: 189622 - DNA, 20 bp, Artificial Sequence
  Description of Artificial Sequence: Synthetic oligonucleotide
  Target: ATXN1; (-) strand; PAM type: YTN; PAM sequence: TTA
tcttcactccccgtttggta

SEQ ID NO: 189623 - DNA, 20 bp, Artificial Sequence
  Description of Artificial Sequence: Synthetic oligonucleotide
  Target: ATXN1; (-) strand; PAM type: YTN; PAM sequence: TTT
atcttcactccccgtttggt

SEQ ID NO: 189624 - DNA, 20 bp, Artificial Sequence
  Description of Artificial Sequence: Synthetic oligonucleotide
  Target: ATXN1; (-) strand; PAM type: YTN; PAM sequence: TTT
tatcttcactccccgtttgg

SEQ ID NO: 189625 - DNA, 20 bp, Artificial Sequence
  Description of Artificial Sequence: Synthetic oligonucleotide
  Target: ATXN1; (-) strand; PAM type: YTN; PAM sequence: TTC
attttatcttcactccccgt

SEQ ID NO: 189626 - DNA, 20 bp, Artificial Sequence
  Description of Artificial Sequence: Synthetic oligonucleotide
  Target: ATXN1; (-) strand; PAM type: YTN; PAM sequence: CTT
cattttatcttcactccccg

SEQ ID NO: 189627 - DNA, 20 bp, Artificial Sequence
  Description of Artificial Sequence: Synthetic oligonucleotide
  Target: ATXN1; (-) strand; PAM type: YTN; PAM sequence: CTC
ttcattttatcttcactccc

SEQ ID NO: 189628 - DNA, 20 bp, Artificial Sequence
  Description of Artificial Sequence: Synthetic oligonucleotide
  Target: ATXN1; (-) strand; PAM type: YTN; PAM sequence: CTG
tctcttcattttatcttcac

SEQ ID NO: 189629 - DNA, 20 bp, Artificial Sequence
  Description of Artificial Sequence: Synthetic oligonucleotide
  Target: ATXN1; (-) strand; PAM type: YTN; PAM sequence: TTC
tgtctcttcattttatcttc

SEQ ID NO: 189630 - DNA, 20 bp, Artificial Sequence
  Description of Artificial Sequence: Synthetic oligonucleotide
  Target: ATXN1; (-) strand; PAM type: YTN; PAM sequence: TTG
ggagatgcatatgtggattc

SEQ ID NO: 189631 - DNA, 20 bp, Artificial Sequence
  Description of Artificial Sequence: Synthetic oligonucleotide
  Target: ATXN1; (-) strand; PAM type: YTN; PAM sequence: TTC
aaaaggacagaggttgggag

SEQ ID NO: 189632 - DNA, 20 bp, Artificial Sequence
  Description of Artificial Sequence: Synthetic oligonucleotide
  Target: ATXN1; (-) strand; PAM type: YTN; PAM sequence: CTG
ttcaaaaggacagaggttgg

SEQ ID NO: 189633 - DNA, 20 bp, Artificial Sequence
  Description of Artificial Sequence: Synthetic oligonucleotide
  Target: ATXN1; (-) strand; PAM type: YTN; PAM sequence: TTG
tgtctgttcaaaaggacaga

SEQ ID NO: 189634 - DNA, 20 bp, Artificial Sequence
  Description of Artificial Sequence: Synthetic oligonucleotide
  Target: ATXN1; (-) strand; PAM type: YTN; PAM sequence: CTT
gtgtctgttcaaaaggacag

SEQ ID NO: 189635 - DNA, 20 bp, Artificial Sequence
  Description of Artificial Sequence: Synthetic oligonucleotide
  Target: ATXN1; (-) strand; PAM type: YTN; PAM sequence: TTA
cttgtgtctgttcaaaagga

SEQ ID NO: 189636 - DNA, 20 bp, Artificial Sequence
  Description of Artificial Sequence: Synthetic oligonucleotide
  Target: ATXN1; (-) strand; PAM type: YTN; PAM sequence: CTG
ttacttgtgtctgttcaaaa

SEQ ID NO: 189637 - DNA, 20 bp, Artificial Sequence
  Description of Artificial Sequence: Synthetic oligonucleotide
  Target: ATXN1; (-) strand; PAM type: YTN; PAM sequence: TTC
tgttacttgtgtctgttcaa

SEQ ID NO: 189638 - DNA, 20 bp, Artificial Sequence
  Description of Artificial Sequence: Synthetic oligonucleotide
  Target: ATXN1; (-) strand; PAM type: YTN; PAM sequence: TTG
gtaaattctgttacttgtgt

SEQ ID NO: 189639 - DNA, 20 bp, Artificial Sequence
  Description of Artificial Sequence: Synthetic oligonucleotide
  Target: ATXN1; (-) strand; PAM type: YTN; PAM sequence: TTT
ggtaaattctgttacttgtg

SEQ ID NO: 189640 - DNA, 20 bp, Artificial Sequence
  Description of Artificial Sequence: Synthetic oligonucleotide
  Target: ATXN1; (-) strand; PAM type: YTN; PAM sequence: TTT
tggtaaattctgttacttgt

SEQ ID NO: 189641 - DNA, 20 bp, Artificial Sequence
  Description of Artificial Sequence: Synthetic oligonucleotide
  Target: ATXN1; (-) strand; PAM type: YTN; PAM sequence: CTT
ttggtaaattctgttacttg

SEQ ID NO: 189642 - DNA, 20 bp, Artificial Sequence
  Description of Artificial Sequence: Synthetic oligonucleotide
  Target: ATXN1; (-) strand; PAM type: YTN; PAM sequence: TTA
atacttttggtaaattctgt

SEQ ID NO: 189643 - DNA, 20 bp, Artificial Sequence
  Description of Artificial Sequence: Synthetic oligonucleotide
  Target: ATXN1; (-) strand; PAM type: YTN; PAM sequence: TTT
aatacttttggtaaattctg

SEQ ID NO: 189644 - DNA, 20 bp, Artificial Sequence
  Description of Artificial Sequence: Synthetic oligonucleotide
  Target: ATXN1; (-) strand; PAM type: YTN; PAM sequence: TTT
taatacttttggtaaattct

SEQ ID NO: 189645 - DNA, 20 bp, Artificial Sequence
  Description of Artificial Sequence: Synthetic oligonucleotide
  Target: ATXN1; (-) strand; PAM type: YTN; PAM sequence: TTT
ttaatacttttggtaaattc

SEQ ID NO: 189646 - DNA, 20 bp, Artificial Sequence
  Description of Artificial Sequence: Synthetic oligonucleotide
  Target: ATXN1; (-) strand; PAM type: YTN; PAM sequence: TTC
caaggtcgtgtttttaatac

SEQ ID NO: 189647 - DNA, 20 bp, Artificial Sequence
  Description of Artificial Sequence: Synthetic oligonucleotide
  Target: ATXN1; (-) strand; PAM type: YTN; PAM sequence: CTT
ccaaggtcgtgtttttaata

SEQ ID NO: 189648 - DNA, 20 bp, Artificial Sequence
  Description of Artificial Sequence: Synthetic oligonucleotide
  Target: ATXN1; (-) strand; PAM type: YTN; PAM sequence: TTG
ataggatgcttccaaggtcg

SEQ ID NO: 189649 - DNA, 20 bp, Artificial Sequence
  Description of Artificial Sequence: Synthetic oligonucleotide
  Target: ATXN1; (-) strand; PAM type: YTN; PAM sequence: TTT
gataggatgcttccaaggtc

SEQ ID NO: 189650 - DNA, 20 bp, Artificial Sequence
  Description of Artificial Sequence: Synthetic oligonucleotide
  Target: ATXN1; (-) strand; PAM type: YTN; PAM sequence: CTT
tgataggatgcttccaaggt

SEQ ID NO: 189651 - DNA, 20 bp, Artificial Sequence
  Description of Artificial Sequence: Synthetic oligonucleotide
  Target: ATXN1; (-) strand; PAM type: YTN; PAM sequence: TTG
tggctttgataggatgcttc

SEQ ID NO: 189652 - DNA, 20 bp, Artificial Sequence
  Description of Artificial Sequence: Synthetic oligonucleotide
  Target: ATXN1; (-) strand; PAM type: YTN; PAM sequence: TTC
ataaaaagaaaaggaagttg

SEQ ID NO: 189653 - DNA, 20 bp, Artificial Sequence
  Description of Artificial Sequence: Synthetic oligonucleotide
  Target: ATXN1; (-) strand; PAM type: YTN; PAM sequence: TTG
catggtagtagttcataaaa

SEQ ID NO: 189654 - DNA, 20 bp, Artificial Sequence
  Description of Artificial Sequence: Synthetic oligonucleotide
  Target: ATXN1; (-) strand; PAM type: YTN; PAM sequence: TTT
gcatggtagtagttcataaa

SEQ ID NO: 189655 - DNA, 20 bp, Artificial Sequence
  Description of Artificial Sequence: Synthetic oligonucleotide
  Target: ATXN1; (-) strand; PAM type: YTN; PAM sequence: TTT
tgcatggtagtagttcataa

SEQ ID NO: 189656 - DNA, 20 bp, Artificial Sequence
  Description of Artificial Sequence: Synthetic oligonucleotide
  Target: ATXN1; (-) strand; PAM type: YTN; PAM sequence: CTG
tagccatgcaattttgcatg

SEQ ID NO: 189657 - DNA, 20 bp, Artificial Sequence
  Description of Artificial Sequence: Synthetic oligonucleotide
  Target: ATXN1; (-) strand; PAM type: YTN; PAM sequence: TTG
atgtcccagctgtagccatg

SEQ ID NO: 189658 - DNA, 20 bp, Artificial Sequence
  Description of Artificial Sequence: Synthetic oligonucleotide
  Target: ATXN1; (-) strand; PAM type: YTN; PAM sequence: TTT
gatgtcccagctgtagccat

SEQ ID NO: 189659 - DNA, 20 bp, Artificial Sequence
  Description of Artificial Sequence: Synthetic oligonucleotide
  Target: ATXN1; (-) strand; PAM type: YTN; PAM sequence: TTA
aagcatgatttgatgtccca

SEQ ID NO: 189660 - DNA, 20 bp, Artificial Sequence
  Description of Artificial Sequence: Synthetic oligonucleotide
  Target: ATXN1; (-) strand; PAM type: YTN; PAM sequence: TTT
aaagcatgatttgatgtccc

SEQ ID NO: 189661 - DNA, 20 bp, Artificial Sequence
  Description of Artificial Sequence: Synthetic oligonucleotide
  Target: ATXN1; (-) strand; PAM type: YTN; PAM sequence: TTT
taaagcatgatttgatgtcc

SEQ ID NO: 189662 - DNA, 20 bp, Artificial Sequence
  Description of Artificial Sequence: Synthetic oligonucleotide
  Target: ATXN1; (-) strand; PAM type: YTN; PAM sequence: TTT
ttaaagcatgatttgatgtc

SEQ ID NO: 189663 - DNA, 20 bp, Artificial Sequence
  Description of Artificial Sequence: Synthetic oligonucleotide
  Target: ATXN1; (-) strand; PAM type: YTN; PAM sequence: TTT
tttaaagcatgatttgatgt

SEQ ID NO: 189664 - DNA, 20 bp, Artificial Sequence
  Description of Artificial Sequence: Synthetic oligonucleotide
  Target: ATXN1; (-) strand; PAM type: YTN; PAM sequence: CTA
attttttaaagcatgatttg

SEQ ID NO: 189665 - DNA, 20 bp, Artificial Sequence
  Description of Artificial Sequence: Synthetic oligonucleotide
  Target: ATXN1; (-) strand; PAM type: YTN; PAM sequence: CTA
gccccaatactaatttttta

SEQ ID NO: 189666 - DNA, 20 bp, Artificial Sequence
  Description of Artificial Sequence: Synthetic oligonucleotide
  Target: ATXN1; (-) strand; PAM type: YTN; PAM sequence: TTA
taggcgtaagccaccacgcc

SEQ ID NO: 189667 - DNA, 20 bp, Artificial Sequence
  Description of Artificial Sequence: Synthetic oligonucleotide
  Target: ATXN1; (-) strand; PAM type: YTN; PAM sequence: CTC
ccaaagtacagggattatag

SEQ ID NO: 189668 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtacagggat

SEQ ID NO: 189669 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtacaggga

SEQ ID NO: 189670 - DNA, 20 bp, Artificial Sequence
  Description of Artificial Sequence: Synthetic oligonucleotide
  Target: ATXN1; (-) strand; PAM type: YTN; PAM sequence: CTG
ccttggcctcccaaagtaca

SEQ ID NO: 189671 - DNA, 20 bp, Artificial Sequence
  Description of Artificial Sequence: Synthetic oligonucleotide
  Target: ATXN1; (-) strand; PAM type: YTN; PAM sequence: CTC
aaatgatccacctgccttgg

SEQ ID NO: 189672 - DNA, 20 bp, Artificial Sequence
  Description of Artificial Sequence: Synthetic oligonucleotide
  Target: ATXN1; (-) strand; PAM type: YTN; PAM sequence: CTG
acctcaaatgatccacctgc

SEQ ID NO: 189673 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaaatgatccacc

SEQ ID NO: 189674 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaaatgat

SEQ ID NO: 189675 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaaatga

SEQ ID NO: 189676 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 189677 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactc

SEQ ID NO: 189678 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 189679 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 189680 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 189681 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 189682 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 189683 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 189684 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 189685 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 189686 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 189687 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 189688 - DNA, 20 bp, Artificial Sequence
  Description of Artificial Sequence: Synthetic oligonucleotide
  Target: ATXN1; (-) strand; PAM type: YTN; PAM sequence: CTC
atttttgtatttttagtaga

SEQ ID NO: 189689 - DNA, 20 bp, Artificial Sequence
  Description of Artificial Sequence: Synthetic oligonucleotide
  Target: ATXN1; (-) strand; PAM type: YTN; PAM sequence: CTG
gctcatttttgtatttttag

SEQ ID NO: 189690 - DNA, 20 bp, Artificial Sequence
  Description of Artificial Sequence: Synthetic oligonucleotide
  Target: ATXN1; (-) strand; PAM type: YTN; PAM sequence: CTG
ccaccatacctggctcattt

SEQ ID NO: 189691 - DNA, 20 bp, Artificial Sequence
  Description of Artificial Sequence: Synthetic oligonucleotide
  Target: ATXN1; (-) strand; PAM type: YTN; PAM sequence: CTA
caggcgcctgccaccatacc

SEQ ID NO: 189692 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcgcctgccac

SEQ ID NO: 189693 - DNA, 20 bp, Artificial Sequence
  Description of Artificial Sequence: Synthetic oligonucleotide
  Target: ATXN1; (-) strand; PAM type: YTN; PAM sequence: CTC
gtgagtagctgggactacag

SEQ ID NO: 189694 - DNA, 20 bp, Artificial Sequence
  Description of Artificial Sequence: Synthetic oligonucleotide
  Target: ATXN1; (-) strand; PAM type: YTN; PAM sequence: CTC
agcctcgtgagtagctggga

SEQ ID NO: 189695 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcgtgagtagct

SEQ ID NO: 189696 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcgtgagta

SEQ ID NO: 189697 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcgtgag

SEQ ID NO: 189698 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 189699 - DNA, 20 bp, Artificial Sequence
  Description of Artificial Sequence: Synthetic oligonucleotide
  Target: ATXN1; (-) strand; PAM type: YTN; PAM sequence: CTG
ggttcaagtgattctcctgc

SEQ ID NO: 189700 - DNA, 20 bp, Artificial Sequence
  Description of Artificial Sequence: Synthetic oligonucleotide
  Target: ATXN1; (-) strand; PAM type: YTN; PAM sequence: TTC
ctgggttcaagtgattctcc

SEQ ID NO: 189701 - DNA, 20 bp, Artificial Sequence
  Description of Artificial Sequence: Synthetic oligonucleotide
  Target: ATXN1; (-) strand; PAM type: YTN; PAM sequence: CTT
cctgggttcaagtgattctc

SEQ ID NO: 189702 - DNA, 20 bp, Artificial Sequence
  Description of Artificial Sequence: Synthetic oligonucleotide
  Target: ATXN1; (-) strand; PAM type: YTN; PAM sequence: CTC
cgcttcctgggttcaagtga

SEQ ID NO: 189703 - DNA, 20 bp, Artificial Sequence
  Description of Artificial Sequence: Synthetic oligonucleotide
  Target: ATXN1; (-) strand; PAM type: YTN; PAM sequence: CTG
caacctccgcttcctgggtt

SEQ ID NO: 189704 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcttcctg

SEQ ID NO: 189705 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccgct

SEQ ID NO: 189706 - DNA, 20 bp, Artificial Sequence
  Description of Artificial Sequence: Synthetic oligonucleotide
  Target: ATXN1; (-) strand; PAM type: YTN; PAM sequence: CTA
gagtgcagtggcatgatctc

SEQ ID NO: 189707 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctagagtgcag

SEQ ID NO: 189708 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctagagtgc

SEQ ID NO: 189709 - DNA, 20 bp, Artificial Sequence
  Description of Artificial Sequence: Synthetic oligonucleotide
  Target: ATXN1; (-) strand; PAM type: YTN; PAM sequence: CTC
actctgtcacccaggctaga

SEQ ID NO: 189710 - DNA, 20 bp, Artificial Sequence
  Description of Artificial Sequence: Synthetic oligonucleotide
  Target: ATXN1; (-) strand; PAM type: YTN; PAM sequence: TTG
agagagagagagagagtctc

SEQ ID NO: 189711 - DNA, 20 bp, Artificial Sequence
  Description of Artificial Sequence: Synthetic oligonucleotide
  Target: ATXN1; (-) strand; PAM type: YTN; PAM sequence: TTT
gagagagagagagagagtct

SEQ ID NO: 189712 - DNA, 20 bp, Artificial Sequence
  Description of Artificial Sequence: Synthetic oligonucleotide
  Target: ATXN1; (-) strand; PAM type: YTN; PAM sequence: TTT
tgagagagagagagagagtc

SEQ ID NO: 189713 - DNA, 20 bp, Artificial Sequence
  Description of Artificial Sequence: Synthetic oligonucleotide
  Target: ATXN1; (-) strand; PAM type: YTN; PAM sequence: TTT
ttgagagagagagagagagt

SEQ ID NO: 189714 - DNA, 20 bp, Artificial Sequence
  Description of Artificial Sequence: Synthetic oligonucleotide
  Target: ATXN1; (-) strand; PAM type: YTN; PAM sequence: TTT
tttgagagagagagagagag

SEQ ID NO: 189715 - DNA, 20 bp, Artificial Sequence
  Description of Artificial Sequence: Synthetic oligonucleotide
  Target: ATXN1; (-) strand; PAM type: YTN; PAM sequence: TTT
ttttgagagagagagagaga

SEQ ID NO: 189716 - DNA, 20 bp, Artificial Sequence
  Description of Artificial Sequence: Synthetic oligonucleotide
  Target: ATXN1; (-) strand; PAM type: YTN; PAM sequence: TTT
tttttgagagagagagagag

SEQ ID NO: 189717 - DNA, 20 bp, Artificial Sequence
  Description of Artificial Sequence: Synthetic oligonucleotide
  Target: ATXN1; (-) strand; PAM type: YTN; PAM sequence: TTT
ttttttgagagagagagaga

SEQ ID NO: 189718 - DNA, 20 bp, Artificial Sequence
  Description of Artificial Sequence: Synthetic oligonucleotide
  Target: ATXN1; (-) strand; PAM type: YTN; PAM sequence: TTT
tttttttgagagagagagag

SEQ ID NO: 189719 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagagagagaga

SEQ ID NO: 189720 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagagagagag

SEQ ID NO: 189721 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagagagaga

SEQ ID NO: 189722 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagagagag

SEQ ID NO: 189723 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagagaga

SEQ ID NO: 189724 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttgagagag

SEQ ID NO: 189725 - DNA, 20 bp, Artificial Sequence
  Description of Artificial Sequence: Synthetic oligonucleotide
  Target: ATXN1; (-) strand; PAM type: YTN; PAM sequence: CTA
atataccaataataactttt

SEQ ID NO: 189726 - DNA, 20 bp, Artificial Sequence
  Description of Artificial Sequence: Synthetic oligonucleotide
  Target: ATXN1; (-) strand; PAM type: YTN; PAM sequence: TTA
ctaatataccaataataact

SEQ ID NO: 189727 - DNA, 20 bp, Artificial Sequence
  Description of Artificial Sequence: Synthetic oligonucleotide
  Target: ATXN1; (-) strand; PAM type: YTN; PAM sequence: TTT
actaatataccaataataac

SEQ ID NO: 189728 - DNA, 20 bp, Artificial Sequence
  Description of Artificial Sequence: Synthetic oligonucleotide
  Target: ATXN1; (-) strand; PAM type: YTN; PAM sequence: TTT
tactaatataccaataataa

SEQ ID NO: 189729 - DNA, 20 bp, Artificial Sequence
  Description of Artificial Sequence: Synthetic oligonucleotide
  Target: ATXN1; (-) strand; PAM type: YTN; PAM sequence: CTT
ttactaatataccaataata

SEQ ID NO: 189730 - DNA, 20 bp, Artificial Sequence
  Description of Artificial Sequence: Synthetic oligonucleotide
  Target: ATXN1; (-) strand; PAM type: YTN; PAM sequence: TTG
aatggcttttactaatatac

SEQ ID NO: 189731 - DNA, 20 bp, Artificial Sequence
  Description of Artificial Sequence: Synthetic oligonucleotide
  Target: ATXN1; (-) strand; PAM type: YTN; PAM sequence: TTT
gaatggcttttactaatata

SEQ ID NO: 189732 - DNA, 20 bp, Artificial Sequence
  Description of Artificial Sequence: Synthetic oligonucleotide
  Target: ATXN1; (-) strand; PAM type: YTN; PAM sequence: CTT
tgaatggcttttactaatat

SEQ ID NO: 189733 - DNA, 20 bp, Artificial Sequence
  Description of Artificial Sequence: Synthetic oligonucleotide
  Target: ATXN1; (-) strand; PAM type: YTN; PAM sequence: TTG
agctttgaatggcttttact

SEQ ID NO: 189734 - DNA, 20 bp, Artificial Sequence
  Description of Artificial Sequence: Synthetic oligonucleotide
  Target: ATXN1; (-) strand; PAM type: YTN; PAM sequence: TTT
gagctttgaatggcttttac

SEQ ID NO: 189735 - DNA, 20 bp, Artificial Sequence
  Description of Artificial Sequence: Synthetic oligonucleotide
  Target: ATXN1; (-) strand; PAM type: YTN; PAM sequence: TTT
tgagctttgaatggctttta

SEQ ID NO: 189736 - DNA, 20 bp, Artificial Sequence
  Description of Artificial Sequence: Synthetic oligonucleotide
  Target: ATXN1; (-) strand; PAM type: YTN; PAM sequence: TTT
ttgagctttgaatggctttt

SEQ ID NO: 189737 - DNA, 20 bp, Artificial Sequence
  Description of Artificial Sequence: Synthetic oligonucleotide
  Target: ATXN1; (-) strand; PAM type: YTN; PAM sequence: TTG
tttttgagctttgaatggct

SEQ ID NO: 189738 - DNA, 20 bp, Artificial Sequence
  Description of Artificial Sequence: Synthetic oligonucleotide
  Target: ATXN1; (-) strand; PAM type: YTN; PAM sequence: CTG
ttgtttttgagctttgaatg

SEQ ID NO: 189739 - DNA, 20 bp, Artificial Sequence
  Description of Artificial Sequence: Synthetic oligonucleotide
  Target: ATXN1; (-) strand; PAM type: YTN; PAM sequence: TTC
tgttgtttttgagctttgaa

SEQ ID NO: 189740 - DNA, 20 bp, Artificial Sequence
  Description of Artificial Sequence: Synthetic oligonucleotide
  Target: ATXN1; (-) strand; PAM type: YTN; PAM sequence: TTC
agaaaataattctgttgttt

SEQ ID NO: 189741 - DNA, 20 bp, Artificial Sequence
  Description of Artificial Sequence: Synthetic oligonucleotide
  Target: ATXN1; (-) strand; PAM type: YTN; PAM sequence: TTT
cagaaaataattctgttgtt

SEQ ID NO: 189742 - DNA, 20 bp, Artificial Sequence
  Description of Artificial Sequence: Synthetic oligonucleotide
  Target: ATXN1; (-) strand; PAM type: YTN; PAM sequence: TTG
aatttcagaaaataattctg

SEQ ID NO: 189743 - DNA, 20 bp, Artificial Sequence
  Description of Artificial Sequence: Synthetic oligonucleotide
  Target: ATXN1; (-) strand; PAM type: YTN; PAM sequence: TTT
gaatttcagaaaataattct

SEQ ID NO: 189744 - DNA, 20 bp, Artificial Sequence
  Description of Artificial Sequence: Synthetic oligonucleotide
  Target: ATXN1; (-) strand; PAM type: YTN; PAM sequence: TTT
tgaatttcagaaaataattc

SEQ ID NO: 189745 - DNA, 20 bp, Artificial Sequence
  Description of Artificial Sequence: Synthetic oligonucleotide
  Target: ATXN1; (-) strand; PAM type: YTN; PAM sequence: CTG
attttgaatttcagaaaata

SEQ ID NO: 189746 - DNA, 20 bp, Artificial Sequence
  Description of Artificial Sequence: Synthetic oligonucleotide
  Target: ATXN1; (-) strand; PAM type: YTN; PAM sequence: CTG
gcactgattttgaatttcag

SEQ ID NO: 189747 - DNA, 20 bp, Artificial Sequence
  Description of Artificial Sequence: Synthetic oligonucleotide
  Target: ATXN1; (-) strand; PAM type: YTN; PAM sequence: TTA
aatctggcactgattttgaa

SEQ ID NO: 189748 - DNA, 20 bp, Artificial Sequence
  Description of Artificial Sequence: Synthetic oligonucleotide
  Target: ATXN1; (-) strand; PAM type: YTN; PAM sequence: TTA
tgcaaaagtagttaaatctg

SEQ ID NO: 189749 - DNA, 20 bp, Artificial Sequence
  Description of Artificial Sequence: Synthetic oligonucleotide
  Target: ATXN1; (-) strand; PAM type: YTN; PAM sequence: CTG
tgggggcaaacattatgcaa

SEQ ID NO: 189750 - DNA, 20 bp, Artificial Sequence
  Description of Artificial Sequence: Synthetic oligonucleotide
  Target: ATXN1; (-) strand; PAM type: YTN; PAM sequence: TTC
tgtgggggcaaacattatgc

SEQ ID NO: 189751 - DNA, 20 bp, Artificial Sequence
  Description of Artificial Sequence: Synthetic oligonucleotide
  Target: ATXN1; (-) strand; PAM type: YTN; PAM sequence: TTA
tggaaagttctgtgggggca

SEQ ID NO: 189752 - DNA, 20 bp, Artificial Sequence
  Description of Artificial Sequence: Synthetic oligonucleotide
  Target: ATXN1; (-) strand; PAM type: YTN; PAM sequence: TTA
ttatggaaagttctgtgggg

SEQ ID NO: 189753 - DNA, 20 bp, Artificial Sequence
  Description of Artificial Sequence: Synthetic oligonucleotide
  Target: ATXN1; (-) strand; PAM type: YTN; PAM sequence: TTG
acgtaatattattatggaaa

SEQ ID NO: 189754 - DNA, 20 bp, Artificial Sequence
  Description of Artificial Sequence: Synthetic oligonucleotide
  Target: ATXN1; (-) strand; PAM type: YTN; PAM sequence: CTG
ttgacgtaatattattatgg

SEQ ID NO: 189755 - DNA, 20 bp, Artificial Sequence
  Description of Artificial Sequence: Synthetic oligonucleotide
  Target: ATXN1; (-) strand; PAM type: YTN; PAM sequence: TTA
gtaaaacaagtagaccaaaa

SEQ ID NO: 189756 - DNA, 20 bp, Artificial Sequence
  Description of Artificial Sequence: Synthetic oligonucleotide
  Target: ATXN1; (-) strand; PAM type: YTN; PAM sequence: TTT
agtaaaacaagtagaccaaa

SEQ ID NO: 189757 - DNA, 20 bp, Artificial Sequence
  Description of Artificial Sequence: Synthetic oligonucleotide
  Target: ATXN1; (-) strand; PAM type: YTN; PAM sequence: TTA
atttagtaaaacaagtagac

SEQ ID NO: 189758 - DNA, 20 bp, Artificial Sequence
  Description of Artificial Sequence: Synthetic oligonucleotide
  Target: ATXN1; (-) strand; PAM type: YTN; PAM sequence: TTT
aatttagtaaaacaagtaga

SEQ ID NO: 189759 - DNA, 20 bp, Artificial Sequence
  Description of Artificial Sequence: Synthetic oligonucleotide
  Target: ATXN1; (-) strand; PAM type: YTN; PAM sequence: TTT
taatttagtaaaacaagtag

SEQ ID NO: 189760 - DNA, 20 bp, Artificial Sequence
  Description of Artificial Sequence: Synthetic oligonucleotide
  Target: ATXN1; (-) strand; PAM type: YTN; PAM sequence: CTT
ttaatttagtaaaacaagta

SEQ ID NO: 189761 - DNA, 20 bp, Artificial Sequence
  Description of Artificial Sequence: Synthetic oligonucleotide
  Target: ATXN1; (-) strand; PAM type: YTN; PAM sequence: TTG
gcttttaatttagtaaaaca

SEQ ID NO: 189762 - DNA, 20 bp, Artificial Sequence
  Description of Artificial Sequence: Synthetic oligonucleotide
  Target: ATXN1; (-) strand; PAM type: YTN; PAM sequence: CTG
ttggcttttaatttagtaaa

SEQ ID NO: 189763 - DNA, 20 bp, Artificial Sequence
  Description of Artificial Sequence: Synthetic oligonucleotide
  Target: ATXN1; (-) strand; PAM type: YTN; PAM sequence: TTG
tatctgttggcttttaattt

SEQ ID NO: 189764 - DNA, 20 bp, Artificial Sequence
  Description of Artificial Sequence: Synthetic oligonucleotide
  Target: ATXN1; (-) strand; PAM type: YTN; PAM sequence: TTG
ttgtatctgttggcttttaa

SEQ ID NO: 189765 - DNA, 20 bp, Artificial Sequence
  Description of Artificial Sequence: Synthetic oligonucleotide
  Target: ATXN1; (-) strand; PAM type: YTN; PAM sequence: TTA
aagtatggagttgttgtatc

SEQ ID NO: 189766 - DNA, 20 bp, Artificial Sequence
  Description of Artificial Sequence: Synthetic oligonucleotide
  Target: ATXN1; (-) strand; PAM type: YTN; PAM sequence: TTT
aaagtatggagttgttgtat

SEQ ID NO: 189767 - DNA, 20 bp, Artificial Sequence
  Description of Artificial Sequence: Synthetic oligonucleotide
  Target: ATXN1; (-) strand; PAM type: YTN; PAM sequence: TTA
aaaaaggagtttaaagtatg

SEQ ID NO: 189768 - DNA, 20 bp, Artificial Sequence
  Description of Artificial Sequence: Synthetic oligonucleotide
  Target: ATXN1; (-) strand; PAM type: YTN; PAM sequence: CTC
ggaatagtattaaaaaagga

SEQ ID NO: 189769 - DNA, 20 bp, Artificial Sequence
  Description of Artificial Sequence: Synthetic oligonucleotide
  Target: ATXN1; (-) strand; PAM type: YTN; PAM sequence: TTA
ctcggaatagtattaaaaaa

SEQ ID NO: 189770 - DNA, 20 bp, Artificial Sequence
  Description of Artificial Sequence: Synthetic oligonucleotide
  Target: ATXN1; (-) strand; PAM type: YTN; PAM sequence: TTA
aacaaggaggcagttactcg

SEQ ID NO: 189771 - DNA, 20 bp, Artificial Sequence
  Description of Artificial Sequence: Synthetic oligonucleotide
  Target: ATXN1; (-) strand; PAM type: YTN; PAM sequence: TTT
aaacaaggaggcagttactc

SEQ ID NO: 189772 - DNA, 20 bp, Artificial Sequence
  Description of Artificial Sequence: Synthetic oligonucleotide
  Target: ATXN1; (-) strand; PAM type: YTN; PAM sequence: TTG
taatatttaaacaaggaggc

SEQ ID NO: 189773 - DNA, 20 bp, Artificial Sequence
  Description of Artificial Sequence: Synthetic oligonucleotide
  Target: ATXN1; (-) strand; PAM type: YTN; PAM sequence: TTG
agtcagaaaattgtaatatt

SEQ ID NO: 189774 - DNA, 20 bp, Artificial Sequence
  Description of Artificial Sequence: Synthetic oligonucleotide
  Target: ATXN1; (-) strand; PAM type: YTN; PAM sequence: CTG
attgagtcagaaaattgtaa

SEQ ID NO: 189775 - DNA, 20 bp, Artificial Sequence
  Description of Artificial Sequence: Synthetic oligonucleotide
  Target: ATXN1; (-) strand; PAM type: YTN; PAM sequence: TTC
tgattgagtcagaaaattgt

SEQ ID NO: 189776 - DNA, 20 bp, Artificial Sequence
  Description of Artificial Sequence: Synthetic oligonucleotide
  Target: ATXN1; (-) strand; PAM type: YTN; PAM sequence: TTG
ttctgattgagtcagaaaat

SEQ ID NO: 189777 - DNA, 20 bp, Artificial Sequence
  Description of Artificial Sequence: Synthetic oligonucleotide
  Target: ATXN1; (-) strand; PAM type: YTN; PAM sequence: TTT
gttctgattgagtcagaaaa

SEQ ID NO: 189778 - DNA, 20 bp, Artificial Sequence
  Description of Artificial Sequence: Synthetic oligonucleotide
  Target: ATXN1; (-) strand; PAM type: YTN; PAM sequence: CTT
tgttctgattgagtcagaaa

SEQ ID NO: 189779 - DNA, 20 bp, Artificial Sequence
  Description of Artificial Sequence: Synthetic oligonucleotide
  Target: ATXN1; (-) strand; PAM type: YTN; PAM sequence: TTG
caatactttgttctgattga

SEQ ID NO: 189780 - DNA, 20 bp, Artificial Sequence
  Description of Artificial Sequence: Synthetic oligonucleotide
  Target: ATXN1; (-) strand; PAM type: YTN; PAM sequence: CTT
gcaatactttgttctgattg

SEQ ID NO: 189781 - DNA, 20 bp, Artificial Sequence
  Description of Artificial Sequence: Synthetic oligonucleotide
  Target: ATXN1; (-) strand; PAM type: YTN; PAM sequence: TTG
tcttgcaatactttgttctg

SEQ ID NO: 189782 - DNA, 20 bp, Artificial Sequence
  Description of Artificial Sequence: Synthetic oligonucleotide
  Target: ATXN1; (-) strand; PAM type: YTN; PAM sequence: TTT
gtcttgcaatactttgttct

SEQ ID NO: 189783 - DNA, 20 bp, Artificial Sequence
  Description of Artificial Sequence: Synthetic oligonucleotide
  Target: ATXN1; (-) strand; PAM type: YTN; PAM sequence: CTT
tgtcttgcaatactttgttc

SEQ ID NO: 189784 - DNA, 20 bp, Artificial Sequence
  Description of Artificial Sequence: Synthetic oligonucleotide
  Target: ATXN1; (-) strand; PAM type: YTN; PAM sequence: TTC
aatagcacctttgtcttgca

SEQ ID NO: 189785 - DNA, 20 bp, Artificial Sequence
  Description of Artificial Sequence: Synthetic oligonucleotide
  Target: ATXN1; (-) strand; PAM type: YTN; PAM sequence: TTT
caatagcacctttgtcttgc

SEQ ID NO: 189786 - DNA, 20 bp, Artificial Sequence
  Description of Artificial Sequence: Synthetic oligonucleotide
  Target: ATXN1; (-) strand; PAM type: YTN; PAM sequence: TTT
tcaatagcacctttgtcttg

SEQ ID NO: 189787 - DNA, 20 bp, Artificial Sequence
  Description of Artificial Sequence: Synthetic oligonucleotide
  Target: ATXN1; (-) strand; PAM type: YTN; PAM sequence: CTC
caaaaaaagagaagttttca

SEQ ID NO: 189788 - DNA, 20 bp, Artificial Sequence
  Description of Artificial Sequence: Synthetic oligonucleotide
  Target: ATXN1; (-) strand; PAM type: YTN; PAM sequence: CTC
ctccaaaaaaagagaagttt

SEQ ID NO: 189789 - DNA, 20 bp, Artificial Sequence
  Description of Artificial Sequence: Synthetic oligonucleotide
  Target: ATXN1; (-) strand; PAM type: YTN; PAM sequence: TTA
tgaagcctcctccaaaaaaa

SEQ ID NO: 189790 - DNA, 20 bp, Artificial Sequence
  Description of Artificial Sequence: Synthetic oligonucleotide
  Target: ATXN1; (-) strand; PAM type: YTN; PAM sequence: TTT
atgaagcctcctccaaaaaa

SEQ ID NO: 189791 - DNA, 20 bp, Artificial Sequence
  Description of Artificial Sequence: Synthetic oligonucleotide
  Target: ATXN1; (-) strand; PAM type: YTN; PAM sequence: TTT
tatgaagcctcctccaaaaa

SEQ ID NO: 189792 - DNA, 20 bp, Artificial Sequence
  Description of Artificial Sequence: Synthetic oligonucleotide
  Target: ATXN1; (-) strand; PAM type: YTN; PAM sequence: CTT
ttatgaagcctcctccaaaa

SEQ ID NO: 189793 - DNA, 20 bp, Artificial Sequence
  Description of Artificial Sequence: Synthetic oligonucleotide
  Target: ATXN1; (-) strand; PAM type: YTN; PAM sequence: CTA
gaatgcttttatgaagcctc

SEQ ID NO: 189794 - DNA, 20 bp, Artificial Sequence
  Description of Artificial Sequence: Synthetic oligonucleotide
  Target: ATXN1; (-) strand; PAM type: YTN; PAM sequence: TTA
agctagaatgcttttatgaa

SEQ ID NO: 189795 - DNA, 20 bp, Artificial Sequence
  Description of Artificial Sequence: Synthetic oligonucleotide
  Target: ATXN1; (-) strand; PAM type: YTN; PAM sequence: TTT
aagctagaatgcttttatga

SEQ ID NO: 189796 - DNA, 20 bp, Artificial Sequence
  Description of Artificial Sequence: Synthetic oligonucleotide
  Target: ATXN1; (-) strand; PAM type: YTN; PAM sequence: TTT
taagctagaatgcttttatg

SEQ ID NO: 189797 - DNA, 20 bp, Artificial Sequence
  Description of Artificial Sequence: Synthetic oligonucleotide
  Target: ATXN1; (-) strand; PAM type: YTN; PAM sequence: TTG
aaatcccagttttaagctag

SEQ ID NO: 189798 - DNA, 20 bp, Artificial Sequence
  Description of Artificial Sequence: Synthetic oligonucleotide
  Target: ATXN1; (-) strand; PAM type: YTN; PAM sequence: TTA
agaccattgaaatcccagtt

SEQ ID NO: 189799 - DNA, 20 bp, Artificial Sequence
  Description of Artificial Sequence: Synthetic oligonucleotide
  Target: ATXN1; (-) strand; PAM type: YTN; PAM sequence: TTC
acagttaagaccattgaaat

SEQ ID NO: 189800 - DNA, 20 bp, Artificial Sequence
  Description of Artificial Sequence: Synthetic oligonucleotide
  Target: ATXN1; (-) strand; PAM type: YTN; PAM sequence: CTA
catggtattcacagttaaga

SEQ ID NO: 189801 - DNA, 20 bp, Artificial Sequence
  Description of Artificial Sequence: Synthetic oligonucleotide
  Target: ATXN1; (-) strand; PAM type: YTN; PAM sequence: CTG
ctacatggtattcacagtta

SEQ ID NO: 189802 - DNA, 20 bp, Artificial Sequence
  Description of Artificial Sequence: Synthetic oligonucleotide
  Target: ATXN1; (-) strand; PAM type: YTN; PAM sequence: TTC
tgctacatggtattcacagt

SEQ ID NO: 189803 - DNA, 20 bp, Artificial Sequence
  Description of Artificial Sequence: Synthetic oligonucleotide
  Target: ATXN1; (-) strand; PAM type: YTN; PAM sequence: TTT
ctgctacatggtattcacag

SEQ ID NO: 189804 - DNA, 20 bp, Artificial Sequence
  Description of Artificial Sequence: Synthetic oligonucleotide
  Target: ATXN1; (-) strand; PAM type: YTN; PAM sequence: CTA
gatataatgccaagtggcat

SEQ ID NO: 189805 - DNA, 20 bp, Artificial Sequence
  Description of Artificial Sequence: Synthetic oligonucleotide
  Target: ATXN1; (-) strand; PAM type: YTN; PAM sequence: TTC
aacaggtaatccctagatat

SEQ ID NO: 189806 - DNA, 20 bp, Artificial Sequence
  Description of Artificial Sequence: Synthetic oligonucleotide
  Target: ATXN1; (-) strand; PAM type: YTN; PAM sequence: TTT
caacaggtaatccctagata

SEQ ID NO: 189807 - DNA, 20 bp, Artificial Sequence
  Description of Artificial Sequence: Synthetic oligonucleotide
  Target: ATXN1; (-) strand; PAM type: YTN; PAM sequence: TTG
gtgtttcaacaggtaatccc

SEQ ID NO: 189808 - DNA, 20 bp, Artificial Sequence
  Description of Artificial Sequence: Synthetic oligonucleotide
  Target: ATXN1; (-) strand; PAM type: YTN; PAM sequence: TTT
ggtgtttcaacaggtaatcc

SEQ ID NO: 189809 - DNA, 20 bp, Artificial Sequence
  Description of Artificial Sequence: Synthetic oligonucleotide
  Target: ATXN1; (-) strand; PAM type: YTN; PAM sequence: CTT
tggtgtttcaacaggtaatc

SEQ ID NO: 189810 - DNA, 20 bp, Artificial Sequence
  Description of Artificial Sequence: Synthetic oligonucleotide
  Target: ATXN1; (-) strand; PAM type: YTN; PAM sequence: CTG
tctttggtgtttcaacaggt

SEQ ID NO: 189811 - DNA, 20 bp, Artificial Sequence
  Description of Artificial Sequence: Synthetic oligonucleotide
  Target: ATXN1; (-) strand; PAM type: YTN; PAM sequence: CTG
cgtaacccacatcaaagtat

SEQ ID NO: 189812 - DNA, 20 bp, Artificial Sequence
  Description of Artificial Sequence: Synthetic oligonucleotide
  Target: ATXN1; (-) strand; PAM type: YTN; PAM sequence: TTA
cccggccctgcgtaacccac

SEQ ID NO: 189813 - DNA, 20 bp, Artificial Sequence
  Description of Artificial Sequence: Synthetic oligonucleotide
  Target: ATXN1; (-) strand; PAM type: YTN; PAM sequence: CTT
acccggccctgcgtaaccca

SEQ ID NO: 189814 - DNA, 20 bp, Artificial Sequence
  Description of Artificial Sequence: Synthetic oligonucleotide
  Target: ATXN1; (-) strand; PAM type: YTN; PAM sequence: TTA
cttacccggccctgcgtaac

SEQ ID NO: 189815 - DNA, 20 bp, Artificial Sequence
  Description of Artificial Sequence: Synthetic oligonucleotide
  Target: ATXN1; (-) strand; PAM type: YTN; PAM sequence: TTG
ttacttacccggccctgcgt

SEQ ID NO: 189816 - DNA, 20 bp, Artificial Sequence
  Description of Artificial Sequence: Synthetic oligonucleotide
  Target: ATXN1; (-) strand; PAM type: YTN; PAM sequence: CTT
gttacttacccggccctgcg

SEQ ID NO: 189817 - DNA, 20 bp, Artificial Sequence
  Description of Artificial Sequence: Synthetic oligonucleotide
  Target: ATXN1; (-) strand; PAM type: YTN; PAM sequence: TTC
ttgttacttacccggccctg

SEQ ID NO: 189818 - DNA, 20 bp, Artificial Sequence
  Description of Artificial Sequence: Synthetic oligonucleotide
  Target: ATXN1; (-) strand; PAM type: YTN; PAM sequence: TTT
cttgttacttacccggccct

SEQ ID NO: 189819 - DNA, 20 bp, Artificial Sequence
  Description of Artificial Sequence: Synthetic oligonucleotide
  Target: ATXN1; (-) strand; PAM type: YTN; PAM sequence: TTG
tatttcttgttacttacccg

SEQ ID NO: 189820 - DNA, 20 bp, Artificial Sequence
  Description of Artificial Sequence: Synthetic oligonucleotide
  Target: ATXN1; (-) strand; PAM type: YTN; PAM sequence: TTC
atagaaagaaagaataattg

SEQ ID NO: 189821 - DNA, 20 bp, Artificial Sequence
  Description of Artificial Sequence: Synthetic oligonucleotide
  Target: ATXN1; (-) strand; PAM type: YTN; PAM sequence: TTC
agcgccacattcatagaaag

SEQ ID NO: 189822 - DNA, 20 bp, Artificial Sequence
  Description of Artificial Sequence: Synthetic oligonucleotide
  Target: ATXN1; (-) strand; PAM type: YTN; PAM sequence: CTT
cagcgccacattcatagaaa

SEQ ID NO: 189823 - DNA, 20 bp, Artificial Sequence
  Description of Artificial Sequence: Synthetic oligonucleotide
  Target: ATXN1; (-) strand; PAM type: YTN; PAM sequence: CTC
caaatatggtatcaaatctt

SEQ ID NO: 189824 - DNA, 20 bp, Artificial Sequence
  Description of Artificial Sequence: Synthetic oligonucleotide
  Target: ATXN1; (-) strand; PAM type: YTN; PAM sequence: CTG
tgctccaaatatggtatcaa

SEQ ID NO: 189825 - DNA, 20 bp, Artificial Sequence
  Description of Artificial Sequence: Synthetic oligonucleotide
  Target: ATXN1; (-) strand; PAM type: YTN; PAM sequence: CTC
cacacgatggatctgtgctc

SEQ ID NO: 189826 - DNA, 20 bp, Artificial Sequence
  Description of Artificial Sequence: Synthetic oligonucleotide
  Target: ATXN1; (-) strand; PAM type: YTN; PAM sequence: TTC
cccatccctccacacgatgg

SEQ ID NO: 189827 - DNA, 20 bp, Artificial Sequence
  Description of Artificial Sequence: Synthetic oligonucleotide
  Target: ATXN1; (-) strand; PAM type: YTN; PAM sequence: TTT
ccccatccctccacacgatg

SEQ ID NO: 189828 - DNA, 20 bp, Artificial Sequence
  Description of Artificial Sequence: Synthetic oligonucleotide
  Target: ATXN1; (-) strand; PAM type: YTN; PAM sequence: CTG
tgtttccccatccctccaca

SEQ ID NO: 189829 - DNA, 20 bp, Artificial Sequence
  Description of Artificial Sequence: Synthetic oligonucleotide
  Target: ATXN1; (-) strand; PAM type: YTN; PAM sequence: CTC
ctgtgtttccccatccctcc

SEQ ID NO: 189830 - DNA, 20 bp, Artificial Sequence
  Description of Artificial Sequence: Synthetic oligonucleotide
  Target: ATXN1; (-) strand; PAM type: YTN; PAM sequence: CTC
tcctgtgtttccccatccct

SEQ ID NO: 189831 - DNA, 20 bp, Artificial Sequence
  Description of Artificial Sequence: Synthetic oligonucleotide
  Target: ATXN1; (-) strand; PAM type: YTN; PAM sequence: CTC
agcacccctctcctgtgttt

SEQ ID NO: 189832 - DNA, 20 bp, Artificial Sequence
  Description of Artificial Sequence: Synthetic oligonucleotide
  Target: ATXN1; (-) strand; PAM type: YTN; PAM sequence: CTG
tggacatgtggtcacactca

SEQ ID NO: 189833 - DNA, 20 bp, Artificial Sequence
  Description of Artificial Sequence: Synthetic oligonucleotide
  Target: ATXN1; (-) strand; PAM type: YTN; PAM sequence: CTC
agacaggcctgtggacatgt

SEQ ID NO: 189834 - DNA, 20 bp, Artificial Sequence
  Description of Artificial Sequence: Synthetic oligonucleotide
  Target: ATXN1; (-) strand; PAM type: YTN; PAM sequence: CTG
tagcgagctcagacaggcct

SEQ ID NO: 189835 - DNA, 20 bp, Artificial Sequence
  Description of Artificial Sequence: Synthetic oligonucleotide
  Target: ATXN1; (-) strand; PAM type: YTN; PAM sequence: TTC
atgatgcagtgtgacctgta

SEQ ID NO: 189836 - DNA, 20 bp, Artificial Sequence
  Description of Artificial Sequence: Synthetic oligonucleotide
  Target: ATXN1; (-) strand; PAM type: YTN; PAM sequence: CTT
catgatgcagtgtgacctgt

SEQ ID NO: 189837 - DNA, 20 bp, Artificial Sequence
  Description of Artificial Sequence: Synthetic oligonucleotide
  Target: ATXN1; (-) strand; PAM type: YTN; PAM sequence: TTG
cagcaagtggagtacagggt

SEQ ID NO: 189838 - DNA, 20 bp, Artificial Sequence
  Description of Artificial Sequence: Synthetic oligonucleotide
  Target: ATXN1; (-) strand; PAM type: YTN; PAM sequence: TTG
aaattgcagcaagtggagta

SEQ ID NO: 189839 - DNA, 20 bp, Artificial Sequence
  Description of Artificial Sequence: Synthetic oligonucleotide
  Target: ATXN1; (-) strand; PAM type: YTN; PAM sequence: TTG
cattgaaattgcagcaagtg

SEQ ID NO: 189840 - DNA, 20 bp, Artificial Sequence
  Description of Artificial Sequence: Synthetic oligonucleotide
  Target: ATXN1; (-) strand; PAM type: YTN; PAM sequence: TTT
gcattgaaattgcagcaagt

SEQ ID NO: 189841 - DNA, 20 bp, Artificial Sequence
  Description of Artificial Sequence: Synthetic oligonucleotide
  Target: ATXN1; (-) strand; PAM type: YTN; PAM sequence: TTA
tttgcattgaaattgcagca

SEQ ID NO: 189842 - DNA, 20 bp, Artificial Sequence
  Description of Artificial Sequence: Synthetic oligonucleotide
  Target: ATXN1; (-) strand; PAM type: YTN; PAM sequence: TTT
atttgcattgaaattgcagc

SEQ ID NO: 189843 - DNA, 20 bp, Artificial Sequence
  Description of Artificial Sequence: Synthetic oligonucleotide
  Target: ATXN1; (-) strand; PAM type: YTN; PAM sequence: CTT
tatttgcattgaaattgcag

SEQ ID NO: 189844 - DNA, 20 bp, Artificial Sequence
  Description of Artificial Sequence: Synthetic oligonucleotide
  Target: ATXN1; (-) strand; PAM type: YTN; PAM sequence: TTC
tttatttgcattgaaattgc

SEQ ID NO: 189845 - DNA, 20 bp, Artificial Sequence
  Description of Artificial Sequence: Synthetic oligonucleotide
  Target: ATXN1; (-) strand; PAM type: YTN; PAM sequence: TTT
ctttatttgcattgaaattg

SEQ ID NO: 189846 - DNA, 20 bp, Artificial Sequence
  Description of Artificial Sequence: Synthetic oligonucleotide
  Target: ATXN1; (-) strand; PAM type: YTN; PAM sequence: TTT
tctttatttgcattgaaatt

SEQ ID NO: 189847 - DNA, 20 bp, Artificial Sequence
  Description of Artificial Sequence: Synthetic oligonucleotide
  Target: ATXN1; (-) strand; PAM type: YTN; PAM sequence: TTT
ttctttatttgcattgaaat

SEQ ID NO: 189848 - DNA, 20 bp, Artificial Sequence
  Description of Artificial Sequence: Synthetic oligonucleotide
  Target: ATXN1; (-) strand; PAM type: YTN; PAM sequence: TTG
atatttttctttatttgcat

SEQ ID NO: 189849 - DNA, 20 bp, Artificial Sequence
  Description of Artificial Sequence: Synthetic oligonucleotide
  Target: ATXN1; (-) strand; PAM type: YTN; PAM sequence: CTC
ataaaatagtagttgatatt

SEQ ID NO: 189850 - DNA, 20 bp, Artificial Sequence
  Description of Artificial Sequence: Synthetic oligonucleotide
  Target: ATXN1; (-) strand; PAM type: YTN; PAM sequence: TTA
ctcataaaatagtagttgat

SEQ ID NO: 189851 - DNA, 20 bp, Artificial Sequence
  Description of Artificial Sequence: Synthetic oligonucleotide
  Target: ATXN1; (-) strand; PAM type: YTN; PAM sequence: TTT
actcataaaatagtagttga

SEQ ID NO: 189852 - DNA, 20 bp, Artificial Sequence
  Description of Artificial Sequence: Synthetic oligonucleotide
  Target: ATXN1; (-) strand; PAM type: YTN; PAM sequence: CTT
tactcataaaatagtagttg

SEQ ID NO: 189853 - DNA, 20 bp, Artificial Sequence
  Description of Artificial Sequence: Synthetic oligonucleotide
  Target: ATXN1; (-) strand; PAM type: YTN; PAM sequence: TTG
ccagcgtcctttactcataa

SEQ ID NO: 189854 - DNA, 20 bp, Artificial Sequence
  Description of Artificial Sequence: Synthetic oligonucleotide
  Target: ATXN1; (-) strand; PAM type: YTN; PAM sequence: CTT
gccagcgtcctttactcata

SEQ ID NO: 189855 - DNA, 20 bp, Artificial Sequence
  Description of Artificial Sequence: Synthetic oligonucleotide
  Target: ATXN1; (-) strand; PAM type: YTN; PAM sequence: CTG
catcttgccagcgtccttta

SEQ ID NO: 189856 - DNA, 20 bp, Artificial Sequence
  Description of Artificial Sequence: Synthetic oligonucleotide
  Target: ATXN1; (-) strand; PAM type: YTN; PAM sequence: TTA
agacaaaccacggctgcatc

SEQ ID NO: 189857 - DNA, 20 bp, Artificial Sequence
  Description of Artificial Sequence: Synthetic oligonucleotide
  Target: ATXN1; (-) strand; PAM type: YTN; PAM sequence: CTT
aagacaaaccacggctgcat

SEQ ID NO: 189858 - DNA, 20 bp, Artificial Sequence
  Description of Artificial Sequence: Synthetic oligonucleotide
  Target: ATXN1; (-) strand; PAM type: YTN; PAM sequence: CTC
ttaagacaaaccacggctgc

SEQ ID NO: 189859 - DNA, 20 bp, Artificial Sequence
  Description of Artificial Sequence: Synthetic oligonucleotide
  Target: ATXN1; (-) strand; PAM type: YTN; PAM sequence: TTC
aggactcttaagacaaacca

SEQ ID NO: 189860 - DNA, 20 bp, Artificial Sequence
  Description of Artificial Sequence: Synthetic oligonucleotide
  Target: ATXN1; (-) strand; PAM type: YTN; PAM sequence: TTT
caggactcttaagacaaacc

SEQ ID NO: 189861 - DNA, 20 bp, Artificial Sequence
  Description of Artificial Sequence: Synthetic oligonucleotide
  Target: ATXN1; (-) strand; PAM type: YTN; PAM sequence: CTG
agtttcaggactcttaagac

SEQ ID NO: 189862 - DNA, 20 bp, Artificial Sequence
  Description of Artificial Sequence: Synthetic oligonucleotide
  Target: ATXN1; (-) strand; PAM type: YTN; PAM sequence: TTA
actgagtttcaggactctta

SEQ ID NO: 189863 - DNA, 20 bp, Artificial Sequence
  Description of Artificial Sequence: Synthetic oligonucleotide
  Target: ATXN1; (-) strand; PAM type: YTN; PAM sequence: TTT
aactgagtttcaggactctt

SEQ ID NO: 189864 - DNA, 20 bp, Artificial Sequence
  Description of Artificial Sequence: Synthetic oligonucleotide
  Target: ATXN1; (-) strand; PAM type: YTN; PAM sequence: TTT
taactgagtttcaggactct

SEQ ID NO: 189865 - DNA, 20 bp, Artificial Sequence
  Description of Artificial Sequence: Synthetic oligonucleotide
  Target: ATXN1; (-) strand; PAM type: YTN; PAM sequence: TTA
atgaaacgcgatcatcaggt

SEQ ID NO: 189866 - DNA, 20 bp, Artificial Sequence
  Description of Artificial Sequence: Synthetic oligonucleotide
  Target: ATXN1; (-) strand; PAM type: YTN; PAM sequence: TTT
aatgaaacgcgatcatcagg

SEQ ID NO: 189867 - DNA, 20 bp, Artificial Sequence
  Description of Artificial Sequence: Synthetic oligonucleotide
  Target: ATXN1; (-) strand; PAM type: YTN; PAM sequence: TTT
taatgaaacgcgatcatcag

SEQ ID NO: 189868 - DNA, 20 bp, Artificial Sequence
  Description of Artificial Sequence: Synthetic oligonucleotide
  Target: ATXN1; (-) strand; PAM type: YTN; PAM sequence: TTT
ttaatgaaacgcgatcatca

SEQ ID NO: 189869 - DNA, 20 bp, Artificial Sequence
  Description of Artificial Sequence: Synthetic oligonucleotide
  Target: ATXN1; (-) strand; PAM type: YTN; PAM sequence: TTG
gggtttttaatgaaacgcga

SEQ ID NO: 189870 - DNA, 20 bp, Artificial Sequence
  Description of Artificial Sequence: Synthetic oligonucleotide
  Target: ATXN1; (-) strand; PAM type: YTN; PAM sequence: CTT
ggggtttttaatgaaacgcg

SEQ ID NO: 189871 - DNA, 20 bp, Artificial Sequence
  Description of Artificial Sequence: Synthetic oligonucleotide
  Target: ATXN1; (-) strand; PAM type: YTN; PAM sequence: TTC
cttggggtttttaatgaaac

SEQ ID NO: 189872 - DNA, 20 bp, Artificial Sequence
  Description of Artificial Sequence: Synthetic oligonucleotide
  Target: ATXN1; (-) strand; PAM type: YTN; PAM sequence: CTC
atggtgtaaagaaattcctt

SEQ ID NO: 189873 - DNA, 20 bp, Artificial Sequence
  Description of Artificial Sequence: Synthetic oligonucleotide
  Target: ATXN1; (-) strand; PAM type: YTN; PAM sequence: TTG
tagaatgctcatggtgtaaa

SEQ ID NO: 189874 - DNA, 20 bp, Artificial Sequence
  Description of Artificial Sequence: Synthetic oligonucleotide
  Target: ATXN1; (-) strand; PAM type: YTN; PAM sequence: CTT
gtagaatgctcatggtgtaa

SEQ ID NO: 189875 - DNA, 20 bp, Artificial Sequence
  Description of Artificial Sequence: Synthetic oligonucleotide
  Target: ATXN1; (-) strand; PAM type: YTN; PAM sequence: TTA
aagagaggtaggaaacttgt

SEQ ID NO: 189876 - DNA, 20 bp, Artificial Sequence
  Description of Artificial Sequence: Synthetic oligonucleotide
  Target: ATXN1; (-) strand; PAM type: YTN; PAM sequence: CTT
aaagagaggtaggaaacttg

SEQ ID NO: 189877 - DNA, 20 bp, Artificial Sequence
  Description of Artificial Sequence: Synthetic oligonucleotide
  Target: ATXN1; (-) strand; PAM type: YTN; PAM sequence: TTA
gtcttaaagagaggtaggaa

SEQ ID NO: 189878 - DNA, 20 bp, Artificial Sequence
  Description of Artificial Sequence: Synthetic oligonucleotide
  Target: ATXN1; (-) strand; PAM type: YTN; PAM sequence: TTT
agtcttaaagagaggtagga

SEQ ID NO: 189879 - DNA, 20 bp, Artificial Sequence
  Description of Artificial Sequence: Synthetic oligonucleotide
  Target: ATXN1; (-) strand; PAM type: YTN; PAM sequence: TTA
aatatttagtcttaaagaga

SEQ ID NO: 189880 - DNA, 20 bp, Artificial Sequence
  Description of Artificial Sequence: Synthetic oligonucleotide
  Target: ATXN1; (-) strand; PAM type: YTN; PAM sequence: TTT
aaatatttagtcttaaagag

SEQ ID NO: 189881 - DNA, 20 bp, Artificial Sequence
  Description of Artificial Sequence: Synthetic oligonucleotide
  Target: ATXN1; (-) strand; PAM type: YTN; PAM sequence: TTT
taaatatttagtcttaaaga

SEQ ID NO: 189882 - DNA, 20 bp, Artificial Sequence
  Description of Artificial Sequence: Synthetic oligonucleotide
  Target: ATXN1; (-) strand; PAM type: YTN; PAM sequence: CTA
aagagttttaaatatttagt

SEQ ID NO: 189883 - DNA, 20 bp, Artificial Sequence
  Description of Artificial Sequence: Synthetic oligonucleotide
  Target: ATXN1; (-) strand; PAM type: YTN; PAM sequence: TTC
taaagagttttaaatattta

SEQ ID NO: 189884 - DNA, 20 bp, Artificial Sequence
  Description of Artificial Sequence: Synthetic oligonucleotide
  Target: ATXN1; (-) strand; PAM type: YTN; PAM sequence: CTA
attctaaagagttttaaata

SEQ ID NO: 189885 - DNA, 20 bp, Artificial Sequence
  Description of Artificial Sequence: Synthetic oligonucleotide
  Target: ATXN1; (-) strand; PAM type: YTN; PAM sequence: CTA
gagccaagtgacacatagat

SEQ ID NO: 189886 - DNA, 20 bp, Artificial Sequence
  Description of Artificial Sequence: Synthetic oligonucleotide
  Target: ATXN1; (-) strand; PAM type: YTN; PAM sequence: TTC
cccgagaatatgtgtcctag

SEQ ID NO: 189887 - DNA, 20 bp, Artificial Sequence
  Description of Artificial Sequence: Synthetic oligonucleotide
  Target: ATXN1; (-) strand; PAM type: YTN; PAM sequence: CTT
ccccgagaatatgtgtccta

SEQ ID NO: 189888 - DNA, 20 bp, Artificial Sequence
  Description of Artificial Sequence: Synthetic oligonucleotide
  Target: ATXN1; (-) strand; PAM type: YTN; PAM sequence: CTC
ttccccgagaatatgtgtcc

SEQ ID NO: 189889 - DNA, 20 bp, Artificial Sequence
  Description of Artificial Sequence: Synthetic oligonucleotide
  Target: ATXN1; (-) strand; PAM type: YTN; PAM sequence: CTA
atagaaatggggatatgctc

SEQ ID NO: 189890 - DNA, 20 bp, Artificial Sequence
  Description of Artificial Sequence: Synthetic oligonucleotide
  Target: ATXN1; (-) strand; PAM type: YTN; PAM sequence: CTC
ctaatagaaatggggatatg

SEQ ID NO: 189891 - DNA, 20 bp, Artificial Sequence
  Description of Artificial Sequence: Synthetic oligonucleotide
  Target: ATXN1; (-) strand; PAM type: YTN; PAM sequence: TTC
tcctaatagaaatggggata

SEQ ID NO: 189892 - DNA, 20 bp, Artificial Sequence
  Description of Artificial Sequence: Synthetic oligonucleotide
  Target: ATXN1; (-) strand; PAM type: YTN; PAM sequence: TTT
ctcctaatagaaatggggat

SEQ ID NO: 189893 - DNA, 20 bp, Artificial Sequence
  Description of Artificial Sequence: Synthetic oligonucleotide
  Target: ATXN1; (-) strand; PAM type: YTN; PAM sequence: CTT
tctcctaatagaaatgggga

SEQ ID NO: 189894 - DNA, 20 bp, Artificial Sequence
  Description of Artificial Sequence: Synthetic oligonucleotide
  Target: ATXN1; (-) strand; PAM type: YTN; PAM sequence: TTC
tttctcctaatagaaatggg

SEQ ID NO: 189895 - DNA, 20 bp, Artificial Sequence
  Description of Artificial Sequence: Synthetic oligonucleotide
  Target: ATXN1; (-) strand; PAM type: YTN; PAM sequence: TTA
ttctttctcctaatagaaat

SEQ ID NO: 189896 - DNA, 20 bp, Artificial Sequence
  Description of Artificial Sequence: Synthetic oligonucleotide
  Target: ATXN1; (-) strand; PAM type: YTN; PAM sequence: CTG
ttattctttctcctaataga

SEQ ID NO: 189897 - DNA, 20 bp, Artificial Sequence
  Description of Artificial Sequence: Synthetic oligonucleotide
  Target: ATXN1; (-) strand; PAM type: YTN; PAM sequence: CTG
caagatgaaggaggagggga

SEQ ID NO: 189898 - DNA, 20 bp, Artificial Sequence
  Description of Artificial Sequence: Synthetic oligonucleotide
  Target: ATXN1; (-) strand; PAM type: YTN; PAM sequence: CTA
aatctgcaagatgaaggagg

SEQ ID NO: 189899 - DNA, 20 bp, Artificial Sequence
  Description of Artificial Sequence: Synthetic oligonucleotide
  Target: ATXN1; (-) strand; PAM type: YTN; PAM sequence: CTA
ggataaacccctaaatctgc

SEQ ID NO: 189900 - DNA, 20 bp, Artificial Sequence
  Description of Artificial Sequence: Synthetic oligonucleotide
  Target: ATXN1; (-) strand; PAM type: YTN; PAM sequence: CTG
agccatgatactaggataaa

SEQ ID NO: 189901 - DNA, 20 bp, Artificial Sequence
  Description of Artificial Sequence: Synthetic oligonucleotide
  Target: ATXN1; (-) strand; PAM type: YTN; PAM sequence: TTG
taagtgtgagaatcccctga

SEQ ID NO: 189902 - DNA, 20 bp, Artificial Sequence
  Description of Artificial Sequence: Synthetic oligonucleotide
  Target: ATXN1; (-) strand; PAM type: YTN; PAM sequence: TTA
ggagttgtaagtgtgagaat

SEQ ID NO: 189903 - DNA, 20 bp, Artificial Sequence
  Description of Artificial Sequence: Synthetic oligonucleotide
  Target: ATXN1; (-) strand; PAM type: YTN; PAM sequence: TTG
atatattaggagttgtaagt

SEQ ID NO: 189904 - DNA, 20 bp, Artificial Sequence
  Description of Artificial Sequence: Synthetic oligonucleotide
  Target: ATXN1; (-) strand; PAM type: YTN; PAM sequence: TTT
gatatattaggagttgtaag

SEQ ID NO: 189905 - DNA, 20 bp, Artificial Sequence
  Description of Artificial Sequence: Synthetic oligonucleotide
  Target: ATXN1; (-) strand; PAM type: YTN; PAM sequence: TTT
tgatatattaggagttgtaa

SEQ ID NO: 189906 - DNA, 20 bp, Artificial Sequence
  Description of Artificial Sequence: Synthetic oligonucleotide
  Target: ATXN1; (-) strand; PAM type: YTN; PAM sequence: TTT
ttgatatattaggagttgta

SEQ ID NO: 189907 - DNA, 20 bp, Artificial Sequence
  Description of Artificial Sequence: Synthetic oligonucleotide
  Target: ATXN1; (-) strand; PAM type: YTN; PAM sequence: TTT
tttgatatattaggagttgt

SEQ ID NO: 189908 - DNA, 20 bp, Artificial Sequence
  Description of Artificial Sequence: Synthetic oligonucleotide
  Target: ATXN1; (-) strand; PAM type: YTN; PAM sequence: CTT
ttttgatatattaggagttg

SEQ ID NO: 189909 - DNA, 20 bp, Artificial Sequence
  Description of Artificial Sequence: Synthetic oligonucleotide
  Target: ATXN1; (-) strand; PAM type: YTN; PAM sequence: CTC
cttttttgatatattaggag

SEQ ID NO: 189910 - DNA, 20 bp, Artificial Sequence
  Description of Artificial Sequence: Synthetic oligonucleotide
  Target: ATXN1; (-) strand; PAM type: YTN; PAM sequence: TTC
tccttttttgatatattagg

SEQ ID NO: 189911 - DNA, 20 bp, Artificial Sequence
  Description of Artificial Sequence: Synthetic oligonucleotide
  Target: ATXN1; (-) strand; PAM type: YTN; PAM sequence: TTT
ctccttttttgatatattag

SEQ ID NO: 189912 - DNA, 20 bp, Artificial Sequence
  Description of Artificial Sequence: Synthetic oligonucleotide
  Target: ATXN1; (-) strand; PAM type: YTN; PAM sequence: TTT
tctccttttttgatatatta

SEQ ID NO: 189913 - DNA, 20 bp, Artificial Sequence
  Description of Artificial Sequence: Synthetic oligonucleotide
  Target: ATXN1; (-) strand; PAM type: YTN; PAM sequence: TTA
agcagtgaagagagattttc

SEQ ID NO: 189914 - DNA, 20 bp, Artificial Sequence
  Description of Artificial Sequence: Synthetic oligonucleotide
  Target: ATXN1; (-) strand; PAM type: YTN; PAM sequence: TTC
gacaaaacaattaagcagtg

SEQ ID NO: 189915 - DNA, 20 bp, Artificial Sequence
  Description of Artificial Sequence: Synthetic oligonucleotide
  Target: ATXN1; (-) strand; PAM type: YTN; PAM sequence: TTA
ttcgacaaaacaattaagca

SEQ ID NO: 189916 - DNA, 20 bp, Artificial Sequence
  Description of Artificial Sequence: Synthetic oligonucleotide
  Target: ATXN1; (-) strand; PAM type: YTN; PAM sequence: CTT
attcgacaaaacaattaagc

SEQ ID NO: 189917 - DNA, 20 bp, Artificial Sequence
  Description of Artificial Sequence: Synthetic oligonucleotide
  Target: ATXN1; (-) strand; PAM type: YTN; PAM sequence: TTG
agagcttattcgacaaaaca

SEQ ID NO: 189918 - DNA, 20 bp, Artificial Sequence
  Description of Artificial Sequence: Synthetic oligonucleotide
  Target: ATXN1; (-) strand; PAM type: YTN; PAM sequence: TTT
gagagcttattcgacaaaac

SEQ ID NO: 189919 - DNA, 20 bp, Artificial Sequence
  Description of Artificial Sequence: Synthetic oligonucleotide
  Target: ATXN1; (-) strand; PAM type: YTN; PAM sequence: TTT
tgagagcttattcgacaaaa

SEQ ID NO: 189920 - DNA, 20 bp, Artificial Sequence
  Description of Artificial Sequence: Synthetic oligonucleotide
  Target: ATXN1; (-) strand; PAM type: YTN; PAM sequence: CTT
ttgagagcttattcgacaaa

SEQ ID NO: 189921 - DNA, 20 bp, Artificial Sequence
  Description of Artificial Sequence: Synthetic oligonucleotide
  Target: ATXN1; (-) strand; PAM type: YTN; PAM sequence: CTG
aaaaaggtaacaaaaatgaa

SEQ ID NO: 189922 - DNA, 20 bp, Artificial Sequence
  Description of Artificial Sequence: Synthetic oligonucleotide
  Target: ATXN1; (-) strand; PAM type: YTN; PAM sequence: TTG
cctgaaaaaggtaacaaaaa

SEQ ID NO: 189923 - DNA, 20 bp, Artificial Sequence
  Description of Artificial Sequence: Synthetic oligonucleotide
  Target: ATXN1; (-) strand; PAM type: YTN; PAM sequence: TTT
gcctgaaaaaggtaacaaaa

SEQ ID NO: 189924 - DNA, 20 bp, Artificial Sequence
  Description of Artificial Sequence: Synthetic oligonucleotide
  Target: ATXN1; (-) strand; PAM type: YTN; PAM sequence: TTT
tgcctgaaaaaggtaacaaa

SEQ ID NO: 189925 - DNA, 20 bp, Artificial Sequence
  Description of Artificial Sequence: Synthetic oligonucleotide
  Target: ATXN1; (-) strand; PAM type: YTN; PAM sequence: TTA
ttttgcctgaaaaaggtaac

SEQ ID NO: 189926 - DNA, 20 bp, Artificial Sequence
  Description of Artificial Sequence: Synthetic oligonucleotide
  Target: ATXN1; (-) strand; PAM type: YTN; PAM sequence: CTT
attttgcctgaaaaaggtaa

SEQ ID NO: 189927 - DNA, 20 bp, Artificial Sequence
  Description of Artificial Sequence: Synthetic oligonucleotide
  Target: ATXN1; (-) strand; PAM type: YTN; PAM sequence: CTC
ttattttgcctgaaaaaggt

SEQ ID NO: 189928 - DNA, 20 bp, Artificial Sequence
  Description of Artificial Sequence: Synthetic oligonucleotide
  Target: ATXN1; (-) strand; PAM type: YTN; PAM sequence: TTG
taaaaggcctcttattttgc

SEQ ID NO: 189929 - DNA, 20 bp, Artificial Sequence
  Description of Artificial Sequence: Synthetic oligonucleotide
  Target: ATXN1; (-) strand; PAM type: YTN; PAM sequence: TTT
gtaaaaggcctcttattttg

SEQ ID NO: 189930 - DNA, 20 bp, Artificial Sequence
  Description of Artificial Sequence: Synthetic oligonucleotide
  Target: ATXN1; (-) strand; PAM type: YTN; PAM sequence: TTT
tgtaaaaggcctcttatttt

SEQ ID NO: 189931 - DNA, 20 bp, Artificial Sequence
  Description of Artificial Sequence: Synthetic oligonucleotide
  Target: ATXN1; (-) strand; PAM type: YTN; PAM sequence: TTT
ttgtaaaaggcctcttattt

SEQ ID NO: 189932 - DNA, 20 bp, Artificial Sequence
  Description of Artificial Sequence: Synthetic oligonucleotide
  Target: ATXN1; (-) strand; PAM type: YTN; PAM sequence: TTA
gcaatagaatttttgtaaaa

SEQ ID NO: 189933 - DNA, 20 bp, Artificial Sequence
  Description of Artificial Sequence: Synthetic oligonucleotide
  Target: ATXN1; (-) strand; PAM type: YTN; PAM sequence: TTT
agcaatagaatttttgtaaa

SEQ ID NO: 189934 - DNA, 20 bp, Artificial Sequence
  Description of Artificial Sequence: Synthetic oligonucleotide
  Target: ATXN1; (-) strand; PAM type: YTN; PAM sequence: TTT
tagcaatagaatttttgtaa

SEQ ID NO: 189935 - DNA, 20 bp, Artificial Sequence
  Description of Artificial Sequence: Synthetic oligonucleotide
  Target: ATXN1; (-) strand; PAM type: YTN; PAM sequence: TTG
ttttagcaatagaatttttg

SEQ ID NO: 189936 - DNA, 20 bp, Artificial Sequence
  Description of Artificial Sequence: Synthetic oligonucleotide
  Target: ATXN1; (-) strand; PAM type: YTN; PAM sequence: TTC
cattgttttagcaatagaat

SEQ ID NO: 189937 - DNA, 20 bp, Artificial Sequence
  Description of Artificial Sequence: Synthetic oligonucleotide
  Target: ATXN1; (-) strand; PAM type: YTN; PAM sequence: TTC
ccgggagaattccattgttt

SEQ ID NO: 189938 - DNA, 20 bp, Artificial Sequence
  Description of Artificial Sequence: Synthetic oligonucleotide
  Target: ATXN1; (-) strand; PAM type: YTN; PAM sequence: TTC
cataacgaagtcattcccgg

SEQ ID NO: 189939 - DNA, 20 bp, Artificial Sequence
  Description of Artificial Sequence: Synthetic oligonucleotide
  Target: ATXN1; (-) strand; PAM type: YTN; PAM sequence: TTT
ccataacgaagtcattcccg

SEQ ID NO: 189940 - DNA, 20 bp, Artificial Sequence
  Description of Artificial Sequence: Synthetic oligonucleotide
  Target: ATXN1; (-) strand; PAM type: YTN; PAM sequence: TTC
atttccataacgaagtcatt

SEQ ID NO: 189941 - DNA, 20 bp, Artificial Sequence
  Description of Artificial Sequence: Synthetic oligonucleotide
  Target: ATXN1; (-) strand; PAM type: YTN; PAM sequence: CTT
catttccataacgaagtcat

SEQ ID NO: 189942 - DNA, 20 bp, Artificial Sequence
  Description of Artificial Sequence: Synthetic oligonucleotide
  Target: ATXN1; (-) strand; PAM type: YTN; PAM sequence: CTG
tcacttcatttccataacga

SEQ ID NO: 189943 - DNA, 20 bp, Artificial Sequence
  Description of Artificial Sequence: Synthetic oligonucleotide
  Target: ATXN1; (-) strand; PAM type: YTN; PAM sequence: CTA
gataaaagaagctgtcactt

SEQ ID NO: 189944 - DNA, 20 bp, Artificial Sequence
  Description of Artificial Sequence: Synthetic oligonucleotide
  Target: ATXN1; (-) strand; PAM type: YTN; PAM sequence: CTG
gctagataaaagaagctgtc

SEQ ID NO: 189945 - DNA, 20 bp, Artificial Sequence
  Description of Artificial Sequence: Synthetic oligonucleotide
  Target: ATXN1; (-) strand; PAM type: YTN; PAM sequence: CTG
cctggctagataaaagaagc

SEQ ID NO: 189946 - DNA, 20 bp, Artificial Sequence
  Description of Artificial Sequence: Synthetic oligonucleotide
  Target: ATXN1; (-) strand; PAM type: YTN; PAM sequence: TTC
tgcctggctagataaaagaa

SEQ ID NO: 189947 - DNA, 20 bp, Artificial Sequence
  Description of Artificial Sequence: Synthetic oligonucleotide
  Target: ATXN1; (-) strand; PAM type: YTN; PAM sequence: TTT
ctgcctggctagataaaaga

SEQ ID NO: 189948 - DNA, 20 bp, Artificial Sequence
  Description of Artificial Sequence: Synthetic oligonucleotide
  Target: ATXN1; (-) strand; PAM type: YTN; PAM sequence: CTT
tctgcctggctagataaaag

SEQ ID NO: 189949 - DNA, 20 bp, Artificial Sequence
  Description of Artificial Sequence: Synthetic oligonucleotide
  Target: ATXN1; (-) strand; PAM type: YTN; PAM sequence: TTA
taaatgcagactttctgcct

SEQ ID NO: 189950 - DNA, 20 bp, Artificial Sequence
  Description of Artificial Sequence: Synthetic oligonucleotide
  Target: ATXN1; (-) strand; PAM type: YTN; PAM sequence: TTT
ataaatgcagactttctgcc

SEQ ID NO: 189951 - DNA, 20 bp, Artificial Sequence
  Description of Artificial Sequence: Synthetic oligonucleotide
  Target: ATXN1; (-) strand; PAM type: YTN; PAM sequence: TTT
tataaatgcagactttctgc

SEQ ID NO: 189952 - DNA, 20 bp, Artificial Sequence
  Description of Artificial Sequence: Synthetic oligonucleotide
  Target: ATXN1; (-) strand; PAM type: YTN; PAM sequence: CTT
ttataaatgcagactttctg

SEQ ID NO: 189953 - DNA, 20 bp, Artificial Sequence
  Description of Artificial Sequence: Synthetic oligonucleotide
  Target: ATXN1; (-) strand; PAM type: YTN; PAM sequence: CTG
aatgccttttataaatgcag

SEQ ID NO: 189954 - DNA, 20 bp, Artificial Sequence
  Description of Artificial Sequence: Synthetic oligonucleotide
  Target: ATXN1; (-) strand; PAM type: YTN; PAM sequence: CTC
tgaatgccttttataaatgc

SEQ ID NO: 189955 - DNA, 20 bp, Artificial Sequence
  Description of Artificial Sequence: Synthetic oligonucleotide
  Target: ATXN1; (-) strand; PAM type: YTN; PAM sequence: TTG
agtgctctgaatgcctttta

SEQ ID NO: 189956 - DNA, 20 bp, Artificial Sequence
  Description of Artificial Sequence: Synthetic oligonucleotide
  Target: ATXN1; (-) strand; PAM type: YTN; PAM sequence: CTT
gagtgctctgaatgcctttt

SEQ ID NO: 189957 - DNA, 20 bp, Artificial Sequence
  Description of Artificial Sequence: Synthetic oligonucleotide
  Target: ATXN1; (-) strand; PAM type: YTN; PAM sequence: CTC
ccacacacaacacttgagtg

SEQ ID NO: 189958 - DNA, 20 bp, Artificial Sequence
  Description of Artificial Sequence: Synthetic oligonucleotide
  Target: ATXN1; (-) strand; PAM type: YTN; PAM sequence: CTG
tcctcccacacacaacactt

SEQ ID NO: 189959 - DNA, 20 bp, Artificial Sequence
  Description of Artificial Sequence: Synthetic oligonucleotide
  Target: ATXN1; (-) strand; PAM type: YTN; PAM sequence: TTC
tgtcctcccacacacaacac

SEQ ID NO: 189960 - DNA, 20 bp, Artificial Sequence
  Description of Artificial Sequence: Synthetic oligonucleotide
  Target: ATXN1; (-) strand; PAM type: YTN; PAM sequence: TTT
ctgtcctcccacacacaaca

SEQ ID NO: 189961 - DNA, 20 bp, Artificial Sequence
  Description of Artificial Sequence: Synthetic oligonucleotide
  Target: ATXN1; (-) strand; PAM type: YTN; PAM sequence: TTT
tctgtcctcccacacacaac

SEQ ID NO: 189962 - DNA, 20 bp, Artificial Sequence
  Description of Artificial Sequence: Synthetic oligonucleotide
  Target: ATXN1; (-) strand; PAM type: YTN; PAM sequence: TTA
aaaatagcattttctgtcct

SEQ ID NO: 189963 - DNA, 20 bp, Artificial Sequence
  Description of Artificial Sequence: Synthetic oligonucleotide
  Target: ATXN1; (-) strand; PAM type: YTN; PAM sequence: CTG
aattaaaaatagcattttct

SEQ ID NO: 189964 - DNA, 20 bp, Artificial Sequence
  Description of Artificial Sequence: Synthetic oligonucleotide
  Target: ATXN1; (-) strand; PAM type: YTN; PAM sequence: CTG
caatctgaattaaaaatagc

SEQ ID NO: 189965 - DNA, 20 bp, Artificial Sequence
  Description of Artificial Sequence: Synthetic oligonucleotide
  Target: ATXN1; (-) strand; PAM type: YTN; PAM sequence: CTG
gatgggaggaatgctgcaat

SEQ ID NO: 189966 - DNA, 20 bp, Artificial Sequence
  Description of Artificial Sequence: Synthetic oligonucleotide
  Target: ATXN1; (-) strand; PAM type: YTN; PAM sequence: CTG
aaagacctggatgggaggaa

SEQ ID NO: 189967 - DNA, 20 bp, Artificial Sequence
  Description of Artificial Sequence: Synthetic oligonucleotide
  Target: ATXN1; (-) strand; PAM type: YTN; PAM sequence: TTA
tactgaaagacctggatggg

SEQ ID NO: 189968 - DNA, 20 bp, Artificial Sequence
  Description of Artificial Sequence: Synthetic oligonucleotide
  Target: ATXN1; (-) strand; PAM type: YTN; PAM sequence: TTA
tgattatactgaaagacctg

SEQ ID NO: 189969 - DNA, 20 bp, Artificial Sequence
  Description of Artificial Sequence: Synthetic oligonucleotide
  Target: ATXN1; (-) strand; PAM type: YTN; PAM sequence: TTA
tgattatgattatactgaaa

SEQ ID NO: 189970 - DNA, 20 bp, Artificial Sequence
  Description of Artificial Sequence: Synthetic oligonucleotide
  Target: ATXN1; (-) strand; PAM type: YTN; PAM sequence: TTA
ttatgattatgattatactg

SEQ ID NO: 189971 - DNA, 20 bp, Artificial Sequence
  Description of Artificial Sequence: Synthetic oligonucleotide
  Target: ATXN1; (-) strand; PAM type: YTN; PAM sequence: CTT
attatgattatgattatact

SEQ ID NO: 189972 - DNA, 20 bp, Artificial Sequence
  Description of Artificial Sequence: Synthetic oligonucleotide
  Target: ATXN1; (-) strand; PAM type: YTN; PAM sequence: TTA
catcagtcttattatgatta

SEQ ID NO: 189973 - DNA, 20 bp, Artificial Sequence
  Description of Artificial Sequence: Synthetic oligonucleotide
  Target: ATXN1; (-) strand; PAM type: YTN; PAM sequence: TTT
acatcagtcttattatgatt

SEQ ID NO: 189974 - DNA, 20 bp, Artificial Sequence
  Description of Artificial Sequence: Synthetic oligonucleotide
  Target: ATXN1; (-) strand; PAM type: YTN; PAM sequence: TTT
tacatcagtcttattatgat

SEQ ID NO: 189975 - DNA, 20 bp, Artificial Sequence
  Description of Artificial Sequence: Synthetic oligonucleotide
  Target: ATXN1; (-) strand; PAM type: YTN; PAM sequence: TTT
ttacatcagtcttattatga

SEQ ID NO: 189976 - DNA, 20 bp, Artificial Sequence
  Description of Artificial Sequence: Synthetic oligonucleotide
  Target: ATXN1; (-) strand; PAM type: YTN; PAM sequence: CTT
tttacatcagtcttattatg

SEQ ID NO: 189977 - DNA, 20 bp, Artificial Sequence
  Description of Artificial Sequence: Synthetic oligonucleotide
  Target: ATXN1; (-) strand; PAM type: YTN; PAM sequence: TTC
tttttacatcagtcttatta

SEQ ID NO: 189978 - DNA, 20 bp, Artificial Sequence
  Description of Artificial Sequence: Synthetic oligonucleotide
  Target: ATXN1; (-) strand; PAM type: YTN; PAM sequence: TTT
ctttttacatcagtcttatt

SEQ ID NO: 189979 - DNA, 20 bp, Artificial Sequence
  Description of Artificial Sequence: Synthetic oligonucleotide
  Target: ATXN1; (-) strand; PAM type: YTN; PAM sequence: TTT
tctttttacatcagtcttat

SEQ ID NO: 189980 - DNA, 20 bp, Artificial Sequence
  Description of Artificial Sequence: Synthetic oligonucleotide
  Target: ATXN1; (-) strand; PAM type: YTN; PAM sequence: TTT
ttctttttacatcagtctta

SEQ ID NO: 189981 - DNA, 20 bp, Artificial Sequence
  Description of Artificial Sequence: Synthetic oligonucleotide
  Target: ATXN1; (-) strand; PAM type: YTN; PAM sequence: TTT
tttctttttacatcagtctt

SEQ ID NO: 189982 - DNA, 20 bp, Artificial Sequence
  Description of Artificial Sequence: Synthetic oligonucleotide
  Target: ATXN1; (-) strand; PAM type: YTN; PAM sequence: TTT
ttttctttttacatcagtct

SEQ ID NO: 189983 - DNA, 20 bp, Artificial Sequence
  Description of Artificial Sequence: Synthetic oligonucleotide
  Target: ATXN1; (-) strand; PAM type: YTN; PAM sequence: TTT
tttttctttttacatcagtc

SEQ ID NO: 189984 - DNA, 20 bp, Artificial Sequence
  Description of Artificial Sequence: Synthetic oligonucleotide
  Target: ATXN1; (-) strand; PAM type: YTN; PAM sequence: TTT
ttttttctttttacatcagt

SEQ ID NO: 189985 - DNA, 20 bp, Artificial Sequence
  Description of Artificial Sequence: Synthetic oligonucleotide
  Target: ATXN1; (-) strand; PAM type: YTN; PAM sequence: TTT
tttttttctttttacatcag

SEQ ID NO: 189986 - DNA, 20 bp, Artificial Sequence
  Description of Artificial Sequence: Synthetic oligonucleotide
  Target: ATXN1; (-) strand; PAM type: YTN; PAM sequence: TTT
ttttttttctttttacatca

SEQ ID NO: 189987 - DNA, 20 bp, Artificial Sequence
  Description of Artificial Sequence: Synthetic oligonucleotide
  Target: ATXN1; (-) strand; PAM type: YTN; PAM sequence: TTT
tttttttttctttttacatc

SEQ ID NO: 189988 - DNA, 20 bp, Artificial Sequence
  Description of Artificial Sequence: Synthetic oligonucleotide
  Target: ATXN1; (-) strand; PAM type: YTN; PAM sequence: CTT
ttttttttttctttttacat

SEQ ID NO: 189989 - DNA, 20 bp, Artificial Sequence
  Description of Artificial Sequence: Synthetic oligonucleotide
  Target: ATXN1; (-) strand; PAM type: YTN; PAM sequence: CTG
gggtcagcaggaatgggaat

SEQ ID NO: 189990 - DNA, 20 bp, Artificial Sequence
  Description of Artificial Sequence: Synthetic oligonucleotide
  Target: ATXN1; (-) strand; PAM type: YTN; PAM sequence: CTG
ctggggtcagcaggaatggg

SEQ ID NO: 189991 - DNA, 20 bp, Artificial Sequence
  Description of Artificial Sequence: Synthetic oligonucleotide
  Target: ATXN1; (-) strand; PAM type: YTN; PAM sequence: TTC
tgctggggtcagcaggaatg

SEQ ID NO: 189992 - DNA, 20 bp, Artificial Sequence
  Description of Artificial Sequence: Synthetic oligonucleotide
  Target: ATXN1; (-) strand; PAM type: YTN; PAM sequence: TTT
ctgctggggtcagcaggaat

SEQ ID NO: 189993 - DNA, 20 bp, Artificial Sequence
  Description of Artificial Sequence: Synthetic oligonucleotide
  Target: ATXN1; (-) strand; PAM type: YTN; PAM sequence: TTT
tctgctggggtcagcaggaa

SEQ ID NO: 189994 - DNA, 20 bp, Artificial Sequence
  Description of Artificial Sequence: Synthetic oligonucleotide
  Target: ATXN1; (-) strand; PAM type: YTN; PAM sequence: TTT
ttctgctggggtcagcagga

SEQ ID NO: 189995 - DNA, 20 bp, Artificial Sequence
  Description of Artificial Sequence: Synthetic oligonucleotide
  Target: ATXN1; (-) strand; PAM type: YTN; PAM sequence: CTT
tttctgctggggtcagcagg

SEQ ID NO: 189996 - DNA, 20 bp, Artificial Sequence
  Description of Artificial Sequence: Synthetic oligonucleotide
  Target: ATXN1; (-) strand; PAM type: YTN; PAM sequence: CTC
tttttctgctggggtcagca

SEQ ID NO: 189997 - DNA, 20 bp, Artificial Sequence
  Description of Artificial Sequence: Synthetic oligonucleotide
  Target: ATXN1; (-) strand; PAM type: YTN; PAM sequence: CTC
tctttttctgctggggtcag

SEQ ID NO: 189998 - DNA, 20 bp, Artificial Sequence
  Description of Artificial Sequence: Synthetic oligonucleotide
  Target: ATXN1; (-) strand; PAM type: YTN; PAM sequence: TTC
tctctttttctgctggggtc

SEQ ID NO: 189999 - DNA, 20 bp, Artificial Sequence
  Description of Artificial Sequence: Synthetic oligonucleotide
  Target: ATXN1; (-) strand; PAM type: YTN; PAM sequence: TTT
ctctctttttctgctggggt

SEQ ID NO: 190000 - DNA, 20 bp, Artificial Sequence
  Description of Artificial Sequence: Synthetic oligonucleotide
  Target: ATXN1; (-) strand; PAM type: YTN; PAM sequence: CTT
tctctctttttctgctgggg

SEQ ID NO: 190001 - DNA, 20 bp, Artificial Sequence
  Description of Artificial Sequence: Synthetic oligonucleotide
  Target: ATXN1; (-) strand; PAM type: YTN; PAM sequence: TTC
tttctctctttttctgctgg

SEQ ID NO: 190002 - DNA, 20 bp, Artificial Sequence
  Description of Artificial Sequence: Synthetic oligonucleotide
  Target: ATXN1; (-) strand; PAM type: YTN; PAM sequence: TTT
ctttctctctttttctgctg

SEQ ID NO: 190003 - DNA, 20 bp, Artificial Sequence
  Description of Artificial Sequence: Synthetic oligonucleotide
  Target: ATXN1; (-) strand; PAM type: YTN; PAM sequence: CTT
tctttctctctttttctgct

SEQ ID NO: 190004 - DNA, 20 bp, Artificial Sequence
  Description of Artificial Sequence: Synthetic oligonucleotide
  Target: ATXN1; (-) strand; PAM type: YTN; PAM sequence: TTC
tttctttctctctttttctg

SEQ ID NO: 190005 - DNA, 20 bp, Artificial Sequence
  Description of Artificial Sequence: Synthetic oligonucleotide
  Target: ATXN1; (-) strand; PAM type: YTN; PAM sequence: TTT
ctttctttctctctttttct

SEQ ID NO: 190006 - DNA, 20 bp, Artificial Sequence
  Description of Artificial Sequence: Synthetic oligonucleotide
  Target: ATXN1; (-) strand; PAM type: YTN; PAM sequence: TTT
tctttctttctctctttttc

SEQ ID NO: 190007 - DNA, 20 bp, Artificial Sequence
  Description of Artificial Sequence: Synthetic oligonucleotide
  Target: ATXN1; (-) strand; PAM type: YTN; PAM sequence: TTA
attttctttctttctctctt

SEQ ID NO: 190008 - DNA, 20 bp, Artificial Sequence
  Description of Artificial Sequence: Synthetic oligonucleotide
  Target: ATXN1; (-) strand; PAM type: YTN; PAM sequence: TTT
aattttctttctttctctct

SEQ ID NO: 190009 - DNA, 20 bp, Artificial Sequence
  Description of Artificial Sequence: Synthetic oligonucleotide
  Target: ATXN1; (-) strand; PAM type: YTN; PAM sequence: TTA
tttaattttctttctttctc

SEQ ID NO: 190010 - DNA, 20 bp, Artificial Sequence
  Description of Artificial Sequence: Synthetic oligonucleotide
  Target: ATXN1; (-) strand; PAM type: YTN; PAM sequence: TTT
atttaattttctttctttct

SEQ ID NO: 190011 - DNA, 20 bp, Artificial Sequence
  Description of Artificial Sequence: Synthetic oligonucleotide
  Target: ATXN1; (-) strand; PAM type: YTN; PAM sequence: TTA
atcatttatttaattttctt

SEQ ID NO: 190012 - DNA, 20 bp, Artificial Sequence
  Description of Artificial Sequence: Synthetic oligonucleotide
  Target: ATXN1; (-) strand; PAM type: YTN; PAM sequence: CTG
tattaatcatttatttaatt

SEQ ID NO: 190013 - DNA, 20 bp, Artificial Sequence
  Description of Artificial Sequence: Synthetic oligonucleotide
  Target: ATXN1; (-) strand; PAM type: YTN; PAM sequence: CTA
aaagtggaaggaagctgtat

SEQ ID NO: 190014 - DNA, 20 bp, Artificial Sequence
  Description of Artificial Sequence: Synthetic oligonucleotide
  Target: ATXN1; (-) strand; PAM type: YTN; PAM sequence: CTC
caagcccacagaacggtcta

SEQ ID NO: 190015 - DNA, 20 bp, Artificial Sequence
  Description of Artificial Sequence: Synthetic oligonucleotide
  Target: ATXN1; (-) strand; PAM type: YTN; PAM sequence: CTC
gaaggtggatctccaagccc

SEQ ID NO: 190016 - DNA, 20 bp, Artificial Sequence
  Description of Artificial Sequence: Synthetic oligonucleotide
  Target: ATXN1; (-) strand; PAM type: YTN; PAM sequence: TTG
cctcgaaggtggatctccaa

SEQ ID NO: 190017 - DNA, 20 bp, Artificial Sequence
  Description of Artificial Sequence: Synthetic oligonucleotide
  Target: ATXN1; (-) strand; PAM type: YTN; PAM sequence: CTG
attgcctcgaaggtggatct

SEQ ID NO: 190018 - DNA, 20 bp, Artificial Sequence
  Description of Artificial Sequence: Synthetic oligonucleotide
  Target: ATXN1; (-) strand; PAM type: YTN; PAM sequence: CTC
tgattgcctcgaaggtggat

SEQ ID NO: 190019 - DNA, 20 bp, Artificial Sequence
  Description of Artificial Sequence: Synthetic oligonucleotide
  Target: ATXN1; (-) strand; PAM type: YTN; PAM sequence: CTG
ctctgattgcctcgaaggtg

SEQ ID NO: 190020 - DNA, 20 bp, Artificial Sequence
  Description of Artificial Sequence: Synthetic oligonucleotide
  Target: ATXN1; (-) strand; PAM type: YTN; PAM sequence: TTG
gataatggatagtctgctct

SEQ ID NO: 190021 - DNA, 20 bp, Artificial Sequence
  Description of Artificial Sequence: Synthetic oligonucleotide
  Target: ATXN1; (-) strand; PAM type: YTN; PAM sequence: TTT
ggataatggatagtctgctc

SEQ ID NO: 190022 - DNA, 20 bp, Artificial Sequence
  Description of Artificial Sequence: Synthetic oligonucleotide
  Target: ATXN1; (-) strand; PAM type: YTN; PAM sequence: CTT
tggataatggatagtctgct

SEQ ID NO: 190023 - DNA, 20 bp, Artificial Sequence
  Description of Artificial Sequence: Synthetic oligonucleotide
  Target: ATXN1; (-) strand; PAM type: YTN; PAM sequence: TTA
actttggataatggatagtc

SEQ ID NO: 190024 - DNA, 20 bp, Artificial Sequence
  Description of Artificial Sequence: Synthetic oligonucleotide
  Target: ATXN1; (-) strand; PAM type: YTN; PAM sequence: TTT
aactttggataatggatagt

SEQ ID NO: 190025 - DNA, 20 bp, Artificial Sequence
  Description of Artificial Sequence: Synthetic oligonucleotide
  Target: ATXN1; (-) strand; PAM type: YTN; PAM sequence: TTT
taactttggataatggatag

SEQ ID NO: 190026 - DNA, 20 bp, Artificial Sequence
  Description of Artificial Sequence: Synthetic oligonucleotide
  Target: ATXN1; (-) strand; PAM type: YTN; PAM sequence: CTT
ttaactttggataatggata

SEQ ID NO: 190027 - DNA, 20 bp, Artificial Sequence
  Description of Artificial Sequence: Synthetic oligonucleotide
  Target: ATXN1; (-) strand; PAM type: YTN; PAM sequence: TTA
aagtgcttttaactttggat

SEQ ID NO: 190028 - DNA, 20 bp, Artificial Sequence
  Description of Artificial Sequence: Synthetic oligonucleotide
  Target: ATXN1; (-) strand; PAM type: YTN; PAM sequence: CTA
gcagagttaaagtgctttta

SEQ ID NO: 190029 - DNA, 20 bp, Artificial Sequence
  Description of Artificial Sequence: Synthetic oligonucleotide
  Target: ATXN1; (-) strand; PAM type: YTN; PAM sequence: TTA
ctagcagagttaaagtgctt

SEQ ID NO: 190030 - DNA, 20 bp, Artificial Sequence
  Description of Artificial Sequence: Synthetic oligonucleotide
  Target: ATXN1; (-) strand; PAM type: YTN; PAM sequence: CTG
ttactagcagagttaaagtg

SEQ ID NO: 190031 - DNA, 20 bp, Artificial Sequence
  Description of Artificial Sequence: Synthetic oligonucleotide
  Target: ATXN1; (-) strand; PAM type: YTN; PAM sequence: TTG
tgtgagaagacgtgatgctg

SEQ ID NO: 190032 - DNA, 20 bp, Artificial Sequence
  Description of Artificial Sequence: Synthetic oligonucleotide
  Target: ATXN1; (-) strand; PAM type: YTN; PAM sequence: TTT
gtgtgagaagacgtgatgct

SEQ ID NO: 190033 - DNA, 20 bp, Artificial Sequence
  Description of Artificial Sequence: Synthetic oligonucleotide
  Target: ATXN1; (-) strand; PAM type: YTN; PAM sequence: TTA
ggagagtgaaagtcacacga

SEQ ID NO: 190034 - DNA, 20 bp, Artificial Sequence
  Description of Artificial Sequence: Synthetic oligonucleotide
  Target: ATXN1; (-) strand; PAM type: YTN; PAM sequence: CTT
aggagagtgaaagtcacacg

SEQ ID NO: 190035 - DNA, 20 bp, Artificial Sequence
  Description of Artificial Sequence: Synthetic oligonucleotide
  Target: ATXN1; (-) strand; PAM type: YTN; PAM sequence: CTG
caaacttaggagagtgaaag

SEQ ID NO: 190036 - DNA, 20 bp, Artificial Sequence
  Description of Artificial Sequence: Synthetic oligonucleotide
  Target: ATXN1; (-) strand; PAM type: YTN; PAM sequence: TTC
ctgcaaacttaggagagtga

SEQ ID NO: 190037 - DNA, 20 bp, Artificial Sequence
  Description of Artificial Sequence: Synthetic oligonucleotide
  Target: ATXN1; (-) strand; PAM type: YTN; PAM sequence: TTC
ccagcaggcacaggcgattc

SEQ ID NO: 190038 - DNA, 20 bp, Artificial Sequence
  Description of Artificial Sequence: Synthetic oligonucleotide
  Target: ATXN1; (-) strand; PAM type: YTN; PAM sequence: TTT
cccagcaggcacaggcgatt

SEQ ID NO: 190039 - DNA, 20 bp, Artificial Sequence
  Description of Artificial Sequence: Synthetic oligonucleotide
  Target: ATXN1; (-) strand; PAM type: YTN; PAM sequence: TTG
cacggcgtttcccagcaggc

SEQ ID NO: 190040 - DNA, 20 bp, Artificial Sequence
  Description of Artificial Sequence: Synthetic oligonucleotide
  Target: ATXN1; (-) strand; PAM type: YTN; PAM sequence: CTT
gcacggcgtttcccagcagg

SEQ ID NO: 190041 - DNA, 20 bp, Artificial Sequence
  Description of Artificial Sequence: Synthetic oligonucleotide
  Target: ATXN1; (-) strand; PAM type: YTN; PAM sequence: TTG
gaaacagatggaggaacttg

SEQ ID NO: 190042 - DNA, 20 bp, Artificial Sequence
  Description of Artificial Sequence: Synthetic oligonucleotide
  Target: ATXN1; (-) strand; PAM type: YTN; PAM sequence: CTT
ggaaacagatggaggaactt

SEQ ID NO: 190043 - DNA, 20 bp, Artificial Sequence
  Description of Artificial Sequence: Synthetic oligonucleotide
  Target: ATXN1; (-) strand; PAM type: YTN; PAM sequence: TTA
agtcttggaaacagatggag

SEQ ID NO: 190044 - DNA, 20 bp, Artificial Sequence
  Description of Artificial Sequence: Synthetic oligonucleotide
  Target: ATXN1; (-) strand; PAM type: YTN; PAM sequence: CTG
tcaccaaggaatgttaagtc

SEQ ID NO: 190045 - DNA, 20 bp, Artificial Sequence
  Description of Artificial Sequence: Synthetic oligonucleotide
  Target: ATXN1; (-) strand; PAM type: YTN; PAM sequence: TTG
cactgtcaccaaggaatgtt

SEQ ID NO: 190046 - DNA, 20 bp, Artificial Sequence
  Description of Artificial Sequence: Synthetic oligonucleotide
  Target: ATXN1; (-) strand; PAM type: YTN; PAM sequence: CTC
gtccattgcactgtcaccaa

SEQ ID NO: 190047 - DNA, 20 bp, Artificial Sequence
  Description of Artificial Sequence: Synthetic oligonucleotide
  Target: ATXN1; (-) strand; PAM type: YTN; PAM sequence: CTG
gactcgtccattgcactgtc

SEQ ID NO: 190048 - DNA, 20 bp, Artificial Sequence
  Description of Artificial Sequence: Synthetic oligonucleotide
  Target: ATXN1; (-) strand; PAM type: YTN; PAM sequence: CTG
ccaccaggctggactcgtcc

SEQ ID NO: 190049 - DNA, 20 bp, Artificial Sequence
  Description of Artificial Sequence: Synthetic oligonucleotide
  Target: ATXN1; (-) strand; PAM type: YTN; PAM sequence: TTC
ccagcatggccctgccacca

SEQ ID NO: 190050 - DNA, 20 bp, Artificial Sequence
  Description of Artificial Sequence: Synthetic oligonucleotide
  Target: ATXN1; (-) strand; PAM type: YTN; PAM sequence: TTA
gaaatcaagttcccagcatg

SEQ ID NO: 190051 - DNA, 20 bp, Artificial Sequence
  Description of Artificial Sequence: Synthetic oligonucleotide
  Target: ATXN1; (-) strand; PAM type: YTN; PAM sequence: TTG
acattagaaatcaagttccc

SEQ ID NO: 190052 - DNA, 20 bp, Artificial Sequence
  Description of Artificial Sequence: Synthetic oligonucleotide
  Target: ATXN1; (-) strand; PAM type: YTN; PAM sequence: TTC
cagtgattgacattagaaat

SEQ ID NO: 190053 - DNA, 20 bp, Artificial Sequence
  Description of Artificial Sequence: Synthetic oligonucleotide
  Target: ATXN1; (-) strand; PAM type: YTN; PAM sequence: CTA
gaagggcattccagtgattg

SEQ ID NO: 190054 - DNA, 20 bp, Artificial Sequence
  Description of Artificial Sequence: Synthetic oligonucleotide
  Target: ATXN1; (-) strand; PAM type: YTN; PAM sequence: TTA
ctagaagggcattccagtga

SEQ ID NO: 190055 - DNA, 20 bp, Artificial Sequence
  Description of Artificial Sequence: Synthetic oligonucleotide
  Target: ATXN1; (-) strand; PAM type: YTN; PAM sequence: CTT
actagaagggcattccagtg

SEQ ID NO: 190056 - DNA, 20 bp, Artificial Sequence
  Description of Artificial Sequence: Synthetic oligonucleotide
  Target: ATXN1; (-) strand; PAM type: YTN; PAM sequence: TTC
cttactagaagggcattcca

SEQ ID NO: 190057 - DNA, 20 bp, Artificial Sequence
  Description of Artificial Sequence: Synthetic oligonucleotide
  Target: ATXN1; (-) strand; PAM type: YTN; PAM sequence: CTT
ccttactagaagggcattcc

SEQ ID NO: 190058 - DNA, 20 bp, Artificial Sequence
  Description of Artificial Sequence: Synthetic oligonucleotide
  Target: ATXN1; (-) strand; PAM type: YTN; PAM sequence: CTC
ttccttactagaagggcatt

SEQ ID NO: 190059 - DNA, 20 bp, Artificial Sequence
  Description of Artificial Sequence: Synthetic oligonucleotide
  Target: ATXN1; (-) strand; PAM type: YTN; PAM sequence: TTG
ggcacctcttccttactaga

SEQ ID NO: 190060 - DNA, 20 bp, Artificial Sequence
  Description of Artificial Sequence: Synthetic oligonucleotide
  Target: ATXN1; (-) strand; PAM type: YTN; PAM sequence: CTT
gggcacctcttccttactag

SEQ ID NO: 190061 - DNA, 20 bp, Artificial Sequence
  Description of Artificial Sequence: Synthetic oligonucleotide
  Target: ATXN1; (-) strand; PAM type: YTN; PAM sequence: CTC
aaacagaagcttgggcacct

SEQ ID NO: 190062 - DNA, 20 bp, Artificial Sequence
  Description of Artificial Sequence: Synthetic oligonucleotide
  Target: ATXN1; (-) strand; PAM type: YTN; PAM sequence: TTA
actcaaacagaagcttgggc

SEQ ID NO: 190063 - DNA, 20 bp, Artificial Sequence
  Description of Artificial Sequence: Synthetic oligonucleotide
  Target: ATXN1; (-) strand; PAM type: YTN; PAM sequence: CTG
tgttaactcaaacagaagct

SEQ ID NO: 190064 - DNA, 20 bp, Artificial Sequence
  Description of Artificial Sequence: Synthetic oligonucleotide
  Target: ATXN1; (-) strand; PAM type: YTN; PAM sequence: CTG
gaaaggtctgtgttaactca

SEQ ID NO: 190065 - DNA, 20 bp, Artificial Sequence
  Description of Artificial Sequence: Synthetic oligonucleotide
  Target: ATXN1; (-) strand; PAM type: YTN; PAM sequence: CTG
acctggaaaggtctgtgtta

SEQ ID NO: 190066 - DNA, 20 bp, Artificial Sequence
  Description of Artificial Sequence: Synthetic oligonucleotide
  Target: ATXN1; (-) strand; PAM type: YTN; PAM sequence: CTA
cacctgacctggaaaggtct

SEQ ID NO: 190067 - DNA, 20 bp, Artificial Sequence
  Description of Artificial Sequence: Synthetic oligonucleotide
  Target: ATXN1; (-) strand; PAM type: YTN; PAM sequence: TTC
tacacctgacctggaaaggt

SEQ ID NO: 190068 - DNA, 20 bp, Artificial Sequence
  Description of Artificial Sequence: Synthetic oligonucleotide
  Target: ATXN1; (-) strand; PAM type: YTN; PAM sequence: CTC
cagattctacacctgacctg

SEQ ID NO: 190069 - DNA, 20 bp, Artificial Sequence
  Description of Artificial Sequence: Synthetic oligonucleotide
  Target: ATXN1; (-) strand; PAM type: YTN; PAM sequence: TTC
atcactccagattctacacc

SEQ ID NO: 190070 - DNA, 20 bp, Artificial Sequence
  Description of Artificial Sequence: Synthetic oligonucleotide
  Target: ATXN1; (-) strand; PAM type: YTN; PAM sequence: TTC
cattcatcactccagattct

SEQ ID NO: 190071 - DNA, 20 bp, Artificial Sequence
  Description of Artificial Sequence: Synthetic oligonucleotide
  Target: ATXN1; (-) strand; PAM type: YTN; PAM sequence: CTT
ccattcatcactccagattc

SEQ ID NO: 190072 - DNA, 20 bp, Artificial Sequence
  Description of Artificial Sequence: Synthetic oligonucleotide
  Target: ATXN1; (-) strand; PAM type: YTN; PAM sequence: TTC
cagcccttccattcatcact

SEQ ID NO: 190073 - DNA, 20 bp, Artificial Sequence
  Description of Artificial Sequence: Synthetic oligonucleotide
  Target: ATXN1; (-) strand; PAM type: YTN; PAM sequence: TTT
ccagcccttccattcatcac

SEQ ID NO: 190074 - DNA, 20 bp, Artificial Sequence
  Description of Artificial Sequence: Synthetic oligonucleotide
  Target: ATXN1; (-) strand; PAM type: YTN; PAM sequence: CTT
tccagcccttccattcatca

SEQ ID NO: 190075 - DNA, 20 bp, Artificial Sequence
  Description of Artificial Sequence: Synthetic oligonucleotide
  Target: ATXN1; (-) strand; PAM type: YTN; PAM sequence: TTC
ctttccagcccttccattca

SEQ ID NO: 190076 - DNA, 20 bp, Artificial Sequence
  Description of Artificial Sequence: Synthetic oligonucleotide
  Target: ATXN1; (-) strand; PAM type: YTN; PAM sequence: TTT
cctttccagcccttccattc

SEQ ID NO: 190077 - DNA, 20 bp, Artificial Sequence
  Description of Artificial Sequence: Synthetic oligonucleotide
  Target: ATXN1; (-) strand; PAM type: YTN; PAM sequence: TTC
atttcctttccagcccttcc

SEQ ID NO: 190078 - DNA, 20 bp, Artificial Sequence
  Description of Artificial Sequence: Synthetic oligonucleotide
  Target: ATXN1; (-) strand; PAM type: YTN; PAM sequence: CTT
catttcctttccagcccttc

SEQ ID NO: 190079 - DNA, 20 bp, Artificial Sequence
  Description of Artificial Sequence: Synthetic oligonucleotide
  Target: ATXN1; (-) strand; PAM type: YTN; PAM sequence: CTG
gtcttcatttcctttccagc

SEQ ID NO: 190080 - DNA, 20 bp, Artificial Sequence
  Description of Artificial Sequence: Synthetic oligonucleotide
  Target: ATXN1; (-) strand; PAM type: YTN; PAM sequence: CTA
cactggtcttcatttccttt

SEQ ID NO: 190081 - DNA, 20 bp, Artificial Sequence
  Description of Artificial Sequence: Synthetic oligonucleotide
  Target: ATXN1; (-) strand; PAM type: YTN; PAM sequence: CTG
caaagagacatctacactgg

SEQ ID NO: 190082 - DNA, 20 bp, Artificial Sequence
  Description of Artificial Sequence: Synthetic oligonucleotide
  Target: ATXN1; (-) strand; PAM type: YTN; PAM sequence: TTC
tgcaaagagacatctacact

SEQ ID NO: 190083 - DNA, 20 bp, Artificial Sequence
  Description of Artificial Sequence: Synthetic oligonucleotide
  Target: ATXN1; (-) strand; PAM type: YTN; PAM sequence: CTT
ctgcaaagagacatctacac

SEQ ID NO: 190084 - DNA, 20 bp, Artificial Sequence
  Description of Artificial Sequence: Synthetic oligonucleotide
  Target: ATXN1; (-) strand; PAM type: YTN; PAM sequence: TTC
aacttctgcaaagagacatc

SEQ ID NO: 190085 - DNA, 20 bp, Artificial Sequence
  Description of Artificial Sequence: Synthetic oligonucleotide
  Target: ATXN1; (-) strand; PAM type: YTN; PAM sequence: CTA
atgttcaacttctgcaaaga

SEQ ID NO: 190086 - DNA, 20 bp, Artificial Sequence
  Description of Artificial Sequence: Synthetic oligonucleotide
  Target: ATXN1; (-) strand; PAM type: YTN; PAM sequence: CTC
taatgttcaacttctgcaaa

SEQ ID NO: 190087 - DNA, 20 bp, Artificial Sequence
  Description of Artificial Sequence: Synthetic oligonucleotide
  Target: ATXN1; (-) strand; PAM type: YTN; PAM sequence: TTC
ctctaatgttcaacttctgc

SEQ ID NO: 190088 - DNA, 20 bp, Artificial Sequence
  Description of Artificial Sequence: Synthetic oligonucleotide
  Target: ATXN1; (-) strand; PAM type: YTN; PAM sequence: TTT
cctctaatgttcaacttctg

SEQ ID NO: 190089 - DNA, 20 bp, Artificial Sequence
  Description of Artificial Sequence: Synthetic oligonucleotide
  Target: ATXN1; (-) strand; PAM type: YTN; PAM sequence: TTT
tcctctaatgttcaacttct

SEQ ID NO: 190090 - DNA, 20 bp, Artificial Sequence
  Description of Artificial Sequence: Synthetic oligonucleotide
  Target: ATXN1; (-) strand; PAM type: YTN; PAM sequence: TTT
ttcctctaatgttcaacttc

SEQ ID NO: 190091 - DNA, 20 bp, Artificial Sequence
  Description of Artificial Sequence: Synthetic oligonucleotide
  Target: ATXN1; (-) strand; PAM type: YTN; PAM sequence: TTT
tttcctctaatgttcaactt

SEQ ID NO: 190092 - DNA, 20 bp, Artificial Sequence
  Description of Artificial Sequence: Synthetic oligonucleotide
  Target: ATXN1; (-) strand; PAM type: YTN; PAM sequence: CTG
ttttttcctctaatgttcaa

SEQ ID NO: 190093 - DNA, 20 bp, Artificial Sequence
  Description of Artificial Sequence: Synthetic oligonucleotide
  Target: ATXN1; (-) strand; PAM type: YTN; PAM sequence: TTC
tgttttttcctctaatgttc

SEQ ID NO: 190094 - DNA, 20 bp, Artificial Sequence
  Description of Artificial Sequence: Synthetic oligonucleotide
  Target: ATXN1; (-) strand; PAM type: YTN; PAM sequence: TTA
ttctgttttttcctctaatg

SEQ ID NO: 190095 - DNA, 20 bp, Artificial Sequence
  Description of Artificial Sequence: Synthetic oligonucleotide
  Target: ATXN1; (-) strand; PAM type: YTN; PAM sequence: CTT
attctgttttttcctctaat

SEQ ID NO: 190096 - DNA, 20 bp, Artificial Sequence
  Description of Artificial Sequence: Synthetic oligonucleotide
  Target: ATXN1; (-) strand; PAM type: YTN; PAM sequence: TTC
atcttattctgttttttcct

SEQ ID NO: 190097 - DNA, 20 bp, Artificial Sequence
  Description of Artificial Sequence: Synthetic oligonucleotide
  Target: ATXN1; (-) strand; PAM type: YTN; PAM sequence: TTT
catcttattctgttttttcc

SEQ ID NO: 190098 - DNA, 20 bp, Artificial Sequence
  Description of Artificial Sequence: Synthetic oligonucleotide
  Target: ATXN1; (-) strand; PAM type: YTN; PAM sequence: TTT
tcatcttattctgttttttc

SEQ ID NO: 190099 - DNA, 20 bp, Artificial Sequence
  Description of Artificial Sequence: Synthetic oligonucleotide
  Target: ATXN1; (-) strand; PAM type: YTN; PAM sequence: TTC
cattttcatcttattctgtt

SEQ ID NO: 190100 - DNA, 20 bp, Artificial Sequence
  Description of Artificial Sequence: Synthetic oligonucleotide
  Target: ATXN1; (-) strand; PAM type: YTN; PAM sequence: TTG
tgattccattttcatcttat

SEQ ID NO: 190101 - DNA, 20 bp, Artificial Sequence
  Description of Artificial Sequence: Synthetic oligonucleotide
  Target: ATXN1; (-) strand; PAM type: YTN; PAM sequence: TTT
gtgattccattttcatctta

SEQ ID NO: 190102 - DNA, 20 bp, Artificial Sequence
  Description of Artificial Sequence: Synthetic oligonucleotide
  Target: ATXN1; (-) strand; PAM type: YTN; PAM sequence: CTT
tgtgattccattttcatctt

SEQ ID NO: 190103 - DNA, 20 bp, Artificial Sequence
  Description of Artificial Sequence: Synthetic oligonucleotide
  Target: ATXN1; (-) strand; PAM type: YTN; PAM sequence: TTA
ccctttgtgattccattttc

SEQ ID NO: 190104 - DNA, 20 bp, Artificial Sequence
  Description of Artificial Sequence: Synthetic oligonucleotide
  Target: ATXN1; (-) strand; PAM type: YTN; PAM sequence: TTT
accctttgtgattccatttt

SEQ ID NO: 190105 - DNA, 20 bp, Artificial Sequence
  Description of Artificial Sequence: Synthetic oligonucleotide
  Target: ATXN1; (-) strand; PAM type: YTN; PAM sequence: TTT
taccctttgtgattccattt

SEQ ID NO: 190106 - DNA, 20 bp, Artificial Sequence
  Description of Artificial Sequence: Synthetic oligonucleotide
  Target: ATXN1; (-) strand; PAM type: YTN; PAM sequence: TTA
aaccagtcattttacccttt

SEQ ID NO: 190107 - DNA, 20 bp, Artificial Sequence
  Description of Artificial Sequence: Synthetic oligonucleotide
  Target: ATXN1; (-) strand; PAM type: YTN; PAM sequence: CTT
aaaccagtcattttaccctt

SEQ ID NO: 190108 - DNA, 20 bp, Artificial Sequence
  Description of Artificial Sequence: Synthetic oligonucleotide
  Target: ATXN1; (-) strand; PAM type: YTN; PAM sequence: CTG
cacatatagccttaaaccag

SEQ ID NO: 190109 - DNA, 20 bp, Artificial Sequence
  Description of Artificial Sequence: Synthetic oligonucleotide
  Target: ATXN1; (-) strand; PAM type: YTN; PAM sequence: CTA
atcctgcacatatagcctta

SEQ ID NO: 190110 - DNA, 20 bp, Artificial Sequence
  Description of Artificial Sequence: Synthetic oligonucleotide
  Target: ATXN1; (-) strand; PAM type: YTN; PAM sequence: CTC
taatcctgcacatatagcct

SEQ ID NO: 190111 - DNA, 20 bp, Artificial Sequence
  Description of Artificial Sequence: Synthetic oligonucleotide
  Target: ATXN1; (-) strand; PAM type: YTN; PAM sequence: TTC
tctaatcctgcacatatagc

SEQ ID NO: 190112 - DNA, 20 bp, Artificial Sequence
  Description of Artificial Sequence: Synthetic oligonucleotide
  Target: ATXN1; (-) strand; PAM type: YTN; PAM sequence: CTT
ctctaatcctgcacatatag

SEQ ID NO: 190113 - DNA, 20 bp, Artificial Sequence
  Description of Artificial Sequence: Synthetic oligonucleotide
  Target: ATXN1; (-) strand; PAM type: YTN; PAM sequence: CTC
ttctctaatcctgcacatat

SEQ ID NO: 190114 - DNA, 20 bp, Artificial Sequence
  Description of Artificial Sequence: Synthetic oligonucleotide
  Target: ATXN1; (-) strand; PAM type: YTN; PAM sequence: TTG
accccatctcttctctaatc

SEQ ID NO: 190115 - DNA, 20 bp, Artificial Sequence
  Description of Artificial Sequence: Synthetic oligonucleotide
  Target: ATXN1; (-) strand; PAM type: YTN; PAM sequence: TTT
gaccccatctcttctctaat

SEQ ID NO: 190116 - DNA, 20 bp, Artificial Sequence
  Description of Artificial Sequence: Synthetic oligonucleotide
  Target: ATXN1; (-) strand; PAM type: YTN; PAM sequence: CTT
tgaccccatctcttctctaa

SEQ ID NO: 190117 - DNA, 20 bp, Artificial Sequence
  Description of Artificial Sequence: Synthetic oligonucleotide
  Target: ATXN1; (-) strand; PAM type: YTN; PAM sequence: TTA
aaaaatacccctttgacccc

SEQ ID NO: 190118 - DNA, 20 bp, Artificial Sequence
  Description of Artificial Sequence: Synthetic oligonucleotide
  Target: ATXN1; (-) strand; PAM type: YTN; PAM sequence: TTC
attaaaaaatacccctttga

SEQ ID NO: 190119 - DNA, 20 bp, Artificial Sequence
  Description of Artificial Sequence: Synthetic oligonucleotide
  Target: ATXN1; (-) strand; PAM type: YTN; PAM sequence: CTT
cattaaaaaatacccctttg

SEQ ID NO: 190120 - DNA, 20 bp, Artificial Sequence
  Description of Artificial Sequence: Synthetic oligonucleotide
  Target: ATXN1; (-) strand; PAM type: YTN; PAM sequence: TTA
tcttcattaaaaaatacccc

SEQ ID NO: 190121 - DNA, 20 bp, Artificial Sequence
  Description of Artificial Sequence: Synthetic oligonucleotide
  Target: ATXN1; (-) strand; PAM type: YTN; PAM sequence: TTT
atcttcattaaaaaataccc

SEQ ID NO: 190122 - DNA, 20 bp, Artificial Sequence
  Description of Artificial Sequence: Synthetic oligonucleotide
  Target: ATXN1; (-) strand; PAM type: YTN; PAM sequence: TTT
tatcttcattaaaaaatacc

SEQ ID NO: 190123 - DNA, 20 bp, Artificial Sequence
  Description of Artificial Sequence: Synthetic oligonucleotide
  Target: ATXN1; (-) strand; PAM type: YTN; PAM sequence: TTA
tgtgaattttatcttcatta

SEQ ID NO: 190124 - DNA, 20 bp, Artificial Sequence
  Description of Artificial Sequence: Synthetic oligonucleotide
  Target: ATXN1; (-) strand; PAM type: YTN; PAM sequence: TTT
atgtgaattttatcttcatt

SEQ ID NO: 190125 - DNA, 20 bp, Artificial Sequence
  Description of Artificial Sequence: Synthetic oligonucleotide
  Target: ATXN1; (-) strand; PAM type: YTN; PAM sequence: TTT
tatgtgaattttatcttcat

SEQ ID NO: 190126 - DNA, 20 bp, Artificial Sequence
  Description of Artificial Sequence: Synthetic oligonucleotide
  Target: ATXN1; (-) strand; PAM type: YTN; PAM sequence: TTG
ttttatgtgaattttatctt

SEQ ID NO: 190127 - DNA, 20 bp, Artificial Sequence
  Description of Artificial Sequence: Synthetic oligonucleotide
  Target: ATXN1; (-) strand; PAM type: YTN; PAM sequence: TTT
gttttatgtgaattttatct

SEQ ID NO: 190128 - DNA, 20 bp, Artificial Sequence
  Description of Artificial Sequence: Synthetic oligonucleotide
  Target: ATXN1; (-) strand; PAM type: YTN; PAM sequence: TTT
tgttttatgtgaattttatc

SEQ ID NO: 190129 - DNA, 20 bp, Artificial Sequence
  Description of Artificial Sequence: Synthetic oligonucleotide
  Target: ATXN1; (-) strand; PAM type: YTN; PAM sequence: CTG
aattttgttttatgtgaatt

SEQ ID NO: 190130 - DNA, 20 bp, Artificial Sequence
  Description of Artificial Sequence: Synthetic oligonucleotide
  Target: ATXN1; (-) strand; PAM type: YTN; PAM sequence: TTA
aaatgctgaattttgtttta

SEQ ID NO: 190131 - DNA, 20 bp, Artificial Sequence
  Description of Artificial Sequence: Synthetic oligonucleotide
  Target: ATXN1; (-) strand; PAM type: YTN; PAM sequence: TTA
aaaacagttaaaatgctgaa

SEQ ID NO: 190132 - DNA, 20 bp, Artificial Sequence
  Description of Artificial Sequence: Synthetic oligonucleotide
  Target: ATXN1; (-) strand; PAM type: YTN; PAM sequence: TTT
aaaaacagttaaaatgctga

SEQ ID NO: 190133 - DNA, 20 bp, Artificial Sequence
  Description of Artificial Sequence: Synthetic oligonucleotide
  Target: ATXN1; (-) strand; PAM type: YTN; PAM sequence: CTT
taaaaacagttaaaatgctg

SEQ ID NO: 190134 - DNA, 20 bp, Artificial Sequence
  Description of Artificial Sequence: Synthetic oligonucleotide
  Target: ATXN1; (-) strand; PAM type: YTN; PAM sequence: TTA
cacactttaaaaacagttaa

SEQ ID NO: 190135 - DNA, 20 bp, Artificial Sequence
  Description of Artificial Sequence: Synthetic oligonucleotide
  Target: ATXN1; (-) strand; PAM type: YTN; PAM sequence: CTT
acacactttaaaaacagtta

SEQ ID NO: 190136 - DNA, 20 bp, Artificial Sequence
  Description of Artificial Sequence: Synthetic oligonucleotide
  Target: ATXN1; (-) strand; PAM type: YTN; PAM sequence: CTG
acttacacactttaaaaaca

SEQ ID NO: 190137 - DNA, 20 bp, Artificial Sequence
  Description of Artificial Sequence: Synthetic oligonucleotide
  Target: ATXN1; (-) strand; PAM type: YTN; PAM sequence: TTC
aacatgtggatggagtaaaa

SEQ ID NO: 190138 - DNA, 20 bp, Artificial Sequence
  Description of Artificial Sequence: Synthetic oligonucleotide
  Target: ATXN1; (-) strand; PAM type: YTN; PAM sequence: TTG
ttcaacatgtggatggagta

SEQ ID NO: 190139 - DNA, 20 bp, Artificial Sequence
  Description of Artificial Sequence: Synthetic oligonucleotide
  Target: ATXN1; (-) strand; PAM type: YTN; PAM sequence: TTA
gatagtgatgatggttgttc

SEQ ID NO: 190140 - DNA, 20 bp, Artificial Sequence
  Description of Artificial Sequence: Synthetic oligonucleotide
  Target: ATXN1; (-) strand; PAM type: YTN; PAM sequence: CTG
gaattagatagtgatgatgg

SEQ ID NO: 190141 - DNA, 20 bp, Artificial Sequence
  Description of Artificial Sequence: Synthetic oligonucleotide
  Target: ATXN1; (-) strand; PAM type: YTN; PAM sequence: TTC
tggaattagatagtgatgat

SEQ ID NO: 190142 - DNA, 20 bp, Artificial Sequence
  Description of Artificial Sequence: Synthetic oligonucleotide
  Target: ATXN1; (-) strand; PAM type: YTN; PAM sequence: CTT
ctggaattagatagtgatga

SEQ ID NO: 190143 - DNA, 20 bp, Artificial Sequence
  Description of Artificial Sequence: Synthetic oligonucleotide
  Target: ATXN1; (-) strand; PAM type: YTN; PAM sequence: TTC
atggataagggggatgatga

SEQ ID NO: 190144 - DNA, 20 bp, Artificial Sequence
  Description of Artificial Sequence: Synthetic oligonucleotide
  Target: ATXN1; (-) strand; PAM type: YTN; PAM sequence: TTT
catggataagggggatgatg

SEQ ID NO: 190145 - DNA, 20 bp, Artificial Sequence
  Description of Artificial Sequence: Synthetic oligonucleotide
  Target: ATXN1; (-) strand; PAM type: YTN; PAM sequence: CTG
tttcatggataagggggatg

SEQ ID NO: 190146 - DNA, 20 bp, Artificial Sequence
  Description of Artificial Sequence: Synthetic oligonucleotide
  Target: ATXN1; (-) strand; PAM type: YTN; PAM sequence: CTG
agaggagtgggggacaggga

SEQ ID NO: 190147 - DNA, 20 bp, Artificial Sequence
  Description of Artificial Sequence: Synthetic oligonucleotide
  Target: ATXN1; (-) strand; PAM type: YTN; PAM sequence: TTG
ccaggggctgagaggagtgg

SEQ ID NO: 190148 - DNA, 20 bp, Artificial Sequence
  Description of Artificial Sequence: Synthetic oligonucleotide
  Target: ATXN1; (-) strand; PAM type: YTN; PAM sequence: TTT
gccaggggctgagaggagtg

SEQ ID NO: 190149 - DNA, 20 bp, Artificial Sequence
  Description of Artificial Sequence: Synthetic oligonucleotide
  Target: ATXN1; (-) strand; PAM type: YTN; PAM sequence: CTT
tgccaggggctgagaggagt

SEQ ID NO: 190150 - DNA, 20 bp, Artificial Sequence
  Description of Artificial Sequence: Synthetic oligonucleotide
  Target: ATXN1; (-) strand; PAM type: YTN; PAM sequence: TTA
gtctttgccaggggctgaga

SEQ ID NO: 190151 - DNA, 20 bp, Artificial Sequence
  Description of Artificial Sequence: Synthetic oligonucleotide
  Target: ATXN1; (-) strand; PAM type: YTN; PAM sequence: TTA
gagtcagaaagtagattagt

SEQ ID NO: 190152 - DNA, 20 bp, Artificial Sequence
  Description of Artificial Sequence: Synthetic oligonucleotide
  Target: ATXN1; (-) strand; PAM type: YTN; PAM sequence: CTT
agagtcagaaagtagattag

SEQ ID NO: 190153 - DNA, 20 bp, Artificial Sequence
  Description of Artificial Sequence: Synthetic oligonucleotide
  Target: ATXN1; (-) strand; PAM type: YTN; PAM sequence: CTC
cttagagtcagaaagtagat

SEQ ID NO: 190154 - DNA, 20 bp, Artificial Sequence
  Description of Artificial Sequence: Synthetic oligonucleotide
  Target: ATXN1; (-) strand; PAM type: YTN; PAM sequence: TTA
tacacaacatccagaataga

SEQ ID NO: 190155 - DNA, 20 bp, Artificial Sequence
  Description of Artificial Sequence: Synthetic oligonucleotide
  Target: ATXN1; (-) strand; PAM type: YTN; PAM sequence: TTT
atacacaacatccagaatag

SEQ ID NO: 190156 - DNA, 20 bp, Artificial Sequence
  Description of Artificial Sequence: Synthetic oligonucleotide
  Target: ATXN1; (-) strand; PAM type: YTN; PAM sequence: TTC
agtttatacacaacatccag

SEQ ID NO: 190157 - DNA, 20 bp, Artificial Sequence
  Description of Artificial Sequence: Synthetic oligonucleotide
  Target: ATXN1; (-) strand; PAM type: YTN; PAM sequence: TTG
tatgattcagtttatacaca

SEQ ID NO: 190158 - DNA, 20 bp, Artificial Sequence
  Description of Artificial Sequence: Synthetic oligonucleotide
  Target: ATXN1; (-) strand; PAM type: YTN; PAM sequence: TTA
tgccaagagaaagcagccag

SEQ ID NO: 190159 - DNA, 20 bp, Artificial Sequence
  Description of Artificial Sequence: Synthetic oligonucleotide
  Target: ATXN1; (-) strand; PAM type: YTN; PAM sequence: TTG
aaaacattatgccaagagaa

SEQ ID NO: 190160 - DNA, 20 bp, Artificial Sequence
  Description of Artificial Sequence: Synthetic oligonucleotide
  Target: ATXN1; (-) strand; PAM type: YTN; PAM sequence: CTT
gaaaacattatgccaagaga

SEQ ID NO: 190161 - DNA, 20 bp, Artificial Sequence
  Description of Artificial Sequence: Synthetic oligonucleotide
  Target: ATXN1; (-) strand; PAM type: YTN; PAM sequence: TTA
caatatgaatgagccttgaa

SEQ ID NO: 190162 - DNA, 20 bp, Artificial Sequence
  Description of Artificial Sequence: Synthetic oligonucleotide
  Target: ATXN1; (-) strand; PAM type: YTN; PAM sequence: CTG
gtacatgttacaatatgaat

SEQ ID NO: 190163 - DNA, 20 bp, Artificial Sequence
  Description of Artificial Sequence: Synthetic oligonucleotide
  Target: ATXN1; (-) strand; PAM type: YTN; PAM sequence: TTG
aaccaaaacaagaatgaagt

SEQ ID NO: 190164 - DNA, 20 bp, Artificial Sequence
  Description of Artificial Sequence: Synthetic oligonucleotide
  Target: ATXN1; (-) strand; PAM type: YTN; PAM sequence: TTA
ttgaaccaaaacaagaatga

SEQ ID NO: 190165 - DNA, 20 bp, Artificial Sequence
  Description of Artificial Sequence: Synthetic oligonucleotide
  Target: ATXN1; (-) strand; PAM type: YTN; PAM sequence: CTA
caatagagtattattgaacc

SEQ ID NO: 190166 - DNA, 20 bp, Artificial Sequence
  Description of Artificial Sequence: Synthetic oligonucleotide
  Target: ATXN1; (-) strand; PAM type: YTN; PAM sequence: CTG
acgaataaataacaaaatgt

SEQ ID NO: 190167 - DNA, 20 bp, Artificial Sequence
  Description of Artificial Sequence: Synthetic oligonucleotide
  Target: ATXN1; (-) strand; PAM type: YTN; PAM sequence: TTC
atagtagcccaaatatggaa

SEQ ID NO: 190168 - DNA, 20 bp, Artificial Sequence
  Description of Artificial Sequence: Synthetic oligonucleotide
  Target: ATXN1; (-) strand; PAM type: YTN; PAM sequence: TTC
atagcagcatgattcatagt

SEQ ID NO: 190169 - DNA, 20 bp, Artificial Sequence
  Description of Artificial Sequence: Synthetic oligonucleotide
  Target: ATXN1; (-) strand; PAM type: YTN; PAM sequence: TTC
aaacaaaaacatgtacatga

SEQ ID NO: 190170 - DNA, 20 bp, Artificial Sequence
  Description of Artificial Sequence: Synthetic oligonucleotide
  Target: ATXN1; (-) strand; PAM type: YTN; PAM sequence: TTG
caaacaggtattcaaacaaa

SEQ ID NO: 190171 - DNA, 20 bp, Artificial Sequence
  Description of Artificial Sequence: Synthetic oligonucleotide
  Target: ATXN1; (-) strand; PAM type: YTN; PAM sequence: TTT
gcaaacaggtattcaaacaa

SEQ ID NO: 190172 - DNA, 20 bp, Artificial Sequence
  Description of Artificial Sequence: Synthetic oligonucleotide
  Target: ATXN1; (-) strand; PAM type: YTN; PAM sequence: CTG
aagagatttgcaaacaggta

SEQ ID NO: 190173 - DNA, 20 bp, Artificial Sequence
  Description of Artificial Sequence: Synthetic oligonucleotide
  Target: ATXN1; (-) strand; PAM type: YTN; PAM sequence: TTA
ggtatacactgaagagattt

SEQ ID NO: 190174 - DNA, 20 bp, Artificial Sequence
  Description of Artificial Sequence: Synthetic oligonucleotide
  Target: ATXN1; (-) strand; PAM type: YTN; PAM sequence: CTT
aggtatacactgaagagatt

SEQ ID NO: 190175 - DNA, 20 bp, Artificial Sequence
  Description of Artificial Sequence: Synthetic oligonucleotide
  Target: ATXN1; (-) strand; PAM type: YTN; PAM sequence: CTC
ttaggtatacactgaagaga

SEQ ID NO: 190176 - DNA, 20 bp, Artificial Sequence
  Description of Artificial Sequence: Synthetic oligonucleotide
  Target: ATXN1; (-) strand; PAM type: YTN; PAM sequence: CTG
ctcttaggtatacactgaag

SEQ ID NO: 190177 - DNA, 20 bp, Artificial Sequence
  Description of Artificial Sequence: Synthetic oligonucleotide
  Target: ATXN1; (-) strand; PAM type: YTN; PAM sequence: TTC
tgctcttaggtatacactga

SEQ ID NO: 190178 - DNA, 20 bp, Artificial Sequence
  Description of Artificial Sequence: Synthetic oligonucleotide
  Target: ATXN1; (-) strand; PAM type: YTN; PAM sequence: CTC
agtagttctgctcttaggta

SEQ ID NO: 190179 - DNA, 20 bp, Artificial Sequence
  Description of Artificial Sequence: Synthetic oligonucleotide
  Target: ATXN1; (-) strand; PAM type: YTN; PAM sequence: TTA
acatatgactcagtagttct

SEQ ID NO: 190180 - DNA, 20 bp, Artificial Sequence
  Description of Artificial Sequence: Synthetic oligonucleotide
  Target: ATXN1; (-) strand; PAM type: YTN; PAM sequence: CTA
aatacagaattaacatatga

SEQ ID NO: 190181 - DNA, 20 bp, Artificial Sequence
  Description of Artificial Sequence: Synthetic oligonucleotide
  Target: ATXN1; (-) strand; PAM type: YTN; PAM sequence: CTC
aaatagctaaatacagaatt

SEQ ID NO: 190182 - DNA, 20 bp, Artificial Sequence
  Description of Artificial Sequence: Synthetic oligonucleotide
  Target: ATXN1; (-) strand; PAM type: YTN; PAM sequence: TTG
gcaagtcctcaaatagctaa

SEQ ID NO: 190183 - DNA, 20 bp, Artificial Sequence
  Description of Artificial Sequence: Synthetic oligonucleotide
  Target: ATXN1; (-) strand; PAM type: YTN; PAM sequence: TTT
ggcaagtcctcaaatagcta

SEQ ID NO: 190184 - DNA, 20 bp, Artificial Sequence
  Description of Artificial Sequence: Synthetic oligonucleotide
  Target: ATXN1; (-) strand; PAM type: YTN; PAM sequence: CTA
tagaaaacaatttggcaagt

SEQ ID NO: 190185 - DNA, 20 bp, Artificial Sequence
  Description of Artificial Sequence: Synthetic oligonucleotide
  Target: ATXN1; (-) strand; PAM type: YTN; PAM sequence: CTG
gtgggaatgtagtatggtgc

SEQ ID NO: 190186 - DNA, 20 bp, Artificial Sequence
  Description of Artificial Sequence: Synthetic oligonucleotide
  Target: ATXN1; (-) strand; PAM type: YTN; PAM sequence: CTG
gctggtgggaatgtagtatg

SEQ ID NO: 190187 - DNA, 20 bp, Artificial Sequence
  Description of Artificial Sequence: Synthetic oligonucleotide
  Target: ATXN1; (-) strand; PAM type: YTN; PAM sequence: CTA
cctggctggtgggaatgtag

SEQ ID NO: 190188 - DNA, 20 bp, Artificial Sequence
  Description of Artificial Sequence: Synthetic oligonucleotide
  Target: ATXN1; (-) strand; PAM type: YTN; PAM sequence: TTC
ctacctggctggtgggaatg

SEQ ID NO: 190189 - DNA, 20 bp, Artificial Sequence
  Description of Artificial Sequence: Synthetic oligonucleotide
  Target: ATXN1; (-) strand; PAM type: YTN; PAM sequence: CTT
cctacctggctggtgggaat

SEQ ID NO: 190190 - DNA, 20 bp, Artificial Sequence
  Description of Artificial Sequence: Synthetic oligonucleotide
  Target: ATXN1; (-) strand; PAM type: YTN; PAM sequence: TTG
tggaaaaaatggtaatcttc

SEQ ID NO: 190191 - DNA, 20 bp, Artificial Sequence
  Description of Artificial Sequence: Synthetic oligonucleotide
  Target: ATXN1; (-) strand; PAM type: YTN; PAM sequence: CTT
gtggaaaaaatggtaatctt

SEQ ID NO: 190192 - DNA, 20 bp, Artificial Sequence
  Description of Artificial Sequence: Synthetic oligonucleotide
  Target: ATXN1; (-) strand; PAM type: YTN; PAM sequence: TTG
gcaagcttgtggaaaaaatg

SEQ ID NO: 190193 - DNA, 20 bp, Artificial Sequence
  Description of Artificial Sequence: Synthetic oligonucleotide
  Target: ATXN1; (-) strand; PAM type: YTN; PAM sequence: TTA
aaaaaggaaaataacaagtg

SEQ ID NO: 190194 - DNA, 20 bp, Artificial Sequence
  Description of Artificial Sequence: Synthetic oligonucleotide
  Target: ATXN1; (-) strand; PAM type: YTN; PAM sequence: TTT
aaaaaaggaaaataacaagt

SEQ ID NO: 190195 - DNA, 20 bp, Artificial Sequence
  Description of Artificial Sequence: Synthetic oligonucleotide
  Target: ATXN1; (-) strand; PAM type: YTN; PAM sequence: TTT
taaaaaaggaaaataacaag

SEQ ID NO: 190196 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaaggaaaataacaa

SEQ ID NO: 190197 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaaggaaaataaca

SEQ ID NO: 190198 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaaggaaaataac

SEQ ID NO: 190199 - DNA, 20 bp, Artificial Sequence
  Description of Artificial Sequence: Synthetic oligonucleotide
  Target: ATXN1; (-) strand; PAM type: YTN; PAM sequence: TTA
tgatggccataattttttta

SEQ ID NO: 190200 - DNA, 20 bp, Artificial Sequence
  Description of Artificial Sequence: Synthetic oligonucleotide
  Target: ATXN1; (-) strand; PAM type: YTN; PAM sequence: TTA
tggtcacccattatgatggc

SEQ ID NO: 190201 - DNA, 20 bp, Artificial Sequence
  Description of Artificial Sequence: Synthetic oligonucleotide
  Target: ATXN1; (-) strand; PAM type: YTN; PAM sequence: TTA
ttatggtcacccattatgat

SEQ ID NO: 190202 - DNA, 20 bp, Artificial Sequence
  Description of Artificial Sequence: Synthetic oligonucleotide
  Target: ATXN1; (-) strand; PAM type: YTN; PAM sequence: TTT
attatggtcacccattatga

SEQ ID NO: 190203 - DNA, 20 bp, Artificial Sequence
  Description of Artificial Sequence: Synthetic oligonucleotide
  Target: ATXN1; (-) strand; PAM type: YTN; PAM sequence: CTT
tattatggtcacccattatg

SEQ ID NO: 190204 - DNA, 20 bp, Artificial Sequence
  Description of Artificial Sequence: Synthetic oligonucleotide
  Target: ATXN1; (-) strand; PAM type: YTN; PAM sequence: TTA
ggggaatgcaaatcaaaacc

SEQ ID NO: 190205 - DNA, 20 bp, Artificial Sequence
  Description of Artificial Sequence: Synthetic oligonucleotide
  Target: ATXN1; (-) strand; PAM type: YTN; PAM sequence: TTT
aggggaatgcaaatcaaaac

SEQ ID NO: 190206 - DNA, 20 bp, Artificial Sequence
  Description of Artificial Sequence: Synthetic oligonucleotide
  Target: ATXN1; (-) strand; PAM type: YTN; PAM sequence: TTA
gtgtttaggggaatgcaaat

SEQ ID NO: 190207 - DNA, 20 bp, Artificial Sequence
  Description of Artificial Sequence: Synthetic oligonucleotide
  Target: ATXN1; (-) strand; PAM type: YTN; PAM sequence: TTA
tgaaaagatgtccaacatca

SEQ ID NO: 190208 - DNA, 20 bp, Artificial Sequence
  Description of Artificial Sequence: Synthetic oligonucleotide
  Target: ATXN1; (-) strand; PAM type: YTN; PAM sequence: CTT
atgaaaagatgtccaacatc

SEQ ID NO: 190209 - DNA, 20 bp, Artificial Sequence
  Description of Artificial Sequence: Synthetic oligonucleotide
  Target: ATXN1; (-) strand; PAM type: YTN; PAM sequence: CTC
caaagaagatatataaatag

SEQ ID NO: 190210 - DNA, 20 bp, Artificial Sequence
  Description of Artificial Sequence: Synthetic oligonucleotide
  Target: ATXN1; (-) strand; PAM type: YTN; PAM sequence: TTC
tccaaagaagatatataaat

SEQ ID NO: 190211 - DNA, 20 bp, Artificial Sequence
  Description of Artificial Sequence: Synthetic oligonucleotide
  Target: ATXN1; (-) strand; PAM type: YTN; PAM sequence: TTT
ctccaaagaagatatataaa

SEQ ID NO: 190212 - DNA, 20 bp, Artificial Sequence
  Description of Artificial Sequence: Synthetic oligonucleotide
  Target: ATXN1; (-) strand; PAM type: YTN; PAM sequence: TTG
gatagagatttctccaaaga

SEQ ID NO: 190213 - DNA, 20 bp, Artificial Sequence
  Description of Artificial Sequence: Synthetic oligonucleotide
  Target: ATXN1; (-) strand; PAM type: YTN; PAM sequence: TTA
aagatggacaaaggcattgg

SEQ ID NO: 190214 - DNA, 20 bp, Artificial Sequence
  Description of Artificial Sequence: Synthetic oligonucleotide
  Target: ATXN1; (-) strand; PAM type: YTN; PAM sequence: TTT
aaagatggacaaaggcattg

SEQ ID NO: 190215 - DNA, 20 bp, Artificial Sequence
  Description of Artificial Sequence: Synthetic oligonucleotide
  Target: ATXN1; (-) strand; PAM type: YTN; PAM sequence: CTA
acaacccagtttaaagatgg

SEQ ID NO: 190216 - DNA, 20 bp, Artificial Sequence
  Description of Artificial Sequence: Synthetic oligonucleotide
  Target: ATXN1; (-) strand; PAM type: YTN; PAM sequence: TTC
aaagagaaaaagactaacaa

SEQ ID NO: 190217 - DNA, 20 bp, Artificial Sequence
  Description of Artificial Sequence: Synthetic oligonucleotide
  Target: ATXN1; (-) strand; PAM type: YTN; PAM sequence: TTA
caattcaaagagaaaaagac

SEQ ID NO: 190218 - DNA, 20 bp, Artificial Sequence
  Description of Artificial Sequence: Synthetic oligonucleotide
  Target: ATXN1; (-) strand; PAM type: YTN; PAM sequence: CTT
acaattcaaagagaaaaaga

SEQ ID NO: 190219 - DNA, 20 bp, Artificial Sequence
  Description of Artificial Sequence: Synthetic oligonucleotide
  Target: ATXN1; (-) strand; PAM type: YTN; PAM sequence: CTC
ttacaattcaaagagaaaaa

SEQ ID NO: 190220 - DNA, 20 bp, Artificial Sequence
  Description of Artificial Sequence: Synthetic oligonucleotide
  Target: ATXN1; (-) strand; PAM type: YTN; PAM sequence: CTG
gaatatataaagaactctta

SEQ ID NO: 190221 - DNA, 20 bp, Artificial Sequence
  Description of Artificial Sequence: Synthetic oligonucleotide
  Target: ATXN1; (-) strand; PAM type: YTN; PAM sequence: TTC
tggaatatataaagaactct

SEQ ID NO: 190222 - DNA, 20 bp, Artificial Sequence
  Description of Artificial Sequence: Synthetic oligonucleotide
  Target: ATXN1; (-) strand; PAM type: YTN; PAM sequence: TTT
ctggaatatataaagaactc

SEQ ID NO: 190223 - DNA, 20 bp, Artificial Sequence
  Description of Artificial Sequence: Synthetic oligonucleotide
  Target: ATXN1; (-) strand; PAM type: YTN; PAM sequence: CTA
gtttctggaatatataaaga

SEQ ID NO: 190224 - DNA, 20 bp, Artificial Sequence
  Description of Artificial Sequence: Synthetic oligonucleotide
  Target: ATXN1; (-) strand; PAM type: YTN; PAM sequence: CTC
ataagggtctagtttctgga

SEQ ID NO: 190225 - DNA, 20 bp, Artificial Sequence
  Description of Artificial Sequence: Synthetic oligonucleotide
  Target: ATXN1; (-) strand; PAM type: YTN; PAM sequence: TTG
caagtcagtatctcataagg

SEQ ID NO: 190226 - DNA, 20 bp, Artificial Sequence
  Description of Artificial Sequence: Synthetic oligonucleotide
  Target: ATXN1; (-) strand; PAM type: YTN; PAM sequence: TTT
gcaagtcagtatctcataag

SEQ ID NO: 190227 - DNA, 20 bp, Artificial Sequence
  Description of Artificial Sequence: Synthetic oligonucleotide
  Target: ATXN1; (-) strand; PAM type: YTN; PAM sequence: CTG
tcaagaaagtcaaaagacag

SEQ ID NO: 190228 - DNA, 20 bp, Artificial Sequence
  Description of Artificial Sequence: Synthetic oligonucleotide
  Target: ATXN1; (-) strand; PAM type: YTN; PAM sequence: TTG
tgaaccaaagggcactgtca

SEQ ID NO: 190229 - DNA, 20 bp, Artificial Sequence
  Description of Artificial Sequence: Synthetic oligonucleotide
  Target: ATXN1; (-) strand; PAM type: YTN; PAM sequence: TTT
gtgaaccaaagggcactgtc

SEQ ID NO: 190230 - DNA, 20 bp, Artificial Sequence
  Description of Artificial Sequence: Synthetic oligonucleotide
  Target: ATXN1; (-) strand; PAM type: YTN; PAM sequence: CTT
tgtgaaccaaagggcactgt

SEQ ID NO: 190231 - DNA, 20 bp, Artificial Sequence
  Description of Artificial Sequence: Synthetic oligonucleotide
  Target: ATXN1; (-) strand; PAM type: YTN; PAM sequence: TTC
atcagtatcaaagcctttgt

SEQ ID NO: 190232 - DNA, 20 bp, Artificial Sequence
  Description of Artificial Sequence: Synthetic oligonucleotide
  Target: ATXN1; (-) strand; PAM type: YTN; PAM sequence: CTT
catcagtatcaaagcctttg

SEQ ID NO: 190233 - DNA, 20 bp, Artificial Sequence
  Description of Artificial Sequence: Synthetic oligonucleotide
  Target: ATXN1; (-) strand; PAM type: YTN; PAM sequence: TTG
gacttcatcagtatcaaagc

SEQ ID NO: 190234 - DNA, 20 bp, Artificial Sequence
  Description of Artificial Sequence: Synthetic oligonucleotide
  Target: ATXN1; (-) strand; PAM type: YTN; PAM sequence: TTA
gatgtgacaccaaaagcaca

SEQ ID NO: 190235 - DNA, 20 bp, Artificial Sequence
  Description of Artificial Sequence: Synthetic oligonucleotide
  Target: ATXN1; (-) strand; PAM type: YTN; PAM sequence: CTT
agatgtgacaccaaaagcac

SEQ ID NO: 190236 - DNA, 20 bp, Artificial Sequence
  Description of Artificial Sequence: Synthetic oligonucleotide
  Target: ATXN1; (-) strand; PAM type: YTN; PAM sequence: TTC
ttagatgtgacaccaaaagc

SEQ ID NO: 190237 - DNA, 20 bp, Artificial Sequence
  Description of Artificial Sequence: Synthetic oligonucleotide
  Target: ATXN1; (-) strand; PAM type: YTN; PAM sequence: TTG
gcaatagattcttagatgtg

SEQ ID NO: 190238 - DNA, 20 bp, Artificial Sequence
  Description of Artificial Sequence: Synthetic oligonucleotide
  Target: ATXN1; (-) strand; PAM type: YTN; PAM sequence: TTT
ggcaatagattcttagatgt

SEQ ID NO: 190239 - DNA, 20 bp, Artificial Sequence
  Description of Artificial Sequence: Synthetic oligonucleotide
  Target: ATXN1; (-) strand; PAM type: YTN; PAM sequence: TTC
atgaccatggatttggcaat

SEQ ID NO: 190240 - DNA, 20 bp, Artificial Sequence
  Description of Artificial Sequence: Synthetic oligonucleotide
  Target: ATXN1; (-) strand; PAM type: YTN; PAM sequence: CTT
catgaccatggatttggcaa

SEQ ID NO: 190241 - DNA, 20 bp, Artificial Sequence
  Description of Artificial Sequence: Synthetic oligonucleotide
  Target: ATXN1; (-) strand; PAM type: YTN; PAM sequence: TTA
aatgaaaacaggagtaaatc

SEQ ID NO: 190242 - DNA, 20 bp, Artificial Sequence
  Description of Artificial Sequence: Synthetic oligonucleotide
  Target: ATXN1; (-) strand; PAM type: YTN; PAM sequence: TTT
aaatgaaaacaggagtaaat

SEQ ID NO: 190243 - DNA, 20 bp, Artificial Sequence
  Description of Artificial Sequence: Synthetic oligonucleotide
  Target: ATXN1; (-) strand; PAM type: YTN; PAM sequence: TTT
taaatgaaaacaggagtaaa

SEQ ID NO: 190244 - DNA, 20 bp, Artificial Sequence
  Description of Artificial Sequence: Synthetic oligonucleotide
  Target: ATXN1; (-) strand; PAM type: YTN; PAM sequence: CTT
ttaaatgaaaacaggagtaa

SEQ ID NO: 190245 - DNA, 20 bp, Artificial Sequence
  Description of Artificial Sequence: Synthetic oligonucleotide
  Target: ATXN1; (-) strand; PAM type: YTN; PAM sequence: CTA
taaaacttttaaatgaaaac

SEQ ID NO: 190246 - DNA, 20 bp, Artificial Sequence
  Description of Artificial Sequence: Synthetic oligonucleotide
  Target: ATXN1; (-) strand; PAM type: YTN; PAM sequence: CTG
aaactataaaacttttaaat

SEQ ID NO: 190247 - DNA, 20 bp, Artificial Sequence
  Description of Artificial Sequence: Synthetic oligonucleotide
  Target: ATXN1; (-) strand; PAM type: YTN; PAM sequence: CTA
aatgtaggaactgaaactat

SEQ ID NO: 190248 - DNA, 20 bp, Artificial Sequence
  Description of Artificial Sequence: Synthetic oligonucleotide
  Target: ATXN1; (-) strand; PAM type: YTN; PAM sequence: CTA
aaaatggatcaataccctaa

SEQ ID NO: 190249 - DNA, 20 bp, Artificial Sequence
  Description of Artificial Sequence: Synthetic oligonucleotide
  Target: ATXN1; (-) strand; PAM type: YTN; PAM sequence: CTC
acaccatatacaaaaatgaa

SEQ ID NO: 190250 - DNA, 20 bp, Artificial Sequence
  Description of Artificial Sequence: Synthetic oligonucleotide
  Target: ATXN1; (-) strand; PAM type: YTN; PAM sequence: TTA
cctcacaccatatacaaaaa

SEQ ID NO: 190251 - DNA, 20 bp, Artificial Sequence
  Description of Artificial Sequence: Synthetic oligonucleotide
  Target: ATXN1; (-) strand; PAM type: YTN; PAM sequence: CTT
acctcacaccatatacaaaa

SEQ ID NO: 190252 - DNA, 20 bp, Artificial Sequence
  Description of Artificial Sequence: Synthetic oligonucleotide
  Target: ATXN1; (-) strand; PAM type: YTN; PAM sequence: TTG
aacccttacctcacaccata

SEQ ID NO: 190253 - DNA, 20 bp, Artificial Sequence
  Description of Artificial Sequence: Synthetic oligonucleotide
  Target: ATXN1; (-) strand; PAM type: YTN; PAM sequence: CTG
ggacacatgccagagaaaga

SEQ ID NO: 190254 - DNA, 20 bp, Artificial Sequence
  Description of Artificial Sequence: Synthetic oligonucleotide
  Target: ATXN1; (-) strand; PAM type: YTN; PAM sequence: CTG
agacaatggaaaaagtcacc

SEQ ID NO: 190255 - DNA, 20 bp, Artificial Sequence
  Description of Artificial Sequence: Synthetic oligonucleotide
  Target: ATXN1; (-) strand; PAM type: YTN; PAM sequence: TTG
gtgctgagacaatggaaaaa

SEQ ID NO: 190256 - DNA, 20 bp, Artificial Sequence
  Description of Artificial Sequence: Synthetic oligonucleotide
  Target: ATXN1; (-) strand; PAM type: YTN; PAM sequence: TTC
aacaattggtgctgagacaa

SEQ ID NO: 190257 - DNA, 20 bp, Artificial Sequence
  Description of Artificial Sequence: Synthetic oligonucleotide
  Target: ATXN1; (-) strand; PAM type: YTN; PAM sequence: TTT
caacaattggtgctgagaca

SEQ ID NO: 190258 - DNA, 20 bp, Artificial Sequence
  Description of Artificial Sequence: Synthetic oligonucleotide
  Target: ATXN1; (-) strand; PAM type: YTN; PAM sequence: TTT
tcaacaattggtgctgagac

SEQ ID NO: 190259 - DNA, 20 bp, Artificial Sequence
  Description of Artificial Sequence: Synthetic oligonucleotide
  Target: ATXN1; (-) strand; PAM type: YTN; PAM sequence: CTT
ttcaacaattggtgctgaga

SEQ ID NO: 190260 - DNA, 20 bp, Artificial Sequence
  Description of Artificial Sequence: Synthetic oligonucleotide
  Target: ATXN1; (-) strand; PAM type: YTN; PAM sequence: CTC
ttttcaacaattggtgctga

SEQ ID NO: 190261 - DNA, 20 bp, Artificial Sequence
  Description of Artificial Sequence: Synthetic oligonucleotide
  Target: ATXN1; (-) strand; PAM type: YTN; PAM sequence: TTA
cctcttttcaacaattggtg

SEQ ID NO: 190262 - DNA, 20 bp, Artificial Sequence
  Description of Artificial Sequence: Synthetic oligonucleotide
  Target: ATXN1; (-) strand; PAM type: YTN; PAM sequence: CTT
acctcttttcaacaattggt

SEQ ID NO: 190263 - DNA, 20 bp, Artificial Sequence
  Description of Artificial Sequence: Synthetic oligonucleotide
  Target: ATXN1; (-) strand; PAM type: YTN; PAM sequence: CTC
ttacctcttttcaacaattg

SEQ ID NO: 190264 - DNA, 20 bp, Artificial Sequence
  Description of Artificial Sequence: Synthetic oligonucleotide
  Target: ATXN1; (-) strand; PAM type: YTN; PAM sequence: CTC
tcttacctcttttcaacaat

SEQ ID NO: 190265 - DNA, 20 bp, Artificial Sequence
  Description of Artificial Sequence: Synthetic oligonucleotide
  Target: ATXN1; (-) strand; PAM type: YTN; PAM sequence: CTC
aaaatctctcttacctcttt

SEQ ID NO: 190266 - DNA, 20 bp, Artificial Sequence
  Description of Artificial Sequence: Synthetic oligonucleotide
  Target: ATXN1; (-) strand; PAM type: YTN; PAM sequence: TTC
atactcaaaatctctcttac

SEQ ID NO: 190267 - DNA, 20 bp, Artificial Sequence
  Description of Artificial Sequence: Synthetic oligonucleotide
  Target: ATXN1; (-) strand; PAM type: YTN; PAM sequence: CTT
catactcaaaatctctctta

SEQ ID NO: 190268 - DNA, 20 bp, Artificial Sequence
  Description of Artificial Sequence: Synthetic oligonucleotide
  Target: ATXN1; (-) strand; PAM type: YTN; PAM sequence: CTA
aaatcacttcatactcaaaa

SEQ ID NO: 190269 - DNA, 20 bp, Artificial Sequence
  Description of Artificial Sequence: Synthetic oligonucleotide
  Target: ATXN1; (-) strand; PAM type: YTN; PAM sequence: TTC
aagagaaaagactaaaatca

SEQ ID NO: 190270 - DNA, 20 bp, Artificial Sequence
  Description of Artificial Sequence: Synthetic oligonucleotide
  Target: ATXN1; (-) strand; PAM type: YTN; PAM sequence: TTT
caagagaaaagactaaaatc

SEQ ID NO: 190271 - DNA, 20 bp, Artificial Sequence
  Description of Artificial Sequence: Synthetic oligonucleotide
  Target: ATXN1; (-) strand; PAM type: YTN; PAM sequence: TTT
tcaagagaaaagactaaaat

SEQ ID NO: 190272 - DNA, 20 bp, Artificial Sequence
  Description of Artificial Sequence: Synthetic oligonucleotide
  Target: ATXN1; (-) strand; PAM type: YTN; PAM sequence: TTT
ttcaagagaaaagactaaaa

SEQ ID NO: 190273 - DNA, 20 bp, Artificial Sequence
  Description of Artificial Sequence: Synthetic oligonucleotide
  Target: ATXN1; (-) strand; PAM type: YTN; PAM sequence: TTT
tttcaagagaaaagactaaa

SEQ ID NO: 190274 - DNA, 20 bp, Artificial Sequence
  Description of Artificial Sequence: Synthetic oligonucleotide
  Target: ATXN1; (-) strand; PAM type: YTN; PAM sequence: TTG
ttttttcaagagaaaagact

SEQ ID NO: 190275 - DNA, 20 bp, Artificial Sequence
  Description of Artificial Sequence: Synthetic oligonucleotide
  Target: ATXN1; (-) strand; PAM type: YTN; PAM sequence: TTT
gttttttcaagagaaaagac

SEQ ID NO: 190276 - DNA, 20 bp, Artificial Sequence
  Description of Artificial Sequence: Synthetic oligonucleotide
  Target: ATXN1; (-) strand; PAM type: YTN; PAM sequence: TTT
tgttttttcaagagaaaaga

SEQ ID NO: 190277 - DNA, 20 bp, Artificial Sequence
  Description of Artificial Sequence: Synthetic oligonucleotide
  Target: ATXN1; (-) strand; PAM type: YTN; PAM sequence: TTA
aagttttgttttttcaagag

SEQ ID NO: 190278 - DNA, 20 bp, Artificial Sequence
  Description of Artificial Sequence: Synthetic oligonucleotide
  Target: ATXN1; (-) strand; PAM type: YTN; PAM sequence: TTT
aaagttttgttttttcaaga

SEQ ID NO: 190279 - DNA, 20 bp, Artificial Sequence
  Description of Artificial Sequence: Synthetic oligonucleotide
  Target: ATXN1; (-) strand; PAM type: YTN; PAM sequence: TTT
taaagttttgttttttcaag

SEQ ID NO: 190280 - DNA, 20 bp, Artificial Sequence
  Description of Artificial Sequence: Synthetic oligonucleotide
  Target: ATXN1; (-) strand; PAM type: YTN; PAM sequence: TTT
ttaaagttttgttttttcaa

SEQ ID NO: 190281 - DNA, 20 bp, Artificial Sequence
  Description of Artificial Sequence: Synthetic oligonucleotide
  Target: ATXN1; (-) strand; PAM type: YTN; PAM sequence: TTA
aaataatgtatatttttaaa

SEQ ID NO: 190282 - DNA, 20 bp, Artificial Sequence
  Description of Artificial Sequence: Synthetic oligonucleotide
  Target: ATXN1; (-) strand; PAM type: YTN; PAM sequence: TTT
aaaataatgtatatttttaa

SEQ ID NO: 190283 - DNA, 20 bp, Artificial Sequence
  Description of Artificial Sequence: Synthetic oligonucleotide
  Target: ATXN1; (-) strand; PAM type: YTN; PAM sequence: TTT
taaaataatgtatattttta

SEQ ID NO: 190284 - DNA, 20 bp, Artificial Sequence
  Description of Artificial Sequence: Synthetic oligonucleotide
  Target: ATXN1; (-) strand; PAM type: YTN; PAM sequence: TTT
ttaaaataatgtatattttt

SEQ ID NO: 190285 - DNA, 20 bp, Artificial Sequence
  Description of Artificial Sequence: Synthetic oligonucleotide
  Target: ATXN1; (-) strand; PAM type: YTN; PAM sequence: TTA
atttttaaaataatgtatat

SEQ ID NO: 190286 - DNA, 20 bp, Artificial Sequence
  Description of Artificial Sequence: Synthetic oligonucleotide
  Target: ATXN1; (-) strand; PAM type: YTN; PAM sequence: CTG
aatacagtcatagtgtaacc

SEQ ID NO: 190287 - DNA, 20 bp, Artificial Sequence
  Description of Artificial Sequence: Synthetic oligonucleotide
  Target: ATXN1; (-) strand; PAM type: YTN; PAM sequence: TTA
aatagtggctgaatacagtc

SEQ ID NO: 190288 - DNA, 20 bp, Artificial Sequence
  Description of Artificial Sequence: Synthetic oligonucleotide
  Target: ATXN1; (-) strand; PAM type: YTN; PAM sequence: TTT
aaatagtggctgaatacagt

SEQ ID NO: 190289 - DNA, 20 bp, Artificial Sequence
  Description of Artificial Sequence: Synthetic oligonucleotide
  Target: ATXN1; (-) strand; PAM type: YTN; PAM sequence: TTA
aaatgtgggatgaggaaaaa

SEQ ID NO: 190290 - DNA, 20 bp, Artificial Sequence
  Description of Artificial Sequence: Synthetic oligonucleotide
  Target: ATXN1; (-) strand; PAM type: YTN; PAM sequence: TTT
aaaatgtgggatgaggaaaa

SEQ ID NO: 190291 - DNA, 20 bp, Artificial Sequence
  Description of Artificial Sequence: Synthetic oligonucleotide
  Target: ATXN1; (-) strand; PAM type: YTN; PAM sequence: CTT
taaaatgtgggatgaggaaa

SEQ ID NO: 190292 - DNA, 20 bp, Artificial Sequence
  Description of Artificial Sequence: Synthetic oligonucleotide
  Target: ATXN1; (-) strand; PAM type: YTN; PAM sequence: CTG
catctttaaaatgtgggatg

SEQ ID NO: 190293 - DNA, 20 bp, Artificial Sequence
  Description of Artificial Sequence: Synthetic oligonucleotide
  Target: ATXN1; (-) strand; PAM type: YTN; PAM sequence: TTG
ctgcatctttaaaatgtggg

SEQ ID NO: 190294 - DNA, 20 bp, Artificial Sequence
  Description of Artificial Sequence: Synthetic oligonucleotide
  Target: ATXN1; (-) strand; PAM type: YTN; PAM sequence: CTT
gctgcatctttaaaatgtgg

SEQ ID NO: 190295 - DNA, 20 bp, Artificial Sequence
  Description of Artificial Sequence: Synthetic oligonucleotide
  Target: ATXN1; (-) strand; PAM type: YTN; PAM sequence: TTC
atgaaaacttgctgcatctt

SEQ ID NO: 190296 - DNA, 20 bp, Artificial Sequence
  Description of Artificial Sequence: Synthetic oligonucleotide
  Target: ATXN1; (-) strand; PAM type: YTN; PAM sequence: CTG
gtgggtcatcattcatgaaa

SEQ ID NO: 190297 - DNA, 20 bp, Artificial Sequence
  Description of Artificial Sequence: Synthetic oligonucleotide
  Target: ATXN1; (-) strand; PAM type: YTN; PAM sequence: CTC
tggtgggtcatcattcatga

SEQ ID NO: 190298 - DNA, 20 bp, Artificial Sequence
  Description of Artificial Sequence: Synthetic oligonucleotide
  Target: ATXN1; (-) strand; PAM type: YTN; PAM sequence: CTC
agcatcatggctctggtggg

SEQ ID NO: 190299 - DNA, 20 bp, Artificial Sequence
  Description of Artificial Sequence: Synthetic oligonucleotide
  Target: ATXN1; (-) strand; PAM type: YTN; PAM sequence: CTG
aaagctcagcatcatggctc

SEQ ID NO: 190300 - DNA, 20 bp, Artificial Sequence
  Description of Artificial Sequence: Synthetic oligonucleotide
  Target: ATXN1; (-) strand; PAM type: YTN; PAM sequence: TTC
cctgaaagctcagcatcatg

SEQ ID NO: 190301 - DNA, 20 bp, Artificial Sequence
  Description of Artificial Sequence: Synthetic oligonucleotide
  Target: ATXN1; (-) strand; PAM type: YTN; PAM sequence: CTT
ccctgaaagctcagcatcat

SEQ ID NO: 190302 - DNA, 20 bp, Artificial Sequence
  Description of Artificial Sequence: Synthetic oligonucleotide
  Target: ATXN1; (-) strand; PAM type: YTN; PAM sequence: TTG
gcttccctgaaagctcagca

SEQ ID NO: 190303 - DNA, 20 bp, Artificial Sequence
  Description of Artificial Sequence: Synthetic oligonucleotide
  Target: ATXN1; (-) strand; PAM type: YTN; PAM sequence: CTC
aagaggtggttggcttccct

SEQ ID NO: 190304 - DNA, 20 bp, Artificial Sequence
  Description of Artificial Sequence: Synthetic oligonucleotide
  Target: ATXN1; (-) strand; PAM type: YTN; PAM sequence: TTG
caaaagcaccacctcaagag

SEQ ID NO: 190305 - DNA, 20 bp, Artificial Sequence
  Description of Artificial Sequence: Synthetic oligonucleotide
  Target: ATXN1; (-) strand; PAM type: YTN; PAM sequence: CTT
gcaaaagcaccacctcaaga

SEQ ID NO: 190306 - DNA, 20 bp, Artificial Sequence
  Description of Artificial Sequence: Synthetic oligonucleotide
  Target: ATXN1; (-) strand; PAM type: YTN; PAM sequence: TTC
ttgcaaaagcaccacctcaa

SEQ ID NO: 190307 - DNA, 20 bp, Artificial Sequence
  Description of Artificial Sequence: Synthetic oligonucleotide
  Target: ATXN1; (-) strand; PAM type: YTN; PAM sequence: TTA
gttcttgcaaaagcaccacc

SEQ ID NO: 190308 - DNA, 20 bp, Artificial Sequence
  Description of Artificial Sequence: Synthetic oligonucleotide
  Target: ATXN1; (-) strand; PAM type: YTN; PAM sequence: TTG
aaaattagttcttgcaaaag

SEQ ID NO: 190309 - DNA, 20 bp, Artificial Sequence
  Description of Artificial Sequence: Synthetic oligonucleotide
  Target: ATXN1; (-) strand; PAM type: YTN; PAM sequence: TTT
gaaaattagttcttgcaaaa

SEQ ID NO: 190310 - DNA, 20 bp, Artificial Sequence
  Description of Artificial Sequence: Synthetic oligonucleotide
  Target: ATXN1; (-) strand; PAM type: YTN; PAM sequence: TTT
tgaaaattagttcttgcaaa

SEQ ID NO: 190311 - DNA, 20 bp, Artificial Sequence
  Description of Artificial Sequence: Synthetic oligonucleotide
  Target: ATXN1; (-) strand; PAM type: YTN; PAM sequence: CTT
ttgaaaattagttcttgcaa

SEQ ID NO: 190312 - DNA, 20 bp, Artificial Sequence
  Description of Artificial Sequence: Synthetic oligonucleotide
  Target: ATXN1; (-) strand; PAM type: YTN; PAM sequence: TTG
cttttgaaaattagttcttg

SEQ ID NO: 190313 - DNA, 20 bp, Artificial Sequence
  Description of Artificial Sequence: Synthetic oligonucleotide
  Target: ATXN1; (-) strand; PAM type: YTN; PAM sequence: CTG
ttgcttttgaaaattagttc

SEQ ID NO: 190314 - DNA, 20 bp, Artificial Sequence
  Description of Artificial Sequence: Synthetic oligonucleotide
  Target: ATXN1; (-) strand; PAM type: YTN; PAM sequence: CTA
ctgttgcttttgaaaattag

SEQ ID NO: 190315 - DNA, 20 bp, Artificial Sequence
  Description of Artificial Sequence: Synthetic oligonucleotide
  Target: ATXN1; (-) strand; PAM type: YTN; PAM sequence: TTC
aagctactgttgcttttgaa

SEQ ID NO: 190316 - DNA, 20 bp, Artificial Sequence
  Description of Artificial Sequence: Synthetic oligonucleotide
  Target: ATXN1; (-) strand; PAM type: YTN; PAM sequence: TTT
caagctactgttgcttttga

SEQ ID NO: 190317 - DNA, 20 bp, Artificial Sequence
  Description of Artificial Sequence: Synthetic oligonucleotide
  Target: ATXN1; (-) strand; PAM type: YTN; PAM sequence: CTA
gaggggcacaaacacagagg

SEQ ID NO: 190318 - DNA, 20 bp, Artificial Sequence
  Description of Artificial Sequence: Synthetic oligonucleotide
  Target: ATXN1; (-) strand; PAM type: YTN; PAM sequence: TTC
actagaggggcacaaacaca

SEQ ID NO: 190319 - DNA, 20 bp, Artificial Sequence
  Description of Artificial Sequence: Synthetic oligonucleotide
  Target: ATXN1; (-) strand; PAM type: YTN; PAM sequence: CTG
ttcactagaggggcacaaac

SEQ ID NO: 190320 - DNA, 20 bp, Artificial Sequence
  Description of Artificial Sequence: Synthetic oligonucleotide
  Target: ATXN1; (-) strand; PAM type: YTN; PAM sequence: CTG
aagacaggggctgttcacta

SEQ ID NO: 190321 - DNA, 20 bp, Artificial Sequence
  Description of Artificial Sequence: Synthetic oligonucleotide
  Target: ATXN1; (-) strand; PAM type: YTN; PAM sequence: CTG
tggatatctgaagacagggg

SEQ ID NO: 190322 - DNA, 20 bp, Artificial Sequence
  Description of Artificial Sequence: Synthetic oligonucleotide
  Target: ATXN1; (-) strand; PAM type: YTN; PAM sequence: TTG
gaaagagaacagaggtctgt

SEQ ID NO: 190323 - DNA, 20 bp, Artificial Sequence
  Description of Artificial Sequence: Synthetic oligonucleotide
  Target: ATXN1; (-) strand; PAM type: YTN; PAM sequence: CTT
ggaaagagaacagaggtctg

SEQ ID NO: 190324 - DNA, 20 bp, Artificial Sequence
  Description of Artificial Sequence: Synthetic oligonucleotide
  Target: ATXN1; (-) strand; PAM type: YTN; PAM sequence: TTA
atgggtgggtgtcgggcttg

SEQ ID NO: 190325 - DNA, 20 bp, Artificial Sequence
  Description of Artificial Sequence: Synthetic oligonucleotide
  Target: ATXN1; (-) strand; PAM type: YTN; PAM sequence: CTT
aatgggtgggtgtcgggctt

SEQ ID NO: 190326 - DNA, 20 bp, Artificial Sequence
  Description of Artificial Sequence: Synthetic oligonucleotide
  Target: ATXN1; (-) strand; PAM type: YTN; PAM sequence: CTC
caaagagccaatcttaatgg

SEQ ID NO: 190327 - DNA, 20 bp, Artificial Sequence
  Description of Artificial Sequence: Synthetic oligonucleotide
  Target: ATXN1; (-) strand; PAM type: YTN; PAM sequence: TTC
tccaaagagccaatcttaat

SEQ ID NO: 190328 - DNA, 20 bp, Artificial Sequence
  Description of Artificial Sequence: Synthetic oligonucleotide
  Target: ATXN1; (-) strand; PAM type: YTN; PAM sequence: TTT
ctccaaagagccaatcttaa

SEQ ID NO: 190329 - DNA, 20 bp, Artificial Sequence
  Description of Artificial Sequence: Synthetic oligonucleotide
  Target: ATXN1; (-) strand; PAM type: YTN; PAM sequence: TTT
tctccaaagagccaatctta

SEQ ID NO: 190330 - DNA, 20 bp, Artificial Sequence
  Description of Artificial Sequence: Synthetic oligonucleotide
  Target: ATXN1; (-) strand; PAM type: YTN; PAM sequence: TTA
agttttctccaaagagccaa

SEQ ID NO: 190331 - DNA, 20 bp, Artificial Sequence
  Description of Artificial Sequence: Synthetic oligonucleotide
  Target: ATXN1; (-) strand; PAM type: YTN; PAM sequence: TTA
ttaagttttctccaaagagc

SEQ ID NO: 190332 - DNA, 20 bp, Artificial Sequence
  Description of Artificial Sequence: Synthetic oligonucleotide
  Target: ATXN1; (-) strand; PAM type: YTN; PAM sequence: TTT
attaagttttctccaaagag

SEQ ID NO: 190333 - DNA, 20 bp, Artificial Sequence
  Description of Artificial Sequence: Synthetic oligonucleotide
  Target: ATXN1; (-) strand; PAM type: YTN; PAM sequence: TTA
gtttattaagttttctccaa

SEQ ID NO: 190334 - DNA, 20 bp, Artificial Sequence
  Description of Artificial Sequence: Synthetic oligonucleotide
  Target: ATXN1; (-) strand; PAM type: YTN; PAM sequence: TTG
gcatgaattagtttattaag

SEQ ID NO: 190335 - DNA, 20 bp, Artificial Sequence
  Description of Artificial Sequence: Synthetic oligonucleotide
  Target: ATXN1; (-) strand; PAM type: YTN; PAM sequence: TTT
ggcatgaattagtttattaa

SEQ ID NO: 190336 - DNA, 20 bp, Artificial Sequence
  Description of Artificial Sequence: Synthetic oligonucleotide
  Target: ATXN1; (-) strand; PAM type: YTN; PAM sequence: TTA
tacacgatttggcatgaatt

SEQ ID NO: 190337 - DNA, 20 bp, Artificial Sequence
  Description of Artificial Sequence: Synthetic oligonucleotide
  Target: ATXN1; (-) strand; PAM type: YTN; PAM sequence: TTG
gttatacacgatttggcatg

SEQ ID NO: 190338 - DNA, 20 bp, Artificial Sequence
  Description of Artificial Sequence: Synthetic oligonucleotide
  Target: ATXN1; (-) strand; PAM type: YTN; PAM sequence: CTT
ggttatacacgatttggcat

SEQ ID NO: 190339 - DNA, 20 bp, Artificial Sequence
  Description of Artificial Sequence: Synthetic oligonucleotide
  Target: ATXN1; (-) strand; PAM type: YTN; PAM sequence: CTC
ttggttatacacgatttggc

SEQ ID NO: 190340 - DNA, 20 bp, Artificial Sequence
  Description of Artificial Sequence: Synthetic oligonucleotide
  Target: ATXN1; (-) strand; PAM type: YTN; PAM sequence: TTC
tcttggttatacacgatttg

SEQ ID NO: 190341 - DNA, 20 bp, Artificial Sequence
  Description of Artificial Sequence: Synthetic oligonucleotide
  Target: ATXN1; (-) strand; PAM type: YTN; PAM sequence: TTT
ctcttggttatacacgattt

SEQ ID NO: 190342 - DNA, 20 bp, Artificial Sequence
  Description of Artificial Sequence: Synthetic oligonucleotide
  Target: ATXN1; (-) strand; PAM type: YTN; PAM sequence: TTA
tttctcttggttatacacga

SEQ ID NO: 190343 - DNA, 20 bp, Artificial Sequence
  Description of Artificial Sequence: Synthetic oligonucleotide
  Target: ATXN1; (-) strand; PAM type: YTN; PAM sequence: CTA
ttatttctcttggttataca

SEQ ID NO: 190344 - DNA, 20 bp, Artificial Sequence
  Description of Artificial Sequence: Synthetic oligonucleotide
  Target: ATXN1; (-) strand; PAM type: YTN; PAM sequence: TTA
ggtatcatgccaaaagtcta

SEQ ID NO: 190345 - DNA, 20 bp, Artificial Sequence
  Description of Artificial Sequence: Synthetic oligonucleotide
  Target: ATXN1; (-) strand; PAM type: YTN; PAM sequence: CTT
aggtatcatgccaaaagtct

SEQ ID NO: 190346 - DNA, 20 bp, Artificial Sequence
  Description of Artificial Sequence: Synthetic oligonucleotide
  Target: ATXN1; (-) strand; PAM type: YTN; PAM sequence: TTA
agataaacagagtcttaggt

SEQ ID NO: 190347 - DNA, 20 bp, Artificial Sequence
  Description of Artificial Sequence: Synthetic oligonucleotide
  Target: ATXN1; (-) strand; PAM type: YTN; PAM sequence: CTT
aagataaacagagtcttagg

SEQ ID NO: 190348 - DNA, 20 bp, Artificial Sequence
  Description of Artificial Sequence: Synthetic oligonucleotide
  Target: ATXN1; (-) strand; PAM type: YTN; PAM sequence: TTG
cttaagataaacagagtctt

SEQ ID NO: 190349 - DNA, 20 bp, Artificial Sequence
  Description of Artificial Sequence: Synthetic oligonucleotide
  Target: ATXN1; (-) strand; PAM type: YTN; PAM sequence: TTT
gcttaagataaacagagtct

SEQ ID NO: 190350 - DNA, 20 bp, Artificial Sequence
  Description of Artificial Sequence: Synthetic oligonucleotide
  Target: ATXN1; (-) strand; PAM type: YTN; PAM sequence: TTT
tgcttaagataaacagagtc

SEQ ID NO: 190351 - DNA, 20 bp, Artificial Sequence
  Description of Artificial Sequence: Synthetic oligonucleotide
  Target: ATXN1; (-) strand; PAM type: YTN; PAM sequence: TTT
ttgcttaagataaacagagt

SEQ ID NO: 190352 - DNA, 20 bp, Artificial Sequence
  Description of Artificial Sequence: Synthetic oligonucleotide
  Target: ATXN1; (-) strand; PAM type: YTN; PAM sequence: CTT
tttgcttaagataaacagag

SEQ ID NO: 190353 - DNA, 20 bp, Artificial Sequence
  Description of Artificial Sequence: Synthetic oligonucleotide
  Target: ATXN1; (-) strand; PAM type: YTN; PAM sequence: TTC
tttttgcttaagataaacag

SEQ ID NO: 190354 - DNA, 20 bp, Artificial Sequence
  Description of Artificial Sequence: Synthetic oligonucleotide
  Target: ATXN1; (-) strand; PAM type: YTN; PAM sequence: CTG
tattctttttgcttaagata

SEQ ID NO: 190355 - DNA, 20 bp, Artificial Sequence
  Description of Artificial Sequence: Synthetic oligonucleotide
  Target: ATXN1; (-) strand; PAM type: YTN; PAM sequence: CTA
cactgtattctttttgctta

SEQ ID NO: 190356 - DNA, 20 bp, Artificial Sequence
  Description of Artificial Sequence: Synthetic oligonucleotide
  Target: ATXN1; (-) strand; PAM type: YTN; PAM sequence: CTA
caacctacactgtattcttt

SEQ ID NO: 190357 - DNA, 20 bp, Artificial Sequence
  Description of Artificial Sequence: Synthetic oligonucleotide
  Target: ATXN1; (-) strand; PAM type: YTN; PAM sequence: TTC
tacaacctacactgtattct

SEQ ID NO: 190358 - DNA, 20 bp, Artificial Sequence
  Description of Artificial Sequence: Synthetic oligonucleotide
  Target: ATXN1; (-) strand; PAM type: YTN; PAM sequence: TTG
atgatagccagaattctaca

SEQ ID NO: 190359 - DNA, 20 bp, Artificial Sequence
  Description of Artificial Sequence: Synthetic oligonucleotide
  Target: ATXN1; (-) strand; PAM type: YTN; PAM sequence: CTG
aattgatgatagccagaatt

SEQ ID NO: 190360 - DNA, 20 bp, Artificial Sequence
  Description of Artificial Sequence: Synthetic oligonucleotide
  Target: ATXN1; (-) strand; PAM type: YTN; PAM sequence: TTG
gctgaattgatgatagccag

SEQ ID NO: 190361 - DNA, 20 bp, Artificial Sequence
  Description of Artificial Sequence: Synthetic oligonucleotide
  Target: ATXN1; (-) strand; PAM type: YTN; PAM sequence: TTG
cattggctgaattgatgata

SEQ ID NO: 190362 - DNA, 20 bp, Artificial Sequence
  Description of Artificial Sequence: Synthetic oligonucleotide
  Target: ATXN1; (-) strand; PAM type: YTN; PAM sequence: CTT
gcattggctgaattgatgat

SEQ ID NO: 190363 - DNA, 20 bp, Artificial Sequence
  Description of Artificial Sequence: Synthetic oligonucleotide
  Target: ATXN1; (-) strand; PAM type: YTN; PAM sequence: CTC
cttgcattggctgaattgat

SEQ ID NO: 190364 - DNA, 20 bp, Artificial Sequence
  Description of Artificial Sequence: Synthetic oligonucleotide
  Target: ATXN1; (-) strand; PAM type: YTN; PAM sequence: TTC
actccttgcattggctgaat

SEQ ID NO: 190365 - DNA, 20 bp, Artificial Sequence
  Description of Artificial Sequence: Synthetic oligonucleotide
  Target: ATXN1; (-) strand; PAM type: YTN; PAM sequence: CTT
cactccttgcattggctgaa

SEQ ID NO: 190366 - DNA, 20 bp, Artificial Sequence
  Description of Artificial Sequence: Synthetic oligonucleotide
  Target: ATXN1; (-) strand; PAM type: YTN; PAM sequence: TTA
aaagtcttcactccttgcat

SEQ ID NO: 190367 - DNA, 20 bp, Artificial Sequence
  Description of Artificial Sequence: Synthetic oligonucleotide
  Target: ATXN1; (-) strand; PAM type: YTN; PAM sequence: TTT
aaaagtcttcactccttgca

SEQ ID NO: 190368 - DNA, 20 bp, Artificial Sequence
  Description of Artificial Sequence: Synthetic oligonucleotide
  Target: ATXN1; (-) strand; PAM type: YTN; PAM sequence: TTA
gggggatttaaaagtcttca

SEQ ID NO: 190369 - DNA, 20 bp, Artificial Sequence
  Description of Artificial Sequence: Synthetic oligonucleotide
  Target: ATXN1; (-) strand; PAM type: YTN; PAM sequence: TTT
agggggatttaaaagtcttc

SEQ ID NO: 190370 - DNA, 20 bp, Artificial Sequence
  Description of Artificial Sequence: Synthetic oligonucleotide
  Target: ATXN1; (-) strand; PAM type: YTN; PAM sequence: CTT
tagggggatttaaaagtctt

SEQ ID NO: 190371 - DNA, 20 bp, Artificial Sequence
  Description of Artificial Sequence: Synthetic oligonucleotide
  Target: ATXN1; (-) strand; PAM type: YTN; PAM sequence: CTG
atgctttagggggatttaaa

SEQ ID NO: 190372 - DNA, 20 bp, Artificial Sequence
  Description of Artificial Sequence: Synthetic oligonucleotide
  Target: ATXN1; (-) strand; PAM type: YTN; PAM sequence: TTG
gagaactgatgctttagggg

SEQ ID NO: 190373 - DNA, 20 bp, Artificial Sequence
  Description of Artificial Sequence: Synthetic oligonucleotide
  Target: ATXN1; (-) strand; PAM type: YTN; PAM sequence: CTG
ggtggtcacaatgtgtagcc

SEQ ID NO: 190374 - DNA, 20 bp, Artificial Sequence
  Description of Artificial Sequence: Synthetic oligonucleotide
  Target: ATXN1; (-) strand; PAM type: YTN; PAM sequence: CTC
tgggtggtcacaatgtgtag

SEQ ID NO: 190375 - DNA, 20 bp, Artificial Sequence
  Description of Artificial Sequence: Synthetic oligonucleotide
  Target: ATXN1; (-) strand; PAM type: YTN; PAM sequence: CTC
tctgggtggtcacaatgtgt

SEQ ID NO: 190376 - DNA, 20 bp, Artificial Sequence
  Description of Artificial Sequence: Synthetic oligonucleotide
  Target: ATXN1; (-) strand; PAM type: YTN; PAM sequence: CTA
aatctctctgggtggtcaca

SEQ ID NO: 190377 - DNA, 20 bp, Artificial Sequence
  Description of Artificial Sequence: Synthetic oligonucleotide
  Target: ATXN1; (-) strand; PAM type: YTN; PAM sequence: TTC
taaatctctctgggtggtca

SEQ ID NO: 190378 - DNA, 20 bp, Artificial Sequence
  Description of Artificial Sequence: Synthetic oligonucleotide
  Target: ATXN1; (-) strand; PAM type: YTN; PAM sequence: TTT
ctaaatctctctgggtggtc

SEQ ID NO: 190379 - DNA, 20 bp, Artificial Sequence
  Description of Artificial Sequence: Synthetic oligonucleotide
  Target: ATXN1; (-) strand; PAM type: YTN; PAM sequence: CTT
tctaaatctctctgggtggt

SEQ ID NO: 190380 - DNA, 20 bp, Artificial Sequence
  Description of Artificial Sequence: Synthetic oligonucleotide
  Target: ATXN1; (-) strand; PAM type: YTN; PAM sequence: TTA
gtactttctaaatctctctg

SEQ ID NO: 190381 - DNA, 20 bp, Artificial Sequence
  Description of Artificial Sequence: Synthetic oligonucleotide
  Target: ATXN1; (-) strand; PAM type: YTN; PAM sequence: CTG
tgggtggaacccagacatta

SEQ ID NO: 190382 - DNA, 20 bp, Artificial Sequence
  Description of Artificial Sequence: Synthetic oligonucleotide
  Target: ATXN1; (-) strand; PAM type: YTN; PAM sequence: CTC
tgtgggtggaacccagacat

SEQ ID NO: 190383 - DNA, 20 bp, Artificial Sequence
  Description of Artificial Sequence: Synthetic oligonucleotide
  Target: ATXN1; (-) strand; PAM type: YTN; PAM sequence: TTA
agtaaggatctctgtgggtg

SEQ ID NO: 190384 - DNA, 20 bp, Artificial Sequence
  Description of Artificial Sequence: Synthetic oligonucleotide
  Target: ATXN1; (-) strand; PAM type: YTN; PAM sequence: CTG
agccataccccagaccagtt

SEQ ID NO: 190385 - DNA, 20 bp, Artificial Sequence
  Description of Artificial Sequence: Synthetic oligonucleotide
  Target: ATXN1; (-) strand; PAM type: YTN; PAM sequence: TTG
cctgagccataccccagacc

SEQ ID NO: 190386 - DNA, 20 bp, Artificial Sequence
  Description of Artificial Sequence: Synthetic oligonucleotide
  Target: ATXN1; (-) strand; PAM type: YTN; PAM sequence: CTA
ttgcctgagccataccccag

SEQ ID NO: 190387 - DNA, 20 bp, Artificial Sequence
  Description of Artificial Sequence: Synthetic oligonucleotide
  Target: ATXN1; (-) strand; PAM type: YTN; PAM sequence: TTC
tattgcctgagccatacccc

SEQ ID NO: 190388 - DNA, 20 bp, Artificial Sequence
  Description of Artificial Sequence: Synthetic oligonucleotide
  Target: ATXN1; (-) strand; PAM type: YTN; PAM sequence: TTC
caaaattctattgcctgagc

SEQ ID NO: 190389 - DNA, 20 bp, Artificial Sequence
  Description of Artificial Sequence: Synthetic oligonucleotide
  Target: ATXN1; (-) strand; PAM type: YTN; PAM sequence: TTT
ccaaaattctattgcctgag

SEQ ID NO: 190390 - DNA, 20 bp, Artificial Sequence
  Description of Artificial Sequence: Synthetic oligonucleotide
  Target: ATXN1; (-) strand; PAM type: YTN; PAM sequence: CTT
tccaaaattctattgcctga

SEQ ID NO: 190391 - DNA, 20 bp, Artificial Sequence
  Description of Artificial Sequence: Synthetic oligonucleotide
  Target: ATXN1; (-) strand; PAM type: YTN; PAM sequence: TTG
gggagctttccaaaattcta

SEQ ID NO: 190392 - DNA, 20 bp, Artificial Sequence
  Description of Artificial Sequence: Synthetic oligonucleotide
  Target: ATXN1; (-) strand; PAM type: YTN; PAM sequence: CTT
ggggagctttccaaaattct

SEQ ID NO: 190393 - DNA, 20 bp, Artificial Sequence
  Description of Artificial Sequence: Synthetic oligonucleotide
  Target: ATXN1; (-) strand; PAM type: YTN; PAM sequence: CTG
catagtagaatcacttgggg

SEQ ID NO: 190394 - DNA, 20 bp, Artificial Sequence
  Description of Artificial Sequence: Synthetic oligonucleotide
  Target: ATXN1; (-) strand; PAM type: YTN; PAM sequence: TTG
gctgcatagtagaatcactt

SEQ ID NO: 190395 - DNA, 20 bp, Artificial Sequence
  Description of Artificial Sequence: Synthetic oligonucleotide
  Target: ATXN1; (-) strand; PAM type: YTN; PAM sequence: CTT
ggctgcatagtagaatcact

SEQ ID NO: 190396 - DNA, 20 bp, Artificial Sequence
  Description of Artificial Sequence: Synthetic oligonucleotide
  Target: ATXN1; (-) strand; PAM type: YTN; PAM sequence: CTC
caccttggctgcatagtaga

SEQ ID NO: 190397 - DNA, 20 bp, Artificial Sequence
  Description of Artificial Sequence: Synthetic oligonucleotide
  Target: ATXN1; (-) strand; PAM type: YTN; PAM sequence: CTC
tccaccttggctgcatagta

SEQ ID NO: 190398 - DNA, 20 bp, Artificial Sequence
  Description of Artificial Sequence: Synthetic oligonucleotide
  Target: ATXN1; (-) strand; PAM type: YTN; PAM sequence: TTC
aggacagtgactctccacct

SEQ ID NO: 190399 - DNA, 20 bp, Artificial Sequence
  Description of Artificial Sequence: Synthetic oligonucleotide
  Target: ATXN1; (-) strand; PAM type: YTN; PAM sequence: CTT
caggacagtgactctccacc

SEQ ID NO: 190400 - DNA, 20 bp, Artificial Sequence
  Description of Artificial Sequence: Synthetic oligonucleotide
  Target: ATXN1; (-) strand; PAM type: YTN; PAM sequence: CTG
atgacttcaggacagtgact

SEQ ID NO: 190401 - DNA, 20 bp, Artificial Sequence
  Description of Artificial Sequence: Synthetic oligonucleotide
  Target: ATXN1; (-) strand; PAM type: YTN; PAM sequence: CTC
tgatgacttcaggacagtga

SEQ ID NO: 190402 - DNA, 20 bp, Artificial Sequence
  Description of Artificial Sequence: Synthetic oligonucleotide
  Target: ATXN1; (-) strand; PAM type: YTN; PAM sequence: TTG
tgggaggagtaggtggcaac

SEQ ID NO: 190403 - DNA, 20 bp, Artificial Sequence
  Description of Artificial Sequence: Synthetic oligonucleotide
  Target: ATXN1; (-) strand; PAM type: YTN; PAM sequence: TTT
gtgggaggagtaggtggcaa

SEQ ID NO: 190404 - DNA, 20 bp, Artificial Sequence
  Description of Artificial Sequence: Synthetic oligonucleotide
  Target: ATXN1; (-) strand; PAM type: YTN; PAM sequence: CTT
tgtgggaggagtaggtggca

SEQ ID NO: 190405 - DNA, 20 bp, Artificial Sequence
  Description of Artificial Sequence: Synthetic oligonucleotide
  Target: ATXN1; (-) strand; PAM type: YTN; PAM sequence: TTG
caagtggtgcaaggtgacaa

SEQ ID NO: 190406 - DNA, 20 bp, Artificial Sequence
  Description of Artificial Sequence: Synthetic oligonucleotide
  Target: ATXN1; (-) strand; PAM type: YTN; PAM sequence: CTT
gcaagtggtgcaaggtgaca

SEQ ID NO: 190407 - DNA, 20 bp, Artificial Sequence
  Description of Artificial Sequence: Synthetic oligonucleotide
  Target: ATXN1; (-) strand; PAM type: YTN; PAM sequence: TTG
cttgcaagtggtgcaaggtg

SEQ ID NO: 190408 - DNA, 20 bp, Artificial Sequence
  Description of Artificial Sequence: Synthetic oligonucleotide
  Target: ATXN1; (-) strand; PAM type: YTN; PAM sequence: CTA
attgcttgcaagtggtgcaa

SEQ ID NO: 190409 - DNA, 20 bp, Artificial Sequence
  Description of Artificial Sequence: Synthetic oligonucleotide
  Target: ATXN1; (-) strand; PAM type: YTN; PAM sequence: TTA
aaatcatgtaaatgtacatc

SEQ ID NO: 190410 - DNA, 20 bp, Artificial Sequence
  Description of Artificial Sequence: Synthetic oligonucleotide
  Target: ATXN1; (-) strand; PAM type: YTN; PAM sequence: TTT
aaaatcatgtaaatgtacat

SEQ ID NO: 190411 - DNA, 20 bp, Artificial Sequence
  Description of Artificial Sequence: Synthetic oligonucleotide
  Target: ATXN1; (-) strand; PAM type: YTN; PAM sequence: TTT
taaaatcatgtaaatgtaca

SEQ ID NO: 190412 - DNA, 20 bp, Artificial Sequence
  Description of Artificial Sequence: Synthetic oligonucleotide
  Target: ATXN1; (-) strand; PAM type: YTN; PAM sequence: CTT
ttaaaatcatgtaaatgtac

SEQ ID NO: 190413 - DNA, 20 bp, Artificial Sequence
  Description of Artificial Sequence: Synthetic oligonucleotide
  Target: ATXN1; (-) strand; PAM type: YTN; PAM sequence: TTA
atcggacatcataagacttt

SEQ ID NO: 190414 - DNA, 20 bp, Artificial Sequence
  Description of Artificial Sequence: Synthetic oligonucleotide
  Target: ATXN1; (-) strand; PAM type: YTN; PAM sequence: TTT
aatcggacatcataagactt

SEQ ID NO: 190415 - DNA, 20 bp, Artificial Sequence
  Description of Artificial Sequence: Synthetic oligonucleotide
  Target: ATXN1; (-) strand; PAM type: YTN; PAM sequence: TTT
taatcggacatcataagact

SEQ ID NO: 190416 - DNA, 20 bp, Artificial Sequence
  Description of Artificial Sequence: Synthetic oligonucleotide
  Target: ATXN1; (-) strand; PAM type: YTN; PAM sequence: TTA
gttttaatcggacatcataa

SEQ ID NO: 190417 - DNA, 20 bp, Artificial Sequence
  Description of Artificial Sequence: Synthetic oligonucleotide
  Target: ATXN1; (-) strand; PAM type: YTN; PAM sequence: TTG
ttagttttaatcggacatca

SEQ ID NO: 190418 - DNA, 20 bp, Artificial Sequence
  Description of Artificial Sequence: Synthetic oligonucleotide
  Target: ATXN1; (-) strand; PAM type: YTN; PAM sequence: TTT
gttagttttaatcggacatc

SEQ ID NO: 190419 - DNA, 20 bp, Artificial Sequence
  Description of Artificial Sequence: Synthetic oligonucleotide
  Target: ATXN1; (-) strand; PAM type: YTN; PAM sequence: TTT
tgttagttttaatcggacat

SEQ ID NO: 190420 - DNA, 20 bp, Artificial Sequence
  Description of Artificial Sequence: Synthetic oligonucleotide
  Target: ATXN1; (-) strand; PAM type: YTN; PAM sequence: TTC
aagttttgttagttttaatc

SEQ ID NO: 190421 - DNA, 20 bp, Artificial Sequence
  Description of Artificial Sequence: Synthetic oligonucleotide
  Target: ATXN1; (-) strand; PAM type: YTN; PAM sequence: CTG
atacaagaaattcaagtttt

SEQ ID NO: 190422 - DNA, 20 bp, Artificial Sequence
  Description of Artificial Sequence: Synthetic oligonucleotide
  Target: ATXN1; (-) strand; PAM type: YTN; PAM sequence: TTG
agaagagtgaatgataactg

SEQ ID NO: 190423 - DNA, 20 bp, Artificial Sequence
  Description of Artificial Sequence: Synthetic oligonucleotide
  Target: ATXN1; (-) strand; PAM type: YTN; PAM sequence: TTG
ttgagaagagtgaatgataa

SEQ ID NO: 190424 - DNA, 20 bp, Artificial Sequence
  Description of Artificial Sequence: Synthetic oligonucleotide
  Target: ATXN1; (-) strand; PAM type: YTN; PAM sequence: TTC
acacggttgttgagaagagt

SEQ ID NO: 190425 - DNA, 20 bp, Artificial Sequence
  Description of Artificial Sequence: Synthetic oligonucleotide
  Target: ATXN1; (-) strand; PAM type: YTN; PAM sequence: TTT
cacacggttgttgagaagag

SEQ ID NO: 190426 - DNA, 20 bp, Artificial Sequence
  Description of Artificial Sequence: Synthetic oligonucleotide
  Target: ATXN1; (-) strand; PAM type: YTN; PAM sequence: CTT
tcacacggttgttgagaaga

SEQ ID NO: 190427 - DNA, 20 bp, Artificial Sequence
  Description of Artificial Sequence: Synthetic oligonucleotide
  Target: ATXN1; (-) strand; PAM type: YTN; PAM sequence: TTA
ctttcacacggttgttgaga

SEQ ID NO: 190428 - DNA, 20 bp, Artificial Sequence
  Description of Artificial Sequence: Synthetic oligonucleotide
  Target: ATXN1; (-) strand; PAM type: YTN; PAM sequence: CTT
actttcacacggttgttgag

SEQ ID NO: 190429 - DNA, 20 bp, Artificial Sequence
  Description of Artificial Sequence: Synthetic oligonucleotide
  Target: ATXN1; (-) strand; PAM type: YTN; PAM sequence: CTC
gtgtgtcatatgggaacaat

SEQ ID NO: 190430 - DNA, 20 bp, Artificial Sequence
  Description of Artificial Sequence: Synthetic oligonucleotide
  Target: ATXN1; (-) strand; PAM type: YTN; PAM sequence: TTC
ctcgtgtgtcatatgggaac

SEQ ID NO: 190431 - DNA, 20 bp, Artificial Sequence
  Description of Artificial Sequence: Synthetic oligonucleotide
  Target: ATXN1; (-) strand; PAM type: YTN; PAM sequence: TTT
cctcgtgtgtcatatgggaa

SEQ ID NO: 190432 - DNA, 20 bp, Artificial Sequence
  Description of Artificial Sequence: Synthetic oligonucleotide
  Target: ATXN1; (-) strand; PAM type: YTN; PAM sequence: TTG
tttcctcgtgtgtcatatgg

SEQ ID NO: 190433 - DNA, 20 bp, Artificial Sequence
  Description of Artificial Sequence: Synthetic oligonucleotide
  Target: ATXN1; (-) strand; PAM type: YTN; PAM sequence: TTT
gtttcctcgtgtgtcatatg

SEQ ID NO: 190434 - DNA, 20 bp, Artificial Sequence
  Description of Artificial Sequence: Synthetic oligonucleotide
  Target: ATXN1; (-) strand; PAM type: YTN; PAM sequence: CTC
agagtttgtttcctcgtgtg

SEQ ID NO: 190435 - DNA, 20 bp, Artificial Sequence
  Description of Artificial Sequence: Synthetic oligonucleotide
  Target: ATXN1; (-) strand; PAM type: YTN; PAM sequence: CTC
tcagagtttgtttcctcgtg

SEQ ID NO: 190436 - DNA, 20 bp, Artificial Sequence
  Description of Artificial Sequence: Synthetic oligonucleotide
  Target: ATXN1; (-) strand; PAM type: YTN; PAM sequence: TTA
atctctcagagtttgtttcc

SEQ ID NO: 190437 - DNA, 20 bp, Artificial Sequence
  Description of Artificial Sequence: Synthetic oligonucleotide
  Target: ATXN1; (-) strand; PAM type: YTN; PAM sequence: TTA
attaatctctcagagtttgt

SEQ ID NO: 190438 - DNA, 20 bp, Artificial Sequence
  Description of Artificial Sequence: Synthetic oligonucleotide
  Target: ATXN1; (-) strand; PAM type: YTN; PAM sequence: CTT
aattaatctctcagagtttg

SEQ ID NO: 190439 - DNA, 20 bp, Artificial Sequence
  Description of Artificial Sequence: Synthetic oligonucleotide
  Target: ATXN1; (-) strand; PAM type: YTN; PAM sequence: CTG
tcgcttaattaatctctcag

SEQ ID NO: 190440 - DNA, 20 bp, Artificial Sequence
  Description of Artificial Sequence: Synthetic oligonucleotide
  Target: ATXN1; (-) strand; PAM type: YTN; PAM sequence: CTA
gggctgtcgcttaattaatc

SEQ ID NO: 190441 - DNA, 20 bp, Artificial Sequence
  Description of Artificial Sequence: Synthetic oligonucleotide
  Target: ATXN1; (-) strand; PAM type: YTN; PAM sequence: CTG
tgatctagggctgtcgctta

SEQ ID NO: 190442 - DNA, 20 bp, Artificial Sequence
  Description of Artificial Sequence: Synthetic oligonucleotide
  Target: ATXN1; (-) strand; PAM type: YTN; PAM sequence: TTC
tgtgatctagggctgtcgct

SEQ ID NO: 190443 - DNA, 20 bp, Artificial Sequence
  Description of Artificial Sequence: Synthetic oligonucleotide
  Target: ATXN1; (-) strand; PAM type: YTN; PAM sequence: TTC
caagttctgtgatctagggc

SEQ ID NO: 190444 - DNA, 20 bp, Artificial Sequence
  Description of Artificial Sequence: Synthetic oligonucleotide
  Target: ATXN1; (-) strand; PAM type: YTN; PAM sequence: CTT
ccaagttctgtgatctaggg

SEQ ID NO: 190445 - DNA, 20 bp, Artificial Sequence
  Description of Artificial Sequence: Synthetic oligonucleotide
  Target: ATXN1; (-) strand; PAM type: YTN; PAM sequence: CTG
ccacttccaagttctgtgat

SEQ ID NO: 190446 - DNA, 20 bp, Artificial Sequence
  Description of Artificial Sequence: Synthetic oligonucleotide
  Target: ATXN1; (-) strand; PAM type: YTN; PAM sequence: TTC
tgccacttccaagttctgtg

SEQ ID NO: 190447 - DNA, 20 bp, Artificial Sequence
  Description of Artificial Sequence: Synthetic oligonucleotide
  Target: ATXN1; (-) strand; PAM type: YTN; PAM sequence: TTT
ctgccacttccaagttctgt

SEQ ID NO: 190448 - DNA, 20 bp, Artificial Sequence
  Description of Artificial Sequence: Synthetic oligonucleotide
  Target: ATXN1; (-) strand; PAM type: YTN; PAM sequence: TTT
tctgccacttccaagttctg

SEQ ID NO: 190449 - DNA, 20 bp, Artificial Sequence
  Description of Artificial Sequence: Synthetic oligonucleotide
  Target: ATXN1; (-) strand; PAM type: YTN; PAM sequence: TTA
aaatcaattttctgccactt

SEQ ID NO: 190450 - DNA, 20 bp, Artificial Sequence
  Description of Artificial Sequence: Synthetic oligonucleotide
  Target: ATXN1; (-) strand; PAM type: YTN; PAM sequence: TTG
tattaaaatcaattttctgc

SEQ ID NO: 190451 - DNA, 20 bp, Artificial Sequence
  Description of Artificial Sequence: Synthetic oligonucleotide
  Target: ATXN1; (-) strand; PAM type: YTN; PAM sequence: TTG
aaacaattgtattaaaatca

SEQ ID NO: 190452 - DNA, 20 bp, Artificial Sequence
  Description of Artificial Sequence: Synthetic oligonucleotide
  Target: ATXN1; (-) strand; PAM type: YTN; PAM sequence: CTG
tggggttgaaacaattgtat

SEQ ID NO: 190453 - DNA, 20 bp, Artificial Sequence
  Description of Artificial Sequence: Synthetic oligonucleotide
  Target: ATXN1; (-) strand; PAM type: YTN; PAM sequence: TTA
taatgatacagactgtgggg

SEQ ID NO: 190454 - DNA, 20 bp, Artificial Sequence
  Description of Artificial Sequence: Synthetic oligonucleotide
  Target: ATXN1; (-) strand; PAM type: YTN; PAM sequence: CTG
ggagattataatgatacaga

SEQ ID NO: 190455 - DNA, 20 bp, Artificial Sequence
  Description of Artificial Sequence: Synthetic oligonucleotide
  Target: ATXN1; (-) strand; PAM type: YTN; PAM sequence: TTA
ctgggagattataatgatac

SEQ ID NO: 190456 - DNA, 20 bp, Artificial Sequence
  Description of Artificial Sequence: Synthetic oligonucleotide
  Target: ATXN1; (-) strand; PAM type: YTN; PAM sequence: TTG
aaattactgggagattataa

SEQ ID NO: 190457 - DNA, 20 bp, Artificial Sequence
  Description of Artificial Sequence: Synthetic oligonucleotide
  Target: ATXN1; (-) strand; PAM type: YTN; PAM sequence: TTT
gaaattactgggagattata

SEQ ID NO: 190458 - DNA, 20 bp, Artificial Sequence
  Description of Artificial Sequence: Synthetic oligonucleotide
  Target: ATXN1; (-) strand; PAM type: YTN; PAM sequence: TTT
tgaaattactgggagattat

SEQ ID NO: 190459 - DNA, 20 bp, Artificial Sequence
  Description of Artificial Sequence: Synthetic oligonucleotide
  Target: ATXN1; (-) strand; PAM type: YTN; PAM sequence: CTT
ttgaaattactgggagatta

SEQ ID NO: 190460 - DNA, 20 bp, Artificial Sequence
  Description of Artificial Sequence: Synthetic oligonucleotide
  Target: ATXN1; (-) strand; PAM type: YTN; PAM sequence: TTG
gcccttttgaaattactggg

SEQ ID NO: 190461 - DNA, 20 bp, Artificial Sequence
  Description of Artificial Sequence: Synthetic oligonucleotide
  Target: ATXN1; (-) strand; PAM type: YTN; PAM sequence: CTC
acagtggttggcccttttga

SEQ ID NO: 190462 - DNA, 20 bp, Artificial Sequence
  Description of Artificial Sequence: Synthetic oligonucleotide
  Target: ATXN1; (-) strand; PAM type: YTN; PAM sequence: TTA
catgcccacactcacagtgg

SEQ ID NO: 190463 - DNA, 20 bp, Artificial Sequence
  Description of Artificial Sequence: Synthetic oligonucleotide
  Target: ATXN1; (-) strand; PAM type: YTN; PAM sequence: TTG
aagatgcaaccaaattacat

SEQ ID NO: 190464 - DNA, 20 bp, Artificial Sequence
  Description of Artificial Sequence: Synthetic oligonucleotide
  Target: ATXN1; (-) strand; PAM type: YTN; PAM sequence: TTC
cacaagatgggtgccacatt

SEQ ID NO: 190465 - DNA, 20 bp, Artificial Sequence
  Description of Artificial Sequence: Synthetic oligonucleotide
  Target: ATXN1; (-) strand; PAM type: YTN; PAM sequence: CTC
gtcccattccacaagatggg

SEQ ID NO: 190466 - DNA, 20 bp, Artificial Sequence
  Description of Artificial Sequence: Synthetic oligonucleotide
  Target: ATXN1; (-) strand; PAM type: YTN; PAM sequence: TTA
tcccctcgtcccattccaca

SEQ ID NO: 190467 - DNA, 20 bp, Artificial Sequence
  Description of Artificial Sequence: Synthetic oligonucleotide
  Target: ATXN1; (-) strand; PAM type: YTN; PAM sequence: TTG
ttatcccctcgtcccattcc

SEQ ID NO: 190468 - DNA, 20 bp, Artificial Sequence
  Description of Artificial Sequence: Synthetic oligonucleotide
  Target: ATXN1; (-) strand; PAM type: YTN; PAM sequence: TTC
agcgagttgttatcccctcg

SEQ ID NO: 190469 - DNA, 20 bp, Artificial Sequence
  Description of Artificial Sequence: Synthetic oligonucleotide
  Target: ATXN1; (-) strand; PAM type: YTN; PAM sequence: CTT
cagcgagttgttatcccctc

SEQ ID NO: 190470 - DNA, 20 bp, Artificial Sequence
  Description of Artificial Sequence: Synthetic oligonucleotide
  Target: ATXN1; (-) strand; PAM type: YTN; PAM sequence: CTC
ttcagcgagttgttatcccc

SEQ ID NO: 190471 - DNA, 20 bp, Artificial Sequence
  Description of Artificial Sequence: Synthetic oligonucleotide
  Target: ATXN1; (-) strand; PAM type: YTN; PAM sequence: TTC
tcttcagcgagttgttatcc

SEQ ID NO: 190472 - DNA, 20 bp, Artificial Sequence
  Description of Artificial Sequence: Synthetic oligonucleotide
  Target: ATXN1; (-) strand; PAM type: YTN; PAM sequence: CTA
ttctcttcagcgagttgtta

SEQ ID NO: 190473 - DNA, 20 bp, Artificial Sequence
  Description of Artificial Sequence: Synthetic oligonucleotide
  Target: ATXN1; (-) strand; PAM type: YTN; PAM sequence: CTG
ctattctcttcagcgagttg

SEQ ID NO: 190474 - DNA, 20 bp, Artificial Sequence
  Description of Artificial Sequence: Synthetic oligonucleotide
  Target: ATXN1; (-) strand; PAM type: YTN; PAM sequence: CTC
acacacccacatgcatacaa

SEQ ID NO: 190475 - DNA, 20 bp, Artificial Sequence
  Description of Artificial Sequence: Synthetic oligonucleotide
  Target: ATXN1; (-) strand; PAM type: YTN; PAM sequence: TTA
tgtacactcacacacccaca

SEQ ID NO: 190476 - DNA, 20 bp, Artificial Sequence
  Description of Artificial Sequence: Synthetic oligonucleotide
  Target: ATXN1; (-) strand; PAM type: YTN; PAM sequence: CTT
atgtacactcacacacccac

SEQ ID NO: 190477 - DNA, 20 bp, Artificial Sequence
  Description of Artificial Sequence: Synthetic oligonucleotide
  Target: ATXN1; (-) strand; PAM type: YTN; PAM sequence: TTA
ggtggacatacacttatgta

SEQ ID NO: 190478 - DNA, 20 bp, Artificial Sequence
  Description of Artificial Sequence: Synthetic oligonucleotide
  Target: ATXN1; (-) strand; PAM type: YTN; PAM sequence: CTT
aggtggacatacacttatgt

SEQ ID NO: 190479 - DNA, 20 bp, Artificial Sequence
  Description of Artificial Sequence: Synthetic oligonucleotide
  Target: ATXN1; (-) strand; PAM type: YTN; PAM sequence: TTC
cttaggtggacatacactta

SEQ ID NO: 190480 - DNA, 20 bp, Artificial Sequence
  Description of Artificial Sequence: Synthetic oligonucleotide
  Target: ATXN1; (-) strand; PAM type: YTN; PAM sequence: TTT
ccttaggtggacatacactt

SEQ ID NO: 190481 - DNA, 20 bp, Artificial Sequence
  Description of Artificial Sequence: Synthetic oligonucleotide
  Target: ATXN1; (-) strand; PAM type: YTN; PAM sequence: CTT
tccttaggtggacatacact

SEQ ID NO: 190482 - DNA, 20 bp, Artificial Sequence
  Description of Artificial Sequence: Synthetic oligonucleotide
  Target: ATXN1; (-) strand; PAM type: YTN; PAM sequence: TTG
aggtccactttccttaggtg

SEQ ID NO: 190483 - DNA, 20 bp, Artificial Sequence
  Description of Artificial Sequence: Synthetic oligonucleotide
  Target: ATXN1; (-) strand; PAM type: YTN; PAM sequence: CTT
gaggtccactttccttaggt

SEQ ID NO: 190484 - DNA, 20 bp, Artificial Sequence
  Description of Artificial Sequence: Synthetic oligonucleotide
  Target: ATXN1; (-) strand; PAM type: YTN; PAM sequence: TTC
agatatacccttgaggtcca

SEQ ID NO: 190485 - DNA, 20 bp, Artificial Sequence
  Description of Artificial Sequence: Synthetic oligonucleotide
  Target: ATXN1; (-) strand; PAM type: YTN; PAM sequence: CTC
aattcagatatacccttgag

SEQ ID NO: 190486 - DNA, 20 bp, Artificial Sequence
  Description of Artificial Sequence: Synthetic oligonucleotide
  Target: ATXN1; (-) strand; PAM type: YTN; PAM sequence: TTC
tcaattcagatatacccttg

SEQ ID NO: 190487 - DNA, 20 bp, Artificial Sequence
  Description of Artificial Sequence: Synthetic oligonucleotide
  Target: ATXN1; (-) strand; PAM type: YTN; PAM sequence: TTT
ctcaattcagatataccctt

SEQ ID NO: 190488 - DNA, 20 bp, Artificial Sequence
  Description of Artificial Sequence: Synthetic oligonucleotide
  Target: ATXN1; (-) strand; PAM type: YTN; PAM sequence: TTG
ggccatatgtttctcaattc

SEQ ID NO: 190489 - DNA, 20 bp, Artificial Sequence
  Description of Artificial Sequence: Synthetic oligonucleotide
  Target: ATXN1; (-) strand; PAM type: YTN; PAM sequence: TTG
tagttgggccatatgtttct

SEQ ID NO: 190490 - DNA, 20 bp, Artificial Sequence
  Description of Artificial Sequence: Synthetic oligonucleotide
  Target: ATXN1; (-) strand; PAM type: YTN; PAM sequence: CTT
gtagttgggccatatgtttc

SEQ ID NO: 190491 - DNA, 20 bp, Artificial Sequence
  Description of Artificial Sequence: Synthetic oligonucleotide
  Target: ATXN1; (-) strand; PAM type: YTN; PAM sequence: TTC
ttgtagttgggccatatgtt

SEQ ID NO: 190492 - DNA, 20 bp, Artificial Sequence
  Description of Artificial Sequence: Synthetic oligonucleotide
  Target: ATXN1; (-) strand; PAM type: YTN; PAM sequence: CTT
cttgtagttgggccatatgt

SEQ ID NO: 190493 - DNA, 20 bp, Artificial Sequence
  Description of Artificial Sequence: Synthetic oligonucleotide
  Target: ATXN1; (-) strand; PAM type: YTN; PAM sequence: CTA
cccaggtaccttcttgtagt

SEQ ID NO: 190494 - DNA, 20 bp, Artificial Sequence
  Description of Artificial Sequence: Synthetic oligonucleotide
  Target: ATXN1; (-) strand; PAM type: YTN; PAM sequence: CTG
aaaaccctacccaggtacct

SEQ ID NO: 190495 - DNA, 20 bp, Artificial Sequence
  Description of Artificial Sequence: Synthetic oligonucleotide
  Target: ATXN1; (-) strand; PAM type: YTN; PAM sequence: CTC
tgaaaaccctacccaggtac

SEQ ID NO: 190496 - DNA, 20 bp, Artificial Sequence
  Description of Artificial Sequence: Synthetic oligonucleotide
  Target: ATXN1; (-) strand; PAM type: YTN; PAM sequence: CTA
catctctgaaaaccctaccc

SEQ ID NO: 190497 - DNA, 20 bp, Artificial Sequence
  Description of Artificial Sequence: Synthetic oligonucleotide
  Target: ATXN1; (-) strand; PAM type: YTN; PAM sequence: TTA
ctacatctctgaaaacccta

SEQ ID NO: 190498 - DNA, 20 bp, Artificial Sequence
  Description of Artificial Sequence: Synthetic oligonucleotide
  Target: ATXN1; (-) strand; PAM type: YTN; PAM sequence: TTG
gaaagaattactacatctct

SEQ ID NO: 190499 - DNA, 20 bp, Artificial Sequence
  Description of Artificial Sequence: Synthetic oligonucleotide
  Target: ATXN1; (-) strand; PAM type: YTN; PAM sequence: CTT
ggaaagaattactacatctc

SEQ ID NO: 190500 - DNA, 20 bp, Artificial Sequence
  Description of Artificial Sequence: Synthetic oligonucleotide
  Target: ATXN1; (-) strand; PAM type: YTN; PAM sequence: TTA
tcacatcttggaaagaatta

SEQ ID NO: 190501 - DNA, 20 bp, Artificial Sequence
  Description of Artificial Sequence: Synthetic oligonucleotide
  Target: ATXN1; (-) strand; PAM type: YTN; PAM sequence: CTT
atcacatcttggaaagaatt

SEQ ID NO: 190502 - DNA, 20 bp, Artificial Sequence
  Description of Artificial Sequence: Synthetic oligonucleotide
  Target: ATXN1; (-) strand; PAM type: YTN; PAM sequence: TTA
ccagtcttatcacatcttgg

SEQ ID NO: 190503 - DNA, 20 bp, Artificial Sequence
  Description of Artificial Sequence: Synthetic oligonucleotide
  Target: ATXN1; (-) strand; PAM type: YTN; PAM sequence: TTT
accagtcttatcacatcttg

SEQ ID NO: 190504 - DNA, 20 bp, Artificial Sequence
  Description of Artificial Sequence: Synthetic oligonucleotide
  Target: ATXN1; (-) strand; PAM type: YTN; PAM sequence: TTT
taccagtcttatcacatctt

SEQ ID NO: 190505 - DNA, 20 bp, Artificial Sequence
  Description of Artificial Sequence: Synthetic oligonucleotide
  Target: ATXN1; (-) strand; PAM type: YTN; PAM sequence: CTT
ttaccagtcttatcacatct

SEQ ID NO: 190506 - DNA, 20 bp, Artificial Sequence
  Description of Artificial Sequence: Synthetic oligonucleotide
  Target: ATXN1; (-) strand; PAM type: YTN; PAM sequence: TTC
atgaccttttaccagtctta

SEQ ID NO: 190507 - DNA, 20 bp, Artificial Sequence
  Description of Artificial Sequence: Synthetic oligonucleotide
  Target: ATXN1; (-) strand; PAM type: YTN; PAM sequence: TTT
catgaccttttaccagtctt

SEQ ID NO: 190508 - DNA, 20 bp, Artificial Sequence
  Description of Artificial Sequence: Synthetic oligonucleotide
  Target: ATXN1; (-) strand; PAM type: YTN; PAM sequence: TTA
tcataatgaagatatttcat

SEQ ID NO: 190509 - DNA, 20 bp, Artificial Sequence
  Description of Artificial Sequence: Synthetic oligonucleotide
  Target: ATXN1; (-) strand; PAM type: YTN; PAM sequence: TTT
atcataatgaagatatttca

SEQ ID NO: 190510 - DNA, 20 bp, Artificial Sequence
  Description of Artificial Sequence: Synthetic oligonucleotide
  Target: ATXN1; (-) strand; PAM type: YTN; PAM sequence: TTT
tatcataatgaagatatttc

SEQ ID NO: 190511 - DNA, 20 bp, Artificial Sequence
  Description of Artificial Sequence: Synthetic oligonucleotide
  Target: ATXN1; (-) strand; PAM type: YTN; PAM sequence: TTT
ttatcataatgaagatattt

SEQ ID NO: 190512 - DNA, 20 bp, Artificial Sequence
  Description of Artificial Sequence: Synthetic oligonucleotide
  Target: ATXN1; (-) strand; PAM type: YTN; PAM sequence: TTT
tttatcataatgaagatatt

SEQ ID NO: 190513 - DNA, 20 bp, Artificial Sequence
  Description of Artificial Sequence: Synthetic oligonucleotide
  Target: ATXN1; (-) strand; PAM type: YTN; PAM sequence: TTT
ttttatcataatgaagatat

SEQ ID NO: 190514 - DNA, 20 bp, Artificial Sequence
  Description of Artificial Sequence: Synthetic oligonucleotide
  Target: ATXN1; (-) strand; PAM type: YTN; PAM sequence: TTT
tttttatcataatgaagata

SEQ ID NO: 190515 - DNA, 20 bp, Artificial Sequence
  Description of Artificial Sequence: Synthetic oligonucleotide
  Target: ATXN1; (-) strand; PAM type: YTN; PAM sequence: TTT
ttttttatcataatgaagat

SEQ ID NO: 190516 - DNA, 20 bp, Artificial Sequence
  Description of Artificial Sequence: Synthetic oligonucleotide
  Target: ATXN1; (-) strand; PAM type: YTN; PAM sequence: TTT
tttttttatcataatgaaga

SEQ ID NO: 190517 - DNA, 20 bp, Artificial Sequence
  Description of Artificial Sequence: Synthetic oligonucleotide
  Target: ATXN1; (-) strand; PAM type: YTN; PAM sequence: TTT
ttttttttatcataatgaag

SEQ ID NO: 190518 - DNA, 20 bp, Artificial Sequence
  Description of Artificial Sequence: Synthetic oligonucleotide
  Target: ATXN1; (-) strand; PAM type: YTN; PAM sequence: TTT
tttttttttatcataatgaa

SEQ ID NO: 190519 - DNA, 20 bp, Artificial Sequence
  Description of Artificial Sequence: Synthetic oligonucleotide
  Target: ATXN1; (-) strand; PAM type: YTN; PAM sequence: TTT
ttttttttttatcataatga

SEQ ID NO: 190520 - DNA, 20 bp, Artificial Sequence
  Description of Artificial Sequence: Synthetic oligonucleotide
  Target: ATXN1; (-) strand; PAM type: YTN; PAM sequence: TTT
tttttttttttatcataatg

SEQ ID NO: 190521 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttatcataat

SEQ ID NO: 190522 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttatcataa

SEQ ID NO: 190523 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttatcata

SEQ ID NO: 190524 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttatcat

SEQ ID NO: 190525 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttatca

SEQ ID NO: 190526 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttatc

SEQ ID NO: 190527 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttat

SEQ ID NO: 190528 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttta

SEQ ID NO: 190529 - DNA, 20 bp, Artificial Sequence
  Description of Artificial Sequence: Synthetic oligonucleotide
  Target: ATXN1; (-) strand; PAM type: YTN; PAM sequence: CTC
aatgtttttttttttttttt

SEQ ID NO: 190530 - DNA, 20 bp, Artificial Sequence
  Description of Artificial Sequence: Synthetic oligonucleotide
  Target: ATXN1; (-) strand; PAM type: YTN; PAM sequence: TTC
ctcaatgttttttttttttt

SEQ ID NO: 190531 - DNA, 20 bp, Artificial Sequence
  Description of Artificial Sequence: Synthetic oligonucleotide
  Target: ATXN1; (-) strand; PAM type: YTN; PAM sequence: TTT
cctcaatgtttttttttttt

SEQ ID NO: 190532 - DNA, 20 bp, Artificial Sequence
  Description of Artificial Sequence: Synthetic oligonucleotide
  Target: ATXN1; (-) strand; PAM type: YTN; PAM sequence: TTG
gtagtttcctcaatgttttt

SEQ ID NO: 190533 - DNA, 20 bp, Artificial Sequence
  Description of Artificial Sequence: Synthetic oligonucleotide
  Target: ATXN1; (-) strand; PAM type: YTN; PAM sequence: TTA
gatgaatccataaatgaatg

SEQ ID NO: 190534 - DNA, 20 bp, Artificial Sequence
  Description of Artificial Sequence: Synthetic oligonucleotide
  Target: ATXN1; (-) strand; PAM type: YTN; PAM sequence: CTA
tatatgggcattagatgaat

SEQ ID NO: 190535 - DNA, 20 bp, Artificial Sequence
  Description of Artificial Sequence: Synthetic oligonucleotide
  Target: ATXN1; (-) strand; PAM type: YTN; PAM sequence: TTG
taatctatatatgggcatta

SEQ ID NO: 190536 - DNA, 20 bp, Artificial Sequence
  Description of Artificial Sequence: Synthetic oligonucleotide
  Target: ATXN1; (-) strand; PAM type: YTN; PAM sequence: TTT
gtaatctatatatgggcatt

SEQ ID NO: 190537 - DNA, 20 bp, Artificial Sequence
  Description of Artificial Sequence: Synthetic oligonucleotide
  Target: ATXN1; (-) strand; PAM type: YTN; PAM sequence: CTT
tgtaatctatatatgggcat

SEQ ID NO: 190538 - DNA, 20 bp, Artificial Sequence
  Description of Artificial Sequence: Synthetic oligonucleotide
  Target: ATXN1; (-) strand; PAM type: YTN; PAM sequence: TTA
agctttgtaatctatatatg

SEQ ID NO: 190539 - DNA, 20 bp, Artificial Sequence
  Description of Artificial Sequence: Synthetic oligonucleotide
  Target: ATXN1; (-) strand; PAM type: YTN; PAM sequence: CTG
attaagctttgtaatctata

SEQ ID NO: 190540 - DNA, 20 bp, Artificial Sequence
  Description of Artificial Sequence: Synthetic oligonucleotide
  Target: ATXN1; (-) strand; PAM type: YTN; PAM sequence: CTA
ctgattaagctttgtaatct

SEQ ID NO: 190541 - DNA, 20 bp, Artificial Sequence
  Description of Artificial Sequence: Synthetic oligonucleotide
  Target: ATXN1; (-) strand; PAM type: YTN; PAM sequence: CTC
actactgattaagctttgta

SEQ ID NO: 190542 - DNA, 20 bp, Artificial Sequence
  Description of Artificial Sequence: Synthetic oligonucleotide
  Target: ATXN1; (-) strand; PAM type: YTN; PAM sequence: TTG
tcactcactactgattaagc

SEQ ID NO: 190543 - DNA, 20 bp, Artificial Sequence
  Description of Artificial Sequence: Synthetic oligonucleotide
  Target: ATXN1; (-) strand; PAM type: YTN; PAM sequence: CTT
gtcactcactactgattaag

SEQ ID NO: 190544 - DNA, 20 bp, Artificial Sequence
  Description of Artificial Sequence: Synthetic oligonucleotide
  Target: ATXN1; (-) strand; PAM type: YTN; PAM sequence: TTC
agtcttgtcactcactactg

SEQ ID NO: 190545 - DNA, 20 bp, Artificial Sequence
  Description of Artificial Sequence: Synthetic oligonucleotide
  Target: ATXN1; (-) strand; PAM type: YTN; PAM sequence: CTT
cagtcttgtcactcactact

SEQ ID NO: 190546 - DNA, 20 bp, Artificial Sequence
  Description of Artificial Sequence: Synthetic oligonucleotide
  Target: ATXN1; (-) strand; PAM type: YTN; PAM sequence: TTC
ttcagtcttgtcactcacta

SEQ ID NO: 190547 - DNA, 20 bp, Artificial Sequence
  Description of Artificial Sequence: Synthetic oligonucleotide
  Target: ATXN1; (-) strand; PAM type: YTN; PAM sequence: CTG
atattcttcagtcttgtcac

SEQ ID NO: 190548 - DNA, 20 bp, Artificial Sequence
  Description of Artificial Sequence: Synthetic oligonucleotide
  Target: ATXN1; (-) strand; PAM type: YTN; PAM sequence: TTG
cctgatattcttcagtcttg

SEQ ID NO: 190549 - DNA, 20 bp, Artificial Sequence
  Description of Artificial Sequence: Synthetic oligonucleotide
  Target: ATXN1; (-) strand; PAM type: YTN; PAM sequence: TTT
gcctgatattcttcagtctt

SEQ ID NO: 190550 - DNA, 20 bp, Artificial Sequence
  Description of Artificial Sequence: Synthetic oligonucleotide
  Target: ATXN1; (-) strand; PAM type: YTN; PAM sequence: TTT
tgcctgatattcttcagtct

SEQ ID NO: 190551 - DNA, 20 bp, Artificial Sequence
  Description of Artificial Sequence: Synthetic oligonucleotide
  Target: ATXN1; (-) strand; PAM type: YTN; PAM sequence: TTT
ttgcctgatattcttcagtc

SEQ ID NO: 190552 - DNA, 20 bp, Artificial Sequence
  Description of Artificial Sequence: Synthetic oligonucleotide
  Target: ATXN1; (-) strand; PAM type: YTN; PAM sequence: TTA
agtatgggagatttttgcct

SEQ ID NO: 190553 - DNA, 20 bp, Artificial Sequence
  Description of Artificial Sequence: Synthetic oligonucleotide
  Target: ATXN1; (-) strand; PAM type: YTN; PAM sequence: TTT
aagtatgggagatttttgcc

SEQ ID NO: 190554 - DNA, 20 bp, Artificial Sequence
  Description of Artificial Sequence: Synthetic oligonucleotide
  Target: ATXN1; (-) strand; PAM type: YTN; PAM sequence: CTG
aatatttaagtatgggagat

SEQ ID NO: 190555 - DNA, 20 bp, Artificial Sequence
  Description of Artificial Sequence: Synthetic oligonucleotide
  Target: ATXN1; (-) strand; PAM type: YTN; PAM sequence: TTA
taagaacctgaatatttaag

SEQ ID NO: 190556 - DNA, 20 bp, Artificial Sequence
  Description of Artificial Sequence: Synthetic oligonucleotide
  Target: ATXN1; (-) strand; PAM type: YTN; PAM sequence: CTA
ttataagaacctgaatattt

SEQ ID NO: 190557 - DNA, 20 bp, Artificial Sequence
  Description of Artificial Sequence: Synthetic oligonucleotide
  Target: ATXN1; (-) strand; PAM type: YTN; PAM sequence: TTG
tctattataagaacctgaat

SEQ ID NO: 190558 - DNA, 20 bp, Artificial Sequence
  Description of Artificial Sequence: Synthetic oligonucleotide
  Target: ATXN1; (-) strand; PAM type: YTN; PAM sequence: CTT
gtctattataagaacctgaa

SEQ ID NO: 190559 - DNA, 20 bp, Artificial Sequence
  Description of Artificial Sequence: Synthetic oligonucleotide
  Target: ATXN1; (-) strand; PAM type: YTN; PAM sequence: TTG
tgtcttgtctattataagaa

SEQ ID NO: 190560 - DNA, 20 bp, Artificial Sequence
  Description of Artificial Sequence: Synthetic oligonucleotide
  Target: ATXN1; (-) strand; PAM type: YTN; PAM sequence: TTA
tgtggaaattgtgtcttgtc

SEQ ID NO: 190561 - DNA, 20 bp, Artificial Sequence
  Description of Artificial Sequence: Synthetic oligonucleotide
  Target: ATXN1; (-) strand; PAM type: YTN; PAM sequence: TTG
gcagacaagatgatattatg

SEQ ID NO: 190562 - DNA, 20 bp, Artificial Sequence
  Description of Artificial Sequence: Synthetic oligonucleotide
  Target: ATXN1; (-) strand; PAM type: YTN; PAM sequence: TTA
atgtgccccatgcattggca

SEQ ID NO: 190563 - DNA, 20 bp, Artificial Sequence
  Description of Artificial Sequence: Synthetic oligonucleotide
  Target: ATXN1; (-) strand; PAM type: YTN; PAM sequence: CTA
gttaatgtgccccatgcatt

SEQ ID NO: 190564 - DNA, 20 bp, Artificial Sequence
  Description of Artificial Sequence: Synthetic oligonucleotide
  Target: ATXN1; (-) strand; PAM type: YTN; PAM sequence: TTG
tgtcaaggctagttaatgtg

SEQ ID NO: 190565 - DNA, 20 bp, Artificial Sequence
  Description of Artificial Sequence: Synthetic oligonucleotide
  Target: ATXN1; (-) strand; PAM type: YTN; PAM sequence: CTA
ttgtgtcaaggctagttaat

SEQ ID NO: 190566 - DNA, 20 bp, Artificial Sequence
  Description of Artificial Sequence: Synthetic oligonucleotide
  Target: ATXN1; (-) strand; PAM type: YTN; PAM sequence: CTA
ctattgtgtcaaggctagtt

SEQ ID NO: 190567 - DNA, 20 bp, Artificial Sequence
  Description of Artificial Sequence: Synthetic oligonucleotide
  Target: ATXN1; (-) strand; PAM type: YTN; PAM sequence: TTC
tactattgtgtcaaggctag

SEQ ID NO: 190568 - DNA, 20 bp, Artificial Sequence
  Description of Artificial Sequence: Synthetic oligonucleotide
  Target: ATXN1; (-) strand; PAM type: YTN; PAM sequence: TTG
ttctactattgtgtcaaggc

SEQ ID NO: 190569 - DNA, 20 bp, Artificial Sequence
  Description of Artificial Sequence: Synthetic oligonucleotide
  Target: ATXN1; (-) strand; PAM type: YTN; PAM sequence: TTT
gttctactattgtgtcaagg

SEQ ID NO: 190570 - DNA, 20 bp, Artificial Sequence
  Description of Artificial Sequence: Synthetic oligonucleotide
  Target: ATXN1; (-) strand; PAM type: YTN; PAM sequence: CTG
atttgttctactattgtgtc

SEQ ID NO: 190571 - DNA, 20 bp, Artificial Sequence
  Description of Artificial Sequence: Synthetic oligonucleotide
  Target: ATXN1; (-) strand; PAM type: YTN; PAM sequence: TTC
tgatttgttctactattgtg

SEQ ID NO: 190572 - DNA, 20 bp, Artificial Sequence
  Description of Artificial Sequence: Synthetic oligonucleotide
  Target: ATXN1; (-) strand; PAM type: YTN; PAM sequence: TTA
ccaattctgatttgttctac

SEQ ID NO: 190573 - DNA, 20 bp, Artificial Sequence
  Description of Artificial Sequence: Synthetic oligonucleotide
  Target: ATXN1; (-) strand; PAM type: YTN; PAM sequence: TTT
accaattctgatttgttcta

SEQ ID NO: 190574 - DNA, 20 bp, Artificial Sequence
  Description of Artificial Sequence: Synthetic oligonucleotide
  Target: ATXN1; (-) strand; PAM type: YTN; PAM sequence: TTT
taccaattctgatttgttct

SEQ ID NO: 190575 - DNA, 20 bp, Artificial Sequence
  Description of Artificial Sequence: Synthetic oligonucleotide
  Target: ATXN1; (-) strand; PAM type: YTN; PAM sequence: TTA
ataatacattttaccaattc

SEQ ID NO: 190576 - DNA, 20 bp, Artificial Sequence
  Description of Artificial Sequence: Synthetic oligonucleotide
  Target: ATXN1; (-) strand; PAM type: YTN; PAM sequence: CTA
ccatcattaataatacattt

SEQ ID NO: 190577 - DNA, 20 bp, Artificial Sequence
  Description of Artificial Sequence: Synthetic oligonucleotide
  Target: ATXN1; (-) strand; PAM type: YTN; PAM sequence: TTC
taccatcattaataatacat

SEQ ID NO: 190578 - DNA, 20 bp, Artificial Sequence
  Description of Artificial Sequence: Synthetic oligonucleotide
  Target: ATXN1; (-) strand; PAM type: YTN; PAM sequence: TTT
ctaccatcattaataataca

SEQ ID NO: 190579 - DNA, 20 bp, Artificial Sequence
  Description of Artificial Sequence: Synthetic oligonucleotide
  Target: ATXN1; (-) strand; PAM type: YTN; PAM sequence: TTC
ccaatttctaccatcattaa

SEQ ID NO: 190580 - DNA, 20 bp, Artificial Sequence
  Description of Artificial Sequence: Synthetic oligonucleotide
  Target: ATXN1; (-) strand; PAM type: YTN; PAM sequence: CTT
cccaatttctaccatcatta

SEQ ID NO: 190581 - DNA, 20 bp, Artificial Sequence
  Description of Artificial Sequence: Synthetic oligonucleotide
  Target: ATXN1; (-) strand; PAM type: YTN; PAM sequence: CTC
acttcccaatttctaccatc

SEQ ID NO: 190582 - DNA, 20 bp, Artificial Sequence
  Description of Artificial Sequence: Synthetic oligonucleotide
  Target: ATXN1; (-) strand; PAM type: YTN; PAM sequence: TTA
aaataagagaaaaaagtgac

SEQ ID NO: 190583 - DNA, 20 bp, Artificial Sequence
  Description of Artificial Sequence: Synthetic oligonucleotide
  Target: ATXN1; (-) strand; PAM type: YTN; PAM sequence: TTT
aaaataagagaaaaaagtga

SEQ ID NO: 190584 - DNA, 20 bp, Artificial Sequence
  Description of Artificial Sequence: Synthetic oligonucleotide
  Target: ATXN1; (-) strand; PAM type: YTN; PAM sequence: TTG
agtgcaccagtttaaaataa

SEQ ID NO: 190585 - DNA, 20 bp, Artificial Sequence
  Description of Artificial Sequence: Synthetic oligonucleotide
  Target: ATXN1; (-) strand; PAM type: YTN; PAM sequence: TTT
gagtgcaccagtttaaaata

SEQ ID NO: 190586 - DNA, 20 bp, Artificial Sequence
  Description of Artificial Sequence: Synthetic oligonucleotide
  Target: ATXN1; (-) strand; PAM type: YTN; PAM sequence: CTA
cacatttgagtgcaccagtt

SEQ ID NO: 190587 - DNA, 20 bp, Artificial Sequence
  Description of Artificial Sequence: Synthetic oligonucleotide
  Target: ATXN1; (-) strand; PAM type: YTN; PAM sequence: CTC
acgcacatgcacaaacctac

SEQ ID NO: 190588 - DNA, 20 bp, Artificial Sequence
  Description of Artificial Sequence: Synthetic oligonucleotide
  Target: ATXN1; (-) strand; PAM type: YTN; PAM sequence: TTG
tgtgtatgcatgtgtgcatg

SEQ ID NO: 190589 - DNA, 20 bp, Artificial Sequence
  Description of Artificial Sequence: Synthetic oligonucleotide
  Target: ATXN1; (-) strand; PAM type: YTN; PAM sequence: TTG
tgtgtgattgtgtgtatgca

SEQ ID NO: 190590 - DNA, 20 bp, Artificial Sequence
  Description of Artificial Sequence: Synthetic oligonucleotide
  Target: ATXN1; (-) strand; PAM type: YTN; PAM sequence: CTT
gtgtgtgattgtgtgtatgc

SEQ ID NO: 190591 - DNA, 20 bp, Artificial Sequence
  Description of Artificial Sequence: Synthetic oligonucleotide
  Target: ATXN1; (-) strand; PAM type: YTN; PAM sequence: CTC
aagccttgtgtgtgattgtg

SEQ ID NO: 190592 - DNA, 20 bp, Artificial Sequence
  Description of Artificial Sequence: Synthetic oligonucleotide
  Target: ATXN1; (-) strand; PAM type: YTN; PAM sequence: TTC
actcaagccttgtgtgtgat

SEQ ID NO: 190593 - DNA, 20 bp, Artificial Sequence
  Description of Artificial Sequence: Synthetic oligonucleotide
  Target: ATXN1; (-) strand; PAM type: YTN; PAM sequence: CTT
cactcaagccttgtgtgtga

SEQ ID NO: 190594 - DNA, 20 bp, Artificial Sequence
  Description of Artificial Sequence: Synthetic oligonucleotide
  Target: ATXN1; (-) strand; PAM type: YTN; PAM sequence: CTG
aaatggagtcttcactcaag

SEQ ID NO: 190595 - DNA, 20 bp, Artificial Sequence
  Description of Artificial Sequence: Synthetic oligonucleotide
  Target: ATXN1; (-) strand; PAM type: YTN; PAM sequence: CTG
tgaacaatggcagaactgaa

SEQ ID NO: 190596 - DNA, 20 bp, Artificial Sequence
  Description of Artificial Sequence: Synthetic oligonucleotide
  Target: ATXN1; (-) strand; PAM type: YTN; PAM sequence: TTA
ggcctgtgaacaatggcaga

SEQ ID NO: 190597 - DNA, 20 bp, Artificial Sequence
  Description of Artificial Sequence: Synthetic oligonucleotide
  Target: ATXN1; (-) strand; PAM type: YTN; PAM sequence: TTG
ttaggcctgtgaacaatggc

SEQ ID NO: 190598 - DNA, 20 bp, Artificial Sequence
  Description of Artificial Sequence: Synthetic oligonucleotide
  Target: ATXN1; (-) strand; PAM type: YTN; PAM sequence: TTA
aggaaaagtaagttgttagg

SEQ ID NO: 190599 - DNA, 20 bp, Artificial Sequence
  Description of Artificial Sequence: Synthetic oligonucleotide
  Target: ATXN1; (-) strand; PAM type: YTN; PAM sequence: TTT
aaggaaaagtaagttgttag

SEQ ID NO: 190600 - DNA, 20 bp, Artificial Sequence
  Description of Artificial Sequence: Synthetic oligonucleotide
  Target: ATXN1; (-) strand; PAM type: YTN; PAM sequence: TTT
taaggaaaagtaagttgtta

SEQ ID NO: 190601 - DNA, 20 bp, Artificial Sequence
  Description of Artificial Sequence: Synthetic oligonucleotide
  Target: ATXN1; (-) strand; PAM type: YTN; PAM sequence: TTG
ttttaaggaaaagtaagttg

SEQ ID NO: 190602 - DNA, 20 bp, Artificial Sequence
  Description of Artificial Sequence: Synthetic oligonucleotide
  Target: ATXN1; (-) strand; PAM type: YTN; PAM sequence: CTT
gttttaaggaaaagtaagtt

SEQ ID NO: 190603 - DNA, 20 bp, Artificial Sequence
  Description of Artificial Sequence: Synthetic oligonucleotide
  Target: ATXN1; (-) strand; PAM type: YTN; PAM sequence: TTC
cttgttttaaggaaaagtaa

SEQ ID NO: 190604 - DNA, 20 bp, Artificial Sequence
  Description of Artificial Sequence: Synthetic oligonucleotide
  Target: ATXN1; (-) strand; PAM type: YTN; PAM sequence: TTT
ccttgttttaaggaaaagta

SEQ ID NO: 190605 - DNA, 20 bp, Artificial Sequence
  Description of Artificial Sequence: Synthetic oligonucleotide
  Target: ATXN1; (-) strand; PAM type: YTN; PAM sequence: CTT
tccttgttttaaggaaaagt

SEQ ID NO: 190606 - DNA, 20 bp, Artificial Sequence
  Description of Artificial Sequence: Synthetic oligonucleotide
  Target: ATXN1; (-) strand; PAM type: YTN; PAM sequence: CTC
ctttccttgttttaaggaaa

SEQ ID NO: 190607 - DNA, 20 bp, Artificial Sequence
  Description of Artificial Sequence: Synthetic oligonucleotide
  Target: ATXN1; (-) strand; PAM type: YTN; PAM sequence: TTA
tggcataataatggaaacag

SEQ ID NO: 190608 - DNA, 20 bp, Artificial Sequence
  Description of Artificial Sequence: Synthetic oligonucleotide
  Target: ATXN1; (-) strand; PAM type: YTN; PAM sequence: CTT
atggcataataatggaaaca

SEQ ID NO: 190609 - DNA, 20 bp, Artificial Sequence
  Description of Artificial Sequence: Synthetic oligonucleotide
  Target: ATXN1; (-) strand; PAM type: YTN; PAM sequence: TTC
cttatggcataataatggaa

SEQ ID NO: 190610 - DNA, 20 bp, Artificial Sequence
  Description of Artificial Sequence: Synthetic oligonucleotide
  Target: ATXN1; (-) strand; PAM type: YTN; PAM sequence: TTT
ccttatggcataataatgga

SEQ ID NO: 190611 - DNA, 20 bp, Artificial Sequence
  Description of Artificial Sequence: Synthetic oligonucleotide
  Target: ATXN1; (-) strand; PAM type: YTN; PAM sequence: TTC
cagtttccttatggcataat

SEQ ID NO: 190612 - DNA, 20 bp, Artificial Sequence
  Description of Artificial Sequence: Synthetic oligonucleotide
  Target: ATXN1; (-) strand; PAM type: YTN; PAM sequence: CTT
ccagtttccttatggcataa

SEQ ID NO: 190613 - DNA, 20 bp, Artificial Sequence
  Description of Artificial Sequence: Synthetic oligonucleotide
  Target: ATXN1; (-) strand; PAM type: YTN; PAM sequence: TTC
ttccagtttccttatggcat

SEQ ID NO: 190614 - DNA, 20 bp, Artificial Sequence
  Description of Artificial Sequence: Synthetic oligonucleotide
  Target: ATXN1; (-) strand; PAM type: YTN; PAM sequence: TTA
aaaataaagaattcttccag

SEQ ID NO: 190615 - DNA, 20 bp, Artificial Sequence
  Description of Artificial Sequence: Synthetic oligonucleotide
  Target: ATXN1; (-) strand; PAM type: YTN; PAM sequence: TTT
aaaaataaagaattcttcca

SEQ ID NO: 190616 - DNA, 20 bp, Artificial Sequence
  Description of Artificial Sequence: Synthetic oligonucleotide
  Target: ATXN1; (-) strand; PAM type: YTN; PAM sequence: TTT
taaaaataaagaattcttcc

SEQ ID NO: 190617 - DNA, 20 bp, Artificial Sequence
  Description of Artificial Sequence: Synthetic oligonucleotide
  Target: ATXN1; (-) strand; PAM type: YTN; PAM sequence: TTA
aaaatattttaaaaataaag

SEQ ID NO: 190618 - DNA, 20 bp, Artificial Sequence
  Description of Artificial Sequence: Synthetic oligonucleotide
  Target: ATXN1; (-) strand; PAM type: YTN; PAM sequence: TTT
aaaaatattttaaaaataaa

SEQ ID NO: 190619 - DNA, 20 bp, Artificial Sequence
  Description of Artificial Sequence: Synthetic oligonucleotide
  Target: ATXN1; (-) strand; PAM type: YTN; PAM sequence: TTA
aagtaaaatttaaaaatatt

SEQ ID NO: 190620 - DNA, 20 bp, Artificial Sequence
  Description of Artificial Sequence: Synthetic oligonucleotide
  Target: ATXN1; (-) strand; PAM type: YTN; PAM sequence: CTT
aaagtaaaatttaaaaatat

SEQ ID NO: 190621 - DNA, 20 bp, Artificial Sequence
  Description of Artificial Sequence: Synthetic oligonucleotide
  Target: ATXN1; (-) strand; PAM type: YTN; PAM sequence: CTG
cacatgtatcccagaactta

SEQ ID NO: 190622 - DNA, 20 bp, Artificial Sequence
  Description of Artificial Sequence: Synthetic oligonucleotide
  Target: ATXN1; (-) strand; PAM type: YTN; PAM sequence: TTC
tgcacatgtatcccagaact

SEQ ID NO: 190623 - DNA, 20 bp, Artificial Sequence
  Description of Artificial Sequence: Synthetic oligonucleotide
  Target: ATXN1; (-) strand; PAM type: YTN; PAM sequence: CTG
catgttctgcacatgtatcc

SEQ ID NO: 190624 - DNA, 20 bp, Artificial Sequence
  Description of Artificial Sequence: Synthetic oligonucleotide
  Target: ATXN1; (-) strand; PAM type: YTN; PAM sequence: CTA
tgtaacaaacctgcatgttc

SEQ ID NO: 190625 - DNA, 20 bp, Artificial Sequence
  Description of Artificial Sequence: Synthetic oligonucleotide
  Target: ATXN1; (-) strand; PAM type: YTN; PAM sequence: TTG
ataggtgcagcaaaccacca

SEQ ID NO: 190626 - DNA, 20 bp, Artificial Sequence
  Description of Artificial Sequence: Synthetic oligonucleotide
  Target: ATXN1; (-) strand; PAM type: YTN; PAM sequence: CTA
gatgatgggttgataggtgc

SEQ ID NO: 190627 - DNA, 20 bp, Artificial Sequence
  Description of Artificial Sequence: Synthetic oligonucleotide
  Target: ATXN1; (-) strand; PAM type: YTN; PAM sequence: TTA
aaacctagatgatgggttga

SEQ ID NO: 190628 - DNA, 20 bp, Artificial Sequence
  Description of Artificial Sequence: Synthetic oligonucleotide
  Target: ATXN1; (-) strand; PAM type: YTN; PAM sequence: CTT
aaaacctagatgatgggttg

SEQ ID NO: 190629 - DNA, 20 bp, Artificial Sequence
  Description of Artificial Sequence: Synthetic oligonucleotide
  Target: ATXN1; (-) strand; PAM type: YTN; PAM sequence: CTA
atgcatgaggggcttaaaac

SEQ ID NO: 190630 - DNA, 20 bp, Artificial Sequence
  Description of Artificial Sequence: Synthetic oligonucleotide
  Target: ATXN1; (-) strand; PAM type: YTN; PAM sequence: TTA
ggacaaatacctaatgcatg

SEQ ID NO: 190631 - DNA, 20 bp, Artificial Sequence
  Description of Artificial Sequence: Synthetic oligonucleotide
  Target: ATXN1; (-) strand; PAM type: YTN; PAM sequence: CTA
tcggtgagtggggggcaagg

SEQ ID NO: 190632 - DNA, 20 bp, Artificial Sequence
  Description of Artificial Sequence: Synthetic oligonucleotide
  Target: ATXN1; (-) strand; PAM type: YTN; PAM sequence: TTG
aataatgagaacacatggac

SEQ ID NO: 190633 - DNA, 20 bp, Artificial Sequence
  Description of Artificial Sequence: Synthetic oligonucleotide
  Target: ATXN1; (-) strand; PAM type: YTN; PAM sequence: CTC
atagtaggagttgaataatg

SEQ ID NO: 190634 - DNA, 20 bp, Artificial Sequence
  Description of Artificial Sequence: Synthetic oligonucleotide
  Target: ATXN1; (-) strand; PAM type: YTN; PAM sequence: CTC
actcatagtaggagttgaat

SEQ ID NO: 190635 - DNA, 20 bp, Artificial Sequence
  Description of Artificial Sequence: Synthetic oligonucleotide
  Target: ATXN1; (-) strand; PAM type: YTN; PAM sequence: TTC
tcactcatagtaggagttga

SEQ ID NO: 190636 - DNA, 20 bp, Artificial Sequence
  Description of Artificial Sequence: Synthetic oligonucleotide
  Target: ATXN1; (-) strand; PAM type: YTN; PAM sequence: CTA
acacaggaacagaaaaccaa

SEQ ID NO: 190637 - DNA, 20 bp, Artificial Sequence
  Description of Artificial Sequence: Synthetic oligonucleotide
  Target: ATXN1; (-) strand; PAM type: YTN; PAM sequence: CTC
agcaaactaacacaggaaca

SEQ ID NO: 190638 - DNA, 20 bp, Artificial Sequence
  Description of Artificial Sequence: Synthetic oligonucleotide
  Target: ATXN1; (-) strand; PAM type: YTN; PAM sequence: TTC
tcagcaaactaacacaggaa

SEQ ID NO: 190639 - DNA, 20 bp, Artificial Sequence
  Description of Artificial Sequence: Synthetic oligonucleotide
  Target: ATXN1; (-) strand; PAM type: YTN; PAM sequence: CTC
attctcagcaaactaacaca

SEQ ID NO: 190640 - DNA, 20 bp, Artificial Sequence
  Description of Artificial Sequence: Synthetic oligonucleotide
  Target: ATXN1; (-) strand; PAM type: YTN; PAM sequence: CTG
gaagcctcattctcagcaaa

SEQ ID NO: 190641 - DNA, 20 bp, Artificial Sequence
  Description of Artificial Sequence: Synthetic oligonucleotide
  Target: ATXN1; (-) strand; PAM type: YTN; PAM sequence: TTA
cagggacatggatgaagctg

SEQ ID NO: 190642 - DNA, 20 bp, Artificial Sequence
  Description of Artificial Sequence: Synthetic oligonucleotide
  Target: ATXN1; (-) strand; PAM type: YTN; PAM sequence: TTT
acagggacatggatgaagct

SEQ ID NO: 190643 - DNA, 20 bp, Artificial Sequence
  Description of Artificial Sequence: Synthetic oligonucleotide
  Target: ATXN1; (-) strand; PAM type: YTN; PAM sequence: CTT
tacagggacatggatgaagc

SEQ ID NO: 190644 - DNA, 20 bp, Artificial Sequence
  Description of Artificial Sequence: Synthetic oligonucleotide
  Target: ATXN1; (-) strand; PAM type: YTN; PAM sequence: CTC
atgtcctttacagggacatg

SEQ ID NO: 190645 - DNA, 20 bp, Artificial Sequence
  Description of Artificial Sequence: Synthetic oligonucleotide
  Target: ATXN1; (-) strand; PAM type: YTN; PAM sequence: CTA
tgcagccataaaaaagaatg

SEQ ID NO: 190646 - DNA, 20 bp, Artificial Sequence
  Description of Artificial Sequence: Synthetic oligonucleotide
  Target: ATXN1; (-) strand; PAM type: YTN; PAM sequence: CTG
gataaagaaaatgtggtaaa

SEQ ID NO: 190647 - DNA, 20 bp, Artificial Sequence
  Description of Artificial Sequence: Synthetic oligonucleotide
  Target: ATXN1; (-) strand; PAM type: YTN; PAM sequence: CTG
gaaaccaacccaaatgccca

SEQ ID NO: 190648 - DNA, 20 bp, Artificial Sequence
  Description of Artificial Sequence: Synthetic oligonucleotide
  Target: ATXN1; (-) strand; PAM type: YTN; PAM sequence: TTA
caatagtaaagactggaaac

SEQ ID NO: 190649 - DNA, 20 bp, Artificial Sequence
  Description of Artificial Sequence: Synthetic oligonucleotide
  Target: ATXN1; (-) strand; PAM type: YTN; PAM sequence: TTT
acaatagtaaagactggaaa

SEQ ID NO: 190650 - DNA, 20 bp, Artificial Sequence
  Description of Artificial Sequence: Synthetic oligonucleotide
  Target: ATXN1; (-) strand; PAM type: YTN; PAM sequence: CTG
cagcagtatttacaatagta

SEQ ID NO: 190651 - DNA, 20 bp, Artificial Sequence
  Description of Artificial Sequence: Synthetic oligonucleotide
  Target: ATXN1; (-) strand; PAM type: YTN; PAM sequence: TTA
ctgcagcagtatttacaata

SEQ ID NO: 190652 - DNA, 20 bp, Artificial Sequence
  Description of Artificial Sequence: Synthetic oligonucleotide
  Target: ATXN1; (-) strand; PAM type: YTN; PAM sequence: TTT
actgcagcagtatttacaat

SEQ ID NO: 190653 - DNA, 20 bp, Artificial Sequence
  Description of Artificial Sequence: Synthetic oligonucleotide
  Target: ATXN1; (-) strand; PAM type: YTN; PAM sequence: TTA
taaagacacatgcacacata

SEQ ID NO: 190654 - DNA, 20 bp, Artificial Sequence
  Description of Artificial Sequence: Synthetic oligonucleotide
  Target: ATXN1; (-) strand; PAM type: YTN; PAM sequence: CTG
ttataaagacacatgcacac

SEQ ID NO: 190655 - DNA, 20 bp, Artificial Sequence
  Description of Artificial Sequence: Synthetic oligonucleotide
  Target: ATXN1; (-) strand; PAM type: YTN; PAM sequence: TTC
tgttataaagacacatgcac

SEQ ID NO: 190656 - DNA, 20 bp, Artificial Sequence
  Description of Artificial Sequence: Synthetic oligonucleotide
  Target: ATXN1; (-) strand; PAM type: YTN; PAM sequence: TTA
taaatcattctgttataaag

SEQ ID NO: 190657 - DNA, 20 bp, Artificial Sequence
  Description of Artificial Sequence: Synthetic oligonucleotide
  Target: ATXN1; (-) strand; PAM type: YTN; PAM sequence: TTA
tatacccaaaggattataaa

SEQ ID NO: 190658 - DNA, 20 bp, Artificial Sequence
  Description of Artificial Sequence: Synthetic oligonucleotide
  Target: ATXN1; (-) strand; PAM type: YTN; PAM sequence: CTG
gttatatacccaaaggatta

SEQ ID NO: 190659 - DNA, 20 bp, Artificial Sequence
  Description of Artificial Sequence: Synthetic oligonucleotide
  Target: ATXN1; (-) strand; PAM type: YTN; PAM sequence: TTA
ctggttatatacccaaagga

SEQ ID NO: 190660 - DNA, 20 bp, Artificial Sequence
  Description of Artificial Sequence: Synthetic oligonucleotide
  Target: ATXN1; (-) strand; PAM type: YTN; PAM sequence: TTG
acccagcaatcccgttactg

SEQ ID NO: 190661 - DNA, 20 bp, Artificial Sequence
  Description of Artificial Sequence: Synthetic oligonucleotide
  Target: ATXN1; (-) strand; PAM type: YTN; PAM sequence: TTT
gacccagcaatcccgttact

SEQ ID NO: 190662 - DNA, 20 bp, Artificial Sequence
  Description of Artificial Sequence: Synthetic oligonucleotide
  Target: ATXN1; (-) strand; PAM type: YTN; PAM sequence: CTA
gaaccagaaataccatttga

SEQ ID NO: 190663 - DNA, 20 bp, Artificial Sequence
  Description of Artificial Sequence: Synthetic oligonucleotide
  Target: ATXN1; (-) strand; PAM type: YTN; PAM sequence: CTC
aaggatctagaaccagaaat

SEQ ID NO: 190664 - DNA, 20 bp, Artificial Sequence
  Description of Artificial Sequence: Synthetic oligonucleotide
  Target: ATXN1; (-) strand; PAM type: YTN; PAM sequence: TTC
ctcaaggatctagaaccaga

SEQ ID NO: 190665 - DNA, 20 bp, Artificial Sequence
  Description of Artificial Sequence: Synthetic oligonucleotide
  Target: ATXN1; (-) strand; PAM type: YTN; PAM sequence: TTG
tggaagacagtgtggcgatt

SEQ ID NO: 190666 - DNA, 20 bp, Artificial Sequence
  Description of Artificial Sequence: Synthetic oligonucleotide
  Target: ATXN1; (-) strand; PAM type: YTN; PAM sequence: TTC
aaccattgtggaagacagtg

SEQ ID NO: 190667 - DNA, 20 bp, Artificial Sequence
  Description of Artificial Sequence: Synthetic oligonucleotide
  Target: ATXN1; (-) strand; PAM type: YTN; PAM sequence: TTA
gttcaaccattgtggaagac

SEQ ID NO: 190668 - DNA, 20 bp, Artificial Sequence
  Description of Artificial Sequence: Synthetic oligonucleotide
  Target: ATXN1; (-) strand; PAM type: YTN; PAM sequence: CTG
taaattagttcaaccattgt

SEQ ID NO: 190669 - DNA, 20 bp, Artificial Sequence
  Description of Artificial Sequence: Synthetic oligonucleotide
  Target: ATXN1; (-) strand; PAM type: YTN; PAM sequence: TTG
ggggactgtaaattagttca

SEQ ID NO: 190670 - DNA, 20 bp, Artificial Sequence
  Description of Artificial Sequence: Synthetic oligonucleotide
  Target: ATXN1; (-) strand; PAM type: YTN; PAM sequence: CTG
ttgggggactgtaaattagt

SEQ ID NO: 190671 - DNA, 20 bp, Artificial Sequence
  Description of Artificial Sequence: Synthetic oligonucleotide
  Target: ATXN1; (-) strand; PAM type: YTN; PAM sequence: TTA
tgctgttgggggactgtaaa

SEQ ID NO: 190672 - DNA, 20 bp, Artificial Sequence
  Description of Artificial Sequence: Synthetic oligonucleotide
  Target: ATXN1; (-) strand; PAM type: YTN; PAM sequence: TTT
atgctgttgggggactgtaa

SEQ ID NO: 190673 - DNA, 20 bp, Artificial Sequence
  Description of Artificial Sequence: Synthetic oligonucleotide
  Target: ATXN1; (-) strand; PAM type: YTN; PAM sequence: TTT
tatgctgttgggggactgta

SEQ ID NO: 190674 - DNA, 20 bp, Artificial Sequence
  Description of Artificial Sequence: Synthetic oligonucleotide
  Target: ATXN1; (-) strand; PAM type: YTN; PAM sequence: CTT
ttatgctgttgggggactgt

SEQ ID NO: 190675 - DNA, 20 bp, Artificial Sequence
  Description of Artificial Sequence: Synthetic oligonucleotide
  Target: ATXN1; (-) strand; PAM type: YTN; PAM sequence: CTG
tggagaaataggaatgcttt

SEQ ID NO: 190676 - DNA, 20 bp, Artificial Sequence
  Description of Artificial Sequence: Synthetic oligonucleotide
  Target: ATXN1; (-) strand; PAM type: YTN; PAM sequence: CTG
gcgaggctgtggagaaatag

SEQ ID NO: 190677 - DNA, 20 bp, Artificial Sequence
  Description of Artificial Sequence: Synthetic oligonucleotide
  Target: ATXN1; (-) strand; PAM type: YTN; PAM sequence: CTA
atagatgctggcgaggctgt

SEQ ID NO: 190678 - DNA, 20 bp, Artificial Sequence
  Description of Artificial Sequence: Synthetic oligonucleotide
  Target: ATXN1; (-) strand; PAM type: YTN; PAM sequence: TTC
ctaatagatgctggcgaggc

SEQ ID NO: 190679 - DNA, 20 bp, Artificial Sequence
  Description of Artificial Sequence: Synthetic oligonucleotide
  Target: ATXN1; (-) strand; PAM type: YTN; PAM sequence: TTT
cctaatagatgctggcgagg

SEQ ID NO: 190680 - DNA, 20 bp, Artificial Sequence
  Description of Artificial Sequence: Synthetic oligonucleotide
  Target: ATXN1; (-) strand; PAM type: YTN; PAM sequence: TTC
cagtttcctaatagatgctg

SEQ ID NO: 190681 - DNA, 20 bp, Artificial Sequence
  Description of Artificial Sequence: Synthetic oligonucleotide
  Target: ATXN1; (-) strand; PAM type: YTN; PAM sequence: CTT
ccagtttcctaatagatgct

SEQ ID NO: 190682 - DNA, 20 bp, Artificial Sequence
  Description of Artificial Sequence: Synthetic oligonucleotide
  Target: ATXN1; (-) strand; PAM type: YTN; PAM sequence: TTC
ttccagtttcctaatagatg

SEQ ID NO: 190683 - DNA, 20 bp, Artificial Sequence
  Description of Artificial Sequence: Synthetic oligonucleotide
  Target: ATXN1; (-) strand; PAM type: YTN; PAM sequence: TTG
tatagaattcttccagtttc

SEQ ID NO: 190684 - DNA, 20 bp, Artificial Sequence
  Description of Artificial Sequence: Synthetic oligonucleotide
  Target: ATXN1; (-) strand; PAM type: YTN; PAM sequence: CTA
ttgtatagaattcttccagt

SEQ ID NO: 190685 - DNA, 20 bp, Artificial Sequence
  Description of Artificial Sequence: Synthetic oligonucleotide
  Target: ATXN1; (-) strand; PAM type: YTN; PAM sequence: CTA
aatctattgtatagaattct

SEQ ID NO: 190686 - DNA, 20 bp, Artificial Sequence
  Description of Artificial Sequence: Synthetic oligonucleotide
  Target: ATXN1; (-) strand; PAM type: YTN; PAM sequence: CTC
ctaaatctattgtatagaat

SEQ ID NO: 190687 - DNA, 20 bp, Artificial Sequence
  Description of Artificial Sequence: Synthetic oligonucleotide
  Target: ATXN1; (-) strand; PAM type: YTN; PAM sequence: TTG
cagctcctaaatctattgta

SEQ ID NO: 190688 - DNA, 20 bp, Artificial Sequence
  Description of Artificial Sequence: Synthetic oligonucleotide
  Target: ATXN1; (-) strand; PAM type: YTN; PAM sequence: TTT
gcagctcctaaatctattgt

SEQ ID NO: 190689 - DNA, 20 bp, Artificial Sequence
  Description of Artificial Sequence: Synthetic oligonucleotide
  Target: ATXN1; (-) strand; PAM type: YTN; PAM sequence: CTT
tgcagctcctaaatctattg

SEQ ID NO: 190690 - DNA, 20 bp, Artificial Sequence
  Description of Artificial Sequence: Synthetic oligonucleotide
  Target: ATXN1; (-) strand; PAM type: YTN; PAM sequence: CTC
ctttgcagctcctaaatcta

SEQ ID NO: 190691 - DNA, 20 bp, Artificial Sequence
  Description of Artificial Sequence: Synthetic oligonucleotide
  Target: ATXN1; (-) strand; PAM type: YTN; PAM sequence: TTA
ctcctttgcagctcctaaat

SEQ ID NO: 190692 - DNA, 20 bp, Artificial Sequence
  Description of Artificial Sequence: Synthetic oligonucleotide
  Target: ATXN1; (-) strand; PAM type: YTN; PAM sequence: CTT
actcctttgcagctcctaaa

SEQ ID NO: 190693 - DNA, 20 bp, Artificial Sequence
  Description of Artificial Sequence: Synthetic oligonucleotide
  Target: ATXN1; (-) strand; PAM type: YTN; PAM sequence: TTC
agcaaatccttactcctttg

SEQ ID NO: 190694 - DNA, 20 bp, Artificial Sequence
  Description of Artificial Sequence: Synthetic oligonucleotide
  Target: ATXN1; (-) strand; PAM type: YTN; PAM sequence: CTT
cagcaaatccttactccttt

SEQ ID NO: 190695 - DNA, 20 bp, Artificial Sequence
  Description of Artificial Sequence: Synthetic oligonucleotide
  Target: ATXN1; (-) strand; PAM type: YTN; PAM sequence: CTA
agaaaatcttcagcaaatcc

SEQ ID NO: 190696 - DNA, 20 bp, Artificial Sequence
  Description of Artificial Sequence: Synthetic oligonucleotide
  Target: ATXN1; (-) strand; PAM type: YTN; PAM sequence: TTG
cctaagaaaatcttcagcaa

SEQ ID NO: 190697 - DNA, 20 bp, Artificial Sequence
  Description of Artificial Sequence: Synthetic oligonucleotide
  Target: ATXN1; (-) strand; PAM type: YTN; PAM sequence: CTT
gcctaagaaaatcttcagca

SEQ ID NO: 190698 - DNA, 20 bp, Artificial Sequence
  Description of Artificial Sequence: Synthetic oligonucleotide
  Target: ATXN1; (-) strand; PAM type: YTN; PAM sequence: CTA
atacttgcctaagaaaatct

SEQ ID NO: 190699 - DNA, 20 bp, Artificial Sequence
  Description of Artificial Sequence: Synthetic oligonucleotide
  Target: ATXN1; (-) strand; PAM type: YTN; PAM sequence: TTC
taatacttgcctaagaaaat

SEQ ID NO: 190700 - DNA, 20 bp, Artificial Sequence
  Description of Artificial Sequence: Synthetic oligonucleotide
  Target: ATXN1; (-) strand; PAM type: YTN; PAM sequence: CTT
ctaatacttgcctaagaaaa

SEQ ID NO: 190701 - DNA, 20 bp, Artificial Sequence
  Description of Artificial Sequence: Synthetic oligonucleotide
  Target: ATXN1; (-) strand; PAM type: YTN; PAM sequence: CTA
accaacttctaatacttgcc

SEQ ID NO: 190702 - DNA, 20 bp, Artificial Sequence
  Description of Artificial Sequence: Synthetic oligonucleotide
  Target: ATXN1; (-) strand; PAM type: YTN; PAM sequence: CTC
atctaaccaacttctaatac

SEQ ID NO: 190703 - DNA, 20 bp, Artificial Sequence
  Description of Artificial Sequence: Synthetic oligonucleotide
  Target: ATXN1; (-) strand; PAM type: YTN; PAM sequence: TTC
tcatctaaccaacttctaat

SEQ ID NO: 190704 - DNA, 20 bp, Artificial Sequence
  Description of Artificial Sequence: Synthetic oligonucleotide
  Target: ATXN1; (-) strand; PAM type: YTN; PAM sequence: TTT
ctcatctaaccaacttctaa

SEQ ID NO: 190705 - DNA, 20 bp, Artificial Sequence
  Description of Artificial Sequence: Synthetic oligonucleotide
  Target: ATXN1; (-) strand; PAM type: YTN; PAM sequence: TTT
tctcatctaaccaacttcta

SEQ ID NO: 190706 - DNA, 20 bp, Artificial Sequence
  Description of Artificial Sequence: Synthetic oligonucleotide
  Target: ATXN1; (-) strand; PAM type: YTN; PAM sequence: CTT
ttctcatctaaccaacttct

SEQ ID NO: 190707 - DNA, 20 bp, Artificial Sequence
  Description of Artificial Sequence: Synthetic oligonucleotide
  Target: ATXN1; (-) strand; PAM type: YTN; PAM sequence: TTG
tgaaaacttttctcatctaa

SEQ ID NO: 190708 - DNA, 20 bp, Artificial Sequence
  Description of Artificial Sequence: Synthetic oligonucleotide
  Target: ATXN1; (-) strand; PAM type: YTN; PAM sequence: CTT
gtgaaaacttttctcatcta

SEQ ID NO: 190709 - DNA, 20 bp, Artificial Sequence
  Description of Artificial Sequence: Synthetic oligonucleotide
  Target: ATXN1; (-) strand; PAM type: YTN; PAM sequence: CTC
ccacttgtgaaaacttttct

SEQ ID NO: 190710 - DNA, 20 bp, Artificial Sequence
  Description of Artificial Sequence: Synthetic oligonucleotide
  Target: ATXN1; (-) strand; PAM type: YTN; PAM sequence: TTA
ggagacaaggaggtacaact

SEQ ID NO: 190711 - DNA, 20 bp, Artificial Sequence
  Description of Artificial Sequence: Synthetic oligonucleotide
  Target: ATXN1; (-) strand; PAM type: YTN; PAM sequence: CTA
caattaggagacaaggaggt

SEQ ID NO: 190712 - DNA, 20 bp, Artificial Sequence
  Description of Artificial Sequence: Synthetic oligonucleotide
  Target: ATXN1; (-) strand; PAM type: YTN; PAM sequence: TTC
actacaattaggagacaagg

SEQ ID NO: 190713 - DNA, 20 bp, Artificial Sequence
  Description of Artificial Sequence: Synthetic oligonucleotide
  Target: ATXN1; (-) strand; PAM type: YTN; PAM sequence: TTG
acagattcactacaattagg

SEQ ID NO: 190714 - DNA, 20 bp, Artificial Sequence
  Description of Artificial Sequence: Synthetic oligonucleotide
  Target: ATXN1; (-) strand; PAM type: YTN; PAM sequence: CTG
aaaagaaagttgacagattc

SEQ ID NO: 190715 - DNA, 20 bp, Artificial Sequence
  Description of Artificial Sequence: Synthetic oligonucleotide
  Target: ATXN1; (-) strand; PAM type: YTN; PAM sequence: TTG
atacactgaaaagaaagttg

SEQ ID NO: 190716 - DNA, 20 bp, Artificial Sequence
  Description of Artificial Sequence: Synthetic oligonucleotide
  Target: ATXN1; (-) strand; PAM type: YTN; PAM sequence: CTT
gatacactgaaaagaaagtt

SEQ ID NO: 190717 - DNA, 20 bp, Artificial Sequence
  Description of Artificial Sequence: Synthetic oligonucleotide
  Target: ATXN1; (-) strand; PAM type: YTN; PAM sequence: TTG
aagagtaaagtcttgataca

SEQ ID NO: 190718 - DNA, 20 bp, Artificial Sequence
  Description of Artificial Sequence: Synthetic oligonucleotide
  Target: ATXN1; (-) strand; PAM type: YTN; PAM sequence: TTT
gaagagtaaagtcttgatac

SEQ ID NO: 190719 - DNA, 20 bp, Artificial Sequence
  Description of Artificial Sequence: Synthetic oligonucleotide
  Target: ATXN1; (-) strand; PAM type: YTN; PAM sequence: TTT
tgaagagtaaagtcttgata

SEQ ID NO: 190720 - DNA, 20 bp, Artificial Sequence
  Description of Artificial Sequence: Synthetic oligonucleotide
  Target: ATXN1; (-) strand; PAM type: YTN; PAM sequence: CTG
agaatgattttgaagagtaa

SEQ ID NO: 190721 - DNA, 20 bp, Artificial Sequence
  Description of Artificial Sequence: Synthetic oligonucleotide
  Target: ATXN1; (-) strand; PAM type: YTN; PAM sequence: TTC
agagcatactgagaatgatt

SEQ ID NO: 190722 - DNA, 20 bp, Artificial Sequence
  Description of Artificial Sequence: Synthetic oligonucleotide
  Target: ATXN1; (-) strand; PAM type: YTN; PAM sequence: TTA
aaagtatagcaattcagagc

SEQ ID NO: 190723 - DNA, 20 bp, Artificial Sequence
  Description of Artificial Sequence: Synthetic oligonucleotide
  Target: ATXN1; (-) strand; PAM type: YTN; PAM sequence: CTT
aaaagtatagcaattcagag

SEQ ID NO: 190724 - DNA, 20 bp, Artificial Sequence
  Description of Artificial Sequence: Synthetic oligonucleotide
  Target: ATXN1; (-) strand; PAM type: YTN; PAM sequence: TTA
acttaaaagtatagcaattc

SEQ ID NO: 190725 - DNA, 20 bp, Artificial Sequence
  Description of Artificial Sequence: Synthetic oligonucleotide
  Target: ATXN1; (-) strand; PAM type: YTN; PAM sequence: TTG
agaagtagttaacttaaaag

SEQ ID NO: 190726 - DNA, 20 bp, Artificial Sequence
  Description of Artificial Sequence: Synthetic oligonucleotide
  Target: ATXN1; (-) strand; PAM type: YTN; PAM sequence: TTT
gagaagtagttaacttaaaa

SEQ ID NO: 190727 - DNA, 20 bp, Artificial Sequence
  Description of Artificial Sequence: Synthetic oligonucleotide
  Target: ATXN1; (-) strand; PAM type: YTN; PAM sequence: CTT
tgagaagtagttaacttaaa

SEQ ID NO: 190728 - DNA, 20 bp, Artificial Sequence
  Description of Artificial Sequence: Synthetic oligonucleotide
  Target: ATXN1; (-) strand; PAM type: YTN; PAM sequence: TTA
aacagcactttgagaagtag

SEQ ID NO: 190729 - DNA, 20 bp, Artificial Sequence
  Description of Artificial Sequence: Synthetic oligonucleotide
  Target: ATXN1; (-) strand; PAM type: YTN; PAM sequence: TTT
aaacagcactttgagaagta

SEQ ID NO: 190730 - DNA, 20 bp, Artificial Sequence
  Description of Artificial Sequence: Synthetic oligonucleotide
  Target: ATXN1; (-) strand; PAM type: YTN; PAM sequence: TTT
taaacagcactttgagaagt

SEQ ID NO: 190731 - DNA, 20 bp, Artificial Sequence
  Description of Artificial Sequence: Synthetic oligonucleotide
  Target: ATXN1; (-) strand; PAM type: YTN; PAM sequence: TTT
ttaaacagcactttgagaag

SEQ ID NO: 190732 - DNA, 20 bp, Artificial Sequence
  Description of Artificial Sequence: Synthetic oligonucleotide
  Target: ATXN1; (-) strand; PAM type: YTN; PAM sequence: TTG
aagatgtcagtttttaaaca

SEQ ID NO: 190733 - DNA, 20 bp, Artificial Sequence
  Description of Artificial Sequence: Synthetic oligonucleotide
  Target: ATXN1; (-) strand; PAM type: YTN; PAM sequence: CTG
aaatgtggttgaagatgtca

SEQ ID NO: 190734 - DNA, 20 bp, Artificial Sequence
  Description of Artificial Sequence: Synthetic oligonucleotide
  Target: ATXN1; (-) strand; PAM type: YTN; PAM sequence: CTA
agcctgaaatgtggttgaag

SEQ ID NO: 190735 - DNA, 20 bp, Artificial Sequence
  Description of Artificial Sequence: Synthetic oligonucleotide
  Target: ATXN1; (-) strand; PAM type: YTN; PAM sequence: TTC
taagcctgaaatgtggttga

SEQ ID NO: 190736 - DNA, 20 bp, Artificial Sequence
  Description of Artificial Sequence: Synthetic oligonucleotide
  Target: ATXN1; (-) strand; PAM type: YTN; PAM sequence: TTA
gatagattctaagcctgaaa

SEQ ID NO: 190737 - DNA, 20 bp, Artificial Sequence
  Description of Artificial Sequence: Synthetic oligonucleotide
  Target: ATXN1; (-) strand; PAM type: YTN; PAM sequence: TTT
agatagattctaagcctgaa

SEQ ID NO: 190738 - DNA, 20 bp, Artificial Sequence
  Description of Artificial Sequence: Synthetic oligonucleotide
  Target: ATXN1; (-) strand; PAM type: YTN; PAM sequence: TTG
caaatttagatagattctaa

SEQ ID NO: 190739 - DNA, 20 bp, Artificial Sequence
  Description of Artificial Sequence: Synthetic oligonucleotide
  Target: ATXN1; (-) strand; PAM type: YTN; PAM sequence: TTT
gcaaatttagatagattcta

SEQ ID NO: 190740 - DNA, 20 bp, Artificial Sequence
  Description of Artificial Sequence: Synthetic oligonucleotide
  Target: ATXN1; (-) strand; PAM type: YTN; PAM sequence: CTT
tgcaaatttagatagattct

SEQ ID NO: 190741 - DNA, 20 bp, Artificial Sequence
  Description of Artificial Sequence: Synthetic oligonucleotide
  Target: ATXN1; (-) strand; PAM type: YTN; PAM sequence: TTC
ataagaaccaatgaaacttt

SEQ ID NO: 190742 - DNA, 20 bp, Artificial Sequence
  Description of Artificial Sequence: Synthetic oligonucleotide
  Target: ATXN1; (-) strand; PAM type: YTN; PAM sequence: TTT
cataagaaccaatgaaactt

SEQ ID NO: 190743 - DNA, 20 bp, Artificial Sequence
  Description of Artificial Sequence: Synthetic oligonucleotide
  Target: ATXN1; (-) strand; PAM type: YTN; PAM sequence: CTT
tcataagaaccaatgaaact

SEQ ID NO: 190744 - DNA, 20 bp, Artificial Sequence
  Description of Artificial Sequence: Synthetic oligonucleotide
  Target: ATXN1; (-) strand; PAM type: YTN; PAM sequence: TTA
agtagcactttcataagaac

SEQ ID NO: 190745 - DNA, 20 bp, Artificial Sequence
  Description of Artificial Sequence: Synthetic oligonucleotide
  Target: ATXN1; (-) strand; PAM type: YTN; PAM sequence: TTT
aagtagcactttcataagaa

SEQ ID NO: 190746 - DNA, 20 bp, Artificial Sequence
  Description of Artificial Sequence: Synthetic oligonucleotide
  Target: ATXN1; (-) strand; PAM type: YTN; PAM sequence: TTT
taagtagcactttcataaga

SEQ ID NO: 190747 - DNA, 20 bp, Artificial Sequence
  Description of Artificial Sequence: Synthetic oligonucleotide
  Target: ATXN1; (-) strand; PAM type: YTN; PAM sequence: TTT
ttaagtagcactttcataag

SEQ ID NO: 190748 - DNA, 20 bp, Artificial Sequence
  Description of Artificial Sequence: Synthetic oligonucleotide
  Target: ATXN1; (-) strand; PAM type: YTN; PAM sequence: TTT
tttaagtagcactttcataa

SEQ ID NO: 190749 - DNA, 20 bp, Artificial Sequence
  Description of Artificial Sequence: Synthetic oligonucleotide
  Target: ATXN1; (-) strand; PAM type: YTN; PAM sequence: TTT
ttttaagtagcactttcata

SEQ ID NO: 190750 - DNA, 20 bp, Artificial Sequence
  Description of Artificial Sequence: Synthetic oligonucleotide
  Target: ATXN1; (-) strand; PAM type: YTN; PAM sequence: CTG
tcaagtgtatttttttaagt

SEQ ID NO: 190751 - DNA, 20 bp, Artificial Sequence
  Description of Artificial Sequence: Synthetic oligonucleotide
  Target: ATXN1; (-) strand; PAM type: YTN; PAM sequence: TTG
gctgtcaagtgtattttttt

SEQ ID NO: 190752 - DNA, 20 bp, Artificial Sequence
  Description of Artificial Sequence: Synthetic oligonucleotide
  Target: ATXN1; (-) strand; PAM type: YTN; PAM sequence: TTC
aagagattggctgtcaagtg

SEQ ID NO: 190753 - DNA, 20 bp, Artificial Sequence
  Description of Artificial Sequence: Synthetic oligonucleotide
  Target: ATXN1; (-) strand; PAM type: YTN; PAM sequence: TTT
caagagattggctgtcaagt

SEQ ID NO: 190754 - DNA, 20 bp, Artificial Sequence
  Description of Artificial Sequence: Synthetic oligonucleotide
  Target: ATXN1; (-) strand; PAM type: YTN; PAM sequence: TTT
tcaagagattggctgtcaag

SEQ ID NO: 190755 - DNA, 20 bp, Artificial Sequence
  Description of Artificial Sequence: Synthetic oligonucleotide
  Target: ATXN1; (-) strand; PAM type: YTN; PAM sequence: CTG
cacaaatcattttcaagaga

SEQ ID NO: 190756 - DNA, 20 bp, Artificial Sequence
  Description of Artificial Sequence: Synthetic oligonucleotide
  Target: ATXN1; (-) strand; PAM type: YTN; PAM sequence: TTC
tgcacaaatcattttcaaga

SEQ ID NO: 190757 - DNA, 20 bp, Artificial Sequence
  Description of Artificial Sequence: Synthetic oligonucleotide
  Target: ATXN1; (-) strand; PAM type: YTN; PAM sequence: TTT
ctgcacaaatcattttcaag

SEQ ID NO: 190758 - DNA, 20 bp, Artificial Sequence
  Description of Artificial Sequence: Synthetic oligonucleotide
  Target: ATXN1; (-) strand; PAM type: YTN; PAM sequence: TTG
aacacaatttctgcacaaat

SEQ ID NO: 190759 - DNA, 20 bp, Artificial Sequence
  Description of Artificial Sequence: Synthetic oligonucleotide
  Target: ATXN1; (-) strand; PAM type: YTN; PAM sequence: TTT
gaacacaatttctgcacaaa

SEQ ID NO: 190760 - DNA, 20 bp, Artificial Sequence
  Description of Artificial Sequence: Synthetic oligonucleotide
  Target: ATXN1; (-) strand; PAM type: YTN; PAM sequence: TTG
atataaagtaatttgaacac

SEQ ID NO: 190761 - DNA, 20 bp, Artificial Sequence
  Description of Artificial Sequence: Synthetic oligonucleotide
  Target: ATXN1; (-) strand; PAM type: YTN; PAM sequence: CTT
gatataaagtaatttgaaca

SEQ ID NO: 190762 - DNA, 20 bp, Artificial Sequence
  Description of Artificial Sequence: Synthetic oligonucleotide
  Target: ATXN1; (-) strand; PAM type: YTN; PAM sequence: TTA
aatgtcttgatataaagtaa

SEQ ID NO: 190763 - DNA, 20 bp, Artificial Sequence
  Description of Artificial Sequence: Synthetic oligonucleotide
  Target: ATXN1; (-) strand; PAM type: YTN; PAM sequence: CTT
aaatgtcttgatataaagta

SEQ ID NO: 190764 - DNA, 20 bp, Artificial Sequence
  Description of Artificial Sequence: Synthetic oligonucleotide
  Target: ATXN1; (-) strand; PAM type: YTN; PAM sequence: CTC
ttaaatgtcttgatataaag

SEQ ID NO: 190765 - DNA, 20 bp, Artificial Sequence
  Description of Artificial Sequence: Synthetic oligonucleotide
  Target: ATXN1; (-) strand; PAM type: YTN; PAM sequence: TTC
tcttaaatgtcttgatataa

SEQ ID NO: 190766 - DNA, 20 bp, Artificial Sequence
  Description of Artificial Sequence: Synthetic oligonucleotide
  Target: ATXN1; (-) strand; PAM type: YTN; PAM sequence: TTT
ctcttaaatgtcttgatata

SEQ ID NO: 190767 - DNA, 20 bp, Artificial Sequence
  Description of Artificial Sequence: Synthetic oligonucleotide
  Target: ATXN1; (-) strand; PAM type: YTN; PAM sequence: TTT
tctcttaaatgtcttgatat

SEQ ID NO: 190768 - DNA, 20 bp, Artificial Sequence
  Description of Artificial Sequence: Synthetic oligonucleotide
  Target: ATXN1; (-) strand; PAM type: YTN; PAM sequence: TTA
caaagaaaaccacattttct

SEQ ID NO: 190769 - DNA, 20 bp, Artificial Sequence
  Description of Artificial Sequence: Synthetic oligonucleotide
  Target: ATXN1; (-) strand; PAM type: YTN; PAM sequence: CTA
ttacaaagaaaaccacattt

SEQ ID NO: 190770 - DNA, 20 bp, Artificial Sequence
  Description of Artificial Sequence: Synthetic oligonucleotide
  Target: ATXN1; (-) strand; PAM type: YTN; PAM sequence: TTA
gcctattacaaagaaaacca

SEQ ID NO: 190771 - DNA, 20 bp, Artificial Sequence
  Description of Artificial Sequence: Synthetic oligonucleotide
  Target: ATXN1; (-) strand; PAM type: YTN; PAM sequence: TTT
agcctattacaaagaaaacc

SEQ ID NO: 190772 - DNA, 20 bp, Artificial Sequence
  Description of Artificial Sequence: Synthetic oligonucleotide
  Target: ATXN1; (-) strand; PAM type: YTN; PAM sequence: TTT
tagcctattacaaagaaaac

SEQ ID NO: 190773 - DNA, 20 bp, Artificial Sequence
  Description of Artificial Sequence: Synthetic oligonucleotide
  Target: ATXN1; (-) strand; PAM type: YTN; PAM sequence: TTT
ttagcctattacaaagaaaa

SEQ ID NO: 190774 - DNA, 20 bp, Artificial Sequence
  Description of Artificial Sequence: Synthetic oligonucleotide
  Target: ATXN1; (-) strand; PAM type: YTN; PAM sequence: TTA
tttttagcctattacaaaga

SEQ ID NO: 190775 - DNA, 20 bp, Artificial Sequence
  Description of Artificial Sequence: Synthetic oligonucleotide
  Target: ATXN1; (-) strand; PAM type: YTN; PAM sequence: TTG
aagataaaggatatcattat

SEQ ID NO: 190776 - DNA, 20 bp, Artificial Sequence
  Description of Artificial Sequence: Synthetic oligonucleotide
  Target: ATXN1; (-) strand; PAM type: YTN; PAM sequence: TTC
agttgaagataaaggatatc

SEQ ID NO: 190777 - DNA, 20 bp, Artificial Sequence
  Description of Artificial Sequence: Synthetic oligonucleotide
  Target: ATXN1; (-) strand; PAM type: YTN; PAM sequence: TTA
tacagcatatgtacatgttc

SEQ ID NO: 190778 - DNA, 20 bp, Artificial Sequence
  Description of Artificial Sequence: Synthetic oligonucleotide
  Target: ATXN1; (-) strand; PAM type: YTN; PAM sequence: CTT
atacagcatatgtacatgtt

SEQ ID NO: 190779 - DNA, 20 bp, Artificial Sequence
  Description of Artificial Sequence: Synthetic oligonucleotide
  Target: ATXN1; (-) strand; PAM type: YTN; PAM sequence: TTA
aatgcaacagcttatacagc

SEQ ID NO: 190780 - DNA, 20 bp, Artificial Sequence
  Description of Artificial Sequence: Synthetic oligonucleotide
  Target: ATXN1; (-) strand; PAM type: YTN; PAM sequence: TTT
aaatgcaacagcttatacag

SEQ ID NO: 190781 - DNA, 20 bp, Artificial Sequence
  Description of Artificial Sequence: Synthetic oligonucleotide
  Target: ATXN1; (-) strand; PAM type: YTN; PAM sequence: TTG
tttaaatgcaacagcttata

SEQ ID NO: 190782 - DNA, 20 bp, Artificial Sequence
  Description of Artificial Sequence: Synthetic oligonucleotide
  Target: ATXN1; (-) strand; PAM type: YTN; PAM sequence: TTT
gtttaaatgcaacagcttat

SEQ ID NO: 190783 - DNA, 20 bp, Artificial Sequence
  Description of Artificial Sequence: Synthetic oligonucleotide
  Target: ATXN1; (-) strand; PAM type: YTN; PAM sequence: TTC
aatttgtttaaatgcaacag

SEQ ID NO: 190784 - DNA, 20 bp, Artificial Sequence
  Description of Artificial Sequence: Synthetic oligonucleotide
  Target: ATXN1; (-) strand; PAM type: YTN; PAM sequence: TTT
caatttgtttaaatgcaaca

SEQ ID NO: 190785 - DNA, 20 bp, Artificial Sequence
  Description of Artificial Sequence: Synthetic oligonucleotide
  Target: ATXN1; (-) strand; PAM type: YTN; PAM sequence: TTT
tcaatttgtttaaatgcaac

SEQ ID NO: 190786 - DNA, 20 bp, Artificial Sequence
  Description of Artificial Sequence: Synthetic oligonucleotide
  Target: ATXN1; (-) strand; PAM type: YTN; PAM sequence: TTT
ttcaatttgtttaaatgcaa

SEQ ID NO: 190787 - DNA, 20 bp, Artificial Sequence
  Description of Artificial Sequence: Synthetic oligonucleotide
  Target: ATXN1; (-) strand; PAM type: YTN; PAM sequence: CTG
tttttcaatttgtttaaatg

SEQ ID NO: 190788 - DNA, 20 bp, Artificial Sequence
  Description of Artificial Sequence: Synthetic oligonucleotide
  Target: ATXN1; (-) strand; PAM type: YTN; PAM sequence: CTA
ctgtttttcaatttgtttaa

SEQ ID NO: 190789 - DNA, 20 bp, Artificial Sequence
  Description of Artificial Sequence: Synthetic oligonucleotide
  Target: ATXN1; (-) strand; PAM type: YTN; PAM sequence: CTA
tagccagaatcctactgttt

SEQ ID NO: 190790 - DNA, 20 bp, Artificial Sequence
  Description of Artificial Sequence: Synthetic oligonucleotide
  Target: ATXN1; (-) strand; PAM type: YTN; PAM sequence: TTA
cggtctatagccagaatcct

SEQ ID NO: 190791 - DNA, 20 bp, Artificial Sequence
  Description of Artificial Sequence: Synthetic oligonucleotide
  Target: ATXN1; (-) strand; PAM type: YTN; PAM sequence: TTT
acggtctatagccagaatcc

SEQ ID NO: 190792 - DNA, 20 bp, Artificial Sequence
  Description of Artificial Sequence: Synthetic oligonucleotide
  Target: ATXN1; (-) strand; PAM type: YTN; PAM sequence: CTT
tacggtctatagccagaatc

SEQ ID NO: 190793 - DNA, 20 bp, Artificial Sequence
  Description of Artificial Sequence: Synthetic oligonucleotide
  Target: ATXN1; (-) strand; PAM type: YTN; PAM sequence: TTC
tttacggtctatagccagaa

SEQ ID NO: 190794 - DNA, 20 bp, Artificial Sequence
  Description of Artificial Sequence: Synthetic oligonucleotide
  Target: ATXN1; (-) strand; PAM type: YTN; PAM sequence: TTT
ctttacggtctatagccaga

SEQ ID NO: 190795 - DNA, 20 bp, Artificial Sequence
  Description of Artificial Sequence: Synthetic oligonucleotide
  Target: ATXN1; (-) strand; PAM type: YTN; PAM sequence: TTG
tttctttacggtctatagcc

SEQ ID NO: 190796 - DNA, 20 bp, Artificial Sequence
  Description of Artificial Sequence: Synthetic oligonucleotide
  Target: ATXN1; (-) strand; PAM type: YTN; PAM sequence: TTT
gtttctttacggtctatagc

SEQ ID NO: 190797 - DNA, 20 bp, Artificial Sequence
  Description of Artificial Sequence: Synthetic oligonucleotide
  Target: ATXN1; (-) strand; PAM type: YTN; PAM sequence: TTT
tgtttctttacggtctatag

SEQ ID NO: 190798 - DNA, 20 bp, Artificial Sequence
  Description of Artificial Sequence: Synthetic oligonucleotide
  Target: ATXN1; (-) strand; PAM type: YTN; PAM sequence: CTG
ggcaagttttgtttctttac

SEQ ID NO: 190799 - DNA, 20 bp, Artificial Sequence
  Description of Artificial Sequence: Synthetic oligonucleotide
  Target: ATXN1; (-) strand; PAM type: YTN; PAM sequence: TTC
tgggcaagttttgtttcttt

SEQ ID NO: 190800 - DNA, 20 bp, Artificial Sequence
  Description of Artificial Sequence: Synthetic oligonucleotide
  Target: ATXN1; (-) strand; PAM type: YTN; PAM sequence: TTA
aaatgatattctgggcaagt

SEQ ID NO: 190801 - DNA, 20 bp, Artificial Sequence
  Description of Artificial Sequence: Synthetic oligonucleotide
  Target: ATXN1; (-) strand; PAM type: YTN; PAM sequence: CTT
aaaatgatattctgggcaag

SEQ ID NO: 190802 - DNA, 20 bp, Artificial Sequence
  Description of Artificial Sequence: Synthetic oligonucleotide
  Target: ATXN1; (-) strand; PAM type: YTN; PAM sequence: TTA
atgcttaaaatgatattctg

SEQ ID NO: 190803 - DNA, 20 bp, Artificial Sequence
  Description of Artificial Sequence: Synthetic oligonucleotide
  Target: ATXN1; (-) strand; PAM type: YTN; PAM sequence: TTT
aatgcttaaaatgatattct

SEQ ID NO: 190804 - DNA, 20 bp, Artificial Sequence
  Description of Artificial Sequence: Synthetic oligonucleotide
  Target: ATXN1; (-) strand; PAM type: YTN; PAM sequence: TTT
taatgcttaaaatgatattc

SEQ ID NO: 190805 - DNA, 20 bp, Artificial Sequence
  Description of Artificial Sequence: Synthetic oligonucleotide
  Target: ATXN1; (-) strand; PAM type: YTN; PAM sequence: TTT
ttaatgcttaaaatgatatt

SEQ ID NO: 190806 - DNA, 20 bp, Artificial Sequence
  Description of Artificial Sequence: Synthetic oligonucleotide
  Target: ATXN1; (-) strand; PAM type: YTN; PAM sequence: TTT
tttaatgcttaaaatgatat

SEQ ID NO: 190807 - DNA, 20 bp, Artificial Sequence
  Description of Artificial Sequence: Synthetic oligonucleotide
  Target: ATXN1; (-) strand; PAM type: YTN; PAM sequence: TTG
tattttttaatgcttaaaat

SEQ ID NO: 190808 - DNA, 20 bp, Artificial Sequence
  Description of Artificial Sequence: Synthetic oligonucleotide
  Target: ATXN1; (-) strand; PAM type: YTN; PAM sequence: TTA
attgtattttttaatgctta

SEQ ID NO: 190809 - DNA, 20 bp, Artificial Sequence
  Description of Artificial Sequence: Synthetic oligonucleotide
  Target: ATXN1; (-) strand; PAM type: YTN; PAM sequence: TTG
tgggaaatagcagttaattg

SEQ ID NO: 190810 - DNA, 20 bp, Artificial Sequence
  Description of Artificial Sequence: Synthetic oligonucleotide
  Target: ATXN1; (-) strand; PAM type: YTN; PAM sequence: TTT
gtgggaaatagcagttaatt

SEQ ID NO: 190811 - DNA, 20 bp, Artificial Sequence
  Description of Artificial Sequence: Synthetic oligonucleotide
  Target: ATXN1; (-) strand; PAM type: YTN; PAM sequence: CTT
tgtgggaaatagcagttaat

SEQ ID NO: 190812 - DNA, 20 bp, Artificial Sequence
  Description of Artificial Sequence: Synthetic oligonucleotide
  Target: ATXN1; (-) strand; PAM type: YTN; PAM sequence: TTG
aactttgtgggaaatagcag

SEQ ID NO: 190813 - DNA, 20 bp, Artificial Sequence
  Description of Artificial Sequence: Synthetic oligonucleotide
  Target: ATXN1; (-) strand; PAM type: YTN; PAM sequence: CTG
tatgtaggattgaactttgt

SEQ ID NO: 190814 - DNA, 20 bp, Artificial Sequence
  Description of Artificial Sequence: Synthetic oligonucleotide
  Target: ATXN1; (-) strand; PAM type: YTN; PAM sequence: TTC
tgtatgtaggattgaacttt

SEQ ID NO: 190815 - DNA, 20 bp, Artificial Sequence
  Description of Artificial Sequence: Synthetic oligonucleotide
  Target: ATXN1; (-) strand; PAM type: YTN; PAM sequence: TTC
cgattctgtatgtaggattg

SEQ ID NO: 190816 - DNA, 20 bp, Artificial Sequence
  Description of Artificial Sequence: Synthetic oligonucleotide
  Target: ATXN1; (-) strand; PAM type: YTN; PAM sequence: TTG
acaattccgattctgtatgt

SEQ ID NO: 190817 - DNA, 20 bp, Artificial Sequence
  Description of Artificial Sequence: Synthetic oligonucleotide
  Target: ATXN1; (-) strand; PAM type: YTN; PAM sequence: CTG
gttgacaattccgattctgt

SEQ ID NO: 190818 - DNA, 20 bp, Artificial Sequence
  Description of Artificial Sequence: Synthetic oligonucleotide
  Target: ATXN1; (-) strand; PAM type: YTN; PAM sequence: TTG
gacctggttgacaattccga

SEQ ID NO: 190819 - DNA, 20 bp, Artificial Sequence
  Description of Artificial Sequence: Synthetic oligonucleotide
  Target: ATXN1; (-) strand; PAM type: YTN; PAM sequence: TTT
ggacctggttgacaattccg

SEQ ID NO: 190820 - DNA, 20 bp, Artificial Sequence
  Description of Artificial Sequence: Synthetic oligonucleotide
  Target: ATXN1; (-) strand; PAM type: YTN; PAM sequence: CTT
tggacctggttgacaattcc

SEQ ID NO: 190821 - DNA, 20 bp, Artificial Sequence
  Description of Artificial Sequence: Synthetic oligonucleotide
  Target: ATXN1; (-) strand; PAM type: YTN; PAM sequence: TTG
atgctttggacctggttgac

SEQ ID NO: 190822 - DNA, 20 bp, Artificial Sequence
  Description of Artificial Sequence: Synthetic oligonucleotide
  Target: ATXN1; (-) strand; PAM type: YTN; PAM sequence: TTT
gatgctttggacctggttga

SEQ ID NO: 190823 - DNA, 20 bp, Artificial Sequence
  Description of Artificial Sequence: Synthetic oligonucleotide
  Target: ATXN1; (-) strand; PAM type: YTN; PAM sequence: TTA
taatttgatgctttggacct

SEQ ID NO: 190824 - DNA, 20 bp, Artificial Sequence
  Description of Artificial Sequence: Synthetic oligonucleotide
  Target: ATXN1; (-) strand; PAM type: YTN; PAM sequence: TTT
ataatttgatgctttggacc

SEQ ID NO: 190825 - DNA, 20 bp, Artificial Sequence
  Description of Artificial Sequence: Synthetic oligonucleotide
  Target: ATXN1; (-) strand; PAM type: YTN; PAM sequence: TTT
tataatttgatgctttggac

SEQ ID NO: 190826 - DNA, 20 bp, Artificial Sequence
  Description of Artificial Sequence: Synthetic oligonucleotide
  Target: ATXN1; (-) strand; PAM type: YTN; PAM sequence: CTG
agacatcaggttttataatt

SEQ ID NO: 190827 - DNA, 20 bp, Artificial Sequence
  Description of Artificial Sequence: Synthetic oligonucleotide
  Target: ATXN1; (-) strand; PAM type: YTN; PAM sequence: TTC
tgagacatcaggttttataa

SEQ ID NO: 190828 - DNA, 20 bp, Artificial Sequence
  Description of Artificial Sequence: Synthetic oligonucleotide
  Target: ATXN1; (-) strand; PAM type: YTN; PAM sequence: TTT
ctgagacatcaggttttata

SEQ ID NO: 190829 - DNA, 20 bp, Artificial Sequence
  Description of Artificial Sequence: Synthetic oligonucleotide
  Target: ATXN1; (-) strand; PAM type: YTN; PAM sequence: CTA
tttctgagacatcaggtttt

SEQ ID NO: 190830 - DNA, 20 bp, Artificial Sequence
  Description of Artificial Sequence: Synthetic oligonucleotide
  Target: ATXN1; (-) strand; PAM type: YTN; PAM sequence: TTG
tctatttctgagacatcagg

SEQ ID NO: 190831 - DNA, 20 bp, Artificial Sequence
  Description of Artificial Sequence: Synthetic oligonucleotide
  Target: ATXN1; (-) strand; PAM type: YTN; PAM sequence: CTT
gtctatttctgagacatcag

SEQ ID NO: 190832 - DNA, 20 bp, Artificial Sequence
  Description of Artificial Sequence: Synthetic oligonucleotide
  Target: ATXN1; (-) strand; PAM type: YTN; PAM sequence: TTC
ttgtctatttctgagacatc

SEQ ID NO: 190833 - DNA, 20 bp, Artificial Sequence
  Description of Artificial Sequence: Synthetic oligonucleotide
  Target: ATXN1; (-) strand; PAM type: YTN; PAM sequence: TTT
cttgtctatttctgagacat

SEQ ID NO: 190834 - DNA, 20 bp, Artificial Sequence
  Description of Artificial Sequence: Synthetic oligonucleotide
  Target: ATXN1; (-) strand; PAM type: YTN; PAM sequence: TTT
tcttgtctatttctgagaca

SEQ ID NO: 190835 - DNA, 20 bp, Artificial Sequence
  Description of Artificial Sequence: Synthetic oligonucleotide
  Target: ATXN1; (-) strand; PAM type: YTN; PAM sequence: CTG
agttttcttgtctatttctg

SEQ ID NO: 190836 - DNA, 20 bp, Artificial Sequence
  Description of Artificial Sequence: Synthetic oligonucleotide
  Target: ATXN1; (-) strand; PAM type: YTN; PAM sequence: TTC
tgagttttcttgtctatttc

SEQ ID NO: 190837 - DNA, 20 bp, Artificial Sequence
  Description of Artificial Sequence: Synthetic oligonucleotide
  Target: ATXN1; (-) strand; PAM type: YTN; PAM sequence: TTT
ctgagttttcttgtctattt

SEQ ID NO: 190838 - DNA, 20 bp, Artificial Sequence
  Description of Artificial Sequence: Synthetic oligonucleotide
  Target: ATXN1; (-) strand; PAM type: YTN; PAM sequence: TTT
tctgagttttcttgtctatt

SEQ ID NO: 190839 - DNA, 20 bp, Artificial Sequence
  Description of Artificial Sequence: Synthetic oligonucleotide
  Target: ATXN1; (-) strand; PAM type: YTN; PAM sequence: TTT
ttctgagttttcttgtctat

SEQ ID NO: 190840 - DNA, 20 bp, Artificial Sequence
  Description of Artificial Sequence: Synthetic oligonucleotide
  Target: ATXN1; (-) strand; PAM type: YTN; PAM sequence: TTT
tttctgagttttcttgtcta

SEQ ID NO: 190841 - DNA, 20 bp, Artificial Sequence
  Description of Artificial Sequence: Synthetic oligonucleotide
  Target: ATXN1; (-) strand; PAM type: YTN; PAM sequence: TTA
ttttttctgagttttcttgt

SEQ ID NO: 190842 - DNA, 20 bp, Artificial Sequence
  Description of Artificial Sequence: Synthetic oligonucleotide
  Target: ATXN1; (-) strand; PAM type: YTN; PAM sequence: CTG
taataattattttttctgag

SEQ ID NO: 190843 - DNA, 20 bp, Artificial Sequence
  Description of Artificial Sequence: Synthetic oligonucleotide
  Target: ATXN1; (-) strand; PAM type: YTN; PAM sequence: TTG
gactgtaataattatttttt

SEQ ID NO: 190844 - DNA, 20 bp, Artificial Sequence
  Description of Artificial Sequence: Synthetic oligonucleotide
  Target: ATXN1; (-) strand; PAM type: YTN; PAM sequence: TTG
tgtgcgattggactgtaata

SEQ ID NO: 190845 - DNA, 20 bp, Artificial Sequence
  Description of Artificial Sequence: Synthetic oligonucleotide
  Target: ATXN1; (-) strand; PAM type: YTN; PAM sequence: TTT
gtgtgcgattggactgtaat

SEQ ID NO: 190846 - DNA, 20 bp, Artificial Sequence
  Description of Artificial Sequence: Synthetic oligonucleotide
  Target: ATXN1; (-) strand; PAM type: YTN; PAM sequence: CTT
tgtgtgcgattggactgtaa

SEQ ID NO: 190847 - DNA, 20 bp, Artificial Sequence
  Description of Artificial Sequence: Synthetic oligonucleotide
  Target: ATXN1; (-) strand; PAM type: YTN; PAM sequence: TTC
tttgtgtgcgattggactgt

SEQ ID NO: 190848 - DNA, 20 bp, Artificial Sequence
  Description of Artificial Sequence: Synthetic oligonucleotide
  Target: ATXN1; (-) strand; PAM type: YTN; PAM sequence: TTT
ctttgtgtgcgattggactg

SEQ ID NO: 190849 - DNA, 20 bp, Artificial Sequence
  Description of Artificial Sequence: Synthetic oligonucleotide
  Target: ATXN1; (-) strand; PAM type: YTN; PAM sequence: TTT
tctttgtgtgcgattggact

SEQ ID NO: 190850 - DNA, 20 bp, Artificial Sequence
  Description of Artificial Sequence: Synthetic oligonucleotide
  Target: ATXN1; (-) strand; PAM type: YTN; PAM sequence: CTT
ttctttgtgtgcgattggac

SEQ ID NO: 190851 - DNA, 20 bp, Artificial Sequence
  Description of Artificial Sequence: Synthetic oligonucleotide
  Target: ATXN1; (-) strand; PAM type: YTN; PAM sequence: CTC
acttttctttgtgtgcgatt

SEQ ID NO: 190852 - DNA, 20 bp, Artificial Sequence
  Description of Artificial Sequence: Synthetic oligonucleotide
  Target: ATXN1; (-) strand; PAM type: YTN; PAM sequence: TTC
tcacttttctttgtgtgcga

SEQ ID NO: 190853 - DNA, 20 bp, Artificial Sequence
  Description of Artificial Sequence: Synthetic oligonucleotide
  Target: ATXN1; (-) strand; PAM type: YTN; PAM sequence: TTA
ttctcacttttctttgtgtg

SEQ ID NO: 190854 - DNA, 20 bp, Artificial Sequence
  Description of Artificial Sequence: Synthetic oligonucleotide
  Target: ATXN1; (-) strand; PAM type: YTN; PAM sequence: TTT
attctcacttttctttgtgt

SEQ ID NO: 190855 - DNA, 20 bp, Artificial Sequence
  Description of Artificial Sequence: Synthetic oligonucleotide
  Target: ATXN1; (-) strand; PAM type: YTN; PAM sequence: TTT
tattctcacttttctttgtg

SEQ ID NO: 190856 - DNA, 20 bp, Artificial Sequence
  Description of Artificial Sequence: Synthetic oligonucleotide
  Target: ATXN1; (-) strand; PAM type: YTN; PAM sequence: CTT
ttattctcacttttctttgt

SEQ ID NO: 190857 - DNA, 20 bp, Artificial Sequence
  Description of Artificial Sequence: Synthetic oligonucleotide
  Target: ATXN1; (-) strand; PAM type: YTN; PAM sequence: TTG
ccttttattctcacttttct

SEQ ID NO: 190858 - DNA, 20 bp, Artificial Sequence
  Description of Artificial Sequence: Synthetic oligonucleotide
  Target: ATXN1; (-) strand; PAM type: YTN; PAM sequence: CTT
gccttttattctcacttttc

SEQ ID NO: 190859 - DNA, 20 bp, Artificial Sequence
  Description of Artificial Sequence: Synthetic oligonucleotide
  Target: ATXN1; (-) strand; PAM type: YTN; PAM sequence: CTA
tataacttgccttttattct

SEQ ID NO: 190860 - DNA, 20 bp, Artificial Sequence
  Description of Artificial Sequence: Synthetic oligonucleotide
  Target: ATXN1; (-) strand; PAM type: YTN; PAM sequence: TTG
tagaaatataaactatataa

SEQ ID NO: 190861 - DNA, 20 bp, Artificial Sequence
  Description of Artificial Sequence: Synthetic oligonucleotide
  Target: ATXN1; (-) strand; PAM type: YTN; PAM sequence: TTT
gtagaaatataaactatata

SEQ ID NO: 190862 - DNA, 20 bp, Artificial Sequence
  Description of Artificial Sequence: Synthetic oligonucleotide
  Target: ATXN1; (-) strand; PAM type: YTN; PAM sequence: CTC
aaaaggaatttgtagaaata

SEQ ID NO: 190863 - DNA, 20 bp, Artificial Sequence
  Description of Artificial Sequence: Synthetic oligonucleotide
  Target: ATXN1; (-) strand; PAM type: YTN; PAM sequence: TTG
cccagtaactcaaaaggaat

SEQ ID NO: 190864 - DNA, 20 bp, Artificial Sequence
  Description of Artificial Sequence: Synthetic oligonucleotide
  Target: ATXN1; (-) strand; PAM type: YTN; PAM sequence: TTA
aatagaatgttgcccagtaa

SEQ ID NO: 190865 - DNA, 20 bp, Artificial Sequence
  Description of Artificial Sequence: Synthetic oligonucleotide
  Target: ATXN1; (-) strand; PAM type: YTN; PAM sequence: CTT
aaatagaatgttgcccagta

SEQ ID NO: 190866 - DNA, 20 bp, Artificial Sequence
  Description of Artificial Sequence: Synthetic oligonucleotide
  Target: ATXN1; (-) strand; PAM type: YTN; PAM sequence: CTG
tcataagggtccacttaaat

SEQ ID NO: 190867 - DNA, 20 bp, Artificial Sequence
  Description of Artificial Sequence: Synthetic oligonucleotide
  Target: ATXN1; (-) strand; PAM type: YTN; PAM sequence: CTA
ctgtcataagggtccactta

SEQ ID NO: 190868 - DNA, 20 bp, Artificial Sequence
  Description of Artificial Sequence: Synthetic oligonucleotide
  Target: ATXN1; (-) strand; PAM type: YTN; PAM sequence: TTA
tactactgtcataagggtcc

SEQ ID NO: 190869 - DNA, 20 bp, Artificial Sequence
  Description of Artificial Sequence: Synthetic oligonucleotide
  Target: ATXN1; (-) strand; PAM type: YTN; PAM sequence: TTC
attatactactgtcataagg

SEQ ID NO: 190870 - DNA, 20 bp, Artificial Sequence
  Description of Artificial Sequence: Synthetic oligonucleotide
  Target: ATXN1; (-) strand; PAM type: YTN; PAM sequence: TTT
cattatactactgtcataag

SEQ ID NO: 190871 - DNA, 20 bp, Artificial Sequence
  Description of Artificial Sequence: Synthetic oligonucleotide
  Target: ATXN1; (-) strand; PAM type: YTN; PAM sequence: TTT
tcattatactactgtcataa

SEQ ID NO: 190872 - DNA, 20 bp, Artificial Sequence
  Description of Artificial Sequence: Synthetic oligonucleotide
  Target: ATXN1; (-) strand; PAM type: YTN; PAM sequence: TTA
gggatattttcattatacta

SEQ ID NO: 190873 - DNA, 20 bp, Artificial Sequence
  Description of Artificial Sequence: Synthetic oligonucleotide
  Target: ATXN1; (-) strand; PAM type: YTN; PAM sequence: CTT
agggatattttcattatact

SEQ ID NO: 190874 - DNA, 20 bp, Artificial Sequence
  Description of Artificial Sequence: Synthetic oligonucleotide
  Target: ATXN1; (-) strand; PAM type: YTN; PAM sequence: CTA
tgacttagggatattttcat

SEQ ID NO: 190875 - DNA, 20 bp, Artificial Sequence
  Description of Artificial Sequence: Synthetic oligonucleotide
  Target: ATXN1; (-) strand; PAM type: YTN; PAM sequence: TTA
gggctatgacttagggatat

SEQ ID NO: 190876 - DNA, 20 bp, Artificial Sequence
  Description of Artificial Sequence: Synthetic oligonucleotide
  Target: ATXN1; (-) strand; PAM type: YTN; PAM sequence: TTT
agggctatgacttagggata

SEQ ID NO: 190877 - DNA, 20 bp, Artificial Sequence
  Description of Artificial Sequence: Synthetic oligonucleotide
  Target: ATXN1; (-) strand; PAM type: YTN; PAM sequence: TTT
tagggctatgacttagggat

SEQ ID NO: 190878 - DNA, 20 bp, Artificial Sequence
  Description of Artificial Sequence: Synthetic oligonucleotide
  Target: ATXN1; (-) strand; PAM type: YTN; PAM sequence: TTG
ttttagggctatgacttagg

SEQ ID NO: 190879 - DNA, 20 bp, Artificial Sequence
  Description of Artificial Sequence: Synthetic oligonucleotide
  Target: ATXN1; (-) strand; PAM type: YTN; PAM sequence: TTC
agtgggaattgttttagggc

SEQ ID NO: 190880 - DNA, 20 bp, Artificial Sequence
  Description of Artificial Sequence: Synthetic oligonucleotide
  Target: ATXN1; (-) strand; PAM type: YTN; PAM sequence: TTC
aatgaaatgttcagtgggaa

SEQ ID NO: 190881 - DNA, 20 bp, Artificial Sequence
  Description of Artificial Sequence: Synthetic oligonucleotide
  Target: ATXN1; (-) strand; PAM type: YTN; PAM sequence: CTA
agcattcaatgaaatgttca

SEQ ID NO: 190882 - DNA, 20 bp, Artificial Sequence
  Description of Artificial Sequence: Synthetic oligonucleotide
  Target: ATXN1; (-) strand; PAM type: YTN; PAM sequence: TTG
cacatactaagcattcaatg

SEQ ID NO: 190883 - DNA, 20 bp, Artificial Sequence
  Description of Artificial Sequence: Synthetic oligonucleotide
  Target: ATXN1; (-) strand; PAM type: YTN; PAM sequence: TTT
gcacatactaagcattcaat

SEQ ID NO: 190884 - DNA, 20 bp, Artificial Sequence
  Description of Artificial Sequence: Synthetic oligonucleotide
  Target: ATXN1; (-) strand; PAM type: YTN; PAM sequence: CTT
tgcacatactaagcattcaa

SEQ ID NO: 190885 - DNA, 20 bp, Artificial Sequence
  Description of Artificial Sequence: Synthetic oligonucleotide
  Target: ATXN1; (-) strand; PAM type: YTN; PAM sequence: CTC
acagtactttgcacatacta

SEQ ID NO: 190886 - DNA, 20 bp, Artificial Sequence
  Description of Artificial Sequence: Synthetic oligonucleotide
  Target: ATXN1; (-) strand; PAM type: YTN; PAM sequence: CTC
acctcacagtactttgcaca

SEQ ID NO: 190887 - DNA, 20 bp, Artificial Sequence
  Description of Artificial Sequence: Synthetic oligonucleotide
  Target: ATXN1; (-) strand; PAM type: YTN; PAM sequence: CTG
aacctcacctcacagtactt

SEQ ID NO: 190888 - DNA, 20 bp, Artificial Sequence
  Description of Artificial Sequence: Synthetic oligonucleotide
  Target: ATXN1; (-) strand; PAM type: YTN; PAM sequence: TTC
tgaacctcacctcacagtac

SEQ ID NO: 190889 - DNA, 20 bp, Artificial Sequence
  Description of Artificial Sequence: Synthetic oligonucleotide
  Target: ATXN1; (-) strand; PAM type: YTN; PAM sequence: TTT
ctgaacctcacctcacagta

SEQ ID NO: 190890 - DNA, 20 bp, Artificial Sequence
  Description of Artificial Sequence: Synthetic oligonucleotide
  Target: ATXN1; (-) strand; PAM type: YTN; PAM sequence: CTC
catttctgaacctcacctca

SEQ ID NO: 190891 - DNA, 20 bp, Artificial Sequence
  Description of Artificial Sequence: Synthetic oligonucleotide
  Target: ATXN1; (-) strand; PAM type: YTN; PAM sequence: TTC
tccatttctgaacctcacct

SEQ ID NO: 190892 - DNA, 20 bp, Artificial Sequence
  Description of Artificial Sequence: Synthetic oligonucleotide
  Target: ATXN1; (-) strand; PAM type: YTN; PAM sequence: TTT
ctccatttctgaacctcacc

SEQ ID NO: 190893 - DNA, 20 bp, Artificial Sequence
  Description of Artificial Sequence: Synthetic oligonucleotide
  Target: ATXN1; (-) strand; PAM type: YTN; PAM sequence: CTT
tctccatttctgaacctcac

SEQ ID NO: 190894 - DNA, 20 bp, Artificial Sequence
  Description of Artificial Sequence: Synthetic oligonucleotide
  Target: ATXN1; (-) strand; PAM type: YTN; PAM sequence: TTC
tttctccatttctgaacctc

SEQ ID NO: 190895 - DNA, 20 bp, Artificial Sequence
  Description of Artificial Sequence: Synthetic oligonucleotide
  Target: ATXN1; (-) strand; PAM type: YTN; PAM sequence: CTT
ctttctccatttctgaacct

SEQ ID NO: 190896 - DNA, 20 bp, Artificial Sequence
  Description of Artificial Sequence: Synthetic oligonucleotide
  Target: ATXN1; (-) strand; PAM type: YTN; PAM sequence: TTC
aaagcaataaaccttctttc

SEQ ID NO: 190897 - DNA, 20 bp, Artificial Sequence
  Description of Artificial Sequence: Synthetic oligonucleotide
  Target: ATXN1; (-) strand; PAM type: YTN; PAM sequence: CTG
cattcaaagcaataaacctt

SEQ ID NO: 190898 - DNA, 20 bp, Artificial Sequence
  Description of Artificial Sequence: Synthetic oligonucleotide
  Target: ATXN1; (-) strand; PAM type: YTN; PAM sequence: TTC
tgcattcaaagcaataaacc

SEQ ID NO: 190899 - DNA, 20 bp, Artificial Sequence
  Description of Artificial Sequence: Synthetic oligonucleotide
  Target: ATXN1; (-) strand; PAM type: YTN; PAM sequence: TTA
aaaatcaatattctgcattc

SEQ ID NO: 190900 - DNA, 20 bp, Artificial Sequence
  Description of Artificial Sequence: Synthetic oligonucleotide
  Target: ATXN1; (-) strand; PAM type: YTN; PAM sequence: TTT
aaaaatcaatattctgcatt

SEQ ID NO: 190901 - DNA, 20 bp, Artificial Sequence
  Description of Artificial Sequence: Synthetic oligonucleotide
  Target: ATXN1; (-) strand; PAM type: YTN; PAM sequence: TTT
taaaaatcaatattctgcat

SEQ ID NO: 190902 - DNA, 20 bp, Artificial Sequence
  Description of Artificial Sequence: Synthetic oligonucleotide
  Target: ATXN1; (-) strand; PAM type: YTN; PAM sequence: TTA
gtgttttaaaaatcaatatt

SEQ ID NO: 190903 - DNA, 20 bp, Artificial Sequence
  Description of Artificial Sequence: Synthetic oligonucleotide
  Target: ATXN1; (-) strand; PAM type: YTN; PAM sequence: CTT
agtgttttaaaaatcaatat

SEQ ID NO: 190904 - DNA, 20 bp, Artificial Sequence
  Description of Artificial Sequence: Synthetic oligonucleotide
  Target: ATXN1; (-) strand; PAM type: YTN; PAM sequence: TTA
gcttagtgttttaaaaatca

SEQ ID NO: 190905 - DNA, 20 bp, Artificial Sequence
  Description of Artificial Sequence: Synthetic oligonucleotide
  Target: ATXN1; (-) strand; PAM type: YTN; PAM sequence: TTG
gtgacgattagcttagtgtt

SEQ ID NO: 190906 - DNA, 20 bp, Artificial Sequence
  Description of Artificial Sequence: Synthetic oligonucleotide
  Target: ATXN1; (-) strand; PAM type: YTN; PAM sequence: TTA
tagttggtgacgattagctt

SEQ ID NO: 190907 - DNA, 20 bp, Artificial Sequence
  Description of Artificial Sequence: Synthetic oligonucleotide
  Target: ATXN1; (-) strand; PAM type: YTN; PAM sequence: TTA
ttatagttggtgacgattag

SEQ ID NO: 190908 - DNA, 20 bp, Artificial Sequence
  Description of Artificial Sequence: Synthetic oligonucleotide
  Target: ATXN1; (-) strand; PAM type: YTN; PAM sequence: TTG
gcaatgaggaatcataaaaa

SEQ ID NO: 190909 - DNA, 20 bp, Artificial Sequence
  Description of Artificial Sequence: Synthetic oligonucleotide
  Target: ATXN1; (-) strand; PAM type: YTN; PAM sequence: CTG
ttggcaatgaggaatcataa

SEQ ID NO: 190910 - DNA, 20 bp, Artificial Sequence
  Description of Artificial Sequence: Synthetic oligonucleotide
  Target: ATXN1; (-) strand; PAM type: YTN; PAM sequence: TTG
ctgttggcaatgaggaatca

SEQ ID NO: 190911 - DNA, 20 bp, Artificial Sequence
  Description of Artificial Sequence: Synthetic oligonucleotide
  Target: ATXN1; (-) strand; PAM type: YTN; PAM sequence: TTG
aaaatcattgctgttggcaa

SEQ ID NO: 190912 - DNA, 20 bp, Artificial Sequence
  Description of Artificial Sequence: Synthetic oligonucleotide
  Target: ATXN1; (-) strand; PAM type: YTN; PAM sequence: TTT
gaaaatcattgctgttggca

SEQ ID NO: 190913 - DNA, 20 bp, Artificial Sequence
  Description of Artificial Sequence: Synthetic oligonucleotide
  Target: ATXN1; (-) strand; PAM type: YTN; PAM sequence: TTA
aaaaacacatttgaaaatca

SEQ ID NO: 190914 - DNA, 20 bp, Artificial Sequence
  Description of Artificial Sequence: Synthetic oligonucleotide
  Target: ATXN1; (-) strand; PAM type: YTN; PAM sequence: TTT
aaaaaacacatttgaaaatc

SEQ ID NO: 190915 - DNA, 20 bp, Artificial Sequence
  Description of Artificial Sequence: Synthetic oligonucleotide
  Target: ATXN1; (-) strand; PAM type: YTN; PAM sequence: TTT
taaaaaacacatttgaaaat

SEQ ID NO: 190916 - DNA, 20 bp, Artificial Sequence
  Description of Artificial Sequence: Synthetic oligonucleotide
  Target: ATXN1; (-) strand; PAM type: YTN; PAM sequence: CTT
ttaaaaaacacatttgaaaa

SEQ ID NO: 190917 - DNA, 20 bp, Artificial Sequence
  Description of Artificial Sequence: Synthetic oligonucleotide
  Target: ATXN1; (-) strand; PAM type: YTN; PAM sequence: CTG
gcttttaaaaaacacatttg

SEQ ID NO: 190918 - DNA, 20 bp, Artificial Sequence
  Description of Artificial Sequence: Synthetic oligonucleotide
  Target: ATXN1; (-) strand; PAM type: YTN; PAM sequence: TTC
tggcttttaaaaaacacatt

SEQ ID NO: 190919 - DNA, 20 bp, Artificial Sequence
  Description of Artificial Sequence: Synthetic oligonucleotide
  Target: ATXN1; (-) strand; PAM type: YTN; PAM sequence: TTG
aaggcagagttctggctttt

SEQ ID NO: 190920 - DNA, 20 bp, Artificial Sequence
  Description of Artificial Sequence: Synthetic oligonucleotide
  Target: ATXN1; (-) strand; PAM type: YTN; PAM sequence: TTT
gaaggcagagttctggcttt

SEQ ID NO: 190921 - DNA, 20 bp, Artificial Sequence
  Description of Artificial Sequence: Synthetic oligonucleotide
  Target: ATXN1; (-) strand; PAM type: YTN; PAM sequence: TTG
tttgaaggcagagttctggc

SEQ ID NO: 190922 - DNA, 20 bp, Artificial Sequence
  Description of Artificial Sequence: Synthetic oligonucleotide
  Target: ATXN1; (-) strand; PAM type: YTN; PAM sequence: TTT
gtttgaaggcagagttctgg

SEQ ID NO: 190923 - DNA, 20 bp, Artificial Sequence
  Description of Artificial Sequence: Synthetic oligonucleotide
  Target: ATXN1; (-) strand; PAM type: YTN; PAM sequence: TTT
tgtttgaaggcagagttctg

SEQ ID NO: 190924 - DNA, 20 bp, Artificial Sequence
  Description of Artificial Sequence: Synthetic oligonucleotide
  Target: ATXN1; (-) strand; PAM type: YTN; PAM sequence: CTA
tataagattttgtttgaagg

SEQ ID NO: 190925 - DNA, 20 bp, Artificial Sequence
  Description of Artificial Sequence: Synthetic oligonucleotide
  Target: ATXN1; (-) strand; PAM type: YTN; PAM sequence: TTC
tatataagattttgtttgaa

SEQ ID NO: 190926 - DNA, 20 bp, Artificial Sequence
  Description of Artificial Sequence: Synthetic oligonucleotide
  Target: ATXN1; (-) strand; PAM type: YTN; PAM sequence: TTT
ctatataagattttgtttga

SEQ ID NO: 190927 - DNA, 20 bp, Artificial Sequence
  Description of Artificial Sequence: Synthetic oligonucleotide
  Target: ATXN1; (-) strand; PAM type: YTN; PAM sequence: TTA
gatttctatataagattttg

SEQ ID NO: 190928 - DNA, 20 bp, Artificial Sequence
  Description of Artificial Sequence: Synthetic oligonucleotide
  Target: ATXN1; (-) strand; PAM type: YTN; PAM sequence: TTG
tgtattagatttctatataa

SEQ ID NO: 190929 - DNA, 20 bp, Artificial Sequence
  Description of Artificial Sequence: Synthetic oligonucleotide
  Target: ATXN1; (-) strand; PAM type: YTN; PAM sequence: CTT
gtgtattagatttctatata

SEQ ID NO: 190930 - DNA, 20 bp, Artificial Sequence
  Description of Artificial Sequence: Synthetic oligonucleotide
  Target: ATXN1; (-) strand; PAM type: YTN; PAM sequence: TTA
tcttgtgtattagatttcta

SEQ ID NO: 190931 - DNA, 20 bp, Artificial Sequence
  Description of Artificial Sequence: Synthetic oligonucleotide
  Target: ATXN1; (-) strand; PAM type: YTN; PAM sequence: TTT
atcttgtgtattagatttct

SEQ ID NO: 190932 - DNA, 20 bp, Artificial Sequence
  Description of Artificial Sequence: Synthetic oligonucleotide
  Target: ATXN1; (-) strand; PAM type: YTN; PAM sequence: TTA
tttatcttgtgtattagatt

SEQ ID NO: 190933 - DNA, 20 bp, Artificial Sequence
  Description of Artificial Sequence: Synthetic oligonucleotide
  Target: ATXN1; (-) strand; PAM type: YTN; PAM sequence: TTT
atttatcttgtgtattagat

SEQ ID NO: 190934 - DNA, 20 bp, Artificial Sequence
  Description of Artificial Sequence: Synthetic oligonucleotide
  Target: ATXN1; (-) strand; PAM type: YTN; PAM sequence: TTT
tatttatcttgtgtattaga

SEQ ID NO: 190935 - DNA, 20 bp, Artificial Sequence
  Description of Artificial Sequence: Synthetic oligonucleotide
  Target: ATXN1; (-) strand; PAM type: YTN; PAM sequence: CTC
aattttatttatcttgtgta

SEQ ID NO: 190936 - DNA, 20 bp, Artificial Sequence
  Description of Artificial Sequence: Synthetic oligonucleotide
  Target: ATXN1; (-) strand; PAM type: YTN; PAM sequence: CTA
gatagtgtaagtagcctcaa

SEQ ID NO: 190937 - DNA, 20 bp, Artificial Sequence
  Description of Artificial Sequence: Synthetic oligonucleotide
  Target: ATXN1; (-) strand; PAM type: YTN; PAM sequence: TTG
gtggtgatggatgaggagta

SEQ ID NO: 190938 - DNA, 20 bp, Artificial Sequence
  Description of Artificial Sequence: Synthetic oligonucleotide
  Target: ATXN1; (-) strand; PAM type: YTN; PAM sequence: CTT
ggtggtgatggatgaggagt

SEQ ID NO: 190939 - DNA, 20 bp, Artificial Sequence
  Description of Artificial Sequence: Synthetic oligonucleotide
  Target: ATXN1; (-) strand; PAM type: YTN; PAM sequence: TTC
agaagtacttggtggtgatg

SEQ ID NO: 190940 - DNA, 20 bp, Artificial Sequence
  Description of Artificial Sequence: Synthetic oligonucleotide
  Target: ATXN1; (-) strand; PAM type: YTN; PAM sequence: CTT
cagaagtacttggtggtgat

SEQ ID NO: 190941 - DNA, 20 bp, Artificial Sequence
  Description of Artificial Sequence: Synthetic oligonucleotide
  Target: ATXN1; (-) strand; PAM type: YTN; PAM sequence: CTG
ccttcagaagtacttggtgg

SEQ ID NO: 190942 - DNA, 20 bp, Artificial Sequence
  Description of Artificial Sequence: Synthetic oligonucleotide
  Target: ATXN1; (-) strand; PAM type: YTN; PAM sequence: CTG
tggggctgccttcagaagta

SEQ ID NO: 190943 - DNA, 20 bp, Artificial Sequence
  Description of Artificial Sequence: Synthetic oligonucleotide
  Target: ATXN1; (-) strand; PAM type: YTN; PAM sequence: CTC
tgtggggctgccttcagaag

SEQ ID NO: 190944 - DNA, 20 bp, Artificial Sequence
  Description of Artificial Sequence: Synthetic oligonucleotide
  Target: ATXN1; (-) strand; PAM type: YTN; PAM sequence: CTG
tgaacctctgtggggctgcc

SEQ ID NO: 190945 - DNA, 20 bp, Artificial Sequence
  Description of Artificial Sequence: Synthetic oligonucleotide
  Target: ATXN1; (-) strand; PAM type: YTN; PAM sequence: CTG
ccctgtgaacctctgtgggg

SEQ ID NO: 190946 - DNA, 20 bp, Artificial Sequence
  Description of Artificial Sequence: Synthetic oligonucleotide
  Target: ATXN1; (-) strand; PAM type: YTN; PAM sequence: CTC
tgccctgtgaacctctgtgg

SEQ ID NO: 190947 - DNA, 20 bp, Artificial Sequence
  Description of Artificial Sequence: Synthetic oligonucleotide
  Target: ATXN1; (-) strand; PAM type: YTN; PAM sequence: CTC
ccaacctctgccctgtgaac

SEQ ID NO: 190948 - DNA, 20 bp, Artificial Sequence
  Description of Artificial Sequence: Synthetic oligonucleotide
  Target: ATXN1; (-) strand; PAM type: YTN; PAM sequence: CTC
agtctcccaacctctgccct

SEQ ID NO: 190949 - DNA, 20 bp, Artificial Sequence
  Description of Artificial Sequence: Synthetic oligonucleotide
  Target: ATXN1; (-) strand; PAM type: YTN; PAM sequence: TTC
tcagtctcccaacctctgcc

SEQ ID NO: 190950 - DNA, 20 bp, Artificial Sequence
  Description of Artificial Sequence: Synthetic oligonucleotide
  Target: ATXN1; (-) strand; PAM type: YTN; PAM sequence: TTT
ctcagtctcccaacctctgc

SEQ ID NO: 190951 - DNA, 20 bp, Artificial Sequence
  Description of Artificial Sequence: Synthetic oligonucleotide
  Target: ATXN1; (-) strand; PAM type: YTN; PAM sequence: CTG
aggatttctcagtctcccaa

SEQ ID NO: 190952 - DNA, 20 bp, Artificial Sequence
  Description of Artificial Sequence: Synthetic oligonucleotide
  Target: ATXN1; (-) strand; PAM type: YTN; PAM sequence: CTC
cagtagcctgaggatttctc

SEQ ID NO: 190953 - DNA, 20 bp, Artificial Sequence
  Description of Artificial Sequence: Synthetic oligonucleotide
  Target: ATXN1; (-) strand; PAM type: YTN; PAM sequence: TTC
tccagtagcctgaggatttc

SEQ ID NO: 190954 - DNA, 20 bp, Artificial Sequence
  Description of Artificial Sequence: Synthetic oligonucleotide
  Target: ATXN1; (-) strand; PAM type: YTN; PAM sequence: CTC
ggtggaggtcagaccacatt

SEQ ID NO: 190955 - DNA, 20 bp, Artificial Sequence
  Description of Artificial Sequence: Synthetic oligonucleotide
  Target: ATXN1; (-) strand; PAM type: YTN; PAM sequence: CTC
agctcggtggaggtcagacc

SEQ ID NO: 190956 - DNA, 20 bp, Artificial Sequence
  Description of Artificial Sequence: Synthetic oligonucleotide
  Target: ATXN1; (-) strand; PAM type: YTN; PAM sequence: CTC
ctcagctcggtggaggtcag

SEQ ID NO: 190957 - DNA, 20 bp, Artificial Sequence
  Description of Artificial Sequence: Synthetic oligonucleotide
  Target: ATXN1; (-) strand; PAM type: YTN; PAM sequence: TTA
aggagtacagactcctcagc

SEQ ID NO: 190958 - DNA, 20 bp, Artificial Sequence
  Description of Artificial Sequence: Synthetic oligonucleotide
  Target: ATXN1; (-) strand; PAM type: YTN; PAM sequence: CTC
ataggccatgttaaggagta

SEQ ID NO: 190959 - DNA, 20 bp, Artificial Sequence
  Description of Artificial Sequence: Synthetic oligonucleotide
  Target: ATXN1; (-) strand; PAM type: YTN; PAM sequence: TTG
tcatgaggccaggagcaaac

SEQ ID NO: 190960 - DNA, 20 bp, Artificial Sequence
  Description of Artificial Sequence: Synthetic oligonucleotide
  Target: ATXN1; (-) strand; PAM type: YTN; PAM sequence: CTT
gtcatgaggccaggagcaaa

SEQ ID NO: 190961 - DNA, 20 bp, Artificial Sequence
  Description of Artificial Sequence: Synthetic oligonucleotide
  Target: ATXN1; (-) strand; PAM type: YTN; PAM sequence: TTG
gtggtaacttgtcatgaggc

SEQ ID NO: 190962 - DNA, 20 bp, Artificial Sequence
  Description of Artificial Sequence: Synthetic oligonucleotide
  Target: ATXN1; (-) strand; PAM type: YTN; PAM sequence: CTC
cattggtggtaacttgtcat

SEQ ID NO: 190963 - DNA, 20 bp, Artificial Sequence
  Description of Artificial Sequence: Synthetic oligonucleotide
  Target: ATXN1; (-) strand; PAM type: YTN; PAM sequence: CTG
ccaagggacagcatggacaa

SEQ ID NO: 190964 - DNA, 20 bp, Artificial Sequence
  Description of Artificial Sequence: Synthetic oligonucleotide
  Target: ATXN1; (-) strand; PAM type: YTN; PAM sequence: CTG
tcaaagagaagatggacata

SEQ ID NO: 190965 - DNA, 20 bp, Artificial Sequence
  Description of Artificial Sequence: Synthetic oligonucleotide
  Target: ATXN1; (-) strand; PAM type: YTN; PAM sequence: TTG
gcatctgtcaaagagaagat

SEQ ID NO: 190966 - DNA, 20 bp, Artificial Sequence
  Description of Artificial Sequence: Synthetic oligonucleotide
  Target: ATXN1; (-) strand; PAM type: YTN; PAM sequence: CTT
ggcatctgtcaaagagaaga

SEQ ID NO: 190967 - DNA, 20 bp, Artificial Sequence
  Description of Artificial Sequence: Synthetic oligonucleotide
  Target: ATXN1; (-) strand; PAM type: YTN; PAM sequence: TTG
tggggtgtcttggcatctgt

SEQ ID NO: 190968 - DNA, 20 bp, Artificial Sequence
  Description of Artificial Sequence: Synthetic oligonucleotide
  Target: ATXN1; (-) strand; PAM type: YTN; PAM sequence: CTG
tgcagagttgtggggtgtct

SEQ ID NO: 190969 - DNA, 20 bp, Artificial Sequence
  Description of Artificial Sequence: Synthetic oligonucleotide
  Target: ATXN1; (-) strand; PAM type: YTN; PAM sequence: CTG
tgtccagctgtgcagagttg

SEQ ID NO: 190970 - DNA, 20 bp, Artificial Sequence
  Description of Artificial Sequence: Synthetic oligonucleotide
  Target: ATXN1; (-) strand; PAM type: YTN; PAM sequence: TTA
agactgtgtccagctgtgca

SEQ ID NO: 190971 - DNA, 20 bp, Artificial Sequence
  Description of Artificial Sequence: Synthetic oligonucleotide
  Target: ATXN1; (-) strand; PAM type: YTN; PAM sequence: TTA
ccagccagcgtggtgagcca

SEQ ID NO: 190972 - DNA, 20 bp, Artificial Sequence
  Description of Artificial Sequence: Synthetic oligonucleotide
  Target: ATXN1; (-) strand; PAM type: YTN; PAM sequence: TTA
agtgaaagccatatgaacaa

SEQ ID NO: 190973 - DNA, 20 bp, Artificial Sequence
  Description of Artificial Sequence: Synthetic oligonucleotide
  Target: ATXN1; (-) strand; PAM type: YTN; PAM sequence: TTT
aagtgaaagccatatgaaca

SEQ ID NO: 190974 - DNA, 20 bp, Artificial Sequence
  Description of Artificial Sequence: Synthetic oligonucleotide
  Target: ATXN1; (-) strand; PAM type: YTN; PAM sequence: TTA
gtttaagtgaaagccatatg

SEQ ID NO: 190975 - DNA, 20 bp, Artificial Sequence
  Description of Artificial Sequence: Synthetic oligonucleotide
  Target: ATXN1; (-) strand; PAM type: YTN; PAM sequence: CTG
aggttagtttaagtgaaagc

SEQ ID NO: 190976 - DNA, 20 bp, Artificial Sequence
  Description of Artificial Sequence: Synthetic oligonucleotide
  Target: ATXN1; (-) strand; PAM type: YTN; PAM sequence: CTC
tgaggttagtttaagtgaaa

SEQ ID NO: 190977 - DNA, 20 bp, Artificial Sequence
  Description of Artificial Sequence: Synthetic oligonucleotide
  Target: ATXN1; (-) strand; PAM type: YTN; PAM sequence: TTA
ctctgaggttagtttaagtg

SEQ ID NO: 190978 - DNA, 20 bp, Artificial Sequence
  Description of Artificial Sequence: Synthetic oligonucleotide
  Target: ATXN1; (-) strand; PAM type: YTN; PAM sequence: TTG
tgttactctgaggttagttt

SEQ ID NO: 190979 - DNA, 20 bp, Artificial Sequence
  Description of Artificial Sequence: Synthetic oligonucleotide
  Target: ATXN1; (-) strand; PAM type: YTN; PAM sequence: CTT
gtgttactctgaggttagtt

SEQ ID NO: 190980 - DNA, 20 bp, Artificial Sequence
  Description of Artificial Sequence: Synthetic oligonucleotide
  Target: ATXN1; (-) strand; PAM type: YTN; PAM sequence: CTG
tgcttgtgttactctgaggt

SEQ ID NO: 190981 - DNA, 20 bp, Artificial Sequence
  Description of Artificial Sequence: Synthetic oligonucleotide
  Target: ATXN1; (-) strand; PAM type: YTN; PAM sequence: TTC
tgtgcttgtgttactctgag

SEQ ID NO: 190982 - DNA, 20 bp, Artificial Sequence
  Description of Artificial Sequence: Synthetic oligonucleotide
  Target: ATXN1; (-) strand; PAM type: YTN; PAM sequence: TTT
ctgtgcttgtgttactctga

SEQ ID NO: 190983 - DNA, 20 bp, Artificial Sequence
  Description of Artificial Sequence: Synthetic oligonucleotide
  Target: ATXN1; (-) strand; PAM type: YTN; PAM sequence: TTT
tctgtgcttgtgttactctg

SEQ ID NO: 190984 - DNA, 20 bp, Artificial Sequence
  Description of Artificial Sequence: Synthetic oligonucleotide
  Target: ATXN1; (-) strand; PAM type: YTN; PAM sequence: CTA
tgaatacattttctgtgctt

SEQ ID NO: 190985 - DNA, 20 bp, Artificial Sequence
  Description of Artificial Sequence: Synthetic oligonucleotide
  Target: ATXN1; (-) strand; PAM type: YTN; PAM sequence: CTG
gaatataactatgaatacat

SEQ ID NO: 190986 - DNA, 20 bp, Artificial Sequence
  Description of Artificial Sequence: Synthetic oligonucleotide
  Target: ATXN1; (-) strand; PAM type: YTN; PAM sequence: TTC
caagctggaatataactatg

SEQ ID NO: 190987 - DNA, 20 bp, Artificial Sequence
  Description of Artificial Sequence: Synthetic oligonucleotide
  Target: ATXN1; (-) strand; PAM type: YTN; PAM sequence: CTG
tgttccaagctggaatataa

SEQ ID NO: 190988 - DNA, 20 bp, Artificial Sequence
  Description of Artificial Sequence: Synthetic oligonucleotide
  Target: ATXN1; (-) strand; PAM type: YTN; PAM sequence: TTA
ggtcaacatctgtgttccaa

SEQ ID NO: 190989 - DNA, 20 bp, Artificial Sequence
  Description of Artificial Sequence: Synthetic oligonucleotide
  Target: ATXN1; (-) strand; PAM type: YTN; PAM sequence: CTG
ttaggtcaacatctgtgttc

SEQ ID NO: 190990 - DNA, 20 bp, Artificial Sequence
  Description of Artificial Sequence: Synthetic oligonucleotide
  Target: ATXN1; (-) strand; PAM type: YTN; PAM sequence: TTA
tgaagccactgttaggtcaa

SEQ ID NO: 190991 - DNA, 20 bp, Artificial Sequence
  Description of Artificial Sequence: Synthetic oligonucleotide
  Target: ATXN1; (-) strand; PAM type: YTN; PAM sequence: TTT
atgaagccactgttaggtca

SEQ ID NO: 190992 - DNA, 20 bp, Artificial Sequence
  Description of Artificial Sequence: Synthetic oligonucleotide
  Target: ATXN1; (-) strand; PAM type: YTN; PAM sequence: TTC
aacaaatatttatgaagcca

SEQ ID NO: 190993 - DNA, 20 bp, Artificial Sequence
  Description of Artificial Sequence: Synthetic oligonucleotide
  Target: ATXN1; (-) strand; PAM type: YTN; PAM sequence: TTC
attcaacaaatatttatgaa

SEQ ID NO: 190994 - DNA, 20 bp, Artificial Sequence
  Description of Artificial Sequence: Synthetic oligonucleotide
  Target: ATXN1; (-) strand; PAM type: YTN; PAM sequence: TTC
attcattcaacaaatattta

SEQ ID NO: 190995 - DNA, 20 bp, Artificial Sequence
  Description of Artificial Sequence: Synthetic oligonucleotide
  Target: ATXN1; (-) strand; PAM type: YTN; PAM sequence: TTA
ttcattcattcaacaaatat

SEQ ID NO: 190996 - DNA, 20 bp, Artificial Sequence
  Description of Artificial Sequence: Synthetic oligonucleotide
  Target: ATXN1; (-) strand; PAM type: YTN; PAM sequence: TTT
attcattcattcaacaaata

SEQ ID NO: 190997 - DNA, 20 bp, Artificial Sequence
  Description of Artificial Sequence: Synthetic oligonucleotide
  Target: ATXN1; (-) strand; PAM type: YTN; PAM sequence: CTT
tattcattcattcaacaaat

SEQ ID NO: 190998 - DNA, 20 bp, Artificial Sequence
  Description of Artificial Sequence: Synthetic oligonucleotide
  Target: ATXN1; (-) strand; PAM type: YTN; PAM sequence: CTC
acccatccatctttattcat

SEQ ID NO: 190999 - DNA, 20 bp, Artificial Sequence
  Description of Artificial Sequence: Synthetic oligonucleotide
  Target: ATXN1; (-) strand; PAM type: YTN; PAM sequence: TTG
tcatgtcatccactcaccca

SEQ ID NO: 191000 - DNA, 20 bp, Artificial Sequence
  Description of Artificial Sequence: Synthetic oligonucleotide
  Target: ATXN1; (-) strand; PAM type: YTN; PAM sequence: TTG
atgaaagtatattgtcatgt

SEQ ID NO: 191001 - DNA, 20 bp, Artificial Sequence
  Description of Artificial Sequence: Synthetic oligonucleotide
  Target: ATXN1; (-) strand; PAM type: YTN; PAM sequence: TTT
gatgaaagtatattgtcatg

SEQ ID NO: 191002 - DNA, 20 bp, Artificial Sequence
  Description of Artificial Sequence: Synthetic oligonucleotide
  Target: ATXN1; (-) strand; PAM type: YTN; PAM sequence: CTA
gtttgatgaaagtatattgt

SEQ ID NO: 191003 - DNA, 20 bp, Artificial Sequence
  Description of Artificial Sequence: Synthetic oligonucleotide
  Target: ATXN1; (-) strand; PAM type: YTN; PAM sequence: TTC
cctagtttgatgaaagtata

SEQ ID NO: 191004 - DNA, 20 bp, Artificial Sequence
  Description of Artificial Sequence: Synthetic oligonucleotide
  Target: ATXN1; (-) strand; PAM type: YTN; PAM sequence: TTT
ccctagtttgatgaaagtat

SEQ ID NO: 191005 - DNA, 20 bp, Artificial Sequence
  Description of Artificial Sequence: Synthetic oligonucleotide
  Target: ATXN1; (-) strand; PAM type: YTN; PAM sequence: TTT
tccctagtttgatgaaagta

SEQ ID NO: 191006 - DNA, 20 bp, Artificial Sequence
  Description of Artificial Sequence: Synthetic oligonucleotide
  Target: ATXN1; (-) strand; PAM type: YTN; PAM sequence: TTT
ttccctagtttgatgaaagt

SEQ ID NO: 191007 - DNA, 20 bp, Artificial Sequence
  Description of Artificial Sequence: Synthetic oligonucleotide
  Target: ATXN1; (-) strand; PAM type: YTN; PAM sequence: TTA
cataaatatttttccctagt

SEQ ID NO: 191008 - DNA, 20 bp, Artificial Sequence
  Description of Artificial Sequence: Synthetic oligonucleotide
  Target: ATXN1; (-) strand; PAM type: YTN; PAM sequence: TTT
acataaatatttttccctag

SEQ ID NO: 191009 - DNA, 20 bp, Artificial Sequence
  Description of Artificial Sequence: Synthetic oligonucleotide
  Target: ATXN1; (-) strand; PAM type: YTN; PAM sequence: TTA
gaagtatatatgtaatatat

SEQ ID NO: 191010 - DNA, 20 bp, Artificial Sequence
  Description of Artificial Sequence: Synthetic oligonucleotide
  Target: ATXN1; (-) strand; PAM type: YTN; PAM sequence: TTT
agaagtatatatgtaatata

SEQ ID NO: 191011 - DNA, 20 bp, Artificial Sequence
  Description of Artificial Sequence: Synthetic oligonucleotide
  Target: ATXN1; (-) strand; PAM type: YTN; PAM sequence: TTT
tagaagtatatatgtaatat

SEQ ID NO: 191012 - DNA, 20 bp, Artificial Sequence
  Description of Artificial Sequence: Synthetic oligonucleotide
  Target: ATXN1; (-) strand; PAM type: YTN; PAM sequence: TTT
ttagaagtatatatgtaata

SEQ ID NO: 191013 - DNA, 20 bp, Artificial Sequence
  Description of Artificial Sequence: Synthetic oligonucleotide
  Target: ATXN1; (-) strand; PAM type: YTN; PAM sequence: TTA
ccacaatttttagaagtata

SEQ ID NO: 191014 - DNA, 20 bp, Artificial Sequence
  Description of Artificial Sequence: Synthetic oligonucleotide
  Target: ATXN1; (-) strand; PAM type: YTN; PAM sequence: TTT
accacaatttttagaagtat

SEQ ID NO: 191015 - DNA, 20 bp, Artificial Sequence
  Description of Artificial Sequence: Synthetic oligonucleotide
  Target: ATXN1; (-) strand; PAM type: YTN; PAM sequence: TTG
tgtagtttaccacaattttt

SEQ ID NO: 191016 - DNA, 20 bp, Artificial Sequence
  Description of Artificial Sequence: Synthetic oligonucleotide
  Target: ATXN1; (-) strand; PAM type: YTN; PAM sequence: TTT
gtgtagtttaccacaatttt

SEQ ID NO: 191017 - DNA, 20 bp, Artificial Sequence
  Description of Artificial Sequence: Synthetic oligonucleotide
  Target: ATXN1; (-) strand; PAM type: YTN; PAM sequence: TTA
tatttgtgtagtttaccaca

SEQ ID NO: 191018 - DNA, 20 bp, Artificial Sequence
  Description of Artificial Sequence: Synthetic oligonucleotide
  Target: ATXN1; (-) strand; PAM type: YTN; PAM sequence: TTT
atatttgtgtagtttaccac

SEQ ID NO: 191019 - DNA, 20 bp, Artificial Sequence
  Description of Artificial Sequence: Synthetic oligonucleotide
  Target: ATXN1; (-) strand; PAM type: YTN; PAM sequence: TTT
tatatttgtgtagtttacca

SEQ ID NO: 191020 - DNA, 20 bp, Artificial Sequence
  Description of Artificial Sequence: Synthetic oligonucleotide
  Target: ATXN1; (-) strand; PAM type: YTN; PAM sequence: TTA
agatggtacattttatattt

SEQ ID NO: 191021 - DNA, 20 bp, Artificial Sequence
  Description of Artificial Sequence: Synthetic oligonucleotide
  Target: ATXN1; (-) strand; PAM type: YTN; PAM sequence: TTT
aagatggtacattttatatt

SEQ ID NO: 191022 - DNA, 20 bp, Artificial Sequence
  Description of Artificial Sequence: Synthetic oligonucleotide
  Target: ATXN1; (-) strand; PAM type: YTN; PAM sequence: TTA
aaaatgtttaagatggtaca

SEQ ID NO: 191023 - DNA, 20 bp, Artificial Sequence
  Description of Artificial Sequence: Synthetic oligonucleotide
  Target: ATXN1; (-) strand; PAM type: YTN; PAM sequence: CTG
tatagttaaaaatgtttaag

SEQ ID NO: 191024 - DNA, 20 bp, Artificial Sequence
  Description of Artificial Sequence: Synthetic oligonucleotide
  Target: ATXN1; (-) strand; PAM type: YTN; PAM sequence: CTG
actgtatagttaaaaatgtt

SEQ ID NO: 191025 - DNA, 20 bp, Artificial Sequence
  Description of Artificial Sequence: Synthetic oligonucleotide
  Target: ATXN1; (-) strand; PAM type: YTN; PAM sequence: TTA
atgccactgactgtatagtt

SEQ ID NO: 191026 - DNA, 20 bp, Artificial Sequence
  Description of Artificial Sequence: Synthetic oligonucleotide
  Target: ATXN1; (-) strand; PAM type: YTN; PAM sequence: CTT
aatgccactgactgtatagt

SEQ ID NO: 191027 - DNA, 20 bp, Artificial Sequence
  Description of Artificial Sequence: Synthetic oligonucleotide
  Target: ATXN1; (-) strand; PAM type: YTN; PAM sequence: TTG
tgaacgtacttaatgccact

SEQ ID NO: 191028 - DNA, 20 bp, Artificial Sequence
  Description of Artificial Sequence: Synthetic oligonucleotide
  Target: ATXN1; (-) strand; PAM type: YTN; PAM sequence: TTG
tgcatcattgtgaacgtact

SEQ ID NO: 191029 - DNA, 20 bp, Artificial Sequence
  Description of Artificial Sequence: Synthetic oligonucleotide
  Target: ATXN1; (-) strand; PAM type: YTN; PAM sequence: TTG
gggggtggatggtggtaatg

SEQ ID NO: 191030 - DNA, 20 bp, Artificial Sequence
  Description of Artificial Sequence: Synthetic oligonucleotide
  Target: ATXN1; (-) strand; PAM type: YTN; PAM sequence: TTT
ggggggtggatggtggtaat

SEQ ID NO: 191031 - DNA, 20 bp, Artificial Sequence
  Description of Artificial Sequence: Synthetic oligonucleotide
  Target: ATXN1; (-) strand; PAM type: YTN; PAM sequence: TTG
caaaatgaagagtttggggg

SEQ ID NO: 191032 - DNA, 20 bp, Artificial Sequence
  Description of Artificial Sequence: Synthetic oligonucleotide
  Target: ATXN1; (-) strand; PAM type: YTN; PAM sequence: TTT
gcaaaatgaagagtttgggg

SEQ ID NO: 191033 - DNA, 20 bp, Artificial Sequence
  Description of Artificial Sequence: Synthetic oligonucleotide
  Target: ATXN1; (-) strand; PAM type: YTN; PAM sequence: TTT
tgcaaaatgaagagtttggg

SEQ ID NO: 191034 - DNA, 20 bp, Artificial Sequence
  Description of Artificial Sequence: Synthetic oligonucleotide
  Target: ATXN1; (-) strand; PAM type: YTN; PAM sequence: TTC
agttttgcaaaatgaagagt

SEQ ID NO: 191035 - DNA, 20 bp, Artificial Sequence
  Description of Artificial Sequence: Synthetic oligonucleotide
  Target: ATXN1; (-) strand; PAM type: YTN; PAM sequence: TTT
cagttttgcaaaatgaagag

SEQ ID NO: 191036 - DNA, 20 bp, Artificial Sequence
  Description of Artificial Sequence: Synthetic oligonucleotide
  Target: ATXN1; (-) strand; PAM type: YTN; PAM sequence: TTA
aaaagtttcagttttgcaaa

SEQ ID NO: 191037 - DNA, 20 bp, Artificial Sequence
  Description of Artificial Sequence: Synthetic oligonucleotide
  Target: ATXN1; (-) strand; PAM type: YTN; PAM sequence: TTA
aatgtacgtatgttaaaaag

SEQ ID NO: 191038 - DNA, 20 bp, Artificial Sequence
  Description of Artificial Sequence: Synthetic oligonucleotide
  Target: ATXN1; (-) strand; PAM type: YTN; PAM sequence: TTT
aaatgtacgtatgttaaaaa

SEQ ID NO: 191039 - DNA, 20 bp, Artificial Sequence
  Description of Artificial Sequence: Synthetic oligonucleotide
  Target: ATXN1; (-) strand; PAM type: YTN; PAM sequence: TTT
taaatgtacgtatgttaaaa

SEQ ID NO: 191040 - DNA, 20 bp, Artificial Sequence
  Description of Artificial Sequence: Synthetic oligonucleotide
  Target: ATXN1; (-) strand; PAM type: YTN; PAM sequence: TTT
ttaaatgtacgtatgttaaa

SEQ ID NO: 191041 - DNA, 20 bp, Artificial Sequence
  Description of Artificial Sequence: Synthetic oligonucleotide
  Target: ATXN1; (-) strand; PAM type: YTN; PAM sequence: TTT
tttaaatgtacgtatgttaa

SEQ ID NO: 191042 - DNA, 20 bp, Artificial Sequence
  Description of Artificial Sequence: Synthetic oligonucleotide
  Target: ATXN1; (-) strand; PAM type: YTN; PAM sequence: TTA
agaattttttaaatgtacgt

SEQ ID NO: 191043 - DNA, 20 bp, Artificial Sequence
  Description of Artificial Sequence: Synthetic oligonucleotide
  Target: ATXN1; (-) strand; PAM type: YTN; PAM sequence: TTT
aagaattttttaaatgtacg

SEQ ID NO: 191044 - DNA, 20 bp, Artificial Sequence
  Description of Artificial Sequence: Synthetic oligonucleotide
  Target: ATXN1; (-) strand; PAM type: YTN; PAM sequence: TTT
taagaattttttaaatgtac

SEQ ID NO: 191045 - DNA, 20 bp, Artificial Sequence
  Description of Artificial Sequence: Synthetic oligonucleotide
  Target: ATXN1; (-) strand; PAM type: YTN; PAM sequence: TTT
ttaagaattttttaaatgta

SEQ ID NO: 191046 - DNA, 20 bp, Artificial Sequence
  Description of Artificial Sequence: Synthetic oligonucleotide
  Target: ATXN1; (-) strand; PAM type: YTN; PAM sequence: TTA
catttttaagaattttttaa

SEQ ID NO: 191047 - DNA, 20 bp, Artificial Sequence
  Description of Artificial Sequence: Synthetic oligonucleotide
  Target: ATXN1; (-) strand; PAM type: YTN; PAM sequence: TTC
aattacatttttaagaattt

SEQ ID NO: 191048 - DNA, 20 bp, Artificial Sequence
  Description of Artificial Sequence: Synthetic oligonucleotide
  Target: ATXN1; (-) strand; PAM type: YTN; PAM sequence: CTA
gatcattcaattacattttt

SEQ ID NO: 191049 - DNA, 20 bp, Artificial Sequence
  Description of Artificial Sequence: Synthetic oligonucleotide
  Target: ATXN1; (-) strand; PAM type: YTN; PAM sequence: CTG
ggtaccccacaccctagatc

SEQ ID NO: 191050 - DNA, 20 bp, Artificial Sequence
  Description of Artificial Sequence: Synthetic oligonucleotide
  Target: ATXN1; (-) strand; PAM type: YTN; PAM sequence: CTG
aaaggcacaagatatatagc

SEQ ID NO: 191051 - DNA, 20 bp, Artificial Sequence
  Description of Artificial Sequence: Synthetic oligonucleotide
  Target: ATXN1; (-) strand; PAM type: YTN; PAM sequence: CTA
agtggggctgaaaggcacaa

SEQ ID NO: 191052 - DNA, 20 bp, Artificial Sequence
  Description of Artificial Sequence: Synthetic oligonucleotide
  Target: ATXN1; (-) strand; PAM type: YTN; PAM sequence: CTA
aagatgccctaagtggggct

SEQ ID NO: 191053 - DNA, 20 bp, Artificial Sequence
  Description of Artificial Sequence: Synthetic oligonucleotide
  Target: ATXN1; (-) strand; PAM type: YTN; PAM sequence: TTG
ctaaagatgccctaagtggg

SEQ ID NO: 191054 - DNA, 20 bp, Artificial Sequence
  Description of Artificial Sequence: Synthetic oligonucleotide
  Target: ATXN1; (-) strand; PAM type: YTN; PAM sequence: CTT
gctaaagatgccctaagtgg

SEQ ID NO: 191055 - DNA, 20 bp, Artificial Sequence
  Description of Artificial Sequence: Synthetic oligonucleotide
  Target: ATXN1; (-) strand; PAM type: YTN; PAM sequence: TTC
ttgctaaagatgccctaagt

SEQ ID NO: 191056 - DNA, 20 bp, Artificial Sequence
  Description of Artificial Sequence: Synthetic oligonucleotide
  Target: ATXN1; (-) strand; PAM type: YTN; PAM sequence: TTT
cttgctaaagatgccctaag

SEQ ID NO: 191057 - DNA, 20 bp, Artificial Sequence
  Description of Artificial Sequence: Synthetic oligonucleotide
  Target: ATXN1; (-) strand; PAM type: YTN; PAM sequence: TTA
ccacatttcttgctaaagat

SEQ ID NO: 191058 - DNA, 20 bp, Artificial Sequence
  Description of Artificial Sequence: Synthetic oligonucleotide
  Target: ATXN1; (-) strand; PAM type: YTN; PAM sequence: TTT
accacatttcttgctaaaga

SEQ ID NO: 191059 - DNA, 20 bp, Artificial Sequence
  Description of Artificial Sequence: Synthetic oligonucleotide
  Target: ATXN1; (-) strand; PAM type: YTN; PAM sequence: CTC
aaccacatttaccacatttc

SEQ ID NO: 191060 - DNA, 20 bp, Artificial Sequence
  Description of Artificial Sequence: Synthetic oligonucleotide
  Target: ATXN1; (-) strand; PAM type: YTN; PAM sequence: TTG
accacatgtctcaaccacat

SEQ ID NO: 191061 - DNA, 20 bp, Artificial Sequence
  Description of Artificial Sequence: Synthetic oligonucleotide
  Target: ATXN1; (-) strand; PAM type: YTN; PAM sequence: TTC
attgaccacatgtctcaacc

SEQ ID NO: 191062 - DNA, 20 bp, Artificial Sequence
  Description of Artificial Sequence: Synthetic oligonucleotide
  Target: ATXN1; (-) strand; PAM type: YTN; PAM sequence: TTT
cattgaccacatgtctcaac

SEQ ID NO: 191063 - DNA, 20 bp, Artificial Sequence
  Description of Artificial Sequence: Synthetic oligonucleotide
  Target: ATXN1; (-) strand; PAM type: YTN; PAM sequence: CTA
gtaggcaggagtttcattga

SEQ ID NO: 191064 - DNA, 20 bp, Artificial Sequence
  Description of Artificial Sequence: Synthetic oligonucleotide
  Target: ATXN1; (-) strand; PAM type: YTN; PAM sequence: CTA
agctagtaggcaggagtttc

SEQ ID NO: 191065 - DNA, 20 bp, Artificial Sequence
  Description of Artificial Sequence: Synthetic oligonucleotide
  Target: ATXN1; (-) strand; PAM type: YTN; PAM sequence: CTA
gtagctaagctagtaggcag

SEQ ID NO: 191066 - DNA, 20 bp, Artificial Sequence
  Description of Artificial Sequence: Synthetic oligonucleotide
  Target: ATXN1; (-) strand; PAM type: YTN; PAM sequence: CTA
gctagtagctaagctagtag

SEQ ID NO: 191067 - DNA, 20 bp, Artificial Sequence
  Description of Artificial Sequence: Synthetic oligonucleotide
  Target: ATXN1; (-) strand; PAM type: YTN; PAM sequence: CTG
ctagctagtagctaagctag

SEQ ID NO: 191068 - DNA, 20 bp, Artificial Sequence
  Description of Artificial Sequence: Synthetic oligonucleotide
  Target: ATXN1; (-) strand; PAM type: YTN; PAM sequence: TTG
agcagcccaaactgctagct

SEQ ID NO: 191069 - DNA, 20 bp, Artificial Sequence
  Description of Artificial Sequence: Synthetic oligonucleotide
  Target: ATXN1; (-) strand; PAM type: YTN; PAM sequence: TTT
gagcagcccaaactgctagc

SEQ ID NO: 191070 - DNA, 20 bp, Artificial Sequence
  Description of Artificial Sequence: Synthetic oligonucleotide
  Target: ATXN1; (-) strand; PAM type: YTN; PAM sequence: TTT
tgagcagcccaaactgctag

SEQ ID NO: 191071 - DNA, 20 bp, Artificial Sequence
  Description of Artificial Sequence: Synthetic oligonucleotide
  Target: ATXN1; (-) strand; PAM type: YTN; PAM sequence: TTC
attttgagcagcccaaactg

SEQ ID NO: 191072 - DNA, 20 bp, Artificial Sequence
  Description of Artificial Sequence: Synthetic oligonucleotide
  Target: ATXN1; (-) strand; PAM type: YTN; PAM sequence: TTA
tccaggaaattcattttgag

SEQ ID NO: 191073 - DNA, 20 bp, Artificial Sequence
  Description of Artificial Sequence: Synthetic oligonucleotide
  Target: ATXN1; (-) strand; PAM type: YTN; PAM sequence: TTA
ggaaaattatccaggaaatt

SEQ ID NO: 191074 - DNA, 20 bp, Artificial Sequence
  Description of Artificial Sequence: Synthetic oligonucleotide
  Target: ATXN1; (-) strand; PAM type: YTN; PAM sequence: CTT
aggaaaattatccaggaaat

SEQ ID NO: 191075 - DNA, 20 bp, Artificial Sequence
  Description of Artificial Sequence: Synthetic oligonucleotide
  Target: ATXN1; (-) strand; PAM type: YTN; PAM sequence: CTA
gcaatacatgcgagtaggag

SEQ ID NO: 191076 - DNA, 20 bp, Artificial Sequence
  Description of Artificial Sequence: Synthetic oligonucleotide
  Target: ATXN1; (-) strand; PAM type: YTN; PAM sequence: CTC
ctagcaatacatgcgagtag

SEQ ID NO: 191077 - DNA, 20 bp, Artificial Sequence
  Description of Artificial Sequence: Synthetic oligonucleotide
  Target: ATXN1; (-) strand; PAM type: YTN; PAM sequence: CTG
gctcctagcaatacatgcga

SEQ ID NO: 191078 - DNA, 20 bp, Artificial Sequence
  Description of Artificial Sequence: Synthetic oligonucleotide
  Target: ATXN1; (-) strand; PAM type: YTN; PAM sequence: CTG
gaagcccaaaccagtcccag

SEQ ID NO: 191079 - DNA, 20 bp, Artificial Sequence
  Description of Artificial Sequence: Synthetic oligonucleotide
  Target: ATXN1; (-) strand; PAM type: YTN; PAM sequence: TTC
tggaagcccaaaccagtccc

SEQ ID NO: 191080 - DNA, 20 bp, Artificial Sequence
  Description of Artificial Sequence: Synthetic oligonucleotide
  Target: ATXN1; (-) strand; PAM type: YTN; PAM sequence: TTT
ctggaagcccaaaccagtcc

SEQ ID NO: 191081 - DNA, 20 bp, Artificial Sequence
  Description of Artificial Sequence: Synthetic oligonucleotide
  Target: ATXN1; (-) strand; PAM type: YTN; PAM sequence: CTT
tctggaagcccaaaccagtc

SEQ ID NO: 191082 - DNA, 20 bp, Artificial Sequence
  Description of Artificial Sequence: Synthetic oligonucleotide
  Target: ATXN1; (-) strand; PAM type: YTN; PAM sequence: TTA
caaggcatgctttctggaag

SEQ ID NO: 191083 - DNA, 20 bp, Artificial Sequence
  Description of Artificial Sequence: Synthetic oligonucleotide
  Target: ATXN1; (-) strand; PAM type: YTN; PAM sequence: TTT
acaaggcatgctttctggaa

SEQ ID NO: 191084 - DNA, 20 bp, Artificial Sequence
  Description of Artificial Sequence: Synthetic oligonucleotide
  Target: ATXN1; (-) strand; PAM type: YTN; PAM sequence: CTT
tacaaggcatgctttctgga

SEQ ID NO: 191085 - DNA, 20 bp, Artificial Sequence
  Description of Artificial Sequence: Synthetic oligonucleotide
  Target: ATXN1; (-) strand; PAM type: YTN; PAM sequence: TTC
tttacaaggcatgctttctg

SEQ ID NO: 191086 - DNA, 20 bp, Artificial Sequence
  Description of Artificial Sequence: Synthetic oligonucleotide
  Target: ATXN1; (-) strand; PAM type: YTN; PAM sequence: CTG
ttctttacaaggcatgcttt

SEQ ID NO: 191087 - DNA, 20 bp, Artificial Sequence
  Description of Artificial Sequence: Synthetic oligonucleotide
  Target: ATXN1; (-) strand; PAM type: YTN; PAM sequence: TTG
acacacaggccctgttcttt

SEQ ID NO: 191088 - DNA, 20 bp, Artificial Sequence
  Description of Artificial Sequence: Synthetic oligonucleotide
  Target: ATXN1; (-) strand; PAM type: YTN; PAM sequence: TTT
gacacacaggccctgttctt

SEQ ID NO: 191089 - DNA, 20 bp, Artificial Sequence
  Description of Artificial Sequence: Synthetic oligonucleotide
  Target: ATXN1; (-) strand; PAM type: YTN; PAM sequence: CTG
tttgacacacaggccctgtt

SEQ ID NO: 191090 - DNA, 20 bp, Artificial Sequence
  Description of Artificial Sequence: Synthetic oligonucleotide
  Target: ATXN1; (-) strand; PAM type: YTN; PAM sequence: TTG
tatacaggctgtttgacaca

SEQ ID NO: 191091 - DNA, 20 bp, Artificial Sequence
  Description of Artificial Sequence: Synthetic oligonucleotide
  Target: ATXN1; (-) strand; PAM type: YTN; PAM sequence: CTA
tgtgtgttgtatacaggctg

SEQ ID NO: 191092 - DNA, 20 bp, Artificial Sequence
  Description of Artificial Sequence: Synthetic oligonucleotide
  Target: ATXN1; (-) strand; PAM type: YTN; PAM sequence: TTG
tcatatataagctatgtgtg

SEQ ID NO: 191093 - DNA, 20 bp, Artificial Sequence
  Description of Artificial Sequence: Synthetic oligonucleotide
  Target: ATXN1; (-) strand; PAM type: YTN; PAM sequence: TTA
aaatgacaaaaatcacatgg

SEQ ID NO: 191094 - DNA, 20 bp, Artificial Sequence
  Description of Artificial Sequence: Synthetic oligonucleotide
  Target: ATXN1; (-) strand; PAM type: YTN; PAM sequence: TTC
agaaatgttaaaatgacaaa

SEQ ID NO: 191095 - DNA, 20 bp, Artificial Sequence
  Description of Artificial Sequence: Synthetic oligonucleotide
  Target: ATXN1; (-) strand; PAM type: YTN; PAM sequence: CTG
agttcagaaatgttaaaatg

SEQ ID NO: 191096 - DNA, 20 bp, Artificial Sequence
  Description of Artificial Sequence: Synthetic oligonucleotide
  Target: ATXN1; (-) strand; PAM type: YTN; PAM sequence: TTA
tgtaccaatcatatataaaa

SEQ ID NO: 191097 - DNA, 20 bp, Artificial Sequence
  Description of Artificial Sequence: Synthetic oligonucleotide
  Target: ATXN1; (-) strand; PAM type: YTN; PAM sequence: TTT
atgtaccaatcatatataaa

SEQ ID NO: 191098 - DNA, 20 bp, Artificial Sequence
  Description of Artificial Sequence: Synthetic oligonucleotide
  Target: ATXN1; (-) strand; PAM type: YTN; PAM sequence: TTT
tatgtaccaatcatatataa

SEQ ID NO: 191099 - DNA, 20 bp, Artificial Sequence
  Description of Artificial Sequence: Synthetic oligonucleotide
  Target: ATXN1; (-) strand; PAM type: YTN; PAM sequence: CTT
ttatgtaccaatcatatata

SEQ ID NO: 191100 - DNA, 20 bp, Artificial Sequence
  Description of Artificial Sequence: Synthetic oligonucleotide
  Target: ATXN1; (-) strand; PAM type: YTN; PAM sequence: CTC
ttttatgtaccaatcatata

SEQ ID NO: 191101 - DNA, 20 bp, Artificial Sequence
  Description of Artificial Sequence: Synthetic oligonucleotide
  Target: ATXN1; (-) strand; PAM type: YTN; PAM sequence: CTA
ccactcttttatgtaccaat

SEQ ID NO: 191102 - DNA, 20 bp, Artificial Sequence
  Description of Artificial Sequence: Synthetic oligonucleotide
  Target: ATXN1; (-) strand; PAM type: YTN; PAM sequence: CTG
ggggtgggggtgctaccact

SEQ ID NO: 191103 - DNA, 20 bp, Artificial Sequence
  Description of Artificial Sequence: Synthetic oligonucleotide
  Target: ATXN1; (-) strand; PAM type: YTN; PAM sequence: TTC
tgggggtgggggtgctacca

SEQ ID NO: 191104 - DNA, 20 bp, Artificial Sequence
  Description of Artificial Sequence: Synthetic oligonucleotide
  Target: ATXN1; (-) strand; PAM type: YTN; PAM sequence: TTT
ctgggggtgggggtgctacc

SEQ ID NO: 191105 - DNA, 20 bp, Artificial Sequence
  Description of Artificial Sequence: Synthetic oligonucleotide
  Target: ATXN1; (-) strand; PAM type: YTN; PAM sequence: TTA
gtttctgggggtgggggtgc

SEQ ID NO: 191106 - DNA, 20 bp, Artificial Sequence
  Description of Artificial Sequence: Synthetic oligonucleotide
  Target: ATXN1; (-) strand; PAM type: YTN; PAM sequence: TTA
aatgattagtttctgggggt

SEQ ID NO: 191107 - DNA, 20 bp, Artificial Sequence
  Description of Artificial Sequence: Synthetic oligonucleotide
  Target: ATXN1; (-) strand; PAM type: YTN; PAM sequence: CTG
tagattaaatgattagtttc

SEQ ID NO: 191108 - DNA, 20 bp, Artificial Sequence
  Description of Artificial Sequence: Synthetic oligonucleotide
  Target: ATXN1; (-) strand; PAM type: YTN; PAM sequence: CTG
atgataatatgcactgtaga

SEQ ID NO: 191109 - DNA, 20 bp, Artificial Sequence
  Description of Artificial Sequence: Synthetic oligonucleotide
  Target: ATXN1; (-) strand; PAM type: YTN; PAM sequence: CTG
tagtgtcactgatgataata

SEQ ID NO: 191110 - DNA, 20 bp, Artificial Sequence
  Description of Artificial Sequence: Synthetic oligonucleotide
  Target: ATXN1; (-) strand; PAM type: YTN; PAM sequence: TTC
tgtagtgtcactgatgataa

SEQ ID NO: 191111 - DNA, 20 bp, Artificial Sequence
  Description of Artificial Sequence: Synthetic oligonucleotide
  Target: ATXN1; (-) strand; PAM type: YTN; PAM sequence: TTT
ctgtagtgtcactgatgata

SEQ ID NO: 191112 - DNA, 20 bp, Artificial Sequence
  Description of Artificial Sequence: Synthetic oligonucleotide
  Target: ATXN1; (-) strand; PAM type: YTN; PAM sequence: TTG
atttctgtagtgtcactgat

SEQ ID NO: 191113 - DNA, 20 bp, Artificial Sequence
  Description of Artificial Sequence: Synthetic oligonucleotide
  Target: ATXN1; (-) strand; PAM type: YTN; PAM sequence: TTT
gatttctgtagtgtcactga

SEQ ID NO: 191114 - DNA, 20 bp, Artificial Sequence
  Description of Artificial Sequence: Synthetic oligonucleotide
  Target: ATXN1; (-) strand; PAM type: YTN; PAM sequence: CTT
tgatttctgtagtgtcactg

SEQ ID NO: 191115 - DNA, 20 bp, Artificial Sequence
  Description of Artificial Sequence: Synthetic oligonucleotide
  Target: ATXN1; (-) strand; PAM type: YTN; PAM sequence: TTC
tttgatttctgtagtgtcac

SEQ ID NO: 191116 - DNA, 20 bp, Artificial Sequence
  Description of Artificial Sequence: Synthetic oligonucleotide
  Target: ATXN1; (-) strand; PAM type: YTN; PAM sequence: TTT
ctttgatttctgtagtgtca

SEQ ID NO: 191117 - DNA, 20 bp, Artificial Sequence
  Description of Artificial Sequence: Synthetic oligonucleotide
  Target: ATXN1; (-) strand; PAM type: YTN; PAM sequence: TTT
tctttgatttctgtagtgtc

SEQ ID NO: 191118 - DNA, 20 bp, Artificial Sequence
  Description of Artificial Sequence: Synthetic oligonucleotide
  Target: ATXN1; (-) strand; PAM type: YTN; PAM sequence: CTG
tgcaaatatgaaatagatac

SEQ ID NO: 191119 - DNA, 20 bp, Artificial Sequence
  Description of Artificial Sequence: Synthetic oligonucleotide
  Target: ATXN1; (-) strand; PAM type: YTN; PAM sequence: TTC
tgtgcaaatatgaaatagat

SEQ ID NO: 191120 - DNA, 20 bp, Artificial Sequence
  Description of Artificial Sequence: Synthetic oligonucleotide
  Target: ATXN1; (-) strand; PAM type: YTN; PAM sequence: TTA
aaaacgattctgtgcaaata

SEQ ID NO: 191121 - DNA, 20 bp, Artificial Sequence
  Description of Artificial Sequence: Synthetic oligonucleotide
  Target: ATXN1; (-) strand; PAM type: YTN; PAM sequence: TTA
aaattaaaaacgattctgtg

SEQ ID NO: 191122 - DNA, 20 bp, Artificial Sequence
  Description of Artificial Sequence: Synthetic oligonucleotide
  Target: ATXN1; (-) strand; PAM type: YTN; PAM sequence: TTT
aaaattaaaaacgattctgt

SEQ ID NO: 191123 - DNA, 20 bp, Artificial Sequence
  Description of Artificial Sequence: Synthetic oligonucleotide
  Target: ATXN1; (-) strand; PAM type: YTN; PAM sequence: TTA
tatgaaaaacatttaaaatt

SEQ ID NO: 191124 - DNA, 20 bp, Artificial Sequence
  Description of Artificial Sequence: Synthetic oligonucleotide
  Target: ATXN1; (-) strand; PAM type: YTN; PAM sequence: TTG
gcaatgtgatcattatatga

SEQ ID NO: 191125 - DNA, 20 bp, Artificial Sequence
  Description of Artificial Sequence: Synthetic oligonucleotide
  Target: ATXN1; (-) strand; PAM type: YTN; PAM sequence: CTC
caagtgtgagattggcaatg

SEQ ID NO: 191126 - DNA, 20 bp, Artificial Sequence
  Description of Artificial Sequence: Synthetic oligonucleotide
  Target: ATXN1; (-) strand; PAM type: YTN; PAM sequence: TTC
tccaagtgtgagattggcaa

SEQ ID NO: 191127 - DNA, 20 bp, Artificial Sequence
  Description of Artificial Sequence: Synthetic oligonucleotide
  Target: ATXN1; (-) strand; PAM type: YTN; PAM sequence: CTT
ctccaagtgtgagattggca

SEQ ID NO: 191128 - DNA, 20 bp, Artificial Sequence
  Description of Artificial Sequence: Synthetic oligonucleotide
  Target: ATXN1; (-) strand; PAM type: YTN; PAM sequence: TTG
cttctccaagtgtgagattg

SEQ ID NO: 191129 - DNA, 20 bp, Artificial Sequence
  Description of Artificial Sequence: Synthetic oligonucleotide
  Target: ATXN1; (-) strand; PAM type: YTN; PAM sequence: TTT
gcttctccaagtgtgagatt

SEQ ID NO: 191130 - DNA, 20 bp, Artificial Sequence
  Description of Artificial Sequence: Synthetic oligonucleotide
  Target: ATXN1; (-) strand; PAM type: YTN; PAM sequence: TTT
tgcttctccaagtgtgagat

SEQ ID NO: 191131 - DNA, 20 bp, Artificial Sequence
  Description of Artificial Sequence: Synthetic oligonucleotide
  Target: ATXN1; (-) strand; PAM type: YTN; PAM sequence: TTT
ttgcttctccaagtgtgaga

SEQ ID NO: 191132 - DNA, 20 bp, Artificial Sequence
  Description of Artificial Sequence: Synthetic oligonucleotide
  Target: ATXN1; (-) strand; PAM type: YTN; PAM sequence: CTT
tttgcttctccaagtgtgag

SEQ ID NO: 191133 - DNA, 20 bp, Artificial Sequence
  Description of Artificial Sequence: Synthetic oligonucleotide
  Target: ATXN1; (-) strand; PAM type: YTN; PAM sequence: TTG
ctttttgcttctccaagtgt

SEQ ID NO: 191134 - DNA, 20 bp, Artificial Sequence
  Description of Artificial Sequence: Synthetic oligonucleotide
  Target: ATXN1; (-) strand; PAM type: YTN; PAM sequence: TTT
gctttttgcttctccaagtg

SEQ ID NO: 191135 - DNA, 20 bp, Artificial Sequence
  Description of Artificial Sequence: Synthetic oligonucleotide
  Target: ATXN1; (-) strand; PAM type: YTN; PAM sequence: CTT
tgctttttgcttctccaagt

SEQ ID NO: 191136 - DNA, 20 bp, Artificial Sequence
  Description of Artificial Sequence: Synthetic oligonucleotide
  Target: ATXN1; (-) strand; PAM type: YTN; PAM sequence: TTC
tttgctttttgcttctccaa

SEQ ID NO: 191137 - DNA, 20 bp, Artificial Sequence
  Description of Artificial Sequence: Synthetic oligonucleotide
  Target: ATXN1; (-) strand; PAM type: YTN; PAM sequence: CTT
ctttgctttttgcttctcca

SEQ ID NO: 191138 - DNA, 20 bp, Artificial Sequence
  Description of Artificial Sequence: Synthetic oligonucleotide
  Target: ATXN1; (-) strand; PAM type: YTN; PAM sequence: TTC
cttctttgctttttgcttct

SEQ ID NO: 191139 - DNA, 20 bp, Artificial Sequence
  Description of Artificial Sequence: Synthetic oligonucleotide
  Target: ATXN1; (-) strand; PAM type: YTN; PAM sequence: TTT
ccttctttgctttttgcttc

SEQ ID NO: 191140 - DNA, 20 bp, Artificial Sequence
  Description of Artificial Sequence: Synthetic oligonucleotide
  Target: ATXN1; (-) strand; PAM type: YTN; PAM sequence: TTT
tccttctttgctttttgctt

SEQ ID NO: 191141 - DNA, 20 bp, Artificial Sequence
  Description of Artificial Sequence: Synthetic oligonucleotide
  Target: ATXN1; (-) strand; PAM type: YTN; PAM sequence: CTT
ttccttctttgctttttgct

SEQ ID NO: 191142 - DNA, 20 bp, Artificial Sequence
  Description of Artificial Sequence: Synthetic oligonucleotide
  Target: ATXN1; (-) strand; PAM type: YTN; PAM sequence: TTC
aagtccttttccttctttgc

SEQ ID NO: 191143 - DNA, 20 bp, Artificial Sequence
  Description of Artificial Sequence: Synthetic oligonucleotide
  Target: ATXN1; (-) strand; PAM type: YTN; PAM sequence: TTT
caagtccttttccttctttg

SEQ ID NO: 191144 - DNA, 20 bp, Artificial Sequence
  Description of Artificial Sequence: Synthetic oligonucleotide
  Target: ATXN1; (-) strand; PAM type: YTN; PAM sequence: TTT
tcaagtccttttccttcttt

SEQ ID NO: 191145 - DNA, 20 bp, Artificial Sequence
  Description of Artificial Sequence: Synthetic oligonucleotide
  Target: ATXN1; (-) strand; PAM type: YTN; PAM sequence: CTT
ttcaagtccttttccttctt

SEQ ID NO: 191146 - DNA, 20 bp, Artificial Sequence
  Description of Artificial Sequence: Synthetic oligonucleotide
  Target: ATXN1; (-) strand; PAM type: YTN; PAM sequence: TTG
tcacccttttcaagtccttt

SEQ ID NO: 191147 - DNA, 20 bp, Artificial Sequence
  Description of Artificial Sequence: Synthetic oligonucleotide
  Target: ATXN1; (-) strand; PAM type: YTN; PAM sequence: CTT
gtcacccttttcaagtcctt

SEQ ID NO: 191148 - DNA, 20 bp, Artificial Sequence
  Description of Artificial Sequence: Synthetic oligonucleotide
  Target: ATXN1; (-) strand; PAM type: YTN; PAM sequence: CTG
agtgacttgtcacccttttc

SEQ ID NO: 191149 - DNA, 20 bp, Artificial Sequence
  Description of Artificial Sequence: Synthetic oligonucleotide
  Target: ATXN1; (-) strand; PAM type: YTN; PAM sequence: TTC
acctgagtgacttgtcaccc

SEQ ID NO: 191150 - DNA, 20 bp, Artificial Sequence
  Description of Artificial Sequence: Synthetic oligonucleotide
  Target: ATXN1; (-) strand; PAM type: YTN; PAM sequence: CTC
atcccattcacctgagtgac

SEQ ID NO: 191151 - DNA, 20 bp, Artificial Sequence
  Description of Artificial Sequence: Synthetic oligonucleotide
  Target: ATXN1; (-) strand; PAM type: YTN; PAM sequence: CTG
gcctcatcccattcacctga

SEQ ID NO: 191152 - DNA, 20 bp, Artificial Sequence
  Description of Artificial Sequence: Synthetic oligonucleotide
  Target: ATXN1; (-) strand; PAM type: YTN; PAM sequence: CTC
ctggcctcatcccattcacc

SEQ ID NO: 191153 - DNA, 20 bp, Artificial Sequence
  Description of Artificial Sequence: Synthetic oligonucleotide
  Target: ATXN1; (-) strand; PAM type: YTN; PAM sequence: CTG
gtcacctcctggcctcatcc

SEQ ID NO: 191154 - DNA, 20 bp, Artificial Sequence
  Description of Artificial Sequence: Synthetic oligonucleotide
  Target: ATXN1; (-) strand; PAM type: YTN; PAM sequence: TTC
acgtcagatccaggcctggt

SEQ ID NO: 191155 - DNA, 20 bp, Artificial Sequence
  Description of Artificial Sequence: Synthetic oligonucleotide
  Target: ATXN1; (-) strand; PAM type: YTN; PAM sequence: TTG
tggggagcagttcacgtcag

SEQ ID NO: 191156 - DNA, 20 bp, Artificial Sequence
  Description of Artificial Sequence: Synthetic oligonucleotide
  Target: ATXN1; (-) strand; PAM type: YTN; PAM sequence: TTT
gtggggagcagttcacgtca

SEQ ID NO: 191157 - DNA, 20 bp, Artificial Sequence
  Description of Artificial Sequence: Synthetic oligonucleotide
  Target: ATXN1; (-) strand; PAM type: YTN; PAM sequence: CTT
tgtggggagcagttcacgtc

SEQ ID NO: 191158 - DNA, 20 bp, Artificial Sequence
  Description of Artificial Sequence: Synthetic oligonucleotide
  Target: ATXN1; (-) strand; PAM type: YTN; PAM sequence: CTG
agcgccgtggagaggtcttt

SEQ ID NO: 191159 - DNA, 20 bp, Artificial Sequence
  Description of Artificial Sequence: Synthetic oligonucleotide
  Target: ATXN1; (-) strand; PAM type: YTN; PAM sequence: CTG
aggctgagcgccgtggagag

SEQ ID NO: 191160 - DNA, 20 bp, Artificial Sequence
  Description of Artificial Sequence: Synthetic oligonucleotide
  Target: ATXN1; (-) strand; PAM type: YTN; PAM sequence: TTA
cacatgaggggagtctgagg

SEQ ID NO: 191161 - DNA, 20 bp, Artificial Sequence
  Description of Artificial Sequence: Synthetic oligonucleotide
  Target: ATXN1; (-) strand; PAM type: YTN; PAM sequence: TTT
acacatgaggggagtctgag

SEQ ID NO: 191162 - DNA, 20 bp, Artificial Sequence
  Description of Artificial Sequence: Synthetic oligonucleotide
  Target: ATXN1; (-) strand; PAM type: YTN; PAM sequence: TTT
tacacatgaggggagtctga

SEQ ID NO: 191163 - DNA, 20 bp, Artificial Sequence
  Description of Artificial Sequence: Synthetic oligonucleotide
  Target: ATXN1; (-) strand; PAM type: YTN; PAM sequence: TTA
ttttacacatgaggggagtc

SEQ ID NO: 191164 - DNA, 20 bp, Artificial Sequence
  Description of Artificial Sequence: Synthetic oligonucleotide
  Target: ATXN1; (-) strand; PAM type: YTN; PAM sequence: CTG
tgttattttacacatgaggg

SEQ ID NO: 191165 - DNA, 20 bp, Artificial Sequence
  Description of Artificial Sequence: Synthetic oligonucleotide
  Target: ATXN1; (-) strand; PAM type: YTN; PAM sequence: TTC
ccctgtgttattttacacat

SEQ ID NO: 191166 - DNA, 20 bp, Artificial Sequence
  Description of Artificial Sequence: Synthetic oligonucleotide
  Target: ATXN1; (-) strand; PAM type: YTN; PAM sequence: TTT
cccctgtgttattttacaca

SEQ ID NO: 191167 - DNA, 20 bp, Artificial Sequence
  Description of Artificial Sequence: Synthetic oligonucleotide
  Target: ATXN1; (-) strand; PAM type: YTN; PAM sequence: TTC
atttcccctgtgttatttta

SEQ ID NO: 191168 - DNA, 20 bp, Artificial Sequence
  Description of Artificial Sequence: Synthetic oligonucleotide
  Target: ATXN1; (-) strand; PAM type: YTN; PAM sequence: TTT
catttcccctgtgttatttt

SEQ ID NO: 191169 - DNA, 20 bp, Artificial Sequence
  Description of Artificial Sequence: Synthetic oligonucleotide
  Target: ATXN1; (-) strand; PAM type: YTN; PAM sequence: TTT
tcatttcccctgtgttattt

SEQ ID NO: 191170 - DNA, 20 bp, Artificial Sequence
  Description of Artificial Sequence: Synthetic oligonucleotide
  Target: ATXN1; (-) strand; PAM type: YTN; PAM sequence: TTA
attttcatttcccctgtgtt

SEQ ID NO: 191171 - DNA, 20 bp, Artificial Sequence
  Description of Artificial Sequence: Synthetic oligonucleotide
  Target: ATXN1; (-) strand; PAM type: YTN; PAM sequence: TTT
aattttcatttcccctgtgt

SEQ ID NO: 191172 - DNA, 20 bp, Artificial Sequence
  Description of Artificial Sequence: Synthetic oligonucleotide
  Target: ATXN1; (-) strand; PAM type: YTN; PAM sequence: CTG
gtttaattttcatttcccct

SEQ ID NO: 191173 - DNA, 20 bp, Artificial Sequence
  Description of Artificial Sequence: Synthetic oligonucleotide
  Target: ATXN1; (-) strand; PAM type: YTN; PAM sequence: TTA
acactggtttaattttcatt

SEQ ID NO: 191174 - DNA, 20 bp, Artificial Sequence
  Description of Artificial Sequence: Synthetic oligonucleotide
  Target: ATXN1; (-) strand; PAM type: YTN; PAM sequence: CTT
aacactggtttaattttcat

SEQ ID NO: 191175 - DNA, 20 bp, Artificial Sequence
  Description of Artificial Sequence: Synthetic oligonucleotide
  Target: ATXN1; (-) strand; PAM type: YTN; PAM sequence: TTG
gtgcaggaagcacgtcagga

SEQ ID NO: 191176 - DNA, 20 bp, Artificial Sequence
  Description of Artificial Sequence: Synthetic oligonucleotide
  Target: ATXN1; (-) strand; PAM type: YTN; PAM sequence: TTG
aatgttggtgcaggaagcac

SEQ ID NO: 191177 - DNA, 20 bp, Artificial Sequence
  Description of Artificial Sequence: Synthetic oligonucleotide
  Target: ATXN1; (-) strand; PAM type: YTN; PAM sequence: CTG
gttgaatgttggtgcaggaa

SEQ ID NO: 191178 - DNA, 20 bp, Artificial Sequence
  Description of Artificial Sequence: Synthetic oligonucleotide
  Target: ATXN1; (-) strand; PAM type: YTN; PAM sequence: CTC
gtaagaaggtcagagagctg

SEQ ID NO: 191179 - DNA, 20 bp, Artificial Sequence
  Description of Artificial Sequence: Synthetic oligonucleotide
  Target: ATXN1; (-) strand; PAM type: YTN; PAM sequence: CTG
agcctcgtaagaaggtcaga

SEQ ID NO: 191180 - DNA, 20 bp, Artificial Sequence
  Description of Artificial Sequence: Synthetic oligonucleotide
  Target: ATXN1; (-) strand; PAM type: YTN; PAM sequence: CTC
ctgagcctcgtaagaaggtc

SEQ ID NO: 191181 - DNA, 20 bp, Artificial Sequence
  Description of Artificial Sequence: Synthetic oligonucleotide
  Target: ATXN1; (-) strand; PAM type: YTN; PAM sequence: TTC
ccccaggaggactcctgagc

SEQ ID NO: 191182 - DNA, 20 bp, Artificial Sequence
  Description of Artificial Sequence: Synthetic oligonucleotide
  Target: ATXN1; (-) strand; PAM type: YTN; PAM sequence: TTT
cccccaggaggactcctgag

SEQ ID NO: 191183 - DNA, 20 bp, Artificial Sequence
  Description of Artificial Sequence: Synthetic oligonucleotide
  Target: ATXN1; (-) strand; PAM type: YTN; PAM sequence: CTT
tcccccaggaggactcctga

SEQ ID NO: 191184 - DNA, 20 bp, Artificial Sequence
  Description of Artificial Sequence: Synthetic oligonucleotide
  Target: ATXN1; (-) strand; PAM type: YTN; PAM sequence: CTC
tttcccccaggaggactcct

SEQ ID NO: 191185 - DNA, 20 bp, Artificial Sequence
  Description of Artificial Sequence: Synthetic oligonucleotide
  Target: ATXN1; (-) strand; PAM type: YTN; PAM sequence: TTG
cagctctttcccccaggagg

SEQ ID NO: 191186 - DNA, 20 bp, Artificial Sequence
  Description of Artificial Sequence: Synthetic oligonucleotide
  Target: ATXN1; (-) strand; PAM type: YTN; PAM sequence: CTG
aaccaaccatgcaaagtaga

SEQ ID NO: 191187 - DNA, 20 bp, Artificial Sequence
  Description of Artificial Sequence: Synthetic oligonucleotide
  Target: ATXN1; (-) strand; PAM type: YTN; PAM sequence: CTA
gagcctgaaccaaccatgca

SEQ ID NO: 191188 - DNA, 20 bp, Artificial Sequence
  Description of Artificial Sequence: Synthetic oligonucleotide
  Target: ATXN1; (-) strand; PAM type: YTN; PAM sequence: TTC
tagagcctgaaccaaccatg

SEQ ID NO: 191189 - DNA, 20 bp, Artificial Sequence
  Description of Artificial Sequence: Synthetic oligonucleotide
  Target: ATXN1; (-) strand; PAM type: YTN; PAM sequence: TTT
ctagagcctgaaccaaccat

SEQ ID NO: 191190 - DNA, 20 bp, Artificial Sequence
  Description of Artificial Sequence: Synthetic oligonucleotide
  Target: ATXN1; (-) strand; PAM type: YTN; PAM sequence: TTT
tctagagcctgaaccaacca

SEQ ID NO: 191191 - DNA, 20 bp, Artificial Sequence
  Description of Artificial Sequence: Synthetic oligonucleotide
  Target: ATXN1; (-) strand; PAM type: YTN; PAM sequence: CTA
ttttctagagcctgaaccaa

SEQ ID NO: 191192 - DNA, 20 bp, Artificial Sequence
  Description of Artificial Sequence: Synthetic oligonucleotide
  Target: ATXN1; (-) strand; PAM type: YTN; PAM sequence: TTG
ctattttctagagcctgaac

SEQ ID NO: 191193 - DNA, 20 bp, Artificial Sequence
  Description of Artificial Sequence: Synthetic oligonucleotide
  Target: ATXN1; (-) strand; PAM type: YTN; PAM sequence: CTT
gctattttctagagcctgaa

SEQ ID NO: 191194 - DNA, 20 bp, Artificial Sequence
  Description of Artificial Sequence: Synthetic oligonucleotide
  Target: ATXN1; (-) strand; PAM type: YTN; PAM sequence: CTC
ttgctattttctagagcctg

SEQ ID NO: 191195 - DNA, 20 bp, Artificial Sequence
  Description of Artificial Sequence: Synthetic oligonucleotide
  Target: ATXN1; (-) strand; PAM type: YTN; PAM sequence: TTG
caggaggaggaggaggtggg

SEQ ID NO: 191196 - DNA, 20 bp, Artificial Sequence
  Description of Artificial Sequence: Synthetic oligonucleotide
  Target: ATXN1; (-) strand; PAM type: YTN; PAM sequence: CTG
attgcaggaggaggaggagg

SEQ ID NO: 191197 - DNA, 20 bp, Artificial Sequence
  Description of Artificial Sequence: Synthetic oligonucleotide
  Target: ATXN1; (-) strand; PAM type: YTN; PAM sequence: CTA
aaaaaaaaaaaaaaaaggaa

SEQ ID NO: 191198 - DNA, 20 bp, Artificial Sequence
  Description of Artificial Sequence: Synthetic oligonucleotide
  Target: ATXN1; (-) strand; PAM type: YTN; PAM sequence: CTA
aagctaaaaaaaaaaaaaaa

SEQ ID NO: 191199 - DNA, 20 bp, Artificial Sequence
  Description of Artificial Sequence: Synthetic oligonucleotide
  Target: ATXN1; (-) strand; PAM type: YTN; PAM sequence: TTG
gaaaatagaagtagagctaa

SEQ ID NO: 191200 - DNA, 20 bp, Artificial Sequence
  Description of Artificial Sequence: Synthetic oligonucleotide
  Target: ATXN1; (-) strand; PAM type: YTN; PAM sequence: CTG
agtagtagaaggcagtagcc

SEQ ID NO: 191201 - DNA, 20 bp, Artificial Sequence
  Description of Artificial Sequence: Synthetic oligonucleotide
  Target: ATXN1; (-) strand; PAM type: YTN; PAM sequence: CTG
ctgagtagtagaaggcagta

SEQ ID NO: 191202 - DNA, 20 bp, Artificial Sequence
  Description of Artificial Sequence: Synthetic oligonucleotide
  Target: ATXN1; (-) strand; PAM type: YTN; PAM sequence: TTA
gctgctgagtagtagaaggc

SEQ ID NO: 191203 - DNA, 20 bp, Artificial Sequence
  Description of Artificial Sequence: Synthetic oligonucleotide
  Target: ATXN1; (-) strand; PAM type: YTN; PAM sequence: CTC
ggagggtgtgtgtaattagc

SEQ ID NO: 191204 - DNA, 20 bp, Artificial Sequence
  Description of Artificial Sequence: Synthetic oligonucleotide
  Target: ATXN1; (-) strand; PAM type: YTN; PAM sequence: TTC
ctcggagggtgtgtgtaatt

SEQ ID NO: 191205 - DNA, 20 bp, Artificial Sequence
  Description of Artificial Sequence: Synthetic oligonucleotide
  Target: ATXN1; (-) strand; PAM type: YTN; PAM sequence: CTA
cgttcctcggagggtgtgtg

SEQ ID NO: 191206 - DNA, 20 bp, Artificial Sequence
  Description of Artificial Sequence: Synthetic oligonucleotide
  Target: ATXN1; (-) strand; PAM type: YTN; PAM sequence: CTC
agtggcctacgttcctcgga

SEQ ID NO: 191207 - DNA, 20 bp, Artificial Sequence
  Description of Artificial Sequence: Synthetic oligonucleotide
  Target: ATXN1; (-) strand; PAM type: YTN; PAM sequence: CTC
actcagtggcctacgttcct

SEQ ID NO: 191208 - DNA, 20 bp, Artificial Sequence
  Description of Artificial Sequence: Synthetic oligonucleotide
  Target: ATXN1; (-) strand; PAM type: YTN; PAM sequence: TTG
ggcccctcactcagtggcct

SEQ ID NO: 191209 - DNA, 20 bp, Artificial Sequence
  Description of Artificial Sequence: Synthetic oligonucleotide
  Target: ATXN1; (-) strand; PAM type: YTN; PAM sequence: TTT
gggcccctcactcagtggcc

SEQ ID NO: 191210 - DNA, 20 bp, Artificial Sequence
  Description of Artificial Sequence: Synthetic oligonucleotide
  Target: ATXN1; (-) strand; PAM type: YTN; PAM sequence: CTG
agtttgggcccctcactcag

SEQ ID NO: 191211 - DNA, 20 bp, Artificial Sequence
  Description of Artificial Sequence: Synthetic oligonucleotide
  Target: ATXN1; (-) strand; PAM type: YTN; PAM sequence: TTG
tgtccagctgagtttgggcc

SEQ ID NO: 191212 - DNA, 20 bp, Artificial Sequence
  Description of Artificial Sequence: Synthetic oligonucleotide
  Target: ATXN1; (-) strand; PAM type: YTN; PAM sequence: CTG
agagggataagcagggattg

SEQ ID NO: 191213 - DNA, 20 bp, Artificial Sequence
  Description of Artificial Sequence: Synthetic oligonucleotide
  Target: ATXN1; (-) strand; PAM type: YTN; PAM sequence: CTG
accacagctgagagggataa

SEQ ID NO: 191214 - DNA, 20 bp, Artificial Sequence
  Description of Artificial Sequence: Synthetic oligonucleotide
  Target: ATXN1; (-) strand; PAM type: YTN; PAM sequence: CTA
ggtgtccagctgaccacagc

SEQ ID NO: 191215 - DNA, 20 bp, Artificial Sequence
  Description of Artificial Sequence: Synthetic oligonucleotide
  Target: ATXN1; (-) strand; PAM type: YTN; PAM sequence: TTC
cccatgtgtgcctaggtgtc

SEQ ID NO: 191216 - DNA, 20 bp, Artificial Sequence
  Description of Artificial Sequence: Synthetic oligonucleotide
  Target: ATXN1; (-) strand; PAM type: YTN; PAM sequence: CTT
ccccatgtgtgcctaggtgt

SEQ ID NO: 191217 - DNA, 20 bp, Artificial Sequence
  Description of Artificial Sequence: Synthetic oligonucleotide
  Target: ATXN1; (-) strand; PAM type: YTN; PAM sequence: CTG
agtggcttccccatgtgtgc

SEQ ID NO: 191218 - DNA, 20 bp, Artificial Sequence
  Description of Artificial Sequence: Synthetic oligonucleotide
  Target: ATXN1; (-) strand; PAM type: YTN; PAM sequence: TTC
aggcaaggactgagtggctt

SEQ ID NO: 191219 - DNA, 20 bp, Artificial Sequence
  Description of Artificial Sequence: Synthetic oligonucleotide
  Target: ATXN1; (-) strand; PAM type: YTN; PAM sequence: TTT
caggcaaggactgagtggct

SEQ ID NO: 191220 - DNA, 20 bp, Artificial Sequence
  Description of Artificial Sequence: Synthetic oligonucleotide
  Target: ATXN1; (-) strand; PAM type: YTN; PAM sequence: CTT
tcaggcaaggactgagtggc

SEQ ID NO: 191221 - DNA, 20 bp, Artificial Sequence
  Description of Artificial Sequence: Synthetic oligonucleotide
  Target: ATXN1; (-) strand; PAM type: YTN; PAM sequence: TTC
tttcaggcaaggactgagtg

SEQ ID NO: 191222 - DNA, 20 bp, Artificial Sequence
  Description of Artificial Sequence: Synthetic oligonucleotide
  Target: ATXN1; (-) strand; PAM type: YTN; PAM sequence: CTT
ctttcaggcaaggactgagt

SEQ ID NO: 191223 - DNA, 20 bp, Artificial Sequence
  Description of Artificial Sequence: Synthetic oligonucleotide
  Target: ATXN1; (-) strand; PAM type: YTN; PAM sequence: TTC
ttctttcaggcaaggactga

SEQ ID NO: 191224 - DNA, 20 bp, Artificial Sequence
  Description of Artificial Sequence: Synthetic oligonucleotide
  Target: ATXN1; (-) strand; PAM type: YTN; PAM sequence: TTT
cttctttcaggcaaggactg

SEQ ID NO: 191225 - DNA, 20 bp, Artificial Sequence
  Description of Artificial Sequence: Synthetic oligonucleotide
  Target: ATXN1; (-) strand; PAM type: YTN; PAM sequence: TTT
tcttctttcaggcaaggact

SEQ ID NO: 191226 - DNA, 20 bp, Artificial Sequence
  Description of Artificial Sequence: Synthetic oligonucleotide
  Target: ATXN1; (-) strand; PAM type: YTN; PAM sequence: CTG
ccggtatgttttcttctttc

SEQ ID NO: 191227 - DNA, 20 bp, Artificial Sequence
  Description of Artificial Sequence: Synthetic oligonucleotide
  Target: ATXN1; (-) strand; PAM type: YTN; PAM sequence: TTG
ggctgccggtatgttttctt

SEQ ID NO: 191228 - DNA, 20 bp, Artificial Sequence
  Description of Artificial Sequence: Synthetic oligonucleotide
  Target: ATXN1; (-) strand; PAM type: YTN; PAM sequence: TTT
gggctgccggtatgttttct

SEQ ID NO: 191229 - DNA, 20 bp, Artificial Sequence
  Description of Artificial Sequence: Synthetic oligonucleotide
  Target: ATXN1; (-) strand; PAM type: YTN; PAM sequence: TTG
agatttgggctgccggtatg

SEQ ID NO: 191230 - DNA, 20 bp, Artificial Sequence
  Description of Artificial Sequence: Synthetic oligonucleotide
  Target: ATXN1; (-) strand; PAM type: YTN; PAM sequence: TTA
gtgaagaaggttgagatttg

SEQ ID NO: 191231 - DNA, 20 bp, Artificial Sequence
  Description of Artificial Sequence: Synthetic oligonucleotide
  Target: ATXN1; (-) strand; PAM type: YTN; PAM sequence: CTG
ttagtgaagaaggttgagat

SEQ ID NO: 191232 - DNA, 20 bp, Artificial Sequence
  Description of Artificial Sequence: Synthetic oligonucleotide
  Target: ATXN1; (-) strand; PAM type: YTN; PAM sequence: TTG
cctgttagtgaagaaggttg

SEQ ID NO: 191233 - DNA, 20 bp, Artificial Sequence
  Description of Artificial Sequence: Synthetic oligonucleotide
  Target: ATXN1; (-) strand; PAM type: YTN; PAM sequence: CTT
gcctgttagtgaagaaggtt

SEQ ID NO: 191234 - DNA, 20 bp, Artificial Sequence
  Description of Artificial Sequence: Synthetic oligonucleotide
  Target: ATXN1; (-) strand; PAM type: YTN; PAM sequence: TTC
aacacatggtaagcttgcct

SEQ ID NO: 191235 - DNA, 20 bp, Artificial Sequence
  Description of Artificial Sequence: Synthetic oligonucleotide
  Target: ATXN1; (-) strand; PAM type: YTN; PAM sequence: TTA
aattcaacacatggtaagct

SEQ ID NO: 191236 - DNA, 20 bp, Artificial Sequence
  Description of Artificial Sequence: Synthetic oligonucleotide
  Target: ATXN1; (-) strand; PAM type: YTN; PAM sequence: CTG
gttaaattcaacacatggta

SEQ ID NO: 191237 - DNA, 20 bp, Artificial Sequence
  Description of Artificial Sequence: Synthetic oligonucleotide
  Target: ATXN1; (-) strand; PAM type: YTN; PAM sequence: CTG
gctggttaaattcaacacat

SEQ ID NO: 191238 - DNA, 20 bp, Artificial Sequence
  Description of Artificial Sequence: Synthetic oligonucleotide
  Target: ATXN1; (-) strand; PAM type: YTN; PAM sequence: TTG
gtgctggctggttaaattca

SEQ ID NO: 191239 - DNA, 20 bp, Artificial Sequence
  Description of Artificial Sequence: Synthetic oligonucleotide
  Target: ATXN1; (-) strand; PAM type: YTN; PAM sequence: TTT
ggtgctggctggttaaattc

SEQ ID NO: 191240 - DNA, 20 bp, Artificial Sequence
  Description of Artificial Sequence: Synthetic oligonucleotide
  Target: ATXN1; (-) strand; PAM type: YTN; PAM sequence: CTG
atggtttggtgctggctggt

SEQ ID NO: 191241 - DNA, 20 bp, Artificial Sequence
  Description of Artificial Sequence: Synthetic oligonucleotide
  Target: ATXN1; (-) strand; PAM type: YTN; PAM sequence: CTG
agtaacagaaagtctgatgg

SEQ ID NO: 191242 - DNA, 20 bp, Artificial Sequence
  Description of Artificial Sequence: Synthetic oligonucleotide
  Target: ATXN1; (-) strand; PAM type: YTN; PAM sequence: TTC
tgagtaacagaaagtctgat

SEQ ID NO: 191243 - DNA, 20 bp, Artificial Sequence
  Description of Artificial Sequence: Synthetic oligonucleotide
  Target: ATXN1; (-) strand; PAM type: YTN; PAM sequence: TTT
ctgagtaacagaaagtctga

SEQ ID NO: 191244 - DNA, 20 bp, Artificial Sequence
  Description of Artificial Sequence: Synthetic oligonucleotide
  Target: ATXN1; (-) strand; PAM type: YTN; PAM sequence: TTA
tttctgagtaacagaaagtc

SEQ ID NO: 191245 - DNA, 20 bp, Artificial Sequence
  Description of Artificial Sequence: Synthetic oligonucleotide
  Target: ATXN1; (-) strand; PAM type: YTN; PAM sequence: CTT
atttctgagtaacagaaagt

SEQ ID NO: 191246 - DNA, 20 bp, Artificial Sequence
  Description of Artificial Sequence: Synthetic oligonucleotide
  Target: ATXN1; (-) strand; PAM type: YTN; PAM sequence: TTA
cttatttctgagtaacagaa

SEQ ID NO: 191247 - DNA, 20 bp, Artificial Sequence
  Description of Artificial Sequence: Synthetic oligonucleotide
  Target: ATXN1; (-) strand; PAM type: YTN; PAM sequence: TTT
acttatttctgagtaacaga

SEQ ID NO: 191248 - DNA, 20 bp, Artificial Sequence
  Description of Artificial Sequence: Synthetic oligonucleotide
  Target: ATXN1; (-) strand; PAM type: YTN; PAM sequence: CTG
tttacttatttctgagtaac

SEQ ID NO: 191249 - DNA, 20 bp, Artificial Sequence
  Description of Artificial Sequence: Synthetic oligonucleotide
  Target: ATXN1; (-) strand; PAM type: YTN; PAM sequence: TTC
atactgtttacttatttctg

SEQ ID NO: 191250 - DNA, 20 bp, Artificial Sequence
  Description of Artificial Sequence: Synthetic oligonucleotide
  Target: ATXN1; (-) strand; PAM type: YTN; PAM sequence: TTT
catactgtttacttatttct

SEQ ID NO: 191251 - DNA, 20 bp, Artificial Sequence
  Description of Artificial Sequence: Synthetic oligonucleotide
  Target: ATXN1; (-) strand; PAM type: YTN; PAM sequence: TTT
tcatactgtttacttatttc

SEQ ID NO: 191252 - DNA, 20 bp, Artificial Sequence
  Description of Artificial Sequence: Synthetic oligonucleotide
  Target: ATXN1; (-) strand; PAM type: YTN; PAM sequence: TTT
ttcatactgtttacttattt

SEQ ID NO: 191253 - DNA, 20 bp, Artificial Sequence
  Description of Artificial Sequence: Synthetic oligonucleotide
  Target: ATXN1; (-) strand; PAM type: YTN; PAM sequence: CTT
tttcatactgtttacttatt

SEQ ID NO: 191254 - DNA, 20 bp, Artificial Sequence
  Description of Artificial Sequence: Synthetic oligonucleotide
  Target: ATXN1; (-) strand; PAM type: YTN; PAM sequence: CTA
ataagggacctttttcatac

SEQ ID NO: 191255 - DNA, 20 bp, Artificial Sequence
  Description of Artificial Sequence: Synthetic oligonucleotide
  Target: ATXN1; (-) strand; PAM type: YTN; PAM sequence: CTG
agcccacctaataagggacc

SEQ ID NO: 191256 - DNA, 20 bp, Artificial Sequence
  Description of Artificial Sequence: Synthetic oligonucleotide
  Target: ATXN1; (-) strand; PAM type: YTN; PAM sequence: CTG
ataccagcaccctgagccca

SEQ ID NO: 191257 - DNA, 20 bp, Artificial Sequence
  Description of Artificial Sequence: Synthetic oligonucleotide
  Target: ATXN1; (-) strand; PAM type: YTN; PAM sequence: CTA
atgatagaatatgcaaaaat

SEQ ID NO: 191258 - DNA, 20 bp, Artificial Sequence
  Description of Artificial Sequence: Synthetic oligonucleotide
  Target: ATXN1; (-) strand; PAM type: YTN; PAM sequence: CTG
acctaatgatagaatatgca

SEQ ID NO: 191259 - DNA, 20 bp, Artificial Sequence
  Description of Artificial Sequence: Synthetic oligonucleotide
  Target: ATXN1; (-) strand; PAM type: YTN; PAM sequence: TTG
ggatgtcagcctgacctaat

SEQ ID NO: 191260 - DNA, 20 bp, Artificial Sequence
  Description of Artificial Sequence: Synthetic oligonucleotide
  Target: ATXN1; (-) strand; PAM type: YTN; PAM sequence: TTT
gggatgtcagcctgacctaa

SEQ ID NO: 191261 - DNA, 20 bp, Artificial Sequence
  Description of Artificial Sequence: Synthetic oligonucleotide
  Target: ATXN1; (-) strand; PAM type: YTN; PAM sequence: TTA
aggtttgggatgtcagcctg

SEQ ID NO: 191262 - DNA, 20 bp, Artificial Sequence
  Description of Artificial Sequence: Synthetic oligonucleotide
  Target: ATXN1; (-) strand; PAM type: YTN; PAM sequence: TTT
aaggtttgggatgtcagcct

SEQ ID NO: 191263 - DNA, 20 bp, Artificial Sequence
  Description of Artificial Sequence: Synthetic oligonucleotide
  Target: ATXN1; (-) strand; PAM type: YTN; PAM sequence: TTT
taaggtttgggatgtcagcc

SEQ ID NO: 191264 - DNA, 20 bp, Artificial Sequence
  Description of Artificial Sequence: Synthetic oligonucleotide
  Target: ATXN1; (-) strand; PAM type: YTN; PAM sequence: TTT
ttaaggtttgggatgtcagc

SEQ ID NO: 191265 - DNA, 20 bp, Artificial Sequence
  Description of Artificial Sequence: Synthetic oligonucleotide
  Target: ATXN1; (-) strand; PAM type: YTN; PAM sequence: CTT
tttaaggtttgggatgtcag

SEQ ID NO: 191266 - DNA, 20 bp, Artificial Sequence
  Description of Artificial Sequence: Synthetic oligonucleotide
  Target: ATXN1; (-) strand; PAM type: YTN; PAM sequence: TTA
actttttaaggtttgggatg

SEQ ID NO: 191267 - DNA, 20 bp, Artificial Sequence
  Description of Artificial Sequence: Synthetic oligonucleotide
  Target: ATXN1; (-) strand; PAM type: YTN; PAM sequence: TTA
ttaactttttaaggtttggg

SEQ ID NO: 191268 - DNA, 20 bp, Artificial Sequence
  Description of Artificial Sequence: Synthetic oligonucleotide
  Target: ATXN1; (-) strand; PAM type: YTN; PAM sequence: CTT
attaactttttaaggtttgg

SEQ ID NO: 191269 - DNA, 20 bp, Artificial Sequence
  Description of Artificial Sequence: Synthetic oligonucleotide
  Target: ATXN1; (-) strand; PAM type: YTN; PAM sequence: TTC
ccttattaactttttaaggt

SEQ ID NO: 191270 - DNA, 20 bp, Artificial Sequence
  Description of Artificial Sequence: Synthetic oligonucleotide
  Target: ATXN1; (-) strand; PAM type: YTN; PAM sequence: TTT
cccttattaactttttaagg

SEQ ID NO: 191271 - DNA, 20 bp, Artificial Sequence
  Description of Artificial Sequence: Synthetic oligonucleotide
  Target: ATXN1; (-) strand; PAM type: YTN; PAM sequence: CTT
tcccttattaactttttaag

SEQ ID NO: 191272 - DNA, 20 bp, Artificial Sequence
  Description of Artificial Sequence: Synthetic oligonucleotide
  Target: ATXN1; (-) strand; PAM type: YTN; PAM sequence: TTC
tttcccttattaacttttta

SEQ ID NO: 191273 - DNA, 20 bp, Artificial Sequence
  Description of Artificial Sequence: Synthetic oligonucleotide
  Target: ATXN1; (-) strand; PAM type: YTN; PAM sequence: TTA
tgcgttctttcccttattaa

SEQ ID NO: 191274 - DNA, 20 bp, Artificial Sequence
  Description of Artificial Sequence: Synthetic oligonucleotide
  Target: ATXN1; (-) strand; PAM type: YTN; PAM sequence: TTT
atgcgttctttcccttatta

SEQ ID NO: 191275 - DNA, 20 bp, Artificial Sequence
  Description of Artificial Sequence: Synthetic oligonucleotide
  Target: ATXN1; (-) strand; PAM type: YTN; PAM sequence: TTA
tatgcgtttatgcgttcttt

SEQ ID NO: 191276 - DNA, 20 bp, Artificial Sequence
  Description of Artificial Sequence: Synthetic oligonucleotide
  Target: ATXN1; (-) strand; PAM type: YTN; PAM sequence: CTT
atatgcgtttatgcgttctt

SEQ ID NO: 191277 - DNA, 20 bp, Artificial Sequence
  Description of Artificial Sequence: Synthetic oligonucleotide
  Target: ATXN1; (-) strand; PAM type: YTN; PAM sequence: TTC
catataaagcttatatgcgt

SEQ ID NO: 191278 - DNA, 20 bp, Artificial Sequence
  Description of Artificial Sequence: Synthetic oligonucleotide
  Target: ATXN1; (-) strand; PAM type: YTN; PAM sequence: CTT
ccatataaagcttatatgcg

SEQ ID NO: 191279 - DNA, 20 bp, Artificial Sequence
  Description of Artificial Sequence: Synthetic oligonucleotide
  Target: ATXN1; (-) strand; PAM type: YTN; PAM sequence: TTA
accttccatataaagcttat

SEQ ID NO: 191280 - DNA, 20 bp, Artificial Sequence
  Description of Artificial Sequence: Synthetic oligonucleotide
  Target: ATXN1; (-) strand; PAM type: YTN; PAM sequence: CTT
aaccttccatataaagctta

SEQ ID NO: 191281 - DNA, 20 bp, Artificial Sequence
  Description of Artificial Sequence: Synthetic oligonucleotide
  Target: ATXN1; (-) strand; PAM type: YTN; PAM sequence: CTG
ccagtgcacttaaccttcca

SEQ ID NO: 191282 - DNA, 20 bp, Artificial Sequence
  Description of Artificial Sequence: Synthetic oligonucleotide
  Target: ATXN1; (-) strand; PAM type: YTN; PAM sequence: TTA
gtaggctgccagtgcactta

SEQ ID NO: 191283 - DNA, 20 bp, Artificial Sequence
  Description of Artificial Sequence: Synthetic oligonucleotide
  Target: ATXN1; (-) strand; PAM type: YTN; PAM sequence: TTT
agtaggctgccagtgcactt

SEQ ID NO: 191284 - DNA, 20 bp, Artificial Sequence
  Description of Artificial Sequence: Synthetic oligonucleotide
  Target: ATXN1; (-) strand; PAM type: YTN; PAM sequence: TTT
tagtaggctgccagtgcact

SEQ ID NO: 191285 - DNA, 20 bp, Artificial Sequence
  Description of Artificial Sequence: Synthetic oligonucleotide
  Target: ATXN1; (-) strand; PAM type: YTN; PAM sequence: CTA
ttttagtaggctgccagtgc

SEQ ID NO: 191286 - DNA, 20 bp, Artificial Sequence
  Description of Artificial Sequence: Synthetic oligonucleotide
  Target: ATXN1; (-) strand; PAM type: YTN; PAM sequence: TTC
tattttagtaggctgccagt

SEQ ID NO: 191287 - DNA, 20 bp, Artificial Sequence
  Description of Artificial Sequence: Synthetic oligonucleotide
  Target: ATXN1; (-) strand; PAM type: YTN; PAM sequence: TTT
ctattttagtaggctgccag

SEQ ID NO: 191288 - DNA, 20 bp, Artificial Sequence
  Description of Artificial Sequence: Synthetic oligonucleotide
  Target: ATXN1; (-) strand; PAM type: YTN; PAM sequence: CTT
tctattttagtaggctgcca

SEQ ID NO: 191289 - DNA, 20 bp, Artificial Sequence
  Description of Artificial Sequence: Synthetic oligonucleotide
  Target: ATXN1; (-) strand; PAM type: YTN; PAM sequence: TTA
actttctattttagtaggct

SEQ ID NO: 191290 - DNA, 20 bp, Artificial Sequence
  Description of Artificial Sequence: Synthetic oligonucleotide
  Target: ATXN1; (-) strand; PAM type: YTN; PAM sequence: TTT
aactttctattttagtaggc

SEQ ID NO: 191291 - DNA, 20 bp, Artificial Sequence
  Description of Artificial Sequence: Synthetic oligonucleotide
  Target: ATXN1; (-) strand; PAM type: YTN; PAM sequence: CTG
tatttaactttctattttag

SEQ ID NO: 191292 - DNA, 20 bp, Artificial Sequence
  Description of Artificial Sequence: Synthetic oligonucleotide
  Target: ATXN1; (-) strand; PAM type: YTN; PAM sequence: TTG
ctgtatttaactttctattt

SEQ ID NO: 191293 - DNA, 20 bp, Artificial Sequence
  Description of Artificial Sequence: Synthetic oligonucleotide
  Target: ATXN1; (-) strand; PAM type: YTN; PAM sequence: CTC
attgctgtatttaactttct

SEQ ID NO: 191294 - DNA, 20 bp, Artificial Sequence
  Description of Artificial Sequence: Synthetic oligonucleotide
  Target: ATXN1; (-) strand; PAM type: YTN; PAM sequence: TTC
aaaatctcattgctgtattt

SEQ ID NO: 191295 - DNA, 20 bp, Artificial Sequence
  Description of Artificial Sequence: Synthetic oligonucleotide
  Target: ATXN1; (-) strand; PAM type: YTN; PAM sequence: TTT
caaaatctcattgctgtatt

SEQ ID NO: 191296 - DNA, 20 bp, Artificial Sequence
  Description of Artificial Sequence: Synthetic oligonucleotide
  Target: ATXN1; (-) strand; PAM type: YTN; PAM sequence: TTG
caaggggaaatttcaaaatc

SEQ ID NO: 191297 - DNA, 20 bp, Artificial Sequence
  Description of Artificial Sequence: Synthetic oligonucleotide
  Target: ATXN1; (-) strand; PAM type: YTN; PAM sequence: TTA
ttgcaaggggaaatttcaaa

SEQ ID NO: 191298 - DNA, 20 bp, Artificial Sequence
  Description of Artificial Sequence: Synthetic oligonucleotide
  Target: ATXN1; (-) strand; PAM type: YTN; PAM sequence: TTT
attgcaaggggaaatttcaa

SEQ ID NO: 191299 - DNA, 20 bp, Artificial Sequence
  Description of Artificial Sequence: Synthetic oligonucleotide
  Target: ATXN1; (-) strand; PAM type: YTN; PAM sequence: TTT
tattgcaaggggaaatttca

SEQ ID NO: 191300 - DNA, 20 bp, Artificial Sequence
  Description of Artificial Sequence: Synthetic oligonucleotide
  Target: ATXN1; (-) strand; PAM type: YTN; PAM sequence: TTT
ttattgcaaggggaaatttc

SEQ ID NO: 191301 - DNA, 20 bp, Artificial Sequence
  Description of Artificial Sequence: Synthetic oligonucleotide
  Target: ATXN1; (-) strand; PAM type: YTN; PAM sequence: TTT
tttattgcaaggggaaattt

SEQ ID NO: 191302 - DNA, 20 bp, Artificial Sequence
  Description of Artificial Sequence: Synthetic oligonucleotide
  Target: ATXN1; (-) strand; PAM type: YTN; PAM sequence: CTT
ttttattgcaaggggaaatt

SEQ ID NO: 191303 - DNA, 20 bp, Artificial Sequence
  Description of Artificial Sequence: Synthetic oligonucleotide
  Target: ATXN1; (-) strand; PAM type: YTN; PAM sequence: TTC
ttttttattgcaaggggaaa

SEQ ID NO: 191304 - DNA, 20 bp, Artificial Sequence
  Description of Artificial Sequence: Synthetic oligonucleotide
  Target: ATXN1; (-) strand; PAM type: YTN; PAM sequence: CTT
cttttttattgcaaggggaa

SEQ ID NO: 191305 - DNA, 20 bp, Artificial Sequence
  Description of Artificial Sequence: Synthetic oligonucleotide
  Target: ATXN1; (-) strand; PAM type: YTN; PAM sequence: TTA
aggccccttcttttttattg

SEQ ID NO: 191306 - DNA, 20 bp, Artificial Sequence
  Description of Artificial Sequence: Synthetic oligonucleotide
  Target: ATXN1; (-) strand; PAM type: YTN; PAM sequence: CTA
ttaaggccccttctttttta

SEQ ID NO: 191307 - DNA, 20 bp, Artificial Sequence
  Description of Artificial Sequence: Synthetic oligonucleotide
  Target: ATXN1; (-) strand; PAM type: YTN; PAM sequence: TTC
ctattaaggccccttctttt

SEQ ID NO: 191308 - DNA, 20 bp, Artificial Sequence
  Description of Artificial Sequence: Synthetic oligonucleotide
  Target: ATXN1; (-) strand; PAM type: YTN; PAM sequence: TTG
tgttcctattaaggcccctt

SEQ ID NO: 191309 - DNA, 20 bp, Artificial Sequence
  Description of Artificial Sequence: Synthetic oligonucleotide
  Target: ATXN1; (-) strand; PAM type: YTN; PAM sequence: CTT
gtgttcctattaaggcccct

SEQ ID NO: 191310 - DNA, 20 bp, Artificial Sequence
  Description of Artificial Sequence: Synthetic oligonucleotide
  Target: ATXN1; (-) strand; PAM type: YTN; PAM sequence: CTG
gcttgtgttcctattaaggc

SEQ ID NO: 191311 - DNA, 20 bp, Artificial Sequence
  Description of Artificial Sequence: Synthetic oligonucleotide
  Target: ATXN1; (-) strand; PAM type: YTN; PAM sequence: TTC
cagcaagcctggcttgtgtt

SEQ ID NO: 191312 - DNA, 20 bp, Artificial Sequence
  Description of Artificial Sequence: Synthetic oligonucleotide
  Target: ATXN1; (-) strand; PAM type: YTN; PAM sequence: TTT
ccagcaagcctggcttgtgt

SEQ ID NO: 191313 - DNA, 20 bp, Artificial Sequence
  Description of Artificial Sequence: Synthetic oligonucleotide
  Target: ATXN1; (-) strand; PAM type: YTN; PAM sequence: TTT
tccagcaagcctggcttgtg

SEQ ID NO: 191314 - DNA, 20 bp, Artificial Sequence
  Description of Artificial Sequence: Synthetic oligonucleotide
  Target: ATXN1; (-) strand; PAM type: YTN; PAM sequence: CTT
ttccagcaagcctggcttgt

SEQ ID NO: 191315 - DNA, 20 bp, Artificial Sequence
  Description of Artificial Sequence: Synthetic oligonucleotide
  Target: ATXN1; (-) strand; PAM type: YTN; PAM sequence: CTG
cttttccagcaagcctggct

SEQ ID NO: 191316 - DNA, 20 bp, Artificial Sequence
  Description of Artificial Sequence: Synthetic oligonucleotide
  Target: ATXN1; (-) strand; PAM type: YTN; PAM sequence: TTA
aggaacaaagactgcttttc

SEQ ID NO: 191317 - DNA, 20 bp, Artificial Sequence
  Description of Artificial Sequence: Synthetic oligonucleotide
  Target: ATXN1; (-) strand; PAM type: YTN; PAM sequence: TTT
aaggaacaaagactgctttt

SEQ ID NO: 191318 - DNA, 20 bp, Artificial Sequence
  Description of Artificial Sequence: Synthetic oligonucleotide
  Target: ATXN1; (-) strand; PAM type: YTN; PAM sequence: TTT
taaggaacaaagactgcttt

SEQ ID NO: 191319 - DNA, 20 bp, Artificial Sequence
  Description of Artificial Sequence: Synthetic oligonucleotide
  Target: ATXN1; (-) strand; PAM type: YTN; PAM sequence: TTG
ttttaaggaacaaagactgc

SEQ ID NO: 191320 - DNA, 20 bp, Artificial Sequence
  Description of Artificial Sequence: Synthetic oligonucleotide
  Target: ATXN1; (-) strand; PAM type: YTN; PAM sequence: TTG
caggttgttttaaggaacaa

SEQ ID NO: 191321 - DNA, 20 bp, Artificial Sequence
  Description of Artificial Sequence: Synthetic oligonucleotide
  Target: ATXN1; (-) strand; PAM type: YTN; PAM sequence: CTC
cataagtagtcaattgcagg

SEQ ID NO: 191322 - DNA, 20 bp, Artificial Sequence
  Description of Artificial Sequence: Synthetic oligonucleotide
  Target: ATXN1; (-) strand; PAM type: YTN; PAM sequence: TTA
agtcctccataagtagtcaa

SEQ ID NO: 191323 - DNA, 20 bp, Artificial Sequence
  Description of Artificial Sequence: Synthetic oligonucleotide
  Target: ATXN1; (-) strand; PAM type: YTN; PAM sequence: TTT
aagtcctccataagtagtca

SEQ ID NO: 191324 - DNA, 20 bp, Artificial Sequence
  Description of Artificial Sequence: Synthetic oligonucleotide
  Target: ATXN1; (-) strand; PAM type: YTN; PAM sequence: TTC
cggaaatttaagtcctccat

SEQ ID NO: 191325 - DNA, 20 bp, Artificial Sequence
  Description of Artificial Sequence: Synthetic oligonucleotide
  Target: ATXN1; (-) strand; PAM type: YTN; PAM sequence: TTT
ccggaaatttaagtcctcca

SEQ ID NO: 191326 - DNA, 20 bp, Artificial Sequence
  Description of Artificial Sequence: Synthetic oligonucleotide
  Target: ATXN1; (-) strand; PAM type: YTN; PAM sequence: CTC
ataaccgtgtacacgggtca

SEQ ID NO: 191327 - DNA, 20 bp, Artificial Sequence
  Description of Artificial Sequence: Synthetic oligonucleotide
  Target: ATXN1; (-) strand; PAM type: YTN; PAM sequence: TTA
tcggagcctcataaccgtgt

SEQ ID NO: 191328 - DNA, 20 bp, Artificial Sequence
  Description of Artificial Sequence: Synthetic oligonucleotide
  Target: ATXN1; (-) strand; PAM type: YTN; PAM sequence: TTG
ttatcggagcctcataaccg

SEQ ID NO: 191329 - DNA, 20 bp, Artificial Sequence
  Description of Artificial Sequence: Synthetic oligonucleotide
  Target: ATXN1; (-) strand; PAM type: YTN; PAM sequence: CTA
ttgttatcggagcctcataa

SEQ ID NO: 191330 - DNA, 20 bp, Artificial Sequence
  Description of Artificial Sequence: Synthetic oligonucleotide
  Target: ATXN1; (-) strand; PAM type: YTN; PAM sequence: CTG
agagtgctattgttatcgga

SEQ ID NO: 191331 - DNA, 20 bp, Artificial Sequence
  Description of Artificial Sequence: Synthetic oligonucleotide
  Target: ATXN1; (-) strand; PAM type: YTN; PAM sequence: CTC
cctgagagtgctattgttat

SEQ ID NO: 191332 - DNA, 20 bp, Artificial Sequence
  Description of Artificial Sequence: Synthetic oligonucleotide
  Target: ATXN1; (-) strand; PAM type: YTN; PAM sequence: TTC
tccctgagagtgctattgtt

SEQ ID NO: 191333 - DNA, 20 bp, Artificial Sequence
  Description of Artificial Sequence: Synthetic oligonucleotide
  Target: ATXN1; (-) strand; PAM type: YTN; PAM sequence: CTG
tcggttctccctgagagtgc

SEQ ID NO: 191334 - DNA, 20 bp, Artificial Sequence
  Description of Artificial Sequence: Synthetic oligonucleotide
  Target: ATXN1; (-) strand; PAM type: YTN; PAM sequence: TTA
aactgtcggttctccctgag

SEQ ID NO: 191335 - DNA, 20 bp, Artificial Sequence
  Description of Artificial Sequence: Synthetic oligonucleotide
  Target: ATXN1; (-) strand; PAM type: YTN; PAM sequence: TTC
gttaaactgtcggttctccc

SEQ ID NO: 191336 - DNA, 20 bp, Artificial Sequence
  Description of Artificial Sequence: Synthetic oligonucleotide
  Target: ATXN1; (-) strand; PAM type: YTN; PAM sequence: TTT
cgttaaactgtcggttctcc

SEQ ID NO: 191337 - DNA, 20 bp, Artificial Sequence
  Description of Artificial Sequence: Synthetic oligonucleotide
  Target: ATXN1; (-) strand; PAM type: YTN; PAM sequence: CTT
tcgttaaactgtcggttctc

SEQ ID NO: 191338 - DNA, 20 bp, Artificial Sequence
  Description of Artificial Sequence: Synthetic oligonucleotide
  Target: ATXN1; (-) strand; PAM type: YTN; PAM sequence: TTG
ctttcgttaaactgtcggtt

SEQ ID NO: 191339 - DNA, 20 bp, Artificial Sequence
  Description of Artificial Sequence: Synthetic oligonucleotide
  Target: ATXN1; (-) strand; PAM type: YTN; PAM sequence: TTT
gctttcgttaaactgtcggt

SEQ ID NO: 191340 - DNA, 20 bp, Artificial Sequence
  Description of Artificial Sequence: Synthetic oligonucleotide
  Target: ATXN1; (-) strand; PAM type: YTN; PAM sequence: CTA
atttgctttcgttaaactgt

SEQ ID NO: 191341 - DNA, 20 bp, Artificial Sequence
  Description of Artificial Sequence: Synthetic oligonucleotide
  Target: ATXN1; (-) strand; PAM type: YTN; PAM sequence: CTG
agaccctaatttgctttcgt

SEQ ID NO: 191342 - DNA, 20 bp, Artificial Sequence
  Description of Artificial Sequence: Synthetic oligonucleotide
  Target: ATXN1; (-) strand; PAM type: YTN; PAM sequence: TTA
ctgagaccctaatttgcttt

SEQ ID NO: 191343 - DNA, 20 bp, Artificial Sequence
  Description of Artificial Sequence: Synthetic oligonucleotide
  Target: ATXN1; (-) strand; PAM type: YTN; PAM sequence: TTA
ttactgagaccctaatttgc

SEQ ID NO: 191344 - DNA, 20 bp, Artificial Sequence
  Description of Artificial Sequence: Synthetic oligonucleotide
  Target: ATXN1; (-) strand; PAM type: YTN; PAM sequence: CTT
attactgagaccctaatttg

SEQ ID NO: 191345 - DNA, 20 bp, Artificial Sequence
  Description of Artificial Sequence: Synthetic oligonucleotide
  Target: ATXN1; (-) strand; PAM type: YTN; PAM sequence: CTC
agtcatcttattactgagac

SEQ ID NO: 191346 - DNA, 20 bp, Artificial Sequence
  Description of Artificial Sequence: Synthetic oligonucleotide
  Target: ATXN1; (-) strand; PAM type: YTN; PAM sequence: TTC
tcagtcatcttattactgag

SEQ ID NO: 191347 - DNA, 20 bp, Artificial Sequence
  Description of Artificial Sequence: Synthetic oligonucleotide
  Target: ATXN1; (-) strand; PAM type: YTN; PAM sequence: TTA
tgttctcagtcatcttatta

SEQ ID NO: 191348 - DNA, 20 bp, Artificial Sequence
  Description of Artificial Sequence: Synthetic oligonucleotide
  Target: ATXN1; (-) strand; PAM type: YTN; PAM sequence: TTT
atgttctcagtcatcttatt

SEQ ID NO: 191349 - DNA, 20 bp, Artificial Sequence
  Description of Artificial Sequence: Synthetic oligonucleotide
  Target: ATXN1; (-) strand; PAM type: YTN; PAM sequence: TTA
aaagatagacgcatagtagt

SEQ ID NO: 191350 - DNA, 20 bp, Artificial Sequence
  Description of Artificial Sequence: Synthetic oligonucleotide
  Target: ATXN1; (-) strand; PAM type: YTN; PAM sequence: TTT
aaaagatagacgcatagtag

SEQ ID NO: 191351 - DNA, 20 bp, Artificial Sequence
  Description of Artificial Sequence: Synthetic oligonucleotide
  Target: ATXN1; (-) strand; PAM type: YTN; PAM sequence: TTA
agtgtttaaaagatagacgc

SEQ ID NO: 191352 - DNA, 20 bp, Artificial Sequence
  Description of Artificial Sequence: Synthetic oligonucleotide
  Target: ATXN1; (-) strand; PAM type: YTN; PAM sequence: CTT
aagtgtttaaaagatagacg

SEQ ID NO: 191353 - DNA, 20 bp, Artificial Sequence
  Description of Artificial Sequence: Synthetic oligonucleotide
  Target: ATXN1; (-) strand; PAM type: YTN; PAM sequence: TTA
cttaagtgtttaaaagatag

SEQ ID NO: 191354 - DNA, 20 bp, Artificial Sequence
  Description of Artificial Sequence: Synthetic oligonucleotide
  Target: ATXN1; (-) strand; PAM type: YTN; PAM sequence: CTA
aaattacttaagtgtttaaa

SEQ ID NO: 191355 - DNA, 20 bp, Artificial Sequence
  Description of Artificial Sequence: Synthetic oligonucleotide
  Target: ATXN1; (-) strand; PAM type: YTN; PAM sequence: CTG
gcaagtgaagcaacactaaa

SEQ ID NO: 191356 - DNA, 20 bp, Artificial Sequence
  Description of Artificial Sequence: Synthetic oligonucleotide
  Target: ATXN1; (-) strand; PAM type: YTN; PAM sequence: CTC
tggcaagtgaagcaacacta

SEQ ID NO: 191357 - DNA, 20 bp, Artificial Sequence
  Description of Artificial Sequence: Synthetic oligonucleotide
  Target: ATXN1; (-) strand; PAM type: YTN; PAM sequence: TTA
ctctggcaagtgaagcaaca

SEQ ID NO: 191358 - DNA, 20 bp, Artificial Sequence
  Description of Artificial Sequence: Synthetic oligonucleotide
  Target: ATXN1; (-) strand; PAM type: YTN; PAM sequence: TTT
actctggcaagtgaagcaac

SEQ ID NO: 191359 - DNA, 20 bp, Artificial Sequence
  Description of Artificial Sequence: Synthetic oligonucleotide
  Target: ATXN1; (-) strand; PAM type: YTN; PAM sequence: CTC
atttactctggcaagtgaag

SEQ ID NO: 191360 - DNA, 20 bp, Artificial Sequence
  Description of Artificial Sequence: Synthetic oligonucleotide
  Target: ATXN1; (-) strand; PAM type: YTN; PAM sequence: TTA
taactcatttactctggcaa

SEQ ID NO: 191361 - DNA, 20 bp, Artificial Sequence
  Description of Artificial Sequence: Synthetic oligonucleotide
  Target: ATXN1; (-) strand; PAM type: YTN; PAM sequence: TTT
ataactcatttactctggca

SEQ ID NO: 191362 - DNA, 20 bp, Artificial Sequence
  Description of Artificial Sequence: Synthetic oligonucleotide
  Target: ATXN1; (-) strand; PAM type: YTN; PAM sequence: TTT
tataactcatttactctggc

SEQ ID NO: 191363 - DNA, 20 bp, Artificial Sequence
  Description of Artificial Sequence: Synthetic oligonucleotide
  Target: ATXN1; (-) strand; PAM type: YTN; PAM sequence: TTT
ttataactcatttactctgg

SEQ ID NO: 191364 - DNA, 20 bp, Artificial Sequence
  Description of Artificial Sequence: Synthetic oligonucleotide
  Target: ATXN1; (-) strand; PAM type: YTN; PAM sequence: TTA
tgagaaagcagaggttttta

SEQ ID NO: 191365 - DNA, 20 bp, Artificial Sequence
  Description of Artificial Sequence: Synthetic oligonucleotide
  Target: ATXN1; (-) strand; PAM type: YTN; PAM sequence: TTT
atgagaaagcagaggttttt

SEQ ID NO: 191366 - DNA, 20 bp, Artificial Sequence
  Description of Artificial Sequence: Synthetic oligonucleotide
  Target: ATXN1; (-) strand; PAM type: YTN; PAM sequence: TTT
tatgagaaagcagaggtttt

SEQ ID NO: 191367 - DNA, 20 bp, Artificial Sequence
  Description of Artificial Sequence: Synthetic oligonucleotide
  Target: ATXN1; (-) strand; PAM type: YTN; PAM sequence: CTT
ttatgagaaagcagaggttt

SEQ ID NO: 191368 - DNA, 20 bp, Artificial Sequence
  Description of Artificial Sequence: Synthetic oligonucleotide
  Target: ATXN1; (-) strand; PAM type: YTN; PAM sequence: TTG
ggtatatggaggcttttatg

SEQ ID NO: 191369 - DNA, 20 bp, Artificial Sequence
  Description of Artificial Sequence: Synthetic oligonucleotide
  Target: ATXN1; (-) strand; PAM type: YTN; PAM sequence: TTC
gttgggtatatggaggcttt

SEQ ID NO: 191370 - DNA, 20 bp, Artificial Sequence
  Description of Artificial Sequence: Synthetic oligonucleotide
  Target: ATXN1; (-) strand; PAM type: YTN; PAM sequence: TTC
gccattcgttgggtatatgg

SEQ ID NO: 191371 - DNA, 20 bp, Artificial Sequence
  Description of Artificial Sequence: Synthetic oligonucleotide
  Target: ATXN1; (-) strand; PAM type: YTN; PAM sequence: TTG
taacatcattcgccattcgt

SEQ ID NO: 191372 - DNA, 20 bp, Artificial Sequence
  Description of Artificial Sequence: Synthetic oligonucleotide
  Target: ATXN1; (-) strand; PAM type: YTN; PAM sequence: TTA
ttgtaacatcattcgccatt

SEQ ID NO: 191373 - DNA, 20 bp, Artificial Sequence
  Description of Artificial Sequence: Synthetic oligonucleotide
  Target: ATXN1; (-) strand; PAM type: YTN; PAM sequence: CTT
attgtaacatcattcgccat

SEQ ID NO: 191374 - DNA, 20 bp, Artificial Sequence
  Description of Artificial Sequence: Synthetic oligonucleotide
  Target: ATXN1; (-) strand; PAM type: YTN; PAM sequence: CTG
cttattgtaacatcattcgc

SEQ ID NO: 191375 - DNA, 20 bp, Artificial Sequence
  Description of Artificial Sequence: Synthetic oligonucleotide
  Target: ATXN1; (-) strand; PAM type: YTN; PAM sequence: TTA
tgggaggaaatgggacacgt

SEQ ID NO: 191376 - DNA, 20 bp, Artificial Sequence
  Description of Artificial Sequence: Synthetic oligonucleotide
  Target: ATXN1; (-) strand; PAM type: YTN; PAM sequence: CTT
atgggaggaaatgggacacg

SEQ ID NO: 191377 - DNA, 20 bp, Artificial Sequence
  Description of Artificial Sequence: Synthetic oligonucleotide
  Target: ATXN1; (-) strand; PAM type: YTN; PAM sequence: TTC
cttatgggaggaaatgggac

SEQ ID NO: 191378 - DNA, 20 bp, Artificial Sequence
  Description of Artificial Sequence: Synthetic oligonucleotide
  Target: ATXN1; (-) strand; PAM type: YTN; PAM sequence: TTA
ttccttatgggaggaaatgg

SEQ ID NO: 191379 - DNA, 20 bp, Artificial Sequence
  Description of Artificial Sequence: Synthetic oligonucleotide
  Target: ATXN1; (-) strand; PAM type: YTN; PAM sequence: CTC
cagatgaagtgaaaaggaga

SEQ ID NO: 191380 - DNA, 20 bp, Artificial Sequence
  Description of Artificial Sequence: Synthetic oligonucleotide
  Target: ATXN1; (-) strand; PAM type: YTN; PAM sequence: CTG
ccctccagatgaagtgaaaa

SEQ ID NO: 191381 - DNA, 20 bp, Artificial Sequence
  Description of Artificial Sequence: Synthetic oligonucleotide
  Target: ATXN1; (-) strand; PAM type: YTN; PAM sequence: CTA
ggagggaagacactgccctc

SEQ ID NO: 191382 - DNA, 20 bp, Artificial Sequence
  Description of Artificial Sequence: Synthetic oligonucleotide
  Target: ATXN1; (-) strand; PAM type: YTN; PAM sequence: TTC
taggagggaagacactgccc

SEQ ID NO: 191383 - DNA, 20 bp, Artificial Sequence
  Description of Artificial Sequence: Synthetic oligonucleotide
  Target: ATXN1; (-) strand; PAM type: YTN; PAM sequence: CTT
ctaggagggaagacactgcc

SEQ ID NO: 191384 - DNA, 20 bp, Artificial Sequence
  Description of Artificial Sequence: Synthetic oligonucleotide
  Target: ATXN1; (-) strand; PAM type: YTN; PAM sequence: CTC
ttctaggagggaagacactg

SEQ ID NO: 191385 - DNA, 20 bp, Artificial Sequence
  Description of Artificial Sequence: Synthetic oligonucleotide
  Target: ATXN1; (-) strand; PAM type: YTN; PAM sequence: CTC
tcttctaggagggaagacac

SEQ ID NO: 191386 - DNA, 20 bp, Artificial Sequence
  Description of Artificial Sequence: Synthetic oligonucleotide
  Target: ATXN1; (-) strand; PAM type: YTN; PAM sequence: CTG
ggcctctcttctaggaggga

SEQ ID NO: 191387 - DNA, 20 bp, Artificial Sequence
  Description of Artificial Sequence: Synthetic oligonucleotide
  Target: ATXN1; (-) strand; PAM type: YTN; PAM sequence: CTC
agcctgggcctctcttctag

SEQ ID NO: 191388 - DNA, 20 bp, Artificial Sequence
  Description of Artificial Sequence: Synthetic oligonucleotide
  Target: ATXN1; (-) strand; PAM type: YTN; PAM sequence: CTC
tcagcctgggcctctcttct

SEQ ID NO: 191389 - DNA, 20 bp, Artificial Sequence
  Description of Artificial Sequence: Synthetic oligonucleotide
  Target: ATXN1; (-) strand; PAM type: YTN; PAM sequence: CTG
ccaaaaccatgatgctctca

SEQ ID NO: 191390 - DNA, 20 bp, Artificial Sequence
  Description of Artificial Sequence: Synthetic oligonucleotide
  Target: ATXN1; (-) strand; PAM type: YTN; PAM sequence: TTC
cctgccaaaaccatgatgct

SEQ ID NO: 191391 - DNA, 20 bp, Artificial Sequence
  Description of Artificial Sequence: Synthetic oligonucleotide
  Target: ATXN1; (-) strand; PAM type: YTN; PAM sequence: CTG
agttccctgccaaaaccatg

SEQ ID NO: 191392 - DNA, 20 bp, Artificial Sequence
  Description of Artificial Sequence: Synthetic oligonucleotide
  Target: ATXN1; (-) strand; PAM type: YTN; PAM sequence: TTC
tgagttccctgccaaaacca

SEQ ID NO: 191393 - DNA, 20 bp, Artificial Sequence
  Description of Artificial Sequence: Synthetic oligonucleotide
  Target: ATXN1; (-) strand; PAM type: YTN; PAM sequence: TTT
ctgagttccctgccaaaacc

SEQ ID NO: 191394 - DNA, 20 bp, Artificial Sequence
  Description of Artificial Sequence: Synthetic oligonucleotide
  Target: ATXN1; (-) strand; PAM type: YTN; PAM sequence: TTT
tctgagttccctgccaaaac

SEQ ID NO: 191395 - DNA, 20 bp, Artificial Sequence
  Description of Artificial Sequence: Synthetic oligonucleotide
  Target: ATXN1; (-) strand; PAM type: YTN; PAM sequence: CTG
atgccaagattttctgagtt

SEQ ID NO: 191396 - DNA, 20 bp, Artificial Sequence
  Description of Artificial Sequence: Synthetic oligonucleotide
  Target: ATXN1; (-) strand; PAM type: YTN; PAM sequence: TTA
tagtaagccctgatgccaag

SEQ ID NO: 191397 - DNA, 20 bp, Artificial Sequence
  Description of Artificial Sequence: Synthetic oligonucleotide
  Target: ATXN1; (-) strand; PAM type: YTN; PAM sequence: CTT
atagtaagccctgatgccaa

SEQ ID NO: 191398 - DNA, 20 bp, Artificial Sequence
  Description of Artificial Sequence: Synthetic oligonucleotide
  Target: ATXN1; (-) strand; PAM type: YTN; PAM sequence: CTC
agcttatagtaagccctgat

SEQ ID NO: 191399 - DNA, 20 bp, Artificial Sequence
  Description of Artificial Sequence: Synthetic oligonucleotide
  Target: ATXN1; (-) strand; PAM type: YTN; PAM sequence: TTA
actcagcttatagtaagccc

SEQ ID NO: 191400 - DNA, 20 bp, Artificial Sequence
  Description of Artificial Sequence: Synthetic oligonucleotide
  Target: ATXN1; (-) strand; PAM type: YTN; PAM sequence: TTT
aactcagcttatagtaagcc

SEQ ID NO: 191401 - DNA, 20 bp, Artificial Sequence
  Description of Artificial Sequence: Synthetic oligonucleotide
  Target: ATXN1; (-) strand; PAM type: YTN; PAM sequence: CTG
tttaactcagcttatagtaa

SEQ ID NO: 191402 - DNA, 20 bp, Artificial Sequence
  Description of Artificial Sequence: Synthetic oligonucleotide
  Target: ATXN1; (-) strand; PAM type: YTN; PAM sequence: TTC
ctgtttaactcagcttatag

SEQ ID NO: 191403 - DNA, 20 bp, Artificial Sequence
  Description of Artificial Sequence: Synthetic oligonucleotide
  Target: ATXN1; (-) strand; PAM type: YTN; PAM sequence: TTC
cattcctgtttaactcagct

SEQ ID NO: 191404 - DNA, 20 bp, Artificial Sequence
  Description of Artificial Sequence: Synthetic oligonucleotide
  Target: ATXN1; (-) strand; PAM type: YTN; PAM sequence: CTT
ccattcctgtttaactcagc

SEQ ID NO: 191405 - DNA, 20 bp, Artificial Sequence
  Description of Artificial Sequence: Synthetic oligonucleotide
  Target: ATXN1; (-) strand; PAM type: YTN; PAM sequence: TTC
caatgatcttccattcctgt

SEQ ID NO: 191406 - DNA, 20 bp, Artificial Sequence
  Description of Artificial Sequence: Synthetic oligonucleotide
  Target: ATXN1; (-) strand; PAM type: YTN; PAM sequence: CTT
ccaatgatcttccattcctg

SEQ ID NO: 191407 - DNA, 20 bp, Artificial Sequence
  Description of Artificial Sequence: Synthetic oligonucleotide
  Target: ATXN1; (-) strand; PAM type: YTN; PAM sequence: TTC
cagggcttccaatgatcttc

SEQ ID NO: 191408 - DNA, 20 bp, Artificial Sequence
  Description of Artificial Sequence: Synthetic oligonucleotide
  Target: ATXN1; (-) strand; PAM type: YTN; PAM sequence: TTT
ccagggcttccaatgatctt

SEQ ID NO: 191409 - DNA, 20 bp, Artificial Sequence
  Description of Artificial Sequence: Synthetic oligonucleotide
  Target: ATXN1; (-) strand; PAM type: YTN; PAM sequence: TTT
tccagggcttccaatgatct

SEQ ID NO: 191410 - DNA, 20 bp, Artificial Sequence
  Description of Artificial Sequence: Synthetic oligonucleotide
  Target: ATXN1; (-) strand; PAM type: YTN; PAM sequence: TTT
ttccagggcttccaatgatc

SEQ ID NO: 191411 - DNA, 20 bp, Artificial Sequence
  Description of Artificial Sequence: Synthetic oligonucleotide
  Target: ATXN1; (-) strand; PAM type: YTN; PAM sequence: CTA
tttttccagggcttccaatg

SEQ ID NO: 191412 - DNA, 20 bp, Artificial Sequence
  Description of Artificial Sequence: Synthetic oligonucleotide
  Target: ATXN1; (-) strand; PAM type: YTN; PAM sequence: TTC
tatttttccagggcttccaa

SEQ ID NO: 191413 - DNA, 20 bp, Artificial Sequence
  Description of Artificial Sequence: Synthetic oligonucleotide
  Target: ATXN1; (-) strand; PAM type: YTN; PAM sequence: TTT
ctatttttccagggcttcca

SEQ ID NO: 191414 - DNA, 20 bp, Artificial Sequence
  Description of Artificial Sequence: Synthetic oligonucleotide
  Target: ATXN1; (-) strand; PAM type: YTN; PAM sequence: TTT
tctatttttccagggcttcc

SEQ ID NO: 191415 - DNA, 20 bp, Artificial Sequence
  Description of Artificial Sequence: Synthetic oligonucleotide
  Target: ATXN1; (-) strand; PAM type: YTN; PAM sequence: CTA
gaaatattttctatttttcc

SEQ ID NO: 191416 - DNA, 20 bp, Artificial Sequence
  Description of Artificial Sequence: Synthetic oligonucleotide
  Target: ATXN1; (-) strand; PAM type: YTN; PAM sequence: CTA
ccctagaaatattttctatt

SEQ ID NO: 191417 - DNA, 20 bp, Artificial Sequence
  Description of Artificial Sequence: Synthetic oligonucleotide
  Target: ATXN1; (-) strand; PAM type: YTN; PAM sequence: CTG
tgctaccctagaaatatttt

SEQ ID NO: 191418 - DNA, 20 bp, Artificial Sequence
  Description of Artificial Sequence: Synthetic oligonucleotide
  Target: ATXN1; (-) strand; PAM type: YTN; PAM sequence: TTC
tgtgctaccctagaaatatt

SEQ ID NO: 191419 - DNA, 20 bp, Artificial Sequence
  Description of Artificial Sequence: Synthetic oligonucleotide
  Target: ATXN1; (-) strand; PAM type: YTN; PAM sequence: CTT
ctgtgctaccctagaaatat

SEQ ID NO: 191420 - DNA, 20 bp, Artificial Sequence
  Description of Artificial Sequence: Synthetic oligonucleotide
  Target: ATXN1; (-) strand; PAM type: YTN; PAM sequence: CTC
catgtcacccaaatgatgag

SEQ ID NO: 191421 - DNA, 20 bp, Artificial Sequence
  Description of Artificial Sequence: Synthetic oligonucleotide
  Target: ATXN1; (-) strand; PAM type: YTN; PAM sequence: CTG
ctccatgtcacccaaatgat

SEQ ID NO: 191422 - DNA, 20 bp, Artificial Sequence
  Description of Artificial Sequence: Synthetic oligonucleotide
  Target: ATXN1; (-) strand; PAM type: YTN; PAM sequence: CTG
cctgctccatgtcacccaaa

SEQ ID NO: 191423 - DNA, 20 bp, Artificial Sequence
  Description of Artificial Sequence: Synthetic oligonucleotide
  Target: ATXN1; (-) strand; PAM type: YTN; PAM sequence: TTG
aaacgatgctgcctgctcca

SEQ ID NO: 191424 - DNA, 20 bp, Artificial Sequence
  Description of Artificial Sequence: Synthetic oligonucleotide
  Target: ATXN1; (-) strand; PAM type: YTN; PAM sequence: CTT
gaaacgatgctgcctgctcc

SEQ ID NO: 191425 - DNA, 20 bp, Artificial Sequence
  Description of Artificial Sequence: Synthetic oligonucleotide
  Target: ATXN1; (-) strand; PAM type: YTN; PAM sequence: TTA
ataaaatgatgaacttgaaa

SEQ ID NO: 191426 - DNA, 20 bp, Artificial Sequence
  Description of Artificial Sequence: Synthetic oligonucleotide
  Target: ATXN1; (-) strand; PAM type: YTN; PAM sequence: CTT
aataaaatgatgaacttgaa

SEQ ID NO: 191427 - DNA, 20 bp, Artificial Sequence
  Description of Artificial Sequence: Synthetic oligonucleotide
  Target: ATXN1; (-) strand; PAM type: YTN; PAM sequence: TTG
cttaataaaatgatgaactt

SEQ ID NO: 191428 - DNA, 20 bp, Artificial Sequence
  Description of Artificial Sequence: Synthetic oligonucleotide
  Target: ATXN1; (-) strand; PAM type: YTN; PAM sequence: CTC
attgcttaataaaatgatga

SEQ ID NO: 191429 - DNA, 20 bp, Artificial Sequence
  Description of Artificial Sequence: Synthetic oligonucleotide
  Target: ATXN1; (-) strand; PAM type: YTN; PAM sequence: TTG
actcattgcttaataaaatg

SEQ ID NO: 191430 - DNA, 20 bp, Artificial Sequence
  Description of Artificial Sequence: Synthetic oligonucleotide
  Target: ATXN1; (-) strand; PAM type: YTN; PAM sequence: TTT
gactcattgcttaataaaat

SEQ ID NO: 191431 - DNA, 20 bp, Artificial Sequence
  Description of Artificial Sequence: Synthetic oligonucleotide
  Target: ATXN1; (-) strand; PAM type: YTN; PAM sequence: TTC
atttgactcattgcttaata

SEQ ID NO: 191432 - DNA, 20 bp, Artificial Sequence
  Description of Artificial Sequence: Synthetic oligonucleotide
  Target: ATXN1; (-) strand; PAM type: YTN; PAM sequence: CTT
catttgactcattgcttaat

SEQ ID NO: 191433 - DNA, 20 bp, Artificial Sequence
  Description of Artificial Sequence: Synthetic oligonucleotide
  Target: ATXN1; (-) strand; PAM type: YTN; PAM sequence: TTC
ttcatttgactcattgctta

SEQ ID NO: 191434 - DNA, 20 bp, Artificial Sequence
  Description of Artificial Sequence: Synthetic oligonucleotide
  Target: ATXN1; (-) strand; PAM type: YTN; PAM sequence: TTT
cttcatttgactcattgctt

SEQ ID NO: 191435 - DNA, 20 bp, Artificial Sequence
  Description of Artificial Sequence: Synthetic oligonucleotide
  Target: ATXN1; (-) strand; PAM type: YTN; PAM sequence: CTT
tcttcatttgactcattgct

SEQ ID NO: 191436 - DNA, 20 bp, Artificial Sequence
  Description of Artificial Sequence: Synthetic oligonucleotide
  Target: ATXN1; (-) strand; PAM type: YTN; PAM sequence: TTA
aaccactttcttcatttgac

SEQ ID NO: 191437 - DNA, 20 bp, Artificial Sequence
  Description of Artificial Sequence: Synthetic oligonucleotide
  Target: ATXN1; (-) strand; PAM type: YTN; PAM sequence: CTT
aaaccactttcttcatttga

SEQ ID NO: 191438 - DNA, 20 bp, Artificial Sequence
  Description of Artificial Sequence: Synthetic oligonucleotide
  Target: ATXN1; (-) strand; PAM type: YTN; PAM sequence: TTC
ccttaaaccactttcttcat

SEQ ID NO: 191439 - DNA, 20 bp, Artificial Sequence
  Description of Artificial Sequence: Synthetic oligonucleotide
  Target: ATXN1; (-) strand; PAM type: YTN; PAM sequence: TTT
cccttaaaccactttcttca

SEQ ID NO: 191440 - DNA, 20 bp, Artificial Sequence
  Description of Artificial Sequence: Synthetic oligonucleotide
  Target: ATXN1; (-) strand; PAM type: YTN; PAM sequence: TTA
gaaaatgaccatttccctta

SEQ ID NO: 191441 - DNA, 20 bp, Artificial Sequence
  Description of Artificial Sequence: Synthetic oligonucleotide
  Target: ATXN1; (-) strand; PAM type: YTN; PAM sequence: CTA
gagaaaaatcattagaaaat

SEQ ID NO: 191442 - DNA, 20 bp, Artificial Sequence
  Description of Artificial Sequence: Synthetic oligonucleotide
  Target: ATXN1; (-) strand; PAM type: YTN; PAM sequence: TTA
aataaaatcatactagagaa

SEQ ID NO: 191443 - DNA, 20 bp, Artificial Sequence
  Description of Artificial Sequence: Synthetic oligonucleotide
  Target: ATXN1; (-) strand; PAM type: YTN; PAM sequence: CTA
ttaaataaaatcatactaga

SEQ ID NO: 191444 - DNA, 20 bp, Artificial Sequence
  Description of Artificial Sequence: Synthetic oligonucleotide
  Target: ATXN1; (-) strand; PAM type: YTN; PAM sequence: TTA
tgtaaaactattaaataaaa

SEQ ID NO: 191445 - DNA, 20 bp, Artificial Sequence
  Description of Artificial Sequence: Synthetic oligonucleotide
  Target: ATXN1; (-) strand; PAM type: YTN; PAM sequence: CTT
atgtaaaactattaaataaa

SEQ ID NO: 191446 - DNA, 20 bp, Artificial Sequence
  Description of Artificial Sequence: Synthetic oligonucleotide
  Target: ATXN1; (-) strand; PAM type: YTN; PAM sequence: TTG
cttatgtaaaactattaaat

SEQ ID NO: 191447 - DNA, 20 bp, Artificial Sequence
  Description of Artificial Sequence: Synthetic oligonucleotide
  Target: ATXN1; (-) strand; PAM type: YTN; PAM sequence: TTT
gcttatgtaaaactattaaa

SEQ ID NO: 191448 - DNA, 20 bp, Artificial Sequence
  Description of Artificial Sequence: Synthetic oligonucleotide
  Target: ATXN1; (-) strand; PAM type: YTN; PAM sequence: CTT
tgcttatgtaaaactattaa

SEQ ID NO: 191449 - DNA, 20 bp, Artificial Sequence
  Description of Artificial Sequence: Synthetic oligonucleotide
  Target: ATXN1; (-) strand; PAM type: YTN; PAM sequence: TTA
aaagggggaggtcagaggag

SEQ ID NO: 191450 - DNA, 20 bp, Artificial Sequence
  Description of Artificial Sequence: Synthetic oligonucleotide
  Target: ATXN1; (-) strand; PAM type: YTN; PAM sequence: TTT
aaaagggggaggtcagagga

SEQ ID NO: 191451 - DNA, 20 bp, Artificial Sequence
  Description of Artificial Sequence: Synthetic oligonucleotide
  Target: ATXN1; (-) strand; PAM type: YTN; PAM sequence: TTT
taaaagggggaggtcagagg

SEQ ID NO: 191452 - DNA, 20 bp, Artificial Sequence
  Description of Artificial Sequence: Synthetic oligonucleotide
  Target: ATXN1; (-) strand; PAM type: YTN; PAM sequence: CTG
gaaattttaaaagggggagg

SEQ ID NO: 191453 - DNA, 20 bp, Artificial Sequence
  Description of Artificial Sequence: Synthetic oligonucleotide
  Target: ATXN1; (-) strand; PAM type: YTN; PAM sequence: TTC
tggaaattttaaaaggggga

SEQ ID NO: 191454 - DNA, 20 bp, Artificial Sequence
  Description of Artificial Sequence: Synthetic oligonucleotide
  Target: ATXN1; (-) strand; PAM type: YTN; PAM sequence: TTT
ctggaaattttaaaaggggg

SEQ ID NO: 191455 - DNA, 20 bp, Artificial Sequence
  Description of Artificial Sequence: Synthetic oligonucleotide
  Target: ATXN1; (-) strand; PAM type: YTN; PAM sequence: TTT
tctggaaattttaaaagggg

SEQ ID NO: 191456 - DNA, 20 bp, Artificial Sequence
  Description of Artificial Sequence: Synthetic oligonucleotide
  Target: ATXN1; (-) strand; PAM type: YTN; PAM sequence: TTA
ttttctggaaattttaaaag

SEQ ID NO: 191457 - DNA, 20 bp, Artificial Sequence
  Description of Artificial Sequence: Synthetic oligonucleotide
  Target: ATXN1; (-) strand; PAM type: YTN; PAM sequence: CTT
attttctggaaattttaaaa

SEQ ID NO: 191458 - DNA, 20 bp, Artificial Sequence
  Description of Artificial Sequence: Synthetic oligonucleotide
  Target: ATXN1; (-) strand; PAM type: YTN; PAM sequence: CTC
catcagaatgtcttattttc

SEQ ID NO: 191459 - DNA, 20 bp, Artificial Sequence
  Description of Artificial Sequence: Synthetic oligonucleotide
  Target: ATXN1; (-) strand; PAM type: YTN; PAM sequence: CTG
atctccatcagaatgtctta

SEQ ID NO: 191460 - DNA, 20 bp, Artificial Sequence
  Description of Artificial Sequence: Synthetic oligonucleotide
  Target: ATXN1; (-) strand; PAM type: YTN; PAM sequence: TTG
tggcctgatctccatcagaa

SEQ ID NO: 191461 - DNA, 20 bp, Artificial Sequence
  Description of Artificial Sequence: Synthetic oligonucleotide
  Target: ATXN1; (-) strand; PAM type: YTN; PAM sequence: CTT
gtggcctgatctccatcaga

SEQ ID NO: 191462 - DNA, 20 bp, Artificial Sequence
  Description of Artificial Sequence: Synthetic oligonucleotide
  Target: ATXN1; (-) strand; PAM type: YTN; PAM sequence: CTG
tcttgtggcctgatctccat

SEQ ID NO: 191463 - DNA, 20 bp, Artificial Sequence
  Description of Artificial Sequence: Synthetic oligonucleotide
  Target: ATXN1; (-) strand; PAM type: YTN; PAM sequence: CTA
ctgtcttgtggcctgatctc

SEQ ID NO: 191464 - DNA, 20 bp, Artificial Sequence
  Description of Artificial Sequence: Synthetic oligonucleotide
  Target: ATXN1; (-) strand; PAM type: YTN; PAM sequence: CTG
aactactgtcttgtggcctg

SEQ ID NO: 191465 - DNA, 20 bp, Artificial Sequence
  Description of Artificial Sequence: Synthetic oligonucleotide
  Target: ATXN1; (-) strand; PAM type: YTN; PAM sequence: TTC
tgaactactgtcttgtggcc

SEQ ID NO: 191466 - DNA, 20 bp, Artificial Sequence
  Description of Artificial Sequence: Synthetic oligonucleotide
  Target: ATXN1; (-) strand; PAM type: YTN; PAM sequence: TTT
ctgaactactgtcttgtggc

SEQ ID NO: 191467 - DNA, 20 bp, Artificial Sequence
  Description of Artificial Sequence: Synthetic oligonucleotide
  Target: ATXN1; (-) strand; PAM type: YTN; PAM sequence: TTT
tctgaactactgtcttgtgg

SEQ ID NO: 191468 - DNA, 20 bp, Artificial Sequence
  Description of Artificial Sequence: Synthetic oligonucleotide
  Target: ATXN1; (-) strand; PAM type: YTN; PAM sequence: CTT
ttctgaactactgtcttgtg

SEQ ID NO: 191469 - DNA, 20 bp, Artificial Sequence
  Description of Artificial Sequence: Synthetic oligonucleotide
  Target: ATXN1; (-) strand; PAM type: YTN; PAM sequence: TTA
cccttttctgaactactgtc

SEQ ID NO: 191470 - DNA, 20 bp, Artificial Sequence
  Description of Artificial Sequence: Synthetic oligonucleotide
  Target: ATXN1; (-) strand; PAM type: YTN; PAM sequence: TTA
aaacaaaaattacccttttc

SEQ ID NO: 191471 - DNA, 20 bp, Artificial Sequence
  Description of Artificial Sequence: Synthetic oligonucleotide
  Target: ATXN1; (-) strand; PAM type: YTN; PAM sequence: TTA
catagggagtgaggagaaaa

SEQ ID NO: 191472 - DNA, 20 bp, Artificial Sequence
  Description of Artificial Sequence: Synthetic oligonucleotide
  Target: ATXN1; (-) strand; PAM type: YTN; PAM sequence: CTG
gccaccaattacatagggag

SEQ ID NO: 191473 - DNA, 20 bp, Artificial Sequence
  Description of Artificial Sequence: Synthetic oligonucleotide
  Target: ATXN1; (-) strand; PAM type: YTN; PAM sequence: TTC
aatatcctggccaccaatta

SEQ ID NO: 191474 - DNA, 20 bp, Artificial Sequence
  Description of Artificial Sequence: Synthetic oligonucleotide
  Target: ATXN1; (-) strand; PAM type: YTN; PAM sequence: TTT
caatatcctggccaccaatt

SEQ ID NO: 191475 - DNA, 20 bp, Artificial Sequence
  Description of Artificial Sequence: Synthetic oligonucleotide
  Target: ATXN1; (-) strand; PAM type: YTN; PAM sequence: TTC
cagagaatttcaatatcctg

SEQ ID NO: 191476 - DNA, 20 bp, Artificial Sequence
  Description of Artificial Sequence: Synthetic oligonucleotide
  Target: ATXN1; (-) strand; PAM type: YTN; PAM sequence: TTT
ccagagaatttcaatatcct

SEQ ID NO: 191477 - DNA, 20 bp, Artificial Sequence
  Description of Artificial Sequence: Synthetic oligonucleotide
  Target: ATXN1; (-) strand; PAM type: YTN; PAM sequence: TTT
tccagagaatttcaatatcc

SEQ ID NO: 191478 - DNA, 20 bp, Artificial Sequence
  Description of Artificial Sequence: Synthetic oligonucleotide
  Target: ATXN1; (-) strand; PAM type: YTN; PAM sequence: CTG
tgttttccagagaatttcaa

SEQ ID NO: 191479 - DNA, 20 bp, Artificial Sequence
  Description of Artificial Sequence: Synthetic oligonucleotide
  Target: ATXN1; (-) strand; PAM type: YTN; PAM sequence: TTC
tgtgttttccagagaatttc

SEQ ID NO: 191480 - DNA, 20 bp, Artificial Sequence
  Description of Artificial Sequence: Synthetic oligonucleotide
  Target: ATXN1; (-) strand; PAM type: YTN; PAM sequence: TTC
atcatgtaaatggattctgt

SEQ ID NO: 191481 - DNA, 20 bp, Artificial Sequence
  Description of Artificial Sequence: Synthetic oligonucleotide
  Target: ATXN1; (-) strand; PAM type: YTN; PAM sequence: TTG
aattcatcatgtaaatggat

SEQ ID NO: 191482 - DNA, 20 bp, Artificial Sequence
  Description of Artificial Sequence: Synthetic oligonucleotide
  Target: ATXN1; (-) strand; PAM type: YTN; PAM sequence: TTA
taatatatcattgaattcat

SEQ ID NO: 191483 - DNA, 20 bp, Artificial Sequence
  Description of Artificial Sequence: Synthetic oligonucleotide
  Target: ATXN1; (-) strand; PAM type: YTN; PAM sequence: CTG
aacaagacattataatatat

SEQ ID NO: 191484 - DNA, 20 bp, Artificial Sequence
  Description of Artificial Sequence: Synthetic oligonucleotide
  Target: ATXN1; (-) strand; PAM type: YTN; PAM sequence: TTC
tgaacaagacattataatat

SEQ ID NO: 191485 - DNA, 20 bp, Artificial Sequence
  Description of Artificial Sequence: Synthetic oligonucleotide
  Target: ATXN1; (-) strand; PAM type: YTN; PAM sequence: CTT
ctgaacaagacattataata

SEQ ID NO: 191486 - DNA, 20 bp, Artificial Sequence
  Description of Artificial Sequence: Synthetic oligonucleotide
  Target: ATXN1; (-) strand; PAM type: YTN; PAM sequence: CTA
acacttctgaacaagacatt

SEQ ID NO: 191487 - DNA, 20 bp, Artificial Sequence
  Description of Artificial Sequence: Synthetic oligonucleotide
  Target: ATXN1; (-) strand; PAM type: YTN; PAM sequence: CTC
ctaacacttctgaacaagac

SEQ ID NO: 191488 - DNA, 20 bp, Artificial Sequence
  Description of Artificial Sequence: Synthetic oligonucleotide
  Target: ATXN1; (-) strand; PAM type: YTN; PAM sequence: TTC
tcctaacacttctgaacaag

SEQ ID NO: 191489 - DNA, 20 bp, Artificial Sequence
  Description of Artificial Sequence: Synthetic oligonucleotide
  Target: ATXN1; (-) strand; PAM type: YTN; PAM sequence: CTC
atcaattctcctaacacttc

SEQ ID NO: 191490 - DNA, 20 bp, Artificial Sequence
  Description of Artificial Sequence: Synthetic oligonucleotide
  Target: ATXN1; (-) strand; PAM type: YTN; PAM sequence: TTA
actcatcaattctcctaaca

SEQ ID NO: 191491 - DNA, 20 bp, Artificial Sequence
  Description of Artificial Sequence: Synthetic oligonucleotide
  Target: ATXN1; (-) strand; PAM type: YTN; PAM sequence: TTA
ccaacattaactcatcaatt

SEQ ID NO: 191492 - DNA, 20 bp, Artificial Sequence
  Description of Artificial Sequence: Synthetic oligonucleotide
  Target: ATXN1; (-) strand; PAM type: YTN; PAM sequence: TTT
accaacattaactcatcaat

SEQ ID NO: 191493 - DNA, 20 bp, Artificial Sequence
  Description of Artificial Sequence: Synthetic oligonucleotide
  Target: ATXN1; (-) strand; PAM type: YTN; PAM sequence: TTG
cagagtgatttaccaacatt

SEQ ID NO: 191494 - DNA, 20 bp, Artificial Sequence
  Description of Artificial Sequence: Synthetic oligonucleotide
  Target: ATXN1; (-) strand; PAM type: YTN; PAM sequence: CTG
ggaattgcagagtgatttac

SEQ ID NO: 191495 - DNA, 20 bp, Artificial Sequence
  Description of Artificial Sequence: Synthetic oligonucleotide
  Target: ATXN1; (-) strand; PAM type: YTN; PAM sequence: TTG
acctgggaattgcagagtga

SEQ ID NO: 191496 - DNA, 20 bp, Artificial Sequence
  Description of Artificial Sequence: Synthetic oligonucleotide
  Target: ATXN1; (-) strand; PAM type: YTN; PAM sequence: TTT
gacctgggaattgcagagtg

SEQ ID NO: 191497 - DNA, 20 bp, Artificial Sequence
  Description of Artificial Sequence: Synthetic oligonucleotide
  Target: ATXN1; (-) strand; PAM type: YTN; PAM sequence: CTT
tgacctgggaattgcagagt

SEQ ID NO: 191498 - DNA, 20 bp, Artificial Sequence
  Description of Artificial Sequence: Synthetic oligonucleotide
  Target: ATXN1; (-) strand; PAM type: YTN; PAM sequence: TTC
acatctttgacctgggaatt

SEQ ID NO: 191499 - DNA, 20 bp, Artificial Sequence
  Description of Artificial Sequence: Synthetic oligonucleotide
  Target: ATXN1; (-) strand; PAM type: YTN; PAM sequence: TTT
cacatctttgacctgggaat

SEQ ID NO: 191500 - DNA, 20 bp, Artificial Sequence
  Description of Artificial Sequence: Synthetic oligonucleotide
  Target: ATXN1; (-) strand; PAM type: YTN; PAM sequence: TTC
atttcacatctttgacctgg

SEQ ID NO: 191501 - DNA, 20 bp, Artificial Sequence
  Description of Artificial Sequence: Synthetic oligonucleotide
  Target: ATXN1; (-) strand; PAM type: YTN; PAM sequence: CTG
aaacaaataatgataatgtt

SEQ ID NO: 191502 - DNA, 20 bp, Artificial Sequence
  Description of Artificial Sequence: Synthetic oligonucleotide
  Target: ATXN1; (-) strand; PAM type: YTN; PAM sequence: CTC
cactgaaacaaataatgata

SEQ ID NO: 191503 - DNA, 20 bp, Artificial Sequence
  Description of Artificial Sequence: Synthetic oligonucleotide
  Target: ATXN1; (-) strand; PAM type: YTN; PAM sequence: TTG
ccagtgagcctccactgaaa

SEQ ID NO: 191504 - DNA, 20 bp, Artificial Sequence
  Description of Artificial Sequence: Synthetic oligonucleotide
  Target: ATXN1; (-) strand; PAM type: YTN; PAM sequence: TTT
gccagtgagcctccactgaa

SEQ ID NO: 191505 - DNA, 20 bp, Artificial Sequence
  Description of Artificial Sequence: Synthetic oligonucleotide
  Target: ATXN1; (-) strand; PAM type: YTN; PAM sequence: TTT
tgccagtgagcctccactga

SEQ ID NO: 191506 - DNA, 20 bp, Artificial Sequence
  Description of Artificial Sequence: Synthetic oligonucleotide
  Target: ATXN1; (-) strand; PAM type: YTN; PAM sequence: CTA
gaccacattttgccagtgag

SEQ ID NO: 191507 - DNA, 20 bp, Artificial Sequence
  Description of Artificial Sequence: Synthetic oligonucleotide
  Target: ATXN1; (-) strand; PAM type: YTN; PAM sequence: CTA
atcaggcccactagaccaca

SEQ ID NO: 191508 - DNA, 20 bp, Artificial Sequence
  Description of Artificial Sequence: Synthetic oligonucleotide
  Target: ATXN1; (-) strand; PAM type: YTN; PAM sequence: TTC
ctaatcaggcccactagacc

SEQ ID NO: 191509 - DNA, 20 bp, Artificial Sequence
  Description of Artificial Sequence: Synthetic oligonucleotide
  Target: ATXN1; (-) strand; PAM type: YTN; PAM sequence: TTT
cctaatcaggcccactagac

SEQ ID NO: 191510 - DNA, 20 bp, Artificial Sequence
  Description of Artificial Sequence: Synthetic oligonucleotide
  Target: ATXN1; (-) strand; PAM type: YTN; PAM sequence: TTG
tttcctaatcaggcccacta

SEQ ID NO: 191511 - DNA, 20 bp, Artificial Sequence
  Description of Artificial Sequence: Synthetic oligonucleotide
  Target: ATXN1; (-) strand; PAM type: YTN; PAM sequence: TTT
gtttcctaatcaggcccact

SEQ ID NO: 191512 - DNA, 20 bp, Artificial Sequence
  Description of Artificial Sequence: Synthetic oligonucleotide
  Target: ATXN1; (-) strand; PAM type: YTN; PAM sequence: TTT
tgtttcctaatcaggcccac

SEQ ID NO: 191513 - DNA, 20 bp, Artificial Sequence
  Description of Artificial Sequence: Synthetic oligonucleotide
  Target: ATXN1; (-) strand; PAM type: YTN; PAM sequence: CTT
ttgtttcctaatcaggccca

SEQ ID NO: 191514 - DNA, 20 bp, Artificial Sequence
  Description of Artificial Sequence: Synthetic oligonucleotide
  Target: ATXN1; (-) strand; PAM type: YTN; PAM sequence: TTA
taagcttttgtttcctaatc

SEQ ID NO: 191515 - DNA, 20 bp, Artificial Sequence
  Description of Artificial Sequence: Synthetic oligonucleotide
  Target: ATXN1; (-) strand; PAM type: YTN; PAM sequence: CTG
caaagttataagcttttgtt

SEQ ID NO: 191516 - DNA, 20 bp, Artificial Sequence
  Description of Artificial Sequence: Synthetic oligonucleotide
  Target: ATXN1; (-) strand; PAM type: YTN; PAM sequence: TTG
ctgcaaagttataagctttt

SEQ ID NO: 191517 - DNA, 20 bp, Artificial Sequence
  Description of Artificial Sequence: Synthetic oligonucleotide
  Target: ATXN1; (-) strand; PAM type: YTN; PAM sequence: CTT
gctgcaaagttataagcttt

SEQ ID NO: 191518 - DNA, 20 bp, Artificial Sequence
  Description of Artificial Sequence: Synthetic oligonucleotide
  Target: ATXN1; (-) strand; PAM type: YTN; PAM sequence: CTC
ttgctgcaaagttataagct

SEQ ID NO: 191519 - DNA, 20 bp, Artificial Sequence
  Description of Artificial Sequence: Synthetic oligonucleotide
  Target: ATXN1; (-) strand; PAM type: YTN; PAM sequence: TTC
ccctcttgctgcaaagttat

SEQ ID NO: 191520 - DNA, 20 bp, Artificial Sequence
  Description of Artificial Sequence: Synthetic oligonucleotide
  Target: ATXN1; (-) strand; PAM type: YTN; PAM sequence: TTT
cccctcttgctgcaaagtta

SEQ ID NO: 191521 - DNA, 20 bp, Artificial Sequence
  Description of Artificial Sequence: Synthetic oligonucleotide
  Target: ATXN1; (-) strand; PAM type: YTN; PAM sequence: TTT
tcccctcttgctgcaaagtt

SEQ ID NO: 191522 - DNA, 20 bp, Artificial Sequence
  Description of Artificial Sequence: Synthetic oligonucleotide
  Target: ATXN1; (-) strand; PAM type: YTN; PAM sequence: CTG
aaaaaatgttttcccctctt

SEQ ID NO: 191523 - DNA, 20 bp, Artificial Sequence
  Description of Artificial Sequence: Synthetic oligonucleotide
  Target: ATXN1; (-) strand; PAM type: YTN; PAM sequence: TTA
ggtaaaaggtagtactgaaa

SEQ ID NO: 191524 - DNA, 20 bp, Artificial Sequence
  Description of Artificial Sequence: Synthetic oligonucleotide
  Target: ATXN1; (-) strand; PAM type: YTN; PAM sequence: TTA
gggtagaagagaattaggta

SEQ ID NO: 191525 - DNA, 20 bp, Artificial Sequence
  Description of Artificial Sequence: Synthetic oligonucleotide
  Target: ATXN1; (-) strand; PAM type: YTN; PAM sequence: CTT
agggtagaagagaattaggt

SEQ ID NO: 191526 - DNA, 20 bp, Artificial Sequence
  Description of Artificial Sequence: Synthetic oligonucleotide
  Target: ATXN1; (-) strand; PAM type: YTN; PAM sequence: CTC
ccttagggtagaagagaatt

SEQ ID NO: 191527 - DNA, 20 bp, Artificial Sequence
  Description of Artificial Sequence: Synthetic oligonucleotide
  Target: ATXN1; (-) strand; PAM type: YTN; PAM sequence: TTA
ctcccttagggtagaagaga

SEQ ID NO: 191528 - DNA, 20 bp, Artificial Sequence
  Description of Artificial Sequence: Synthetic oligonucleotide
  Target: ATXN1; (-) strand; PAM type: YTN; PAM sequence: TTT
actcccttagggtagaagag

SEQ ID NO: 191529 - DNA, 20 bp, Artificial Sequence
  Description of Artificial Sequence: Synthetic oligonucleotide
  Target: ATXN1; (-) strand; PAM type: YTN; PAM sequence: CTT
tactcccttagggtagaaga

SEQ ID NO: 191530 - DNA, 20 bp, Artificial Sequence
  Description of Artificial Sequence: Synthetic oligonucleotide
  Target: ATXN1; (-) strand; PAM type: YTN; PAM sequence: TTG
gcatgccctttactccctta

SEQ ID NO: 191531 - DNA, 20 bp, Artificial Sequence
  Description of Artificial Sequence: Synthetic oligonucleotide
  Target: ATXN1; (-) strand; PAM type: YTN; PAM sequence: TTA
tcaataatcattggcatgcc

SEQ ID NO: 191532 - DNA, 20 bp, Artificial Sequence
  Description of Artificial Sequence: Synthetic oligonucleotide
  Target: ATXN1; (-) strand; PAM type: YTN; PAM sequence: TTG
aatgatgttatcaataatca

SEQ ID NO: 191533 - DNA, 20 bp, Artificial Sequence
  Description of Artificial Sequence: Synthetic oligonucleotide
  Target: ATXN1; (-) strand; PAM type: YTN; PAM sequence: TTA
catggcgttgaatgatgtta

SEQ ID NO: 191534 - DNA, 20 bp, Artificial Sequence
  Description of Artificial Sequence: Synthetic oligonucleotide
  Target: ATXN1; (-) strand; PAM type: YTN; PAM sequence: CTC
attacatggcgttgaatgat

SEQ ID NO: 191535 - DNA, 20 bp, Artificial Sequence
  Description of Artificial Sequence: Synthetic oligonucleotide
  Target: ATXN1; (-) strand; PAM type: YTN; PAM sequence: TTC
agtggtgtcaactcattaca

SEQ ID NO: 191536 - DNA, 20 bp, Artificial Sequence
  Description of Artificial Sequence: Synthetic oligonucleotide
  Target: ATXN1; (-) strand; PAM type: YTN; PAM sequence: TTT
cagtggtgtcaactcattac

SEQ ID NO: 191537 - DNA, 20 bp, Artificial Sequence
  Description of Artificial Sequence: Synthetic oligonucleotide
  Target: ATXN1; (-) strand; PAM type: YTN; PAM sequence: TTA
tttcagtggtgtcaactcat

SEQ ID NO: 191538 - DNA, 20 bp, Artificial Sequence
  Description of Artificial Sequence: Synthetic oligonucleotide
  Target: ATXN1; (-) strand; PAM type: YTN; PAM sequence: TTT
atttcagtggtgtcaactca

SEQ ID NO: 191539 - DNA, 20 bp, Artificial Sequence
  Description of Artificial Sequence: Synthetic oligonucleotide
  Target: ATXN1; (-) strand; PAM type: YTN; PAM sequence: TTG
gtttatttcagtggtgtcaa

SEQ ID NO: 191540 - DNA, 20 bp, Artificial Sequence
  Description of Artificial Sequence: Synthetic oligonucleotide
  Target: ATXN1; (-) strand; PAM type: YTN; PAM sequence: TTT
ggtttatttcagtggtgtca

SEQ ID NO: 191541 - DNA, 20 bp, Artificial Sequence
  Description of Artificial Sequence: Synthetic oligonucleotide
  Target: ATXN1; (-) strand; PAM type: YTN; PAM sequence: CTT
tggtttatttcagtggtgtc

SEQ ID NO: 191542 - DNA, 20 bp, Artificial Sequence
  Description of Artificial Sequence: Synthetic oligonucleotide
  Target: ATXN1; (-) strand; PAM type: YTN; PAM sequence: CTA
catcctttggtttatttcag

SEQ ID NO: 191543 - DNA, 20 bp, Artificial Sequence
  Description of Artificial Sequence: Synthetic oligonucleotide
  Target: ATXN1; (-) strand; PAM type: YTN; PAM sequence: CTG
tacatacatccctacatcct

SEQ ID NO: 191544 - DNA, 20 bp, Artificial Sequence
  Description of Artificial Sequence: Synthetic oligonucleotide
  Target: ATXN1; (-) strand; PAM type: YTN; PAM sequence: TTC
atccatccagctgtacatac

SEQ ID NO: 191545 - DNA, 20 bp, Artificial Sequence
  Description of Artificial Sequence: Synthetic oligonucleotide
  Target: ATXN1; (-) strand; PAM type: YTN; PAM sequence: CTG
tccattcatccatccagctg

SEQ ID NO: 191546 - DNA, 20 bp, Artificial Sequence
  Description of Artificial Sequence: Synthetic oligonucleotide
  Target: ATXN1; (-) strand; PAM type: YTN; PAM sequence: CTG
tccatccatccatctgtcca

SEQ ID NO: 191547 - DNA, 20 bp, Artificial Sequence
  Description of Artificial Sequence: Synthetic oligonucleotide
  Target: ATXN1; (-) strand; PAM type: YTN; PAM sequence: TTG
tctgtccatccatccatctg

SEQ ID NO: 191548 - DNA, 20 bp, Artificial Sequence
  Description of Artificial Sequence: Synthetic oligonucleotide
  Target: ATXN1; (-) strand; PAM type: YTN; PAM sequence: TTT
gtctgtccatccatccatct

SEQ ID NO: 191549 - DNA, 20 bp, Artificial Sequence
  Description of Artificial Sequence: Synthetic oligonucleotide
  Target: ATXN1; (-) strand; PAM type: YTN; PAM sequence: TTG
gtcaccggccatttgtctgt

SEQ ID NO: 191550 - DNA, 20 bp, Artificial Sequence
  Description of Artificial Sequence: Synthetic oligonucleotide
  Target: ATXN1; (-) strand; PAM type: YTN; PAM sequence: TTT
ggtcaccggccatttgtctg

SEQ ID NO: 191551 - DNA, 20 bp, Artificial Sequence
  Description of Artificial Sequence: Synthetic oligonucleotide
  Target: ATXN1; (-) strand; PAM type: YTN; PAM sequence: TTT
tggtcaccggccatttgtct

SEQ ID NO: 191552 - DNA, 20 bp, Artificial Sequence
  Description of Artificial Sequence: Synthetic oligonucleotide
  Target: ATXN1; (-) strand; PAM type: YTN; PAM sequence: TTA
atatataacacggaggagta

SEQ ID NO: 191553 - DNA, 20 bp, Artificial Sequence
  Description of Artificial Sequence: Synthetic oligonucleotide
  Target: ATXN1; (-) strand; PAM type: YTN; PAM sequence: CTT
aatatataacacggaggagt

SEQ ID NO: 191554 - DNA, 20 bp, Artificial Sequence
  Description of Artificial Sequence: Synthetic oligonucleotide
  Target: ATXN1; (-) strand; PAM type: YTN; PAM sequence: CTA
aaaaagcagccttaatatat

SEQ ID NO: 191555 - DNA, 20 bp, Artificial Sequence
  Description of Artificial Sequence: Synthetic oligonucleotide
  Target: ATXN1; (-) strand; PAM type: YTN; PAM sequence: TTC
taaaaaagcagccttaatat

SEQ ID NO: 191556 - DNA, 20 bp, Artificial Sequence
  Description of Artificial Sequence: Synthetic oligonucleotide
  Target: ATXN1; (-) strand; PAM type: YTN; PAM sequence: TTG
ggtaagaaggacagtgttct

SEQ ID NO: 191557 - DNA, 20 bp, Artificial Sequence
  Description of Artificial Sequence: Synthetic oligonucleotide
  Target: ATXN1; (-) strand; PAM type: YTN; PAM sequence: TTT
gggtaagaaggacagtgttc

SEQ ID NO: 191558 - DNA, 20 bp, Artificial Sequence
  Description of Artificial Sequence: Synthetic oligonucleotide
  Target: ATXN1; (-) strand; PAM type: YTN; PAM sequence: CTA
cagtgataatttgggtaaga

SEQ ID NO: 191559 - DNA, 20 bp, Artificial Sequence
  Description of Artificial Sequence: Synthetic oligonucleotide
  Target: ATXN1; (-) strand; PAM type: YTN; PAM sequence: TTC
tacagtgataatttgggtaa

SEQ ID NO: 191560 - DNA, 20 bp, Artificial Sequence
  Description of Artificial Sequence: Synthetic oligonucleotide
  Target: ATXN1; (-) strand; PAM type: YTN; PAM sequence: CTT
ctacagtgataatttgggta

SEQ ID NO: 191561 - DNA, 20 bp, Artificial Sequence
  Description of Artificial Sequence: Synthetic oligonucleotide
  Target: ATXN1; (-) strand; PAM type: YTN; PAM sequence: CTG
cttctacagtgataatttgg

SEQ ID NO: 191562 - DNA, 20 bp, Artificial Sequence
  Description of Artificial Sequence: Synthetic oligonucleotide
  Target: ATXN1; (-) strand; PAM type: YTN; PAM sequence: TTA
aagcatgatgatctgcttct

SEQ ID NO: 191563 - DNA, 20 bp, Artificial Sequence
  Description of Artificial Sequence: Synthetic oligonucleotide
  Target: ATXN1; (-) strand; PAM type: YTN; PAM sequence: CTT
aaagcatgatgatctgcttc

SEQ ID NO: 191564 - DNA, 20 bp, Artificial Sequence
  Description of Artificial Sequence: Synthetic oligonucleotide
  Target: ATXN1; (-) strand; PAM type: YTN; PAM sequence: CTA
aggcttaaagcatgatgatc

SEQ ID NO: 191565 - DNA, 20 bp, Artificial Sequence
  Description of Artificial Sequence: Synthetic oligonucleotide
  Target: ATXN1; (-) strand; PAM type: YTN; PAM sequence: TTC
taaggcttaaagcatgatga

SEQ ID NO: 191566 - DNA, 20 bp, Artificial Sequence
  Description of Artificial Sequence: Synthetic oligonucleotide
  Target: ATXN1; (-) strand; PAM type: YTN; PAM sequence: TTG
aaatccatcatattctaagg

SEQ ID NO: 191567 - DNA, 20 bp, Artificial Sequence
  Description of Artificial Sequence: Synthetic oligonucleotide
  Target: ATXN1; (-) strand; PAM type: YTN; PAM sequence: CTC
acagatatgatgcagtaatt

SEQ ID NO: 191568 - DNA, 20 bp, Artificial Sequence
  Description of Artificial Sequence: Synthetic oligonucleotide
  Target: ATXN1; (-) strand; PAM type: YTN; PAM sequence: CTA
accaaaaatctcacagatat

SEQ ID NO: 191569 - DNA, 20 bp, Artificial Sequence
  Description of Artificial Sequence: Synthetic oligonucleotide
  Target: ATXN1; (-) strand; PAM type: YTN; PAM sequence: TTC
ctaaccaaaaatctcacaga

SEQ ID NO: 191570 - DNA, 20 bp, Artificial Sequence
  Description of Artificial Sequence: Synthetic oligonucleotide
  Target: ATXN1; (-) strand; PAM type: YTN; PAM sequence: TTA
aaagttcctaaccaaaaatc

SEQ ID NO: 191571 - DNA, 20 bp, Artificial Sequence
  Description of Artificial Sequence: Synthetic oligonucleotide
  Target: ATXN1; (-) strand; PAM type: YTN; PAM sequence: TTC
atattaaaagttcctaacca

SEQ ID NO: 191572 - DNA, 20 bp, Artificial Sequence
  Description of Artificial Sequence: Synthetic oligonucleotide
  Target: ATXN1; (-) strand; PAM type: YTN; PAM sequence: TTG
gacaaattcatattaaaagt

SEQ ID NO: 191573 - DNA, 20 bp, Artificial Sequence
  Description of Artificial Sequence: Synthetic oligonucleotide
  Target: ATXN1; (-) strand; PAM type: YTN; PAM sequence: CTG
aaaaaattggacaaattcat

SEQ ID NO: 191574 - DNA, 20 bp, Artificial Sequence
  Description of Artificial Sequence: Synthetic oligonucleotide
  Target: ATXN1; (-) strand; PAM type: YTN; PAM sequence: TTA
ctgaaaaaattggacaaatt

SEQ ID NO: 191575 - DNA, 20 bp, Artificial Sequence
  Description of Artificial Sequence: Synthetic oligonucleotide
  Target: ATXN1; (-) strand; PAM type: YTN; PAM sequence: TTG
cattactgaaaaaattggac

SEQ ID NO: 191576 - DNA, 20 bp, Artificial Sequence
  Description of Artificial Sequence: Synthetic oligonucleotide
  Target: ATXN1; (-) strand; PAM type: YTN; PAM sequence: TTT
gcattactgaaaaaattgga

SEQ ID NO: 191577 - DNA, 20 bp, Artificial Sequence
  Description of Artificial Sequence: Synthetic oligonucleotide
  Target: ATXN1; (-) strand; PAM type: YTN; PAM sequence: TTT
tgcattactgaaaaaattgg

SEQ ID NO: 191578 - DNA, 20 bp, Artificial Sequence
  Description of Artificial Sequence: Synthetic oligonucleotide
  Target: ATXN1; (-) strand; PAM type: YTN; PAM sequence: TTA
aaccaaaaagttttgcatta

SEQ ID NO: 191579 - DNA, 20 bp, Artificial Sequence
  Description of Artificial Sequence: Synthetic oligonucleotide
  Target: ATXN1; (-) strand; PAM type: YTN; PAM sequence: CTG
acaagggtaggaataacaac

SEQ ID NO: 191580 - DNA, 20 bp, Artificial Sequence
  Description of Artificial Sequence: Synthetic oligonucleotide
  Target: ATXN1; (-) strand; PAM type: YTN; PAM sequence: TTG
gctgacaagggtaggaataa

SEQ ID NO: 191581 - DNA, 20 bp, Artificial Sequence
  Description of Artificial Sequence: Synthetic oligonucleotide
  Target: ATXN1; (-) strand; PAM type: YTN; PAM sequence: TTT
ggctgacaagggtaggaata

SEQ ID NO: 191582 - DNA, 20 bp, Artificial Sequence
  Description of Artificial Sequence: Synthetic oligonucleotide
  Target: ATXN1; (-) strand; PAM type: YTN; PAM sequence: TTA
tgagtttggctgacaagggt

SEQ ID NO: 191583 - DNA, 20 bp, Artificial Sequence
  Description of Artificial Sequence: Synthetic oligonucleotide
  Target: ATXN1; (-) strand; PAM type: YTN; PAM sequence: TTT
atgagtttggctgacaaggg

SEQ ID NO: 191584 - DNA, 20 bp, Artificial Sequence
  Description of Artificial Sequence: Synthetic oligonucleotide
  Target: ATXN1; (-) strand; PAM type: YTN; PAM sequence: TTT
tatgagtttggctgacaagg

SEQ ID NO: 191585 - DNA, 20 bp, Artificial Sequence
  Description of Artificial Sequence: Synthetic oligonucleotide
  Target: ATXN1; (-) strand; PAM type: YTN; PAM sequence: TTA
ttttatgagtttggctgaca

SEQ ID NO: 191586 - DNA, 20 bp, Artificial Sequence
  Description of Artificial Sequence: Synthetic oligonucleotide
  Target: ATXN1; (-) strand; PAM type: YTN; PAM sequence: TTT
attttatgagtttggctgac

SEQ ID NO: 191587 - DNA, 20 bp, Artificial Sequence
  Description of Artificial Sequence: Synthetic oligonucleotide
  Target: ATXN1; (-) strand; PAM type: YTN; PAM sequence: CTT
tattttatgagtttggctga

SEQ ID NO: 191588 - DNA, 20 bp, Artificial Sequence
  Description of Artificial Sequence: Synthetic oligonucleotide
  Target: ATXN1; (-) strand; PAM type: YTN; PAM sequence: TTA
gaaaatctttattttatgag

SEQ ID NO: 191589 - DNA, 20 bp, Artificial Sequence
  Description of Artificial Sequence: Synthetic oligonucleotide
  Target: ATXN1; (-) strand; PAM type: YTN; PAM sequence: CTA
aataccatatattagaaaat

SEQ ID NO: 191590 - DNA, 20 bp, Artificial Sequence
  Description of Artificial Sequence: Synthetic oligonucleotide
  Target: ATXN1; (-) strand; PAM type: YTN; PAM sequence: TTC
taaataccatatattagaaa

SEQ ID NO: 191591 - DNA, 20 bp, Artificial Sequence
  Description of Artificial Sequence: Synthetic oligonucleotide
  Target: ATXN1; (-) strand; PAM type: YTN; PAM sequence: TTT
ctaaataccatatattagaa

SEQ ID NO: 191592 - DNA, 20 bp, Artificial Sequence
  Description of Artificial Sequence: Synthetic oligonucleotide
  Target: ATXN1; (-) strand; PAM type: YTN; PAM sequence: CTA
tagtgcagagaatttctaaa

SEQ ID NO: 191593 - DNA, 20 bp, Artificial Sequence
  Description of Artificial Sequence: Synthetic oligonucleotide
  Target: ATXN1; (-) strand; PAM type: YTN; PAM sequence: TTC
tatagtgcagagaatttcta

SEQ ID NO: 191594 - DNA, 20 bp, Artificial Sequence
  Description of Artificial Sequence: Synthetic oligonucleotide
  Target: ATXN1; (-) strand; PAM type: YTN; PAM sequence: CTT
ctatagtgcagagaatttct

SEQ ID NO: 191595 - DNA, 20 bp, Artificial Sequence
  Description of Artificial Sequence: Synthetic oligonucleotide
  Target: ATXN1; (-) strand; PAM type: YTN; PAM sequence: TTC
aaacaccttctatagtgcag

SEQ ID NO: 191596 - DNA, 20 bp, Artificial Sequence
  Description of Artificial Sequence: Synthetic oligonucleotide
  Target: ATXN1; (-) strand; PAM type: YTN; PAM sequence: CTT
caaacaccttctatagtgca

SEQ ID NO: 191597 - DNA, 20 bp, Artificial Sequence
  Description of Artificial Sequence: Synthetic oligonucleotide
  Target: ATXN1; (-) strand; PAM type: YTN; PAM sequence: TTA
acttcaaacaccttctatag

SEQ ID NO: 191598 - DNA, 20 bp, Artificial Sequence
  Description of Artificial Sequence: Synthetic oligonucleotide
  Target: ATXN1; (-) strand; PAM type: YTN; PAM sequence: TTC
attaacttcaaacaccttct

SEQ ID NO: 191599 - DNA, 20 bp, Artificial Sequence
  Description of Artificial Sequence: Synthetic oligonucleotide
  Target: ATXN1; (-) strand; PAM type: YTN; PAM sequence: TTA
ttcattaacttcaaacacct

SEQ ID NO: 191600 - DNA, 20 bp, Artificial Sequence
  Description of Artificial Sequence: Synthetic oligonucleotide
  Target: ATXN1; (-) strand; PAM type: YTN; PAM sequence: TTT
attcattaacttcaaacacc

SEQ ID NO: 191601 - DNA, 20 bp, Artificial Sequence
  Description of Artificial Sequence: Synthetic oligonucleotide
  Target: ATXN1; (-) strand; PAM type: YTN; PAM sequence: TTA
tttattcattaacttcaaac

SEQ ID NO: 191602 - DNA, 20 bp, Artificial Sequence
  Description of Artificial Sequence: Synthetic oligonucleotide
  Target: ATXN1; (-) strand; PAM type: YTN; PAM sequence: TTT
atttattcattaacttcaaa

SEQ ID NO: 191603 - DNA, 20 bp, Artificial Sequence
  Description of Artificial Sequence: Synthetic oligonucleotide
  Target: ATXN1; (-) strand; PAM type: YTN; PAM sequence: TTA
tccatttatttattcattaa

SEQ ID NO: 191604 - DNA, 20 bp, Artificial Sequence
  Description of Artificial Sequence: Synthetic oligonucleotide
  Target: ATXN1; (-) strand; PAM type: YTN; PAM sequence: TTT
atccatttatttattcatta

SEQ ID NO: 191605 - DNA, 20 bp, Artificial Sequence
  Description of Artificial Sequence: Synthetic oligonucleotide
  Target: ATXN1; (-) strand; PAM type: YTN; PAM sequence: CTA
tttatccatttatttattca

SEQ ID NO: 191606 - DNA, 20 bp, Artificial Sequence
  Description of Artificial Sequence: Synthetic oligonucleotide
  Target: ATXN1; (-) strand; PAM type: YTN; PAM sequence: TTA
cccatctatttatccattta

SEQ ID NO: 191607 - DNA, 20 bp, Artificial Sequence
  Description of Artificial Sequence: Synthetic oligonucleotide
  Target: ATXN1; (-) strand; PAM type: YTN; PAM sequence: CTT
acccatctatttatccattt

SEQ ID NO: 191608 - DNA, 20 bp, Artificial Sequence
  Description of Artificial Sequence: Synthetic oligonucleotide
  Target: ATXN1; (-) strand; PAM type: YTN; PAM sequence: CTG
gatgatgccacttacccatc

SEQ ID NO: 191609 - DNA, 20 bp, Artificial Sequence
  Description of Artificial Sequence: Synthetic oligonucleotide
  Target: ATXN1; (-) strand; PAM type: YTN; PAM sequence: CTG
tggctggatgatgccactta

SEQ ID NO: 191610 - DNA, 20 bp, Artificial Sequence
  Description of Artificial Sequence: Synthetic oligonucleotide
  Target: ATXN1; (-) strand; PAM type: YTN; PAM sequence: TTG
cagtgctgtggctggatgat

SEQ ID NO: 191611 - DNA, 20 bp, Artificial Sequence
  Description of Artificial Sequence: Synthetic oligonucleotide
  Target: ATXN1; (-) strand; PAM type: YTN; PAM sequence: TTC
ggacattgcagtgctgtggc

SEQ ID NO: 191612 - DNA, 20 bp, Artificial Sequence
  Description of Artificial Sequence: Synthetic oligonucleotide
  Target: ATXN1; (-) strand; PAM type: YTN; PAM sequence: CTT
cggacattgcagtgctgtgg

SEQ ID NO: 191613 - DNA, 20 bp, Artificial Sequence
  Description of Artificial Sequence: Synthetic oligonucleotide
  Target: ATXN1; (-) strand; PAM type: YTN; PAM sequence: TTC
cttcggacattgcagtgctg

SEQ ID NO: 191614 - DNA, 20 bp, Artificial Sequence
  Description of Artificial Sequence: Synthetic oligonucleotide
  Target: ATXN1; (-) strand; PAM type: YTN; PAM sequence: TTC
agagttccttcggacattgc

SEQ ID NO: 191615 - DNA, 20 bp, Artificial Sequence
  Description of Artificial Sequence: Synthetic oligonucleotide
  Target: ATXN1; (-) strand; PAM type: YTN; PAM sequence: TTT
cagagttccttcggacattg

SEQ ID NO: 191616 - DNA, 20 bp, Artificial Sequence
  Description of Artificial Sequence: Synthetic oligonucleotide
  Target: ATXN1; (-) strand; PAM type: YTN; PAM sequence: CTA
gaggcatgaggaacgtttca

SEQ ID NO: 191617 - DNA, 20 bp, Artificial Sequence
  Description of Artificial Sequence: Synthetic oligonucleotide
  Target: ATXN1; (-) strand; PAM type: YTN; PAM sequence: TTC
ctagaggcatgaggaacgtt

SEQ ID NO: 191618 - DNA, 20 bp, Artificial Sequence
  Description of Artificial Sequence: Synthetic oligonucleotide
  Target: ATXN1; (-) strand; PAM type: YTN; PAM sequence: TTT
cctagaggcatgaggaacgt

SEQ ID NO: 191619 - DNA, 20 bp, Artificial Sequence
  Description of Artificial Sequence: Synthetic oligonucleotide
  Target: ATXN1; (-) strand; PAM type: YTN; PAM sequence: CTT
tcctagaggcatgaggaacg

SEQ ID NO: 191620 - DNA, 20 bp, Artificial Sequence
  Description of Artificial Sequence: Synthetic oligonucleotide
  Target: ATXN1; (-) strand; PAM type: YTN; PAM sequence: TTC
aaaggtcagtctttcctaga

SEQ ID NO: 191621 - DNA, 20 bp, Artificial Sequence
  Description of Artificial Sequence: Synthetic oligonucleotide
  Target: ATXN1; (-) strand; PAM type: YTN; PAM sequence: CTG
gcgtattcaaaggtcagtct

SEQ ID NO: 191622 - DNA, 20 bp, Artificial Sequence
  Description of Artificial Sequence: Synthetic oligonucleotide
  Target: ATXN1; (-) strand; PAM type: YTN; PAM sequence: TTG
tctggcgtattcaaaggtca

SEQ ID NO: 191623 - DNA, 20 bp, Artificial Sequence
  Description of Artificial Sequence: Synthetic oligonucleotide
  Target: ATXN1; (-) strand; PAM type: YTN; PAM sequence: CTT
gtctggcgtattcaaaggtc

SEQ ID NO: 191624 - DNA, 20 bp, Artificial Sequence
  Description of Artificial Sequence: Synthetic oligonucleotide
  Target: ATXN1; (-) strand; PAM type: YTN; PAM sequence: CTA
agaaaaatacttgtctggcg

SEQ ID NO: 191625 - DNA, 20 bp, Artificial Sequence
  Description of Artificial Sequence: Synthetic oligonucleotide
  Target: ATXN1; (-) strand; PAM type: YTN; PAM sequence: TTG
ctaagaaaaatacttgtctg

SEQ ID NO: 191626 - DNA, 20 bp, Artificial Sequence
  Description of Artificial Sequence: Synthetic oligonucleotide
  Target: ATXN1; (-) strand; PAM type: YTN; PAM sequence: TTT
gctaagaaaaatacttgtct

SEQ ID NO: 191627 - DNA, 20 bp, Artificial Sequence
  Description of Artificial Sequence: Synthetic oligonucleotide
  Target: ATXN1; (-) strand; PAM type: YTN; PAM sequence: CTC
ataaatgtttgctaagaaaa

SEQ ID NO: 191628 - DNA, 20 bp, Artificial Sequence
  Description of Artificial Sequence: Synthetic oligonucleotide
  Target: ATXN1; (-) strand; PAM type: YTN; PAM sequence: TTG
ctcataaatgtttgctaaga

SEQ ID NO: 191629 - DNA, 20 bp, Artificial Sequence
  Description of Artificial Sequence: Synthetic oligonucleotide
  Target: ATXN1; (-) strand; PAM type: YTN; PAM sequence: TTG
agcccattgctcataaatgt

SEQ ID NO: 191630 - DNA, 20 bp, Artificial Sequence
  Description of Artificial Sequence: Synthetic oligonucleotide
  Target: ATXN1; (-) strand; PAM type: YTN; PAM sequence: CTA
atatagtgattgagcccatt

SEQ ID NO: 191631 - DNA, 20 bp, Artificial Sequence
  Description of Artificial Sequence: Synthetic oligonucleotide
  Target: ATXN1; (-) strand; PAM type: YTN; PAM sequence: TTA
aacactaatatagtgattga

SEQ ID NO: 191632 - DNA, 20 bp, Artificial Sequence
  Description of Artificial Sequence: Synthetic oligonucleotide
  Target: ATXN1; (-) strand; PAM type: YTN; PAM sequence: CTT
aaacactaatatagtgattg

SEQ ID NO: 191633 - DNA, 20 bp, Artificial Sequence
  Description of Artificial Sequence: Synthetic oligonucleotide
  Target: ATXN1; (-) strand; PAM type: YTN; PAM sequence: CTA
tacaggaaaagcccttaaac

SEQ ID NO: 191634 - DNA, 20 bp, Artificial Sequence
  Description of Artificial Sequence: Synthetic oligonucleotide
  Target: ATXN1; (-) strand; PAM type: YTN; PAM sequence: TTC
tatacaggaaaagcccttaa

SEQ ID NO: 191635 - DNA, 20 bp, Artificial Sequence
  Description of Artificial Sequence: Synthetic oligonucleotide
  Target: ATXN1; (-) strand; PAM type: YTN; PAM sequence: CTT
ctatacaggaaaagccctta

SEQ ID NO: 191636 - DNA, 20 bp, Artificial Sequence
  Description of Artificial Sequence: Synthetic oligonucleotide
  Target: ATXN1; (-) strand; PAM type: YTN; PAM sequence: TTC
agtcaaagaaagagcttcta

SEQ ID NO: 191637 - DNA, 20 bp, Artificial Sequence
  Description of Artificial Sequence: Synthetic oligonucleotide
  Target: ATXN1; (-) strand; PAM type: YTN; PAM sequence: CTT
cagtcaaagaaagagcttct

SEQ ID NO: 191638 - DNA, 20 bp, Artificial Sequence
  Description of Artificial Sequence: Synthetic oligonucleotide
  Target: ATXN1; (-) strand; PAM type: YTN; PAM sequence: TTG
gagacttcagtcaaagaaag

SEQ ID NO: 191639 - DNA, 20 bp, Artificial Sequence
  Description of Artificial Sequence: Synthetic oligonucleotide
  Target: ATXN1; (-) strand; PAM type: YTN; PAM sequence: TTT
ggagacttcagtcaaagaaa

SEQ ID NO: 191640 - DNA, 20 bp, Artificial Sequence
  Description of Artificial Sequence: Synthetic oligonucleotide
  Target: ATXN1; (-) strand; PAM type: YTN; PAM sequence: CTT
tggagacttcagtcaaagaa

SEQ ID NO: 191641 - DNA, 20 bp, Artificial Sequence
  Description of Artificial Sequence: Synthetic oligonucleotide
  Target: ATXN1; (-) strand; PAM type: YTN; PAM sequence: TTG
gctttggagacttcagtcaa

SEQ ID NO: 191642 - DNA, 20 bp, Artificial Sequence
  Description of Artificial Sequence: Synthetic oligonucleotide
  Target: ATXN1; (-) strand; PAM type: YTN; PAM sequence: TTT
ggctttggagacttcagtca

SEQ ID NO: 191643 - DNA, 20 bp, Artificial Sequence
  Description of Artificial Sequence: Synthetic oligonucleotide
  Target: ATXN1; (-) strand; PAM type: YTN; PAM sequence: TTG
taaatttggctttggagact

SEQ ID NO: 191644 - DNA, 20 bp, Artificial Sequence
  Description of Artificial Sequence: Synthetic oligonucleotide
  Target: ATXN1; (-) strand; PAM type: YTN; PAM sequence: TTC
aggcatacataataattgta

SEQ ID NO: 191645 - DNA, 20 bp, Artificial Sequence
  Description of Artificial Sequence: Synthetic oligonucleotide
  Target: ATXN1; (-) strand; PAM type: YTN; PAM sequence: TTA
ttcaggcatacataataatt

SEQ ID NO: 191646 - DNA, 20 bp, Artificial Sequence
  Description of Artificial Sequence: Synthetic oligonucleotide
  Target: ATXN1; (-) strand; PAM type: YTN; PAM sequence: TTT
attcaggcatacataataat

SEQ ID NO: 191647 - DNA, 20 bp, Artificial Sequence
  Description of Artificial Sequence: Synthetic oligonucleotide
  Target: ATXN1; (-) strand; PAM type: YTN; PAM sequence: TTT
tattcaggcatacataataa

SEQ ID NO: 191648 - DNA, 20 bp, Artificial Sequence
  Description of Artificial Sequence: Synthetic oligonucleotide
  Target: ATXN1; (-) strand; PAM type: YTN; PAM sequence: CTT
ttattcaggcatacataata

SEQ ID NO: 191649 - DNA, 20 bp, Artificial Sequence
  Description of Artificial Sequence: Synthetic oligonucleotide
  Target: ATXN1; (-) strand; PAM type: YTN; PAM sequence: TTA
ccttttattcaggcatacat

SEQ ID NO: 191650 - DNA, 20 bp, Artificial Sequence
  Description of Artificial Sequence: Synthetic oligonucleotide
  Target: ATXN1; (-) strand; PAM type: YTN; PAM sequence: TTA
tattaccttttattcaggca

SEQ ID NO: 191651 - DNA, 20 bp, Artificial Sequence
  Description of Artificial Sequence: Synthetic oligonucleotide
  Target: ATXN1; (-) strand; PAM type: YTN; PAM sequence: TTA
tattatattaccttttattc

SEQ ID NO: 191652 - DNA, 20 bp, Artificial Sequence
  Description of Artificial Sequence: Synthetic oligonucleotide
  Target: ATXN1; (-) strand; PAM type: YTN; PAM sequence: CTT
atattatattaccttttatt

SEQ ID NO: 191653 - DNA, 20 bp, Artificial Sequence
  Description of Artificial Sequence: Synthetic oligonucleotide
  Target: ATXN1; (-) strand; PAM type: YTN; PAM sequence: TTA
ccttatattatattaccttt

SEQ ID NO: 191654 - DNA, 20 bp, Artificial Sequence
  Description of Artificial Sequence: Synthetic oligonucleotide
  Target: ATXN1; (-) strand; PAM type: YTN; PAM sequence: TTG
gagaaaaattaccttatatt

SEQ ID NO: 191655 - DNA, 20 bp, Artificial Sequence
  Description of Artificial Sequence: Synthetic oligonucleotide
  Target: ATXN1; (-) strand; PAM type: YTN; PAM sequence: TTT
ggagaaaaattaccttatat

SEQ ID NO: 191656 - DNA, 20 bp, Artificial Sequence
  Description of Artificial Sequence: Synthetic oligonucleotide
  Target: ATXN1; (-) strand; PAM type: YTN; PAM sequence: CTT
tggagaaaaattaccttata

SEQ ID NO: 191657 - DNA, 20 bp, Artificial Sequence
  Description of Artificial Sequence: Synthetic oligonucleotide
  Target: ATXN1; (-) strand; PAM type: YTN; PAM sequence: TTC
tttggagaaaaattacctta

SEQ ID NO: 191658 - DNA, 20 bp, Artificial Sequence
  Description of Artificial Sequence: Synthetic oligonucleotide
  Target: ATXN1; (-) strand; PAM type: YTN; PAM sequence: TTT
ctttggagaaaaattacctt

SEQ ID NO: 191659 - DNA, 20 bp, Artificial Sequence
  Description of Artificial Sequence: Synthetic oligonucleotide
  Target: ATXN1; (-) strand; PAM type: YTN; PAM sequence: CTT
tctttggagaaaaattacct

SEQ ID NO: 191660 - DNA, 20 bp, Artificial Sequence
  Description of Artificial Sequence: Synthetic oligonucleotide
  Target: ATXN1; (-) strand; PAM type: YTN; PAM sequence: CTG
agggctttctttggagaaaa

SEQ ID NO: 191661 - DNA, 20 bp, Artificial Sequence
  Description of Artificial Sequence: Synthetic oligonucleotide
  Target: ATXN1; (-) strand; PAM type: YTN; PAM sequence: TTC
tgagggctttctttggagaa

SEQ ID NO: 191662 - DNA, 20 bp, Artificial Sequence
  Description of Artificial Sequence: Synthetic oligonucleotide
  Target: ATXN1; (-) strand; PAM type: YTN; PAM sequence: TTT
ctgagggctttctttggaga

SEQ ID NO: 191663 - DNA, 20 bp, Artificial Sequence
  Description of Artificial Sequence: Synthetic oligonucleotide
  Target: ATXN1; (-) strand; PAM type: YTN; PAM sequence: TTT
tctgagggctttctttggag

SEQ ID NO: 191664 - DNA, 20 bp, Artificial Sequence
  Description of Artificial Sequence: Synthetic oligonucleotide
  Target: ATXN1; (-) strand; PAM type: YTN; PAM sequence: CTT
ttctgagggctttctttgga

SEQ ID NO: 191665 - DNA, 20 bp, Artificial Sequence
  Description of Artificial Sequence: Synthetic oligonucleotide
  Target: ATXN1; (-) strand; PAM type: YTN; PAM sequence: TTA
ggcttttctgagggctttct

SEQ ID NO: 191666 - DNA, 20 bp, Artificial Sequence
  Description of Artificial Sequence: Synthetic oligonucleotide
  Target: ATXN1; (-) strand; PAM type: YTN; PAM sequence: CTT
aggcttttctgagggctttc

SEQ ID NO: 191667 - DNA, 20 bp, Artificial Sequence
  Description of Artificial Sequence: Synthetic oligonucleotide
  Target: ATXN1; (-) strand; PAM type: YTN; PAM sequence: TTA
agggtacttaggcttttctg

SEQ ID NO: 191668 - DNA, 20 bp, Artificial Sequence
  Description of Artificial Sequence: Synthetic oligonucleotide
  Target: ATXN1; (-) strand; PAM type: YTN; PAM sequence: CTC
aaaaattaagggtacttagg

SEQ ID NO: 191669 - DNA, 20 bp, Artificial Sequence
  Description of Artificial Sequence: Synthetic oligonucleotide
  Target: ATXN1; (-) strand; PAM type: YTN; PAM sequence: TTG
taagaactcaaaaattaagg

SEQ ID NO: 191670 - DNA, 20 bp, Artificial Sequence
  Description of Artificial Sequence: Synthetic oligonucleotide
  Target: ATXN1; (-) strand; PAM type: YTN; PAM sequence: TTT
gtaagaactcaaaaattaag

SEQ ID NO: 191671 - DNA, 20 bp, Artificial Sequence
  Description of Artificial Sequence: Synthetic oligonucleotide
  Target: ATXN1; (-) strand; PAM type: YTN; PAM sequence: CTT
tgtaagaactcaaaaattaa

SEQ ID NO: 191672 - DNA, 20 bp, Artificial Sequence
  Description of Artificial Sequence: Synthetic oligonucleotide
  Target: ATXN1; (-) strand; PAM type: YTN; PAM sequence: TTA
agagaccaatagatacaata

SEQ ID NO: 191673 - DNA, 20 bp, Artificial Sequence
  Description of Artificial Sequence: Synthetic oligonucleotide
  Target: ATXN1; (-) strand; PAM type: YTN; PAM sequence: TTT
aagagaccaatagatacaat

SEQ ID NO: 191674 - DNA, 20 bp, Artificial Sequence
  Description of Artificial Sequence: Synthetic oligonucleotide
  Target: ATXN1; (-) strand; PAM type: YTN; PAM sequence: TTA
tttaagagaccaatagatac

SEQ ID NO: 191675 - DNA, 20 bp, Artificial Sequence
  Description of Artificial Sequence: Synthetic oligonucleotide
  Target: ATXN1; (-) strand; PAM type: YTN; PAM sequence: TTT
atttaagagaccaatagata

SEQ ID NO: 191676 - DNA, 20 bp, Artificial Sequence
  Description of Artificial Sequence: Synthetic oligonucleotide
  Target: ATXN1; (-) strand; PAM type: YTN; PAM sequence: CTT
tatttaagagaccaatagat

SEQ ID NO: 191677 - DNA, 20 bp, Artificial Sequence
  Description of Artificial Sequence: Synthetic oligonucleotide
  Target: ATXN1; (-) strand; PAM type: YTN; PAM sequence: CTA
ctttatttaagagaccaata

SEQ ID NO: 191678 - DNA, 20 bp, Artificial Sequence
  Description of Artificial Sequence: Synthetic oligonucleotide
  Target: ATXN1; (-) strand; PAM type: YTN; PAM sequence: TTC
cataaagactactttattta

SEQ ID NO: 191679 - DNA, 20 bp, Artificial Sequence
  Description of Artificial Sequence: Synthetic oligonucleotide
  Target: ATXN1; (-) strand; PAM type: YTN; PAM sequence: CTT
ccataaagactactttattt

SEQ ID NO: 191680 - DNA, 20 bp, Artificial Sequence
  Description of Artificial Sequence: Synthetic oligonucleotide
  Target: ATXN1; (-) strand; PAM type: YTN; PAM sequence: TTA
aggtaatatgtcttccataa

SEQ ID NO: 191681 - DNA, 20 bp, Artificial Sequence
  Description of Artificial Sequence: Synthetic oligonucleotide
  Target: ATXN1; (-) strand; PAM type: YTN; PAM sequence: TTT
aaggtaatatgtcttccata

SEQ ID NO: 191682 - DNA, 20 bp, Artificial Sequence
  Description of Artificial Sequence: Synthetic oligonucleotide
  Target: ATXN1; (-) strand; PAM type: YTN; PAM sequence: TTT
taaggtaatatgtcttccat

SEQ ID NO: 191683 - DNA, 20 bp, Artificial Sequence
  Description of Artificial Sequence: Synthetic oligonucleotide
  Target: ATXN1; (-) strand; PAM type: YTN; PAM sequence: TTA
tcaaggtagttttaaggtaa

SEQ ID NO: 191684 - DNA, 20 bp, Artificial Sequence
  Description of Artificial Sequence: Synthetic oligonucleotide
  Target: ATXN1; (-) strand; PAM type: YTN; PAM sequence: TTT
atcaaggtagttttaaggta

SEQ ID NO: 191685 - DNA, 20 bp, Artificial Sequence
  Description of Artificial Sequence: Synthetic oligonucleotide
  Target: ATXN1; (-) strand; PAM type: YTN; PAM sequence: CTA
gcatttatcaaggtagtttt

SEQ ID NO: 191686 - DNA, 20 bp, Artificial Sequence
  Description of Artificial Sequence: Synthetic oligonucleotide
  Target: ATXN1; (-) strand; PAM type: YTN; PAM sequence: TTA
tataaacatgccaaactagc

SEQ ID NO: 191687 - DNA, 20 bp, Artificial Sequence
  Description of Artificial Sequence: Synthetic oligonucleotide
  Target: ATXN1; (-) strand; PAM type: YTN; PAM sequence: CTG
ttatataaacatgccaaact

SEQ ID NO: 191688 - DNA, 20 bp, Artificial Sequence
  Description of Artificial Sequence: Synthetic oligonucleotide
  Target: ATXN1; (-) strand; PAM type: YTN; PAM sequence: TTA
ggtggctgttatataaacat

SEQ ID NO: 191689 - DNA, 20 bp, Artificial Sequence
  Description of Artificial Sequence: Synthetic oligonucleotide
  Target: ATXN1; (-) strand; PAM type: YTN; PAM sequence: CTG
ttaggtggctgttatataaa

SEQ ID NO: 191690 - DNA, 20 bp, Artificial Sequence
  Description of Artificial Sequence: Synthetic oligonucleotide
  Target: ATXN1; (-) strand; PAM type: YTN; PAM sequence: TTC
tgttaggtggctgttatata

SEQ ID NO: 191691 - DNA, 20 bp, Artificial Sequence
  Description of Artificial Sequence: Synthetic oligonucleotide
  Target: ATXN1; (-) strand; PAM type: YTN; PAM sequence: TTA
aaaaacaaaaggaaaaacag

SEQ ID NO: 191692 - DNA, 20 bp, Artificial Sequence
  Description of Artificial Sequence: Synthetic oligonucleotide
  Target: ATXN1; (-) strand; PAM type: YTN; PAM sequence: TTC
cattaaaaaacaaaaggaaa

SEQ ID NO: 191693 - DNA, 20 bp, Artificial Sequence
  Description of Artificial Sequence: Synthetic oligonucleotide
  Target: ATXN1; (-) strand; PAM type: YTN; PAM sequence: CTT
ccattaaaaaacaaaaggaa

SEQ ID NO: 191694 - DNA, 20 bp, Artificial Sequence
  Description of Artificial Sequence: Synthetic oligonucleotide
  Target: ATXN1; (-) strand; PAM type: YTN; PAM sequence: TTC
ttccattaaaaaacaaaagg

SEQ ID NO: 191695 - DNA, 20 bp, Artificial Sequence
  Description of Artificial Sequence: Synthetic oligonucleotide
  Target: ATXN1; (-) strand; PAM type: YTN; PAM sequence: TTT
cttccattaaaaaacaaaag

SEQ ID NO: 191696 - DNA, 20 bp, Artificial Sequence
  Description of Artificial Sequence: Synthetic oligonucleotide
  Target: ATXN1; (-) strand; PAM type: YTN; PAM sequence: TTT
tcttccattaaaaaacaaaa

SEQ ID NO: 191697 - DNA, 20 bp, Artificial Sequence
  Description of Artificial Sequence: Synthetic oligonucleotide
  Target: ATXN1; (-) strand; PAM type: YTN; PAM sequence: TTG
ttttcttccattaaaaaaca

SEQ ID NO: 191698 - DNA, 20 bp, Artificial Sequence
  Description of Artificial Sequence: Synthetic oligonucleotide
  Target: ATXN1; (-) strand; PAM type: YTN; PAM sequence: TTT
gttttcttccattaaaaaac

SEQ ID NO: 191699 - DNA, 20 bp, Artificial Sequence
  Description of Artificial Sequence: Synthetic oligonucleotide
  Target: ATXN1; (-) strand; PAM type: YTN; PAM sequence: CTA
gtcaaatttgttttcttcca

SEQ ID NO: 191700 - DNA, 20 bp, Artificial Sequence
  Description of Artificial Sequence: Synthetic oligonucleotide
  Target: ATXN1; (-) strand; PAM type: YTN; PAM sequence: TTA
ctagtcaaatttgttttctt

SEQ ID NO: 191701 - DNA, 20 bp, Artificial Sequence
  Description of Artificial Sequence: Synthetic oligonucleotide
  Target: ATXN1; (-) strand; PAM type: YTN; PAM sequence: TTC
caagaataattactagtcaa

SEQ ID NO: 191702 - DNA, 20 bp, Artificial Sequence
  Description of Artificial Sequence: Synthetic oligonucleotide
  Target: ATXN1; (-) strand; PAM type: YTN; PAM sequence: CTT
ccaagaataattactagtca

SEQ ID NO: 191703 - DNA, 20 bp, Artificial Sequence
  Description of Artificial Sequence: Synthetic oligonucleotide
  Target: ATXN1; (-) strand; PAM type: YTN; PAM sequence: CTA
ggaaagtcatacttccaaga

SEQ ID NO: 191704 - DNA, 20 bp, Artificial Sequence
  Description of Artificial Sequence: Synthetic oligonucleotide
  Target: ATXN1; (-) strand; PAM type: YTN; PAM sequence: TTG
caactaggaaagtcatactt

SEQ ID NO: 191705 - DNA, 20 bp, Artificial Sequence
  Description of Artificial Sequence: Synthetic oligonucleotide
  Target: ATXN1; (-) strand; PAM type: YTN; PAM sequence: CTT
gcaactaggaaagtcatact

SEQ ID NO: 191706 - DNA, 20 bp, Artificial Sequence
  Description of Artificial Sequence: Synthetic oligonucleotide
  Target: ATXN1; (-) strand; PAM type: YTN; PAM sequence: TTA
tagtgacatccagtgcttgc

SEQ ID NO: 191707 - DNA, 20 bp, Artificial Sequence
  Description of Artificial Sequence: Synthetic oligonucleotide
  Target: ATXN1; (-) strand; PAM type: YTN; PAM sequence: TTT
atagtgacatccagtgcttg

SEQ ID NO: 191708 - DNA, 20 bp, Artificial Sequence
  Description of Artificial Sequence: Synthetic oligonucleotide
  Target: ATXN1; (-) strand; PAM type: YTN; PAM sequence: TTA
tttatagtgacatccagtgc

SEQ ID NO: 191709 - DNA, 20 bp, Artificial Sequence
  Description of Artificial Sequence: Synthetic oligonucleotide
  Target: ATXN1; (-) strand; PAM type: YTN; PAM sequence: TTT
atttatagtgacatccagtg

SEQ ID NO: 191710 - DNA, 20 bp, Artificial Sequence
  Description of Artificial Sequence: Synthetic oligonucleotide
  Target: ATXN1; (-) strand; PAM type: YTN; PAM sequence: TTT
tatttatagtgacatccagt

SEQ ID NO: 191711 - DNA, 20 bp, Artificial Sequence
  Description of Artificial Sequence: Synthetic oligonucleotide
  Target: ATXN1; (-) strand; PAM type: YTN; PAM sequence: TTT
ttatttatagtgacatccag

SEQ ID NO: 191712 - DNA, 20 bp, Artificial Sequence
  Description of Artificial Sequence: Synthetic oligonucleotide
  Target: ATXN1; (-) strand; PAM type: YTN; PAM sequence: TTT
tttatttatagtgacatcca

SEQ ID NO: 191713 - DNA, 20 bp, Artificial Sequence
  Description of Artificial Sequence: Synthetic oligonucleotide
  Target: ATXN1; (-) strand; PAM type: YTN; PAM sequence: CTT
ttttatttatagtgacatcc

SEQ ID NO: 191714 - DNA, 20 bp, Artificial Sequence
  Description of Artificial Sequence: Synthetic oligonucleotide
  Target: ATXN1; (-) strand; PAM type: YTN; PAM sequence: TTA
aaatgcttttttatttatag

SEQ ID NO: 191715 - DNA, 20 bp, Artificial Sequence
  Description of Artificial Sequence: Synthetic oligonucleotide
  Target: ATXN1; (-) strand; PAM type: YTN; PAM sequence: TTT
aaaatgcttttttatttata

SEQ ID NO: 191716 - DNA, 20 bp, Artificial Sequence
  Description of Artificial Sequence: Synthetic oligonucleotide
  Target: ATXN1; (-) strand; PAM type: YTN; PAM sequence: CTT
taaaatgcttttttatttat

SEQ ID NO: 191717 - DNA, 20 bp, Artificial Sequence
  Description of Artificial Sequence: Synthetic oligonucleotide
  Target: ATXN1; (-) strand; PAM type: YTN; PAM sequence: TTA
aaagtaatctttaaaatgct

SEQ ID NO: 191718 - DNA, 20 bp, Artificial Sequence
  Description of Artificial Sequence: Synthetic oligonucleotide
  Target: ATXN1; (-) strand; PAM type: YTN; PAM sequence: TTT
aaaagtaatctttaaaatgc

SEQ ID NO: 191719 - DNA, 20 bp, Artificial Sequence
  Description of Artificial Sequence: Synthetic oligonucleotide
  Target: ATXN1; (-) strand; PAM type: YTN; PAM sequence: TTT
taaaagtaatctttaaaatg

SEQ ID NO: 191720 - DNA, 20 bp, Artificial Sequence
  Description of Artificial Sequence: Synthetic oligonucleotide
  Target: ATXN1; (-) strand; PAM type: YTN; PAM sequence: CTT
ttaaaagtaatctttaaaat

SEQ ID NO: 191721 - DNA, 20 bp, Artificial Sequence
  Description of Artificial Sequence: Synthetic oligonucleotide
  Target: ATXN1; (-) strand; PAM type: YTN; PAM sequence: TTG
cttttaaaagtaatctttaa

SEQ ID NO: 191722 - DNA, 20 bp, Artificial Sequence
  Description of Artificial Sequence: Synthetic oligonucleotide
  Target: ATXN1; (-) strand; PAM type: YTN; PAM sequence: CTG
tgttgcttttaaaagtaatc

SEQ ID NO: 191723 - DNA, 20 bp, Artificial Sequence
  Description of Artificial Sequence: Synthetic oligonucleotide
  Target: ATXN1; (-) strand; PAM type: YTN; PAM sequence: TTA
ctgtgttgcttttaaaagta

SEQ ID NO: 191724 - DNA, 20 bp, Artificial Sequence
  Description of Artificial Sequence: Synthetic oligonucleotide
  Target: ATXN1; (-) strand; PAM type: YTN; PAM sequence: CTT
actgtgttgcttttaaaagt

SEQ ID NO: 191725 - DNA, 20 bp, Artificial Sequence
  Description of Artificial Sequence: Synthetic oligonucleotide
  Target: ATXN1; (-) strand; PAM type: YTN; PAM sequence: TTA
accacttactgtgttgcttt

SEQ ID NO: 191726 - DNA, 20 bp, Artificial Sequence
  Description of Artificial Sequence: Synthetic oligonucleotide
  Target: ATXN1; (-) strand; PAM type: YTN; PAM sequence: CTT
aaccacttactgtgttgctt

SEQ ID NO: 191727 - DNA, 20 bp, Artificial Sequence
  Description of Artificial Sequence: Synthetic oligonucleotide
  Target: ATXN1; (-) strand; PAM type: YTN; PAM sequence: CTG
caacttaaccacttactgtg

SEQ ID NO: 191728 - DNA, 20 bp, Artificial Sequence
  Description of Artificial Sequence: Synthetic oligonucleotide
  Target: ATXN1; (-) strand; PAM type: YTN; PAM sequence: CTC
tgcaacttaaccacttactg

SEQ ID NO: 191729 - DNA, 20 bp, Artificial Sequence
  Description of Artificial Sequence: Synthetic oligonucleotide
  Target: ATXN1; (-) strand; PAM type: YTN; PAM sequence: TTG
atgaactctgcaacttaacc

SEQ ID NO: 191730 - DNA, 20 bp, Artificial Sequence
  Description of Artificial Sequence: Synthetic oligonucleotide
  Target: ATXN1; (-) strand; PAM type: YTN; PAM sequence: TTT
gatgaactctgcaacttaac

SEQ ID NO: 191731 - DNA, 20 bp, Artificial Sequence
  Description of Artificial Sequence: Synthetic oligonucleotide
  Target: ATXN1; (-) strand; PAM type: YTN; PAM sequence: TTT
tgatgaactctgcaacttaa

SEQ ID NO: 191732 - DNA, 20 bp, Artificial Sequence
  Description of Artificial Sequence: Synthetic oligonucleotide
  Target: ATXN1; (-) strand; PAM type: YTN; PAM sequence: CTG
tgagtgtattttgatgaact

SEQ ID NO: 191733 - DNA, 20 bp, Artificial Sequence
  Description of Artificial Sequence: Synthetic oligonucleotide
  Target: ATXN1; (-) strand; PAM type: YTN; PAM sequence: TTC
ctgtgagtgtattttgatga

SEQ ID NO: 191734 - DNA, 20 bp, Artificial Sequence
  Description of Artificial Sequence: Synthetic oligonucleotide
  Target: ATXN1; (-) strand; PAM type: YTN; PAM sequence: CTT
cctgtgagtgtattttgatg

SEQ ID NO: 191735 - DNA, 20 bp, Artificial Sequence
  Description of Artificial Sequence: Synthetic oligonucleotide
  Target: ATXN1; (-) strand; PAM type: YTN; PAM sequence: TTC
ttcctgtgagtgtattttga

SEQ ID NO: 191736 - DNA, 20 bp, Artificial Sequence
  Description of Artificial Sequence: Synthetic oligonucleotide
  Target: ATXN1; (-) strand; PAM type: YTN; PAM sequence: TTC
attcttcctgtgagtgtatt

SEQ ID NO: 191737 - DNA, 20 bp, Artificial Sequence
  Description of Artificial Sequence: Synthetic oligonucleotide
  Target: ATXN1; (-) strand; PAM type: YTN; PAM sequence: CTT
cattcttcctgtgagtgtat

SEQ ID NO: 191738 - DNA, 20 bp, Artificial Sequence
  Description of Artificial Sequence: Synthetic oligonucleotide
  Target: ATXN1; (-) strand; PAM type: YTN; PAM sequence: TTC
ttcattcttcctgtgagtgt

SEQ ID NO: 191739 - DNA, 20 bp, Artificial Sequence
  Description of Artificial Sequence: Synthetic oligonucleotide
  Target: ATXN1; (-) strand; PAM type: YTN; PAM sequence: TTT
cttcattcttcctgtgagtg

SEQ ID NO: 191740 - DNA, 20 bp, Artificial Sequence
  Description of Artificial Sequence: Synthetic oligonucleotide
  Target: ATXN1; (-) strand; PAM type: YTN; PAM sequence: TTT
tcttcattcttcctgtgagt

SEQ ID NO: 191741 - DNA, 20 bp, Artificial Sequence
  Description of Artificial Sequence: Synthetic oligonucleotide
  Target: ATXN1; (-) strand; PAM type: YTN; PAM sequence: TTT
ttcttcattcttcctgtgag

SEQ ID NO: 191742 - DNA, 20 bp, Artificial Sequence
  Description of Artificial Sequence: Synthetic oligonucleotide
  Target: ATXN1; (-) strand; PAM type: YTN; PAM sequence: TTA
agagatgtttttcttcattc

SEQ ID NO: 191743 - DNA, 20 bp, Artificial Sequence
  Description of Artificial Sequence: Synthetic oligonucleotide
  Target: ATXN1; (-) strand; PAM type: YTN; PAM sequence: TTA
ttaagagatgtttttcttca

SEQ ID NO: 191744 - DNA, 20 bp, Artificial Sequence
  Description of Artificial Sequence: Synthetic oligonucleotide
  Target: ATXN1; (-) strand; PAM type: YTN; PAM sequence: CTA
aaccatattattaagagatg

SEQ ID NO: 191745 - DNA, 20 bp, Artificial Sequence
  Description of Artificial Sequence: Synthetic oligonucleotide
  Target: ATXN1; (-) strand; PAM type: YTN; PAM sequence: TTG
tcacaatatcctaaaccata

SEQ ID NO: 191746 - DNA, 20 bp, Artificial Sequence
  Description of Artificial Sequence: Synthetic oligonucleotide
  Target: ATXN1; (-) strand; PAM type: YTN; PAM sequence: TTA
ttgtcacaatatcctaaacc

SEQ ID NO: 191747 - DNA, 20 bp, Artificial Sequence
  Description of Artificial Sequence: Synthetic oligonucleotide
  Target: ATXN1; (-) strand; PAM type: YTN; PAM sequence: TTG
gggaccattattgtcacaat

SEQ ID NO: 191748 - DNA, 20 bp, Artificial Sequence
  Description of Artificial Sequence: Synthetic oligonucleotide
  Target: ATXN1; (-) strand; PAM type: YTN; PAM sequence: CTA
cattggggaccattattgtc

SEQ ID NO: 191749 - DNA, 20 bp, Artificial Sequence
  Description of Artificial Sequence: Synthetic oligonucleotide
  Target: ATXN1; (-) strand; PAM type: YTN; PAM sequence: CTA
tagggaggcatcctacattg

SEQ ID NO: 191750 - DNA, 20 bp, Artificial Sequence
  Description of Artificial Sequence: Synthetic oligonucleotide
  Target: ATXN1; (-) strand; PAM type: YTN; PAM sequence: TTA
atgtgagcatggctataggg

SEQ ID NO: 191751 - DNA, 20 bp, Artificial Sequence
  Description of Artificial Sequence: Synthetic oligonucleotide
  Target: ATXN1; (-) strand; PAM type: YTN; PAM sequence: TTG
gccaaaaaaagacatatagc

SEQ ID NO: 191752 - DNA, 20 bp, Artificial Sequence
  Description of Artificial Sequence: Synthetic oligonucleotide
  Target: ATXN1; (-) strand; PAM type: YTN; PAM sequence: TTG
agaccccattggccaaaaaa

SEQ ID NO: 191753 - DNA, 20 bp, Artificial Sequence
  Description of Artificial Sequence: Synthetic oligonucleotide
  Target: ATXN1; (-) strand; PAM type: YTN; PAM sequence: TTG
ttgagaccccattggccaaa

SEQ ID NO: 191754 - DNA, 20 bp, Artificial Sequence
  Description of Artificial Sequence: Synthetic oligonucleotide
  Target: ATXN1; (-) strand; PAM type: YTN; PAM sequence: TTT
gttgagaccccattggccaa

SEQ ID NO: 191755 - DNA, 20 bp, Artificial Sequence
  Description of Artificial Sequence: Synthetic oligonucleotide
  Target: ATXN1; (-) strand; PAM type: YTN; PAM sequence: TTA
catttgttgagaccccattg

SEQ ID NO: 191756 - DNA, 20 bp, Artificial Sequence
  Description of Artificial Sequence: Synthetic oligonucleotide
  Target: ATXN1; (-) strand; PAM type: YTN; PAM sequence: TTG
gttacatttgttgagacccc

SEQ ID NO: 191757 - DNA, 20 bp, Artificial Sequence
  Description of Artificial Sequence: Synthetic oligonucleotide
  Target: ATXN1; (-) strand; PAM type: YTN; PAM sequence: TTC
gttggttacatttgttgaga

SEQ ID NO: 191758 - DNA, 20 bp, Artificial Sequence
  Description of Artificial Sequence: Synthetic oligonucleotide
  Target: ATXN1; (-) strand; PAM type: YTN; PAM sequence: CTA
tattcgttggttacatttgt

SEQ ID NO: 191759 - DNA, 20 bp, Artificial Sequence
  Description of Artificial Sequence: Synthetic oligonucleotide
  Target: ATXN1; (-) strand; PAM type: YTN; PAM sequence: TTC
ctatattcgttggttacatt

SEQ ID NO: 191760 - DNA, 20 bp, Artificial Sequence
  Description of Artificial Sequence: Synthetic oligonucleotide
  Target: ATXN1; (-) strand; PAM type: YTN; PAM sequence: CTA
agccgcaagtgcccattcct

SEQ ID NO: 191761 - DNA, 20 bp, Artificial Sequence
  Description of Artificial Sequence: Synthetic oligonucleotide
  Target: ATXN1; (-) strand; PAM type: YTN; PAM sequence: TTC
atcctaagccgcaagtgccc

SEQ ID NO: 191762 - DNA, 20 bp, Artificial Sequence
  Description of Artificial Sequence: Synthetic oligonucleotide
  Target: ATXN1; (-) strand; PAM type: YTN; PAM sequence: TTT
catcctaagccgcaagtgcc

SEQ ID NO: 191763 - DNA, 20 bp, Artificial Sequence
  Description of Artificial Sequence: Synthetic oligonucleotide
  Target: ATXN1; (-) strand; PAM type: YTN; PAM sequence: TTA
ccagaaatttcatcctaagc

SEQ ID NO: 191764 - DNA, 20 bp, Artificial Sequence
  Description of Artificial Sequence: Synthetic oligonucleotide
  Target: ATXN1; (-) strand; PAM type: YTN; PAM sequence: CTA
ttaccagaaatttcatccta

SEQ ID NO: 191765 - DNA, 20 bp, Artificial Sequence
  Description of Artificial Sequence: Synthetic oligonucleotide
  Target: ATXN1; (-) strand; PAM type: YTN; PAM sequence: TTG
atgctattaccagaaatttc

SEQ ID NO: 191766 - DNA, 20 bp, Artificial Sequence
  Description of Artificial Sequence: Synthetic oligonucleotide
  Target: ATXN1; (-) strand; PAM type: YTN; PAM sequence: TTT
gatgctattaccagaaattt

SEQ ID NO: 191767 - DNA, 20 bp, Artificial Sequence
  Description of Artificial Sequence: Synthetic oligonucleotide
  Target: ATXN1; (-) strand; PAM type: YTN; PAM sequence: CTG
tgtttgatgctattaccaga

SEQ ID NO: 191768 - DNA, 20 bp, Artificial Sequence
  Description of Artificial Sequence: Synthetic oligonucleotide
  Target: ATXN1; (-) strand; PAM type: YTN; PAM sequence: CTC
tgtgtttgatgctattacca

SEQ ID NO: 191769 - DNA, 20 bp, Artificial Sequence
  Description of Artificial Sequence: Synthetic oligonucleotide
  Target: ATXN1; (-) strand; PAM type: YTN; PAM sequence: CTA
ctctgtgtttgatgctatta

SEQ ID NO: 191770 - DNA, 20 bp, Artificial Sequence
  Description of Artificial Sequence: Synthetic oligonucleotide
  Target: ATXN1; (-) strand; PAM type: YTN; PAM sequence: TTC
atctactctgtgtttgatgc

SEQ ID NO: 191771 - DNA, 20 bp, Artificial Sequence
  Description of Artificial Sequence: Synthetic oligonucleotide
  Target: ATXN1; (-) strand; PAM type: YTN; PAM sequence: TTG
acgttcatctactctgtgtt

SEQ ID NO: 191772 - DNA, 20 bp, Artificial Sequence
  Description of Artificial Sequence: Synthetic oligonucleotide
  Target: ATXN1; (-) strand; PAM type: YTN; PAM sequence: CTT
gacgttcatctactctgtgt

SEQ ID NO: 191773 - DNA, 20 bp, Artificial Sequence
  Description of Artificial Sequence: Synthetic oligonucleotide
  Target: ATXN1; (-) strand; PAM type: YTN; PAM sequence: TTC
caaagcacatcatcttgacg

SEQ ID NO: 191774 - DNA, 20 bp, Artificial Sequence
  Description of Artificial Sequence: Synthetic oligonucleotide
  Target: ATXN1; (-) strand; PAM type: YTN; PAM sequence: TTT
ccaaagcacatcatcttgac

SEQ ID NO: 191775 - DNA, 20 bp, Artificial Sequence
  Description of Artificial Sequence: Synthetic oligonucleotide
  Target: ATXN1; (-) strand; PAM type: YTN; PAM sequence: TTT
tccaaagcacatcatcttga

SEQ ID NO: 191776 - DNA, 20 bp, Artificial Sequence
  Description of Artificial Sequence: Synthetic oligonucleotide
  Target: ATXN1; (-) strand; PAM type: YTN; PAM sequence: CTA
catggcaggtcatgtagtat

SEQ ID NO: 191777 - DNA, 20 bp, Artificial Sequence
  Description of Artificial Sequence: Synthetic oligonucleotide
  Target: ATXN1; (-) strand; PAM type: YTN; PAM sequence: TTG
aactacatggcaggtcatgt

SEQ ID NO: 191778 - DNA, 20 bp, Artificial Sequence
  Description of Artificial Sequence: Synthetic oligonucleotide
  Target: ATXN1; (-) strand; PAM type: YTN; PAM sequence: TTT
gaactacatggcaggtcatg

SEQ ID NO: 191779 - DNA, 20 bp, Artificial Sequence
  Description of Artificial Sequence: Synthetic oligonucleotide
  Target: ATXN1; (-) strand; PAM type: YTN; PAM sequence: TTT
tgaactacatggcaggtcat

SEQ ID NO: 191780 - DNA, 20 bp, Artificial Sequence
  Description of Artificial Sequence: Synthetic oligonucleotide
  Target: ATXN1; (-) strand; PAM type: YTN; PAM sequence: CTC
acgttttgaactacatggca

SEQ ID NO: 191781 - DNA, 20 bp, Artificial Sequence
  Description of Artificial Sequence: Synthetic oligonucleotide
  Target: ATXN1; (-) strand; PAM type: YTN; PAM sequence: TTC
ctcacgttttgaactacatg

SEQ ID NO: 191782 - DNA, 20 bp, Artificial Sequence
  Description of Artificial Sequence: Synthetic oligonucleotide
  Target: ATXN1; (-) strand; PAM type: YTN; PAM sequence: CTT
cctcacgttttgaactacat

SEQ ID NO: 191783 - DNA, 20 bp, Artificial Sequence
  Description of Artificial Sequence: Synthetic oligonucleotide
  Target: ATXN1; (-) strand; PAM type: YTN; PAM sequence: CTA
tatcagtatcttcctcacgt

SEQ ID NO: 191784 - DNA, 20 bp, Artificial Sequence
  Description of Artificial Sequence: Synthetic oligonucleotide
  Target: ATXN1; (-) strand; PAM type: YTN; PAM sequence: CTA
ctatatcagtatcttcctca

SEQ ID NO: 191785 - DNA, 20 bp, Artificial Sequence
  Description of Artificial Sequence: Synthetic oligonucleotide
  Target: ATXN1; (-) strand; PAM type: YTN; PAM sequence: TTA
tctactatatcagtatcttc

SEQ ID NO: 191786 - DNA, 20 bp, Artificial Sequence
  Description of Artificial Sequence: Synthetic oligonucleotide
  Target: ATXN1; (-) strand; PAM type: YTN; PAM sequence: TTT
atctactatatcagtatctt

SEQ ID NO: 191787 - DNA, 20 bp, Artificial Sequence
  Description of Artificial Sequence: Synthetic oligonucleotide
  Target: ATXN1; (-) strand; PAM type: YTN; PAM sequence: TTT
tatctactatatcagtatct

SEQ ID NO: 191788 - DNA, 20 bp, Artificial Sequence
  Description of Artificial Sequence: Synthetic oligonucleotide
  Target: ATXN1; (-) strand; PAM type: YTN; PAM sequence: CTT
ttatctactatatcagtatc

SEQ ID NO: 191789 - DNA, 20 bp, Artificial Sequence
  Description of Artificial Sequence: Synthetic oligonucleotide
  Target: ATXN1; (-) strand; PAM type: YTN; PAM sequence: TTA
caacttttatctactatatc

SEQ ID NO: 191790 - DNA, 20 bp, Artificial Sequence
  Description of Artificial Sequence: Synthetic oligonucleotide
  Target: ATXN1; (-) strand; PAM type: YTN; PAM sequence: CTT
acaacttttatctactatat

SEQ ID NO: 191791 - DNA, 20 bp, Artificial Sequence
  Description of Artificial Sequence: Synthetic oligonucleotide
  Target: ATXN1; (-) strand; PAM type: YTN; PAM sequence: TTA
cttacaacttttatctacta

SEQ ID NO: 191792 - DNA, 20 bp, Artificial Sequence
  Description of Artificial Sequence: Synthetic oligonucleotide
  Target: ATXN1; (-) strand; PAM type: YTN; PAM sequence: TTT
acttacaacttttatctact

SEQ ID NO: 191793 - DNA, 20 bp, Artificial Sequence
  Description of Artificial Sequence: Synthetic oligonucleotide
  Target: ATXN1; (-) strand; PAM type: YTN; PAM sequence: TTT
tacttacaacttttatctac

SEQ ID NO: 191794 - DNA, 20 bp, Artificial Sequence
  Description of Artificial Sequence: Synthetic oligonucleotide
  Target: ATXN1; (-) strand; PAM type: YTN; PAM sequence: TTA
tatgaaataattttacttac

SEQ ID NO: 191795 - DNA, 20 bp, Artificial Sequence
  Description of Artificial Sequence: Synthetic oligonucleotide
  Target: ATXN1; (-) strand; PAM type: YTN; PAM sequence: TTC
atattatatgaaataatttt

SEQ ID NO: 191796 - DNA, 20 bp, Artificial Sequence
  Description of Artificial Sequence: Synthetic oligonucleotide
  Target: ATXN1; (-) strand; PAM type: YTN; PAM sequence: TTT
catattatatgaaataattt

SEQ ID NO: 191797 - DNA, 20 bp, Artificial Sequence
  Description of Artificial Sequence: Synthetic oligonucleotide
  Target: ATXN1; (-) strand; PAM type: YTN; PAM sequence: CTT
tcatattatatgaaataatt

SEQ ID NO: 191798 - DNA, 20 bp, Artificial Sequence
  Description of Artificial Sequence: Synthetic oligonucleotide
  Target: ATXN1; (-) strand; PAM type: YTN; PAM sequence: TTC
cactttcatattatatgaaa

SEQ ID NO: 191799 - DNA, 20 bp, Artificial Sequence
  Description of Artificial Sequence: Synthetic oligonucleotide
  Target: ATXN1; (-) strand; PAM type: YTN; PAM sequence: CTT
ccactttcatattatatgaa

SEQ ID NO: 191800 - DNA, 20 bp, Artificial Sequence
  Description of Artificial Sequence: Synthetic oligonucleotide
  Target: ATXN1; (-) strand; PAM type: YTN; PAM sequence: TTC
ttccactttcatattatatg

SEQ ID NO: 191801 - DNA, 20 bp, Artificial Sequence
  Description of Artificial Sequence: Synthetic oligonucleotide
  Target: ATXN1; (-) strand; PAM type: YTN; PAM sequence: TTT
cttccactttcatattatat

SEQ ID NO: 191802 - DNA, 20 bp, Artificial Sequence
  Description of Artificial Sequence: Synthetic oligonucleotide
  Target: ATXN1; (-) strand; PAM type: YTN; PAM sequence: CTT
tcttccactttcatattata

SEQ ID NO: 191803 - DNA, 20 bp, Artificial Sequence
  Description of Artificial Sequence: Synthetic oligonucleotide
  Target: ATXN1; (-) strand; PAM type: YTN; PAM sequence: CTG
ctttcttccactttcatatt

SEQ ID NO: 191804 - DNA, 20 bp, Artificial Sequence
  Description of Artificial Sequence: Synthetic oligonucleotide
  Target: ATXN1; (-) strand; PAM type: YTN; PAM sequence: TTA
gacatactgctttcttccac

SEQ ID NO: 191805 - DNA, 20 bp, Artificial Sequence
  Description of Artificial Sequence: Synthetic oligonucleotide
  Target: ATXN1; (-) strand; PAM type: YTN; PAM sequence: TTT
agacatactgctttcttcca

SEQ ID NO: 191806 - DNA, 20 bp, Artificial Sequence
  Description of Artificial Sequence: Synthetic oligonucleotide
  Target: ATXN1; (-) strand; PAM type: YTN; PAM sequence: TTA
atttagacatactgctttct

SEQ ID NO: 191807 - DNA, 20 bp, Artificial Sequence
  Description of Artificial Sequence: Synthetic oligonucleotide
  Target: ATXN1; (-) strand; PAM type: YTN; PAM sequence: TTA
aataatatatacattaattt

SEQ ID NO: 191808 - DNA, 20 bp, Artificial Sequence
  Description of Artificial Sequence: Synthetic oligonucleotide
  Target: ATXN1; (-) strand; PAM type: YTN; PAM sequence: TTT
aaataatatatacattaatt

SEQ ID NO: 191809 - DNA, 20 bp, Artificial Sequence
  Description of Artificial Sequence: Synthetic oligonucleotide
  Target: ATXN1; (-) strand; PAM type: YTN; PAM sequence: TTT
taaataatatatacattaat

SEQ ID NO: 191810 - DNA, 20 bp, Artificial Sequence
  Description of Artificial Sequence: Synthetic oligonucleotide
  Target: ATXN1; (-) strand; PAM type: YTN; PAM sequence: CTC
aaagacattttaaataatat

SEQ ID NO: 191811 - DNA, 20 bp, Artificial Sequence
  Description of Artificial Sequence: Synthetic oligonucleotide
  Target: ATXN1; (-) strand; PAM type: YTN; PAM sequence: TTA
atctcaaagacattttaaat

SEQ ID NO: 191812 - DNA, 20 bp, Artificial Sequence
  Description of Artificial Sequence: Synthetic oligonucleotide
  Target: ATXN1; (-) strand; PAM type: YTN; PAM sequence: TTT
aatctcaaagacattttaaa

SEQ ID NO: 191813 - DNA, 20 bp, Artificial Sequence
  Description of Artificial Sequence: Synthetic oligonucleotide
  Target: ATXN1; (-) strand; PAM type: YTN; PAM sequence: TTA
tttaatctcaaagacatttt

SEQ ID NO: 191814 - DNA, 20 bp, Artificial Sequence
  Description of Artificial Sequence: Synthetic oligonucleotide
  Target: ATXN1; (-) strand; PAM type: YTN; PAM sequence: TTA
aattatttaatctcaaagac

SEQ ID NO: 191815 - DNA, 20 bp, Artificial Sequence
  Description of Artificial Sequence: Synthetic oligonucleotide
  Target: ATXN1; (-) strand; PAM type: YTN; PAM sequence: CTT
aaattatttaatctcaaaga

SEQ ID NO: 191816 - DNA, 20 bp, Artificial Sequence
  Description of Artificial Sequence: Synthetic oligonucleotide
  Target: ATXN1; (-) strand; PAM type: YTN; PAM sequence: TTG
tgcttaaattatttaatctc

SEQ ID NO: 191817 - DNA, 20 bp, Artificial Sequence
  Description of Artificial Sequence: Synthetic oligonucleotide
  Target: ATXN1; (-) strand; PAM type: YTN; PAM sequence: TTT
gtgcttaaattatttaatct

SEQ ID NO: 191818 - DNA, 20 bp, Artificial Sequence
  Description of Artificial Sequence: Synthetic oligonucleotide
  Target: ATXN1; (-) strand; PAM type: YTN; PAM sequence: TTA
aaccatcagatttgtgctta

SEQ ID NO: 191819 - DNA, 20 bp, Artificial Sequence
  Description of Artificial Sequence: Synthetic oligonucleotide
  Target: ATXN1; (-) strand; PAM type: YTN; PAM sequence: CTA
ttaaaccatcagatttgtgc

SEQ ID NO: 191820 - DNA, 20 bp, Artificial Sequence
  Description of Artificial Sequence: Synthetic oligonucleotide
  Target: ATXN1; (-) strand; PAM type: YTN; PAM sequence: TTC
tattaaaccatcagatttgt

SEQ ID NO: 191821 - DNA, 20 bp, Artificial Sequence
  Description of Artificial Sequence: Synthetic oligonucleotide
  Target: ATXN1; (-) strand; PAM type: YTN; PAM sequence: TTT
ctattaaaccatcagatttg

SEQ ID NO: 191822 - DNA, 20 bp, Artificial Sequence
  Description of Artificial Sequence: Synthetic oligonucleotide
  Target: ATXN1; (-) strand; PAM type: YTN; PAM sequence: TTA
gagatttctattaaaccatc

SEQ ID NO: 191823 - DNA, 20 bp, Artificial Sequence
  Description of Artificial Sequence: Synthetic oligonucleotide
  Target: ATXN1; (-) strand; PAM type: YTN; PAM sequence: TTT
agagatttctattaaaccat

SEQ ID NO: 191824 - DNA, 20 bp, Artificial Sequence
  Description of Artificial Sequence: Synthetic oligonucleotide
  Target: ATXN1; (-) strand; PAM type: YTN; PAM sequence: TTA
aggatttagagatttctatt

SEQ ID NO: 191825 - DNA, 20 bp, Artificial Sequence
  Description of Artificial Sequence: Synthetic oligonucleotide
  Target: ATXN1; (-) strand; PAM type: YTN; PAM sequence: TTT
aaggatttagagatttctat

SEQ ID NO: 191826 - DNA, 20 bp, Artificial Sequence
  Description of Artificial Sequence: Synthetic oligonucleotide
  Target: ATXN1; (-) strand; PAM type: YTN; PAM sequence: CTA
taagcatttaaggatttaga

SEQ ID NO: 191827 - DNA, 20 bp, Artificial Sequence
  Description of Artificial Sequence: Synthetic oligonucleotide
  Target: ATXN1; (-) strand; PAM type: YTN; PAM sequence: TTG
tctataagcatttaaggatt

SEQ ID NO: 191828 - DNA, 20 bp, Artificial Sequence
  Description of Artificial Sequence: Synthetic oligonucleotide
  Target: ATXN1; (-) strand; PAM type: YTN; PAM sequence: TTT
gtctataagcatttaaggat

SEQ ID NO: 191829 - DNA, 20 bp, Artificial Sequence
  Description of Artificial Sequence: Synthetic oligonucleotide
  Target: ATXN1; (-) strand; PAM type: YTN; PAM sequence: TTG
gccagtttgtctataagcat

SEQ ID NO: 191830 - DNA, 20 bp, Artificial Sequence
  Description of Artificial Sequence: Synthetic oligonucleotide
  Target: ATXN1; (-) strand; PAM type: YTN; PAM sequence: TTT
ggccagtttgtctataagca

SEQ ID NO: 191831 - DNA, 20 bp, Artificial Sequence
  Description of Artificial Sequence: Synthetic oligonucleotide
  Target: ATXN1; (-) strand; PAM type: YTN; PAM sequence: TTT
tggccagtttgtctataagc

SEQ ID NO: 191832 - DNA, 20 bp, Artificial Sequence
  Description of Artificial Sequence: Synthetic oligonucleotide
  Target: ATXN1; (-) strand; PAM type: YTN; PAM sequence: TTT
ttggccagtttgtctataag

SEQ ID NO: 191833 - DNA, 20 bp, Artificial Sequence
  Description of Artificial Sequence: Synthetic oligonucleotide
  Target: ATXN1; (-) strand; PAM type: YTN; PAM sequence: TTT
tttggccagtttgtctataa

SEQ ID NO: 191834 - DNA, 20 bp, Artificial Sequence
  Description of Artificial Sequence: Synthetic oligonucleotide
  Target: ATXN1; (-) strand; PAM type: YTN; PAM sequence: TTC
aatgaattttttggccagtt

SEQ ID NO: 191835 - DNA, 20 bp, Artificial Sequence
  Description of Artificial Sequence: Synthetic oligonucleotide
  Target: ATXN1; (-) strand; PAM type: YTN; PAM sequence: TTT
caatgaattttttggccagt

SEQ ID NO: 191836 - DNA, 20 bp, Artificial Sequence
  Description of Artificial Sequence: Synthetic oligonucleotide
  Target: ATXN1; (-) strand; PAM type: YTN; PAM sequence: CTT
tcaatgaattttttggccag

SEQ ID NO: 191837 - DNA, 20 bp, Artificial Sequence
  Description of Artificial Sequence: Synthetic oligonucleotide
  Target: ATXN1; (-) strand; PAM type: YTN; PAM sequence: TTA
tcctttcaatgaattttttg

SEQ ID NO: 191838 - DNA, 20 bp, Artificial Sequence
  Description of Artificial Sequence: Synthetic oligonucleotide
  Target: ATXN1; (-) strand; PAM type: YTN; PAM sequence: TTT
atcctttcaatgaatttttt

SEQ ID NO: 191839 - DNA, 20 bp, Artificial Sequence
  Description of Artificial Sequence: Synthetic oligonucleotide
  Target: ATXN1; (-) strand; PAM type: YTN; PAM sequence: CTT
tatcctttcaatgaattttt

SEQ ID NO: 191840 - DNA, 20 bp, Artificial Sequence
  Description of Artificial Sequence: Synthetic oligonucleotide
  Target: ATXN1; (-) strand; PAM type: YTN; PAM sequence: TTA
tgccatcctttatcctttca

SEQ ID NO: 191841 - DNA, 20 bp, Artificial Sequence
  Description of Artificial Sequence: Synthetic oligonucleotide
  Target: ATXN1; (-) strand; PAM type: YTN; PAM sequence: TTT
atgccatcctttatcctttc

SEQ ID NO: 191842 - DNA, 20 bp, Artificial Sequence
  Description of Artificial Sequence: Synthetic oligonucleotide
  Target: ATXN1; (-) strand; PAM type: YTN; PAM sequence: TTC
atatttatgccatcctttat

SEQ ID NO: 191843 - DNA, 20 bp, Artificial Sequence
  Description of Artificial Sequence: Synthetic oligonucleotide
  Target: ATXN1; (-) strand; PAM type: YTN; PAM sequence: TTA
taccatagaagttcatattt

SEQ ID NO: 191844 - DNA, 20 bp, Artificial Sequence
  Description of Artificial Sequence: Synthetic oligonucleotide
  Target: ATXN1; (-) strand; PAM type: YTN; PAM sequence: CTG
cattataccatagaagttca

SEQ ID NO: 191845 - DNA, 20 bp, Artificial Sequence
  Description of Artificial Sequence: Synthetic oligonucleotide
  Target: ATXN1; (-) strand; PAM type: YTN; PAM sequence: CTG
ggcctgcattataccataga

SEQ ID NO: 191846 - DNA, 20 bp, Artificial Sequence
  Description of Artificial Sequence: Synthetic oligonucleotide
  Target: ATXN1; (-) strand; PAM type: YTN; PAM sequence: CTC
aagaagtctgggcctgcatt

SEQ ID NO: 191847 - DNA, 20 bp, Artificial Sequence
  Description of Artificial Sequence: Synthetic oligonucleotide
  Target: ATXN1; (-) strand; PAM type: YTN; PAM sequence: CTG
cagctcaagaagtctgggcc

SEQ ID NO: 191848 - DNA, 20 bp, Artificial Sequence
  Description of Artificial Sequence: Synthetic oligonucleotide
  Target: ATXN1; (-) strand; PAM type: YTN; PAM sequence: TTC
aggcctgcagctcaagaagt

SEQ ID NO: 191849 - DNA, 20 bp, Artificial Sequence
  Description of Artificial Sequence: Synthetic oligonucleotide
  Target: ATXN1; (-) strand; PAM type: YTN; PAM sequence: CTT
caggcctgcagctcaagaag

SEQ ID NO: 191850 - DNA, 20 bp, Artificial Sequence
  Description of Artificial Sequence: Synthetic oligonucleotide
  Target: ATXN1; (-) strand; PAM type: YTN; PAM sequence: TTG
agtcttcaggcctgcagctc

SEQ ID NO: 191851 - DNA, 20 bp, Artificial Sequence
  Description of Artificial Sequence: Synthetic oligonucleotide
  Target: ATXN1; (-) strand; PAM type: YTN; PAM sequence: TTC
agatagacagttgagtcttc

SEQ ID NO: 191852 - DNA, 20 bp, Artificial Sequence
  Description of Artificial Sequence: Synthetic oligonucleotide
  Target: ATXN1; (-) strand; PAM type: YTN; PAM sequence: TTT
cagatagacagttgagtctt

SEQ ID NO: 191853 - DNA, 20 bp, Artificial Sequence
  Description of Artificial Sequence: Synthetic oligonucleotide
  Target: ATXN1; (-) strand; PAM type: YTN; PAM sequence: TTA
ggggatatttcagatagaca

SEQ ID NO: 191854 - DNA, 20 bp, Artificial Sequence
  Description of Artificial Sequence: Synthetic oligonucleotide
  Target: ATXN1; (-) strand; PAM type: YTN; PAM sequence: TTT
aggggatatttcagatagac

SEQ ID NO: 191855 - DNA, 20 bp, Artificial Sequence
  Description of Artificial Sequence: Synthetic oligonucleotide
  Target: ATXN1; (-) strand; PAM type: YTN; PAM sequence: TTT
taggggatatttcagataga

SEQ ID NO: 191856 - DNA, 20 bp, Artificial Sequence
  Description of Artificial Sequence: Synthetic oligonucleotide
  Target: ATXN1; (-) strand; PAM type: YTN; PAM sequence: TTT
ttaggggatatttcagatag

SEQ ID NO: 191857 - DNA, 20 bp, Artificial Sequence
  Description of Artificial Sequence: Synthetic oligonucleotide
  Target: ATXN1; (-) strand; PAM type: YTN; PAM sequence: TTT
tttaggggatatttcagata

SEQ ID NO: 191858 - DNA, 20 bp, Artificial Sequence
  Description of Artificial Sequence: Synthetic oligonucleotide
  Target: ATXN1; (-) strand; PAM type: YTN; PAM sequence: TTT
ttttaggggatatttcagat

SEQ ID NO: 191859 - DNA, 20 bp, Artificial Sequence
  Description of Artificial Sequence: Synthetic oligonucleotide
  Target: ATXN1; (-) strand; PAM type: YTN; PAM sequence: CTT
tttttaggggatatttcaga

SEQ ID NO: 191860 - DNA, 20 bp, Artificial Sequence
  Description of Artificial Sequence: Synthetic oligonucleotide
  Target: ATXN1; (-) strand; PAM type: YTN; PAM sequence: TTG
agacctttttttaggggata

SEQ ID NO: 191861 - DNA, 20 bp, Artificial Sequence
  Description of Artificial Sequence: Synthetic oligonucleotide
  Target: ATXN1; (-) strand; PAM type: YTN; PAM sequence: TTT
gagacctttttttaggggat

SEQ ID NO: 191862 - DNA, 20 bp, Artificial Sequence
  Description of Artificial Sequence: Synthetic oligonucleotide
  Target: ATXN1; (-) strand; PAM type: YTN; PAM sequence: TTG
gaggtttgagaccttttttt

SEQ ID NO: 191863 - DNA, 20 bp, Artificial Sequence
  Description of Artificial Sequence: Synthetic oligonucleotide
  Target: ATXN1; (-) strand; PAM type: YTN; PAM sequence: CTA
ataggttggaggtttgagac

SEQ ID NO: 191864 - DNA, 20 bp, Artificial Sequence
  Description of Artificial Sequence: Synthetic oligonucleotide
  Target: ATXN1; (-) strand; PAM type: YTN; PAM sequence: TTG
atagtagccatcctaatagg

SEQ ID NO: 191865 - DNA, 20 bp, Artificial Sequence
  Description of Artificial Sequence: Synthetic oligonucleotide
  Target: ATXN1; (-) strand; PAM type: YTN; PAM sequence: TTT
gatagtagccatcctaatag

SEQ ID NO: 191866 - DNA, 20 bp, Artificial Sequence
  Description of Artificial Sequence: Synthetic oligonucleotide
  Target: ATXN1; (-) strand; PAM type: YTN; PAM sequence: TTA
aaaaaatgtatttgatagta

SEQ ID NO: 191867 - DNA, 20 bp, Artificial Sequence
  Description of Artificial Sequence: Synthetic oligonucleotide
  Target: ATXN1; (-) strand; PAM type: YTN; PAM sequence: CTG
gttaaaaaaatgtatttgat

SEQ ID NO: 191868 - DNA, 20 bp, Artificial Sequence
  Description of Artificial Sequence: Synthetic oligonucleotide
  Target: ATXN1; (-) strand; PAM type: YTN; PAM sequence: TTC
tggttaaaaaaatgtatttg

SEQ ID NO: 191869 - DNA, 20 bp, Artificial Sequence
  Description of Artificial Sequence: Synthetic oligonucleotide
  Target: ATXN1; (-) strand; PAM type: YTN; PAM sequence: TTT
ctggttaaaaaaatgtattt

SEQ ID NO: 191870 - DNA, 20 bp, Artificial Sequence
  Description of Artificial Sequence: Synthetic oligonucleotide
  Target: ATXN1; (-) strand; PAM type: YTN; PAM sequence: TTT
tctggttaaaaaaatgtatt

SEQ ID NO: 191871 - DNA, 20 bp, Artificial Sequence
  Description of Artificial Sequence: Synthetic oligonucleotide
  Target: ATXN1; (-) strand; PAM type: YTN; PAM sequence: TTA
ttttctggttaaaaaaatgt

SEQ ID NO: 191872 - DNA, 20 bp, Artificial Sequence
  Description of Artificial Sequence: Synthetic oligonucleotide
  Target: ATXN1; (-) strand; PAM type: YTN; PAM sequence: TTG
ttattttctggttaaaaaaa

SEQ ID NO: 191873 - DNA, 20 bp, Artificial Sequence
  Description of Artificial Sequence: Synthetic oligonucleotide
  Target: ATXN1; (-) strand; PAM type: YTN; PAM sequence: CTC
accaacagttgttattttct

SEQ ID NO: 191874 - DNA, 20 bp, Artificial Sequence
  Description of Artificial Sequence: Synthetic oligonucleotide
  Target: ATXN1; (-) strand; PAM type: YTN; PAM sequence: CTA
tgtcctcaccaacagttgtt

SEQ ID NO: 191875 - DNA, 20 bp, Artificial Sequence
  Description of Artificial Sequence: Synthetic oligonucleotide
  Target: ATXN1; (-) strand; PAM type: YTN; PAM sequence: CTC
tatgtcctcaccaacagttg

SEQ ID NO: 191876 - DNA, 20 bp, Artificial Sequence
  Description of Artificial Sequence: Synthetic oligonucleotide
  Target: ATXN1; (-) strand; PAM type: YTN; PAM sequence: TTC
tctatgtcctcaccaacagt

SEQ ID NO: 191877 - DNA, 20 bp, Artificial Sequence
  Description of Artificial Sequence: Synthetic oligonucleotide
  Target: ATXN1; (-) strand; PAM type: YTN; PAM sequence: TTT
ctctatgtcctcaccaacag

SEQ ID NO: 191878 - DNA, 20 bp, Artificial Sequence
  Description of Artificial Sequence: Synthetic oligonucleotide
  Target: ATXN1; (-) strand; PAM type: YTN; PAM sequence: TTC
cagtttctctatgtcctcac

SEQ ID NO: 191879 - DNA, 20 bp, Artificial Sequence
  Description of Artificial Sequence: Synthetic oligonucleotide
  Target: ATXN1; (-) strand; PAM type: YTN; PAM sequence: CTA
ccaacagtgcacaagggttc

SEQ ID NO: 191880 - DNA, 20 bp, Artificial Sequence
  Description of Artificial Sequence: Synthetic oligonucleotide
  Target: ATXN1; (-) strand; PAM type: YTN; PAM sequence: TTC
taccaacagtgcacaagggt

SEQ ID NO: 191881 - DNA, 20 bp, Artificial Sequence
  Description of Artificial Sequence: Synthetic oligonucleotide
  Target: ATXN1; (-) strand; PAM type: YTN; PAM sequence: TTT
ctaccaacagtgcacaaggg

SEQ ID NO: 191882 - DNA, 20 bp, Artificial Sequence
  Description of Artificial Sequence: Synthetic oligonucleotide
  Target: ATXN1; (-) strand; PAM type: YTN; PAM sequence: TTG
catttctaccaacagtgcac

SEQ ID NO: 191883 - DNA, 20 bp, Artificial Sequence
  Description of Artificial Sequence: Synthetic oligonucleotide
  Target: ATXN1; (-) strand; PAM type: YTN; PAM sequence: TTT
gcatttctaccaacagtgca

SEQ ID NO: 191884 - DNA, 20 bp, Artificial Sequence
  Description of Artificial Sequence: Synthetic oligonucleotide
  Target: ATXN1; (-) strand; PAM type: YTN; PAM sequence: CTT
tgcatttctaccaacagtgc

SEQ ID NO: 191885 - DNA, 20 bp, Artificial Sequence
  Description of Artificial Sequence: Synthetic oligonucleotide
  Target: ATXN1; (-) strand; PAM type: YTN; PAM sequence: CTG
caccactttgcatttctacc

SEQ ID NO: 191886 - DNA, 20 bp, Artificial Sequence
  Description of Artificial Sequence: Synthetic oligonucleotide
  Target: ATXN1; (-) strand; PAM type: YTN; PAM sequence: TTC
cacagtggctgcaccacttt

SEQ ID NO: 191887 - DNA, 20 bp, Artificial Sequence
  Description of Artificial Sequence: Synthetic oligonucleotide
  Target: ATXN1; (-) strand; PAM type: YTN; PAM sequence: TTT
ccacagtggctgcaccactt

SEQ ID NO: 191888 - DNA, 20 bp, Artificial Sequence
  Description of Artificial Sequence: Synthetic oligonucleotide
  Target: ATXN1; (-) strand; PAM type: YTN; PAM sequence: TTT
tccacagtggctgcaccact

SEQ ID NO: 191889 - DNA, 20 bp, Artificial Sequence
  Description of Artificial Sequence: Synthetic oligonucleotide
  Target: ATXN1; (-) strand; PAM type: YTN; PAM sequence: CTG
tatcgttttccacagtggct

SEQ ID NO: 191890 - DNA, 20 bp, Artificial Sequence
  Description of Artificial Sequence: Synthetic oligonucleotide
  Target: ATXN1; (-) strand; PAM type: YTN; PAM sequence: CTG
ctgtatcgttttccacagtg

SEQ ID NO: 191891 - DNA, 20 bp, Artificial Sequence
  Description of Artificial Sequence: Synthetic oligonucleotide
  Target: ATXN1; (-) strand; PAM type: YTN; PAM sequence: TTA
tgaactgctgtatcgttttc

SEQ ID NO: 191892 - DNA, 20 bp, Artificial Sequence
  Description of Artificial Sequence: Synthetic oligonucleotide
  Target: ATXN1; (-) strand; PAM type: YTN; PAM sequence: TTT
atgaactgctgtatcgtttt

SEQ ID NO: 191893 - DNA, 20 bp, Artificial Sequence
  Description of Artificial Sequence: Synthetic oligonucleotide
  Target: ATXN1; (-) strand; PAM type: YTN; PAM sequence: TTT
tatgaactgctgtatcgttt

SEQ ID NO: 191894 - DNA, 20 bp, Artificial Sequence
  Description of Artificial Sequence: Synthetic oligonucleotide
  Target: ATXN1; (-) strand; PAM type: YTN; PAM sequence: TTT
ttatgaactgctgtatcgtt

SEQ ID NO: 191895 - DNA, 20 bp, Artificial Sequence
  Description of Artificial Sequence: Synthetic oligonucleotide
  Target: ATXN1; (-) strand; PAM type: YTN; PAM sequence: TTT
tttatgaactgctgtatcgt

SEQ ID NO: 191896 - DNA, 20 bp, Artificial Sequence
  Description of Artificial Sequence: Synthetic oligonucleotide
  Target: ATXN1; (-) strand; PAM type: YTN; PAM sequence: TTA
aattttttatgaactgctgt

SEQ ID NO: 191897 - DNA, 20 bp, Artificial Sequence
  Description of Artificial Sequence: Synthetic oligonucleotide
  Target: ATXN1; (-) strand; PAM type: YTN; PAM sequence: TTT
aaattttttatgaactgctg

SEQ ID NO: 191898 - DNA, 20 bp, Artificial Sequence
  Description of Artificial Sequence: Synthetic oligonucleotide
  Target: ATXN1; (-) strand; PAM type: YTN; PAM sequence: TTT
taaattttttatgaactgct

SEQ ID NO: 191899 - DNA, 20 bp, Artificial Sequence
  Description of Artificial Sequence: Synthetic oligonucleotide
  Target: ATXN1; (-) strand; PAM type: YTN; PAM sequence: TTT
ttaaattttttatgaactgc

SEQ ID NO: 191900 - DNA, 20 bp, Artificial Sequence
  Description of Artificial Sequence: Synthetic oligonucleotide
  Target: ATXN1; (-) strand; PAM type: YTN; PAM sequence: CTA
tttttaaattttttatgaac

SEQ ID NO: 191901 - DNA, 20 bp, Artificial Sequence
  Description of Artificial Sequence: Synthetic oligonucleotide
  Target: ATXN1; (-) strand; PAM type: YTN; PAM sequence: TTC
tatttttaaattttttatga

SEQ ID NO: 191902 - DNA, 20 bp, Artificial Sequence
  Description of Artificial Sequence: Synthetic oligonucleotide
  Target: ATXN1; (-) strand; PAM type: YTN; PAM sequence: CTG
gatcacgtggcaattctatt

SEQ ID NO: 191903 - DNA, 20 bp, Artificial Sequence
  Description of Artificial Sequence: Synthetic oligonucleotide
  Target: ATXN1; (-) strand; PAM type: YTN; PAM sequence: TTG
ctggatcacgtggcaattct

SEQ ID NO: 191904 - DNA, 20 bp, Artificial Sequence
  Description of Artificial Sequence: Synthetic oligonucleotide
  Target: ATXN1; (-) strand; PAM type: YTN; PAM sequence: CTG
gaaatggaattgctggatca

SEQ ID NO: 191905 - DNA, 20 bp, Artificial Sequence
  Description of Artificial Sequence: Synthetic oligonucleotide
  Target: ATXN1; (-) strand; PAM type: YTN; PAM sequence: TTG
ggtatatacctggaaatgga

SEQ ID NO: 191906 - DNA, 20 bp, Artificial Sequence
  Description of Artificial Sequence: Synthetic oligonucleotide
  Target: ATXN1; (-) strand; PAM type: YTN; PAM sequence: TTT
gggtatatacctggaaatgg

SEQ ID NO: 191907 - DNA, 20 bp, Artificial Sequence
  Description of Artificial Sequence: Synthetic oligonucleotide
  Target: ATXN1; (-) strand; PAM type: YTN; PAM sequence: TTT
tgggtatatacctggaaatg

SEQ ID NO: 191908 - DNA, 20 bp, Artificial Sequence
  Description of Artificial Sequence: Synthetic oligonucleotide
  Target: ATXN1; (-) strand; PAM type: YTN; PAM sequence: CTT
ttgggtatatacctggaaat

SEQ ID NO: 191909 - DNA, 20 bp, Artificial Sequence
  Description of Artificial Sequence: Synthetic oligonucleotide
  Target: ATXN1; (-) strand; PAM type: YTN; PAM sequence: TTC
ttttgggtatatacctggaa

SEQ ID NO: 191910 - DNA, 20 bp, Artificial Sequence
  Description of Artificial Sequence: Synthetic oligonucleotide
  Target: ATXN1; (-) strand; PAM type: YTN; PAM sequence: TTC
agttcttttgggtatatacc

SEQ ID NO: 191911 - DNA, 20 bp, Artificial Sequence
  Description of Artificial Sequence: Synthetic oligonucleotide
  Target: ATXN1; (-) strand; PAM type: YTN; PAM sequence: TTT
cagttcttttgggtatatac

SEQ ID NO: 191912 - DNA, 20 bp, Artificial Sequence
  Description of Artificial Sequence: Synthetic oligonucleotide
  Target: ATXN1; (-) strand; PAM type: YTN; PAM sequence: CTT
tcagttcttttgggtatata

SEQ ID NO: 191913 - DNA, 20 bp, Artificial Sequence
  Description of Artificial Sequence: Synthetic oligonucleotide
  Target: ATXN1; (-) strand; PAM type: YTN; PAM sequence: CTC
ctttcagttcttttgggtat

SEQ ID NO: 191914 - DNA, 20 bp, Artificial Sequence
  Description of Artificial Sequence: Synthetic oligonucleotide
  Target: ATXN1; (-) strand; PAM type: YTN; PAM sequence: TTC
tcctttcagttcttttgggt

SEQ ID NO: 191915 - DNA, 20 bp, Artificial Sequence
  Description of Artificial Sequence: Synthetic oligonucleotide
  Target: ATXN1; (-) strand; PAM type: YTN; PAM sequence: TTG
aggttctcctttcagttctt

SEQ ID NO: 191916 - DNA, 20 bp, Artificial Sequence
  Description of Artificial Sequence: Synthetic oligonucleotide
  Target: ATXN1; (-) strand; PAM type: YTN; PAM sequence: TTT
gaggttctcctttcagttct

SEQ ID NO: 191917 - DNA, 20 bp, Artificial Sequence
  Description of Artificial Sequence: Synthetic oligonucleotide
  Target: ATXN1; (-) strand; PAM type: YTN; PAM sequence: CTA
tgaatgtgggtgtacaaatt

SEQ ID NO: 191918 - DNA, 20 bp, Artificial Sequence
  Description of Artificial Sequence: Synthetic oligonucleotide
  Target: ATXN1; (-) strand; PAM type: YTN; PAM sequence: CTG
ctatgaatgtgggtgtacaa

SEQ ID NO: 191919 - DNA, 20 bp, Artificial Sequence
  Description of Artificial Sequence: Synthetic oligonucleotide
  Target: ATXN1; (-) strand; PAM type: YTN; PAM sequence: CTG
tgaataatgctgctatgaat

SEQ ID NO: 191920 - DNA, 20 bp, Artificial Sequence
  Description of Artificial Sequence: Synthetic oligonucleotide
  Target: ATXN1; (-) strand; PAM type: YTN; PAM sequence: TTA
ctgtgaataatgctgctatg

SEQ ID NO: 191921 - DNA, 20 bp, Artificial Sequence
  Description of Artificial Sequence: Synthetic oligonucleotide
  Target: ATXN1; (-) strand; PAM type: YTN; PAM sequence: TTG
gttactgtgaataatgctgc

SEQ ID NO: 191922 - DNA, 20 bp, Artificial Sequence
  Description of Artificial Sequence: Synthetic oligonucleotide
  Target: ATXN1; (-) strand; PAM type: YTN; PAM sequence: TTT
ggttactgtgaataatgctg

SEQ ID NO: 191923 - DNA, 20 bp, Artificial Sequence
  Description of Artificial Sequence: Synthetic oligonucleotide
  Target: ATXN1; (-) strand; PAM type: YTN; PAM sequence: TTT
tggttactgtgaataatgct

SEQ ID NO: 191924 - DNA, 20 bp, Artificial Sequence
  Description of Artificial Sequence: Synthetic oligonucleotide
  Target: ATXN1; (-) strand; PAM type: YTN; PAM sequence: CTT
ttggttactgtgaataatgc

SEQ ID NO: 191925 - DNA, 20 bp, Artificial Sequence
  Description of Artificial Sequence: Synthetic oligonucleotide
  Target: ATXN1; (-) strand; PAM type: YTN; PAM sequence: TTC
caccttttggttactgtgaa

SEQ ID NO: 191926 - DNA, 20 bp, Artificial Sequence
  Description of Artificial Sequence: Synthetic oligonucleotide
  Target: ATXN1; (-) strand; PAM type: YTN; PAM sequence: TTT
ccaccttttggttactgtga

SEQ ID NO: 191927 - DNA, 20 bp, Artificial Sequence
  Description of Artificial Sequence: Synthetic oligonucleotide
  Target: ATXN1; (-) strand; PAM type: YTN; PAM sequence: TTG
tttccaccttttggttactg

SEQ ID NO: 191928 - DNA, 20 bp, Artificial Sequence
  Description of Artificial Sequence: Synthetic oligonucleotide
  Target: ATXN1; (-) strand; PAM type: YTN; PAM sequence: TTG
ggttgtttccaccttttggt

SEQ ID NO: 191929 - DNA, 20 bp, Artificial Sequence
  Description of Artificial Sequence: Synthetic oligonucleotide
  Target: ATXN1; (-) strand; PAM type: YTN; PAM sequence: CTT
gggttgtttccaccttttgg

SEQ ID NO: 191930 - DNA, 20 bp, Artificial Sequence
  Description of Artificial Sequence: Synthetic oligonucleotide
  Target: ATXN1; (-) strand; PAM type: YTN; PAM sequence: CTG
tccataaacacttgggttgt

SEQ ID NO: 191931 - DNA, 20 bp, Artificial Sequence
  Description of Artificial Sequence: Synthetic oligonucleotide
  Target: ATXN1; (-) strand; PAM type: YTN; PAM sequence: TTC
atctgtccataaacacttgg

SEQ ID NO: 191932 - DNA, 20 bp, Artificial Sequence
  Description of Artificial Sequence: Synthetic oligonucleotide
  Target: ATXN1; (-) strand; PAM type: YTN; PAM sequence: TTC
attcatctgtccataaacac

SEQ ID NO: 191933 - DNA, 20 bp, Artificial Sequence
  Description of Artificial Sequence: Synthetic oligonucleotide
  Target: ATXN1; (-) strand; PAM type: YTN; PAM sequence: TTA
ttcattcatctgtccataaa

SEQ ID NO: 191934 - DNA, 20 bp, Artificial Sequence
  Description of Artificial Sequence: Synthetic oligonucleotide
  Target: ATXN1; (-) strand; PAM type: YTN; PAM sequence: TTT
attcattcatctgtccataa

SEQ ID NO: 191935 - DNA, 20 bp, Artificial Sequence
  Description of Artificial Sequence: Synthetic oligonucleotide
  Target: ATXN1; (-) strand; PAM type: YTN; PAM sequence: TTG
tttattcattcatctgtcca

SEQ ID NO: 191936 - DNA, 20 bp, Artificial Sequence
  Description of Artificial Sequence: Synthetic oligonucleotide
  Target: ATXN1; (-) strand; PAM type: YTN; PAM sequence: TTT
gtttattcattcatctgtcc

SEQ ID NO: 191937 - DNA, 20 bp, Artificial Sequence
  Description of Artificial Sequence: Synthetic oligonucleotide
  Target: ATXN1; (-) strand; PAM type: YTN; PAM sequence: TTT
tgtttattcattcatctgtc

SEQ ID NO: 191938 - DNA, 20 bp, Artificial Sequence
  Description of Artificial Sequence: Synthetic oligonucleotide
  Target: ATXN1; (-) strand; PAM type: YTN; PAM sequence: TTG
tatatatcacattttgttta

SEQ ID NO: 191939 - DNA, 20 bp, Artificial Sequence
  Description of Artificial Sequence: Synthetic oligonucleotide
  Target: ATXN1; (-) strand; PAM type: YTN; PAM sequence: CTT
gtatatatcacattttgttt

SEQ ID NO: 191940 - DNA, 20 bp, Artificial Sequence
  Description of Artificial Sequence: Synthetic oligonucleotide
  Target: ATXN1; (-) strand; PAM type: YTN; PAM sequence: CTC
ttgtatatatcacattttgt

SEQ ID NO: 191941 - DNA, 20 bp, Artificial Sequence
  Description of Artificial Sequence: Synthetic oligonucleotide
  Target: ATXN1; (-) strand; PAM type: YTN; PAM sequence: TTC
cactcttgtatatatcacat

SEQ ID NO: 191942 - DNA, 20 bp, Artificial Sequence
  Description of Artificial Sequence: Synthetic oligonucleotide
  Target: ATXN1; (-) strand; PAM type: YTN; PAM sequence: CTG
atgaatattccactcttgta

SEQ ID NO: 191943 - DNA, 20 bp, Artificial Sequence
  Description of Artificial Sequence: Synthetic oligonucleotide
  Target: ATXN1; (-) strand; PAM type: YTN; PAM sequence: TTA
aggctgatgaatattccact

SEQ ID NO: 191944 - DNA, 20 bp, Artificial Sequence
  Description of Artificial Sequence: Synthetic oligonucleotide
  Target: ATXN1; (-) strand; PAM type: YTN; PAM sequence: TTT
aaggctgatgaatattccac

SEQ ID NO: 191945 - DNA, 20 bp, Artificial Sequence
  Description of Artificial Sequence: Synthetic oligonucleotide
  Target: ATXN1; (-) strand; PAM type: YTN; PAM sequence: TTT
taaggctgatgaatattcca

SEQ ID NO: 191946 - DNA, 20 bp, Artificial Sequence
  Description of Artificial Sequence: Synthetic oligonucleotide
  Target: ATXN1; (-) strand; PAM type: YTN; PAM sequence: TTT
ttaaggctgatgaatattcc

SEQ ID NO: 191947 - DNA, 20 bp, Artificial Sequence
  Description of Artificial Sequence: Synthetic oligonucleotide
  Target: ATXN1; (-) strand; PAM type: YTN; PAM sequence: TTT
tttaaggctgatgaatattc

SEQ ID NO: 191948 - DNA, 20 bp, Artificial Sequence
  Description of Artificial Sequence: Synthetic oligonucleotide
  Target: ATXN1; (-) strand; PAM type: YTN; PAM sequence: TTT
ttttaaggctgatgaatatt

SEQ ID NO: 191949 - DNA, 20 bp, Artificial Sequence
  Description of Artificial Sequence: Synthetic oligonucleotide
  Target: ATXN1; (-) strand; PAM type: YTN; PAM sequence: CTT
tttttaaggctgatgaatat

SEQ ID NO: 191950 - DNA, 20 bp, Artificial Sequence
  Description of Artificial Sequence: Synthetic oligonucleotide
  Target: ATXN1; (-) strand; PAM type: YTN; PAM sequence: TTC
tttttttaaggctgatgaat

SEQ ID NO: 191951 - DNA, 20 bp, Artificial Sequence
  Description of Artificial Sequence: Synthetic oligonucleotide
  Target: ATXN1; (-) strand; PAM type: YTN; PAM sequence: TTT
ctttttttaaggctgatgaa

SEQ ID NO: 191952 - DNA, 20 bp, Artificial Sequence
  Description of Artificial Sequence: Synthetic oligonucleotide
  Target: ATXN1; (-) strand; PAM type: YTN; PAM sequence: TTG
taacatgtgtcagaatttct

SEQ ID NO: 191953 - DNA, 20 bp, Artificial Sequence
  Description of Artificial Sequence: Synthetic oligonucleotide
  Target: ATXN1; (-) strand; PAM type: YTN; PAM sequence: CTC
aaggtcatccatgttgtaac

SEQ ID NO: 191954 - DNA, 20 bp, Artificial Sequence
  Description of Artificial Sequence: Synthetic oligonucleotide
  Target: ATXN1; (-) strand; PAM type: YTN; PAM sequence: TTA
gcataatgtcctcaaggtca

SEQ ID NO: 191955 - DNA, 20 bp, Artificial Sequence
  Description of Artificial Sequence: Synthetic oligonucleotide
  Target: ATXN1; (-) strand; PAM type: YTN; PAM sequence: TTT
agcataatgtcctcaaggtc

SEQ ID NO: 191956 - DNA, 20 bp, Artificial Sequence
  Description of Artificial Sequence: Synthetic oligonucleotide
  Target: ATXN1; (-) strand; PAM type: YTN; PAM sequence: TTG
tttagcataatgtcctcaag

SEQ ID NO: 191957 - DNA, 20 bp, Artificial Sequence
  Description of Artificial Sequence: Synthetic oligonucleotide
  Target: ATXN1; (-) strand; PAM type: YTN; PAM sequence: TTT
gtttagcataatgtcctcaa

SEQ ID NO: 191958 - DNA, 20 bp, Artificial Sequence
  Description of Artificial Sequence: Synthetic oligonucleotide
  Target: ATXN1; (-) strand; PAM type: YTN; PAM sequence: TTT
tgtttagcataatgtcctca

SEQ ID NO: 191959 - DNA, 20 bp, Artificial Sequence
  Description of Artificial Sequence: Synthetic oligonucleotide
  Target: ATXN1; (-) strand; PAM type: YTN; PAM sequence: TTT
ttgtttagcataatgtcctc

SEQ ID NO: 191960 - DNA, 20 bp, Artificial Sequence
  Description of Artificial Sequence: Synthetic oligonucleotide
  Target: ATXN1; (-) strand; PAM type: YTN; PAM sequence: CTT
tttgtttagcataatgtcct

SEQ ID NO: 191961 - DNA, 20 bp, Artificial Sequence
  Description of Artificial Sequence: Synthetic oligonucleotide
  Target: ATXN1; (-) strand; PAM type: YTN; PAM sequence: TTG
tgactttttgtttagcataa

SEQ ID NO: 191962 - DNA, 20 bp, Artificial Sequence
  Description of Artificial Sequence: Synthetic oligonucleotide
  Target: ATXN1; (-) strand; PAM type: YTN; PAM sequence: TTT
gtgactttttgtttagcata

SEQ ID NO: 191963 - DNA, 20 bp, Artificial Sequence
  Description of Artificial Sequence: Synthetic oligonucleotide
  Target: ATXN1; (-) strand; PAM type: YTN; PAM sequence: TTT
tgtgactttttgtttagcat

SEQ ID NO: 191964 - DNA, 20 bp, Artificial Sequence
  Description of Artificial Sequence: Synthetic oligonucleotide
  Target: ATXN1; (-) strand; PAM type: YTN; PAM sequence: CTT
ttgtgactttttgtttagca

SEQ ID NO: 191965 - DNA, 20 bp, Artificial Sequence
  Description of Artificial Sequence: Synthetic oligonucleotide
  Target: ATXN1; (-) strand; PAM type: YTN; PAM sequence: TTG
tccttttgtgactttttgtt

SEQ ID NO: 191966 - DNA, 20 bp, Artificial Sequence
  Description of Artificial Sequence: Synthetic oligonucleotide
  Target: ATXN1; (-) strand; PAM type: YTN; PAM sequence: TTT
gtccttttgtgactttttgt

SEQ ID NO: 191967 - DNA, 20 bp, Artificial Sequence
  Description of Artificial Sequence: Synthetic oligonucleotide
  Target: ATXN1; (-) strand; PAM type: YTN; PAM sequence: CTA
tgagtagaatcacacagggt

SEQ ID NO: 191968 - DNA, 20 bp, Artificial Sequence
  Description of Artificial Sequence: Synthetic oligonucleotide
  Target: ATXN1; (-) strand; PAM type: YTN; PAM sequence: CTC
ctatgagtagaatcacacag

SEQ ID NO: 191969 - DNA, 20 bp, Artificial Sequence
  Description of Artificial Sequence: Synthetic oligonucleotide
  Target: ATXN1; (-) strand; PAM type: YTN; PAM sequence: CTA
gggacctcctatgagtagaa

SEQ ID NO: 191970 - DNA, 20 bp, Artificial Sequence
  Description of Artificial Sequence: Synthetic oligonucleotide
  Target: ATXN1; (-) strand; PAM type: YTN; PAM sequence: CTC
tagggacctcctatgagtag

SEQ ID NO: 191971 - DNA, 20 bp, Artificial Sequence
  Description of Artificial Sequence: Synthetic oligonucleotide
  Target: ATXN1; (-) strand; PAM type: YTN; PAM sequence: CTG
ctctagggacctcctatgag

SEQ ID NO: 191972 - DNA, 20 bp, Artificial Sequence
  Description of Artificial Sequence: Synthetic oligonucleotide
  Target: ATXN1; (-) strand; PAM type: YTN; PAM sequence: TTG
actgctctagggacctccta

SEQ ID NO: 191973 - DNA, 20 bp, Artificial Sequence
  Description of Artificial Sequence: Synthetic oligonucleotide
  Target: ATXN1; (-) strand; PAM type: YTN; PAM sequence: TTT
gactgctctagggacctcct

SEQ ID NO: 191974 - DNA, 20 bp, Artificial Sequence
  Description of Artificial Sequence: Synthetic oligonucleotide
  Target: ATXN1; (-) strand; PAM type: YTN; PAM sequence: CTA
tgaatttgactgctctaggg

SEQ ID NO: 191975 - DNA, 20 bp, Artificial Sequence
  Description of Artificial Sequence: Synthetic oligonucleotide
  Target: ATXN1; (-) strand; PAM type: YTN; PAM sequence: CTC
tatgaatttgactgctctag

SEQ ID NO: 191976 - DNA, 20 bp, Artificial Sequence
  Description of Artificial Sequence: Synthetic oligonucleotide
  Target: ATXN1; (-) strand; PAM type: YTN; PAM sequence: CTG
cctctatgaatttgactgct

SEQ ID NO: 191977 - DNA, 20 bp, Artificial Sequence
  Description of Artificial Sequence: Synthetic oligonucleotide
  Target: ATXN1; (-) strand; PAM type: YTN; PAM sequence: TTC
tgcctctatgaatttgactg

SEQ ID NO: 191978 - DNA, 20 bp, Artificial Sequence
  Description of Artificial Sequence: Synthetic oligonucleotide
  Target: ATXN1; (-) strand; PAM type: YTN; PAM sequence: TTT
ctgcctctatgaatttgact

SEQ ID NO: 191979 - DNA, 20 bp, Artificial Sequence
  Description of Artificial Sequence: Synthetic oligonucleotide
  Target: ATXN1; (-) strand; PAM type: YTN; PAM sequence: CTT
tctgcctctatgaatttgac

SEQ ID NO: 191980 - DNA, 20 bp, Artificial Sequence
  Description of Artificial Sequence: Synthetic oligonucleotide
  Target: ATXN1; (-) strand; PAM type: YTN; PAM sequence: CTA
ctttctgcctctatgaattt

SEQ ID NO: 191981 - DNA, 20 bp, Artificial Sequence
  Description of Artificial Sequence: Synthetic oligonucleotide
  Target: ATXN1; (-) strand; PAM type: YTN; PAM sequence: TTC
tactttctgcctctatgaat

SEQ ID NO: 191982 - DNA, 20 bp, Artificial Sequence
  Description of Artificial Sequence: Synthetic oligonucleotide
  Target: ATXN1; (-) strand; PAM type: YTN; PAM sequence: CTG
gtaatcaccattctactttc

SEQ ID NO: 191983 - DNA, 20 bp, Artificial Sequence
  Description of Artificial Sequence: Synthetic oligonucleotide
  Target: ATXN1; (-) strand; PAM type: YTN; PAM sequence: CTC
ctggtaatcaccattctact

SEQ ID NO: 191984 - DNA, 20 bp, Artificial Sequence
  Description of Artificial Sequence: Synthetic oligonucleotide
  Target: ATXN1; (-) strand; PAM type: YTN; PAM sequence: CTC
cctcctggtaatcaccattc

SEQ ID NO: 191985 - DNA, 20 bp, Artificial Sequence
  Description of Artificial Sequence: Synthetic oligonucleotide
  Target: ATXN1; (-) strand; PAM type: YTN; PAM sequence: TTC
cccctccctcctggtaatca

SEQ ID NO: 191986 - DNA, 20 bp, Artificial Sequence
  Description of Artificial Sequence: Synthetic oligonucleotide
  Target: ATXN1; (-) strand; PAM type: YTN; PAM sequence: CTT
ccccctccctcctggtaatc

SEQ ID NO: 191987 - DNA, 20 bp, Artificial Sequence
  Description of Artificial Sequence: Synthetic oligonucleotide
  Target: ATXN1; (-) strand; PAM type: YTN; PAM sequence: TTC
ccccttccccctccctcctg

SEQ ID NO: 191988 - DNA, 20 bp, Artificial Sequence
  Description of Artificial Sequence: Synthetic oligonucleotide
  Target: ATXN1; (-) strand; PAM type: YTN; PAM sequence: CTT
cccccttccccctccctcct

SEQ ID NO: 191989 - DNA, 20 bp, Artificial Sequence
  Description of Artificial Sequence: Synthetic oligonucleotide
  Target: ATXN1; (-) strand; PAM type: YTN; PAM sequence: TTC
ccccttcccccttccccctc

SEQ ID NO: 191990 - DNA, 20 bp, Artificial Sequence
  Description of Artificial Sequence: Synthetic oligonucleotide
  Target: ATXN1; (-) strand; PAM type: YTN; PAM sequence: TTA
gacaataaattcccccttcc

SEQ ID NO: 191991 - DNA, 20 bp, Artificial Sequence
  Description of Artificial Sequence: Synthetic oligonucleotide
  Target: ATXN1; (-) strand; PAM type: YTN; PAM sequence: CTG
tacccattagacaataaatt

SEQ ID NO: 191992 - DNA, 20 bp, Artificial Sequence
  Description of Artificial Sequence: Synthetic oligonucleotide
  Target: ATXN1; (-) strand; PAM type: YTN; PAM sequence: CTC
tgtacccattagacaataaa

SEQ ID NO: 191993 - DNA, 20 bp, Artificial Sequence
  Description of Artificial Sequence: Synthetic oligonucleotide
  Target: ATXN1; (-) strand; PAM type: YTN; PAM sequence: TTG
caaaactctgtacccattag

SEQ ID NO: 191994 - DNA, 20 bp, Artificial Sequence
  Description of Artificial Sequence: Synthetic oligonucleotide
  Target: ATXN1; (-) strand; PAM type: YTN; PAM sequence: CTT
gcaaaactctgtacccatta

SEQ ID NO: 191995 - DNA, 20 bp, Artificial Sequence
  Description of Artificial Sequence: Synthetic oligonucleotide
  Target: ATXN1; (-) strand; PAM type: YTN; PAM sequence: TTG
tgtcttgcaaaactctgtac

SEQ ID NO: 191996 - DNA, 20 bp, Artificial Sequence
  Description of Artificial Sequence: Synthetic oligonucleotide
  Target: ATXN1; (-) strand; PAM type: YTN; PAM sequence: TTT
gtgtcttgcaaaactctgta

SEQ ID NO: 191997 - DNA, 20 bp, Artificial Sequence
  Description of Artificial Sequence: Synthetic oligonucleotide
  Target: ATXN1; (-) strand; PAM type: YTN; PAM sequence: CTG
tttgtgtcttgcaaaactct

SEQ ID NO: 191998 - DNA, 20 bp, Artificial Sequence
  Description of Artificial Sequence: Synthetic oligonucleotide
  Target: ATXN1; (-) strand; PAM type: YTN; PAM sequence: CTC
agctgtttgtgtcttgcaaa

SEQ ID NO: 191999 - DNA, 20 bp, Artificial Sequence
  Description of Artificial Sequence: Synthetic oligonucleotide
  Target: ATXN1; (-) strand; PAM type: YTN; PAM sequence: TTG
tgcatccagtctcagctgtt

SEQ ID NO: 192000 - DNA, 20 bp, Artificial Sequence
  Description of Artificial Sequence: Synthetic oligonucleotide
  Target: ATXN1; (-) strand; PAM type: YTN; PAM sequence: CTC
gttgtgcatccagtctcagc

SEQ ID NO: 192001 - DNA, 20 bp, Artificial Sequence
  Description of Artificial Sequence: Synthetic oligonucleotide
  Target: ATXN1; (-) strand; PAM type: YTN; PAM sequence: TTC
tcgttgtgcatccagtctca

SEQ ID NO: 192002 - DNA, 20 bp, Artificial Sequence
  Description of Artificial Sequence: Synthetic oligonucleotide
  Target: ATXN1; (-) strand; PAM type: YTN; PAM sequence: CTG
atagtatccagtatattctc

SEQ ID NO: 192003 - DNA, 20 bp, Artificial Sequence
  Description of Artificial Sequence: Synthetic oligonucleotide
  Target: ATXN1; (-) strand; PAM type: YTN; PAM sequence: TTC
aagatacagcctgatagtat

SEQ ID NO: 192004 - DNA, 20 bp, Artificial Sequence
  Description of Artificial Sequence: Synthetic oligonucleotide
  Target: ATXN1; (-) strand; PAM type: YTN; PAM sequence: CTG
ggttcaagatacagcctgat

SEQ ID NO: 192005 - DNA, 20 bp, Artificial Sequence
  Description of Artificial Sequence: Synthetic oligonucleotide
  Target: ATXN1; (-) strand; PAM type: YTN; PAM sequence: TTG
aatggtggcagtggcatcag

SEQ ID NO: 192006 - DNA, 20 bp, Artificial Sequence
  Description of Artificial Sequence: Synthetic oligonucleotide
  Target: ATXN1; (-) strand; PAM type: YTN; PAM sequence: CTT
gaatggtggcagtggcatca

SEQ ID NO: 192007 - DNA, 20 bp, Artificial Sequence
  Description of Artificial Sequence: Synthetic oligonucleotide
  Target: ATXN1; (-) strand; PAM type: YTN; PAM sequence: TTG
ggcttgaatggtggcagtgg

SEQ ID NO: 192008 - DNA, 20 bp, Artificial Sequence
  Description of Artificial Sequence: Synthetic oligonucleotide
  Target: ATXN1; (-) strand; PAM type: YTN; PAM sequence: CTT
gggcttgaatggtggcagtg

SEQ ID NO: 192009 - DNA, 20 bp, Artificial Sequence
  Description of Artificial Sequence: Synthetic oligonucleotide
  Target: ATXN1; (-) strand; PAM type: YTN; PAM sequence: TTG
acaggatagaaaatgacagt

SEQ ID NO: 192010 - DNA, 20 bp, Artificial Sequence
  Description of Artificial Sequence: Synthetic oligonucleotide
  Target: ATXN1; (-) strand; PAM type: YTN; PAM sequence: CTG
tagttgacaggatagaaaat

SEQ ID NO: 192011 - DNA, 20 bp, Artificial Sequence
  Description of Artificial Sequence: Synthetic oligonucleotide
  Target: ATXN1; (-) strand; PAM type: YTN; PAM sequence: TTA
aaaggatggcaagaaaaaca

SEQ ID NO: 192012 - DNA, 20 bp, Artificial Sequence
  Description of Artificial Sequence: Synthetic oligonucleotide
  Target: ATXN1; (-) strand; PAM type: YTN; PAM sequence: CTG
tgacattaaaaggatggcaa

SEQ ID NO: 192013 - DNA, 20 bp, Artificial Sequence
  Description of Artificial Sequence: Synthetic oligonucleotide
  Target: ATXN1; (-) strand; PAM type: YTN; PAM sequence: TTA
ctgtgacattaaaaggatgg

SEQ ID NO: 192014 - DNA, 20 bp, Artificial Sequence
  Description of Artificial Sequence: Synthetic oligonucleotide
  Target: ATXN1; (-) strand; PAM type: YTN; PAM sequence: TTT
actgtgacattaaaaggatg

SEQ ID NO: 192015 - DNA, 20 bp, Artificial Sequence
  Description of Artificial Sequence: Synthetic oligonucleotide
  Target: ATXN1; (-) strand; PAM type: YTN; PAM sequence: TTT
tactgtgacattaaaaggat

SEQ ID NO: 192016 - DNA, 20 bp, Artificial Sequence
  Description of Artificial Sequence: Synthetic oligonucleotide
  Target: ATXN1; (-) strand; PAM type: YTN; PAM sequence: TTT
ttactgtgacattaaaagga

SEQ ID NO: 192017 - DNA, 20 bp, Artificial Sequence
  Description of Artificial Sequence: Synthetic oligonucleotide
  Target: ATXN1; (-) strand; PAM type: YTN; PAM sequence: CTT
tttactgtgacattaaaagg

SEQ ID NO: 192018 - DNA, 20 bp, Artificial Sequence
  Description of Artificial Sequence: Synthetic oligonucleotide
  Target: ATXN1; (-) strand; PAM type: YTN; PAM sequence: TTC
atgacactttttactgtgac

SEQ ID NO: 192019 - DNA, 20 bp, Artificial Sequence
  Description of Artificial Sequence: Synthetic oligonucleotide
  Target: ATXN1; (-) strand; PAM type: YTN; PAM sequence: TTT
catgacactttttactgtga

SEQ ID NO: 192020 - DNA, 20 bp, Artificial Sequence
  Description of Artificial Sequence: Synthetic oligonucleotide
  Target: ATXN1; (-) strand; PAM type: YTN; PAM sequence: TTT
tcatgacactttttactgtg

SEQ ID NO: 192021 - DNA, 20 bp, Artificial Sequence
  Description of Artificial Sequence: Synthetic oligonucleotide
  Target: ATXN1; (-) strand; PAM type: YTN; PAM sequence: CTA
ttttcatgacactttttact

SEQ ID NO: 192022 - DNA, 20 bp, Artificial Sequence
  Description of Artificial Sequence: Synthetic oligonucleotide
  Target: ATXN1; (-) strand; PAM type: YTN; PAM sequence: TTG
ctattttcatgacacttttt

SEQ ID NO: 192023 - DNA, 20 bp, Artificial Sequence
  Description of Artificial Sequence: Synthetic oligonucleotide
  Target: ATXN1; (-) strand; PAM type: YTN; PAM sequence: TTT
gctattttcatgacactttt

SEQ ID NO: 192024 - DNA, 20 bp, Artificial Sequence
  Description of Artificial Sequence: Synthetic oligonucleotide
  Target: ATXN1; (-) strand; PAM type: YTN; PAM sequence: CTT
tgctattttcatgacacttt

SEQ ID NO: 192025 - DNA, 20 bp, Artificial Sequence
  Description of Artificial Sequence: Synthetic oligonucleotide
  Target: ATXN1; (-) strand; PAM type: YTN; PAM sequence: CTG
ctttgctattttcatgacac

SEQ ID NO: 192026 - DNA, 20 bp, Artificial Sequence
  Description of Artificial Sequence: Synthetic oligonucleotide
  Target: ATXN1; (-) strand; PAM type: YTN; PAM sequence: TTA
ccctgctttgctattttcat

SEQ ID NO: 192027 - DNA, 20 bp, Artificial Sequence
  Description of Artificial Sequence: Synthetic oligonucleotide
  Target: ATXN1; (-) strand; PAM type: YTN; PAM sequence: CTT
accctgctttgctattttca

SEQ ID NO: 192028 - DNA, 20 bp, Artificial Sequence
  Description of Artificial Sequence: Synthetic oligonucleotide
  Target: ATXN1; (-) strand; PAM type: YTN; PAM sequence: TTC
ttaccctgctttgctatttt

SEQ ID NO: 192029 - DNA, 20 bp, Artificial Sequence
  Description of Artificial Sequence: Synthetic oligonucleotide
  Target: ATXN1; (-) strand; PAM type: YTN; PAM sequence: CTT
cttaccctgctttgctattt

SEQ ID NO: 192030 - DNA, 20 bp, Artificial Sequence
  Description of Artificial Sequence: Synthetic oligonucleotide
  Target: ATXN1; (-) strand; PAM type: YTN; PAM sequence: CTA
acatagtatgccggtcttct

SEQ ID NO: 192031 - DNA, 20 bp, Artificial Sequence
  Description of Artificial Sequence: Synthetic oligonucleotide
  Target: ATXN1; (-) strand; PAM type: YTN; PAM sequence: CTA
tctaacatagtatgccggtc

SEQ ID NO: 192032 - DNA, 20 bp, Artificial Sequence
  Description of Artificial Sequence: Synthetic oligonucleotide
  Target: ATXN1; (-) strand; PAM type: YTN; PAM sequence: TTG
tccatcctatctaacatagt

SEQ ID NO: 192033 - DNA, 20 bp, Artificial Sequence
  Description of Artificial Sequence: Synthetic oligonucleotide
  Target: ATXN1; (-) strand; PAM type: YTN; PAM sequence: CTT
gtccatcctatctaacatag

SEQ ID NO: 192034 - DNA, 20 bp, Artificial Sequence
  Description of Artificial Sequence: Synthetic oligonucleotide
  Target: ATXN1; (-) strand; PAM type: YTN; PAM sequence: TTC
cttgtccatcctatctaaca

SEQ ID NO: 192035 - DNA, 20 bp, Artificial Sequence
  Description of Artificial Sequence: Synthetic oligonucleotide
  Target: ATXN1; (-) strand; PAM type: YTN; PAM sequence: CTT
ccttgtccatcctatctaac

SEQ ID NO: 192036 - DNA, 20 bp, Artificial Sequence
  Description of Artificial Sequence: Synthetic oligonucleotide
  Target: ATXN1; (-) strand; PAM type: YTN; PAM sequence: CTC
caagaggccttccttgtcca

SEQ ID NO: 192037 - DNA, 20 bp, Artificial Sequence
  Description of Artificial Sequence: Synthetic oligonucleotide
  Target: ATXN1; (-) strand; PAM type: YTN; PAM sequence: CTG
aatgagtgcacaaatgtcac

SEQ ID NO: 192038 - DNA, 20 bp, Artificial Sequence
  Description of Artificial Sequence: Synthetic oligonucleotide
  Target: ATXN1; (-) strand; PAM type: YTN; PAM sequence: TTG
aatggaaaaatgacctgaat

SEQ ID NO: 192039 - DNA, 20 bp, Artificial Sequence
  Description of Artificial Sequence: Synthetic oligonucleotide
  Target: ATXN1; (-) strand; PAM type: YTN; PAM sequence: TTT
gaatggaaaaatgacctgaa

SEQ ID NO: 192040 - DNA, 20 bp, Artificial Sequence
  Description of Artificial Sequence: Synthetic oligonucleotide
  Target: ATXN1; (-) strand; PAM type: YTN; PAM sequence: TTT
tgaatggaaaaatgacctga

SEQ ID NO: 192041 - DNA, 20 bp, Artificial Sequence
  Description of Artificial Sequence: Synthetic oligonucleotide
  Target: ATXN1; (-) strand; PAM type: YTN; PAM sequence: CTT
ttgaatggaaaaatgacctg

SEQ ID NO: 192042 - DNA, 20 bp, Artificial Sequence
  Description of Artificial Sequence: Synthetic oligonucleotide
  Target: ATXN1; (-) strand; PAM type: YTN; PAM sequence: CTA
tcgaatgcttttgaatggaa

SEQ ID NO: 192043 - DNA, 20 bp, Artificial Sequence
  Description of Artificial Sequence: Synthetic oligonucleotide
  Target: ATXN1; (-) strand; PAM type: YTN; PAM sequence: TTA
ccataaataggacagtcaga

SEQ ID NO: 192044 - DNA, 20 bp, Artificial Sequence
  Description of Artificial Sequence: Synthetic oligonucleotide
  Target: ATXN1; (-) strand; PAM type: YTN; PAM sequence: CTA
cagaattaccataaatagga

SEQ ID NO: 192045 - DNA, 20 bp, Artificial Sequence
  Description of Artificial Sequence: Synthetic oligonucleotide
  Target: ATXN1; (-) strand; PAM type: YTN; PAM sequence: CTG
aatggctacagaattaccat

SEQ ID NO: 192046 - DNA, 20 bp, Artificial Sequence
  Description of Artificial Sequence: Synthetic oligonucleotide
  Target: ATXN1; (-) strand; PAM type: YTN; PAM sequence: TTC
agtcctgaatggctacagaa

SEQ ID NO: 192047 - DNA, 20 bp, Artificial Sequence
  Description of Artificial Sequence: Synthetic oligonucleotide
  Target: ATXN1; (-) strand; PAM type: YTN; PAM sequence: TTT
cagtcctgaatggctacaga

SEQ ID NO: 192048 - DNA, 20 bp, Artificial Sequence
  Description of Artificial Sequence: Synthetic oligonucleotide
  Target: ATXN1; (-) strand; PAM type: YTN; PAM sequence: CTG
tcagagtttcagtcctgaat

SEQ ID NO: 192049 - DNA, 20 bp, Artificial Sequence
  Description of Artificial Sequence: Synthetic oligonucleotide
  Target: ATXN1; (-) strand; PAM type: YTN; PAM sequence: CTA
gatgcgatacagagagagaa

SEQ ID NO: 192050 - DNA, 20 bp, Artificial Sequence
  Description of Artificial Sequence: Synthetic oligonucleotide
  Target: ATXN1; (-) strand; PAM type: YTN; PAM sequence: TTA
gcaatggggaaaatagagac

SEQ ID NO: 192051 - DNA, 20 bp, Artificial Sequence
  Description of Artificial Sequence: Synthetic oligonucleotide
  Target: ATXN1; (-) strand; PAM type: YTN; PAM sequence: CTT
agcaatggggaaaatagaga

SEQ ID NO: 192052 - DNA, 20 bp, Artificial Sequence
  Description of Artificial Sequence: Synthetic oligonucleotide
  Target: ATXN1; (-) strand; PAM type: YTN; PAM sequence: CTC
ttagcaatggggaaaataga

SEQ ID NO: 192053 - DNA, 20 bp, Artificial Sequence
  Description of Artificial Sequence: Synthetic oligonucleotide
  Target: ATXN1; (-) strand; PAM type: YTN; PAM sequence: TTA
ctcttagcaatggggaaaat

SEQ ID NO: 192054 - DNA, 20 bp, Artificial Sequence
  Description of Artificial Sequence: Synthetic oligonucleotide
  Target: ATXN1; (-) strand; PAM type: YTN; PAM sequence: TTC
caagagaaggagtagtagat

SEQ ID NO: 192055 - DNA, 20 bp, Artificial Sequence
  Description of Artificial Sequence: Synthetic oligonucleotide
  Target: ATXN1; (-) strand; PAM type: YTN; PAM sequence: CTG
gcatgtatatgtaggataga

SEQ ID NO: 192056 - DNA, 20 bp, Artificial Sequence
  Description of Artificial Sequence: Synthetic oligonucleotide
  Target: ATXN1; (-) strand; PAM type: YTN; PAM sequence: TTC
atctggcatgtatatgtagg

SEQ ID NO: 192057 - DNA, 20 bp, Artificial Sequence
  Description of Artificial Sequence: Synthetic oligonucleotide
  Target: ATXN1; (-) strand; PAM type: YTN; PAM sequence: TTA
gaaagattcatctggcatgt

SEQ ID NO: 192058 - DNA, 20 bp, Artificial Sequence
  Description of Artificial Sequence: Synthetic oligonucleotide
  Target: ATXN1; (-) strand; PAM type: YTN; PAM sequence: TTT
agaaagattcatctggcatg

SEQ ID NO: 192059 - DNA, 20 bp, Artificial Sequence
  Description of Artificial Sequence: Synthetic oligonucleotide
  Target: ATXN1; (-) strand; PAM type: YTN; PAM sequence: CTG
cagtttagaaagattcatct

SEQ ID NO: 192060 - DNA, 20 bp, Artificial Sequence
  Description of Artificial Sequence: Synthetic oligonucleotide
  Target: ATXN1; (-) strand; PAM type: YTN; PAM sequence: TTG
aaactgcagtttagaaagat

SEQ ID NO: 192061 - DNA, 20 bp, Artificial Sequence
  Description of Artificial Sequence: Synthetic oligonucleotide
  Target: ATXN1; (-) strand; PAM type: YTN; PAM sequence: TTG
aaacgagaaagaagattgaa

SEQ ID NO: 192062 - DNA, 20 bp, Artificial Sequence
  Description of Artificial Sequence: Synthetic oligonucleotide
  Target: ATXN1; (-) strand; PAM type: YTN; PAM sequence: TTT
gaaacgagaaagaagattga

SEQ ID NO: 192063 - DNA, 20 bp, Artificial Sequence
  Description of Artificial Sequence: Synthetic oligonucleotide
  Target: ATXN1; (-) strand; PAM type: YTN; PAM sequence: TTT
tgaaacgagaaagaagattg

SEQ ID NO: 192064 - DNA, 20 bp, Artificial Sequence
  Description of Artificial Sequence: Synthetic oligonucleotide
  Target: ATXN1; (-) strand; PAM type: YTN; PAM sequence: TTC
aggaagcgaagaggaaccag

SEQ ID NO: 192065 - DNA, 20 bp, Artificial Sequence
  Description of Artificial Sequence: Synthetic oligonucleotide
  Target: ATXN1; (-) strand; PAM type: YTN; PAM sequence: TTA
attcaggaagcgaagaggaa

SEQ ID NO: 192066 - DNA, 20 bp, Artificial Sequence
  Description of Artificial Sequence: Synthetic oligonucleotide
  Target: ATXN1; (-) strand; PAM type: YTN; PAM sequence: CTT
aattcaggaagcgaagagga

SEQ ID NO: 192067 - DNA, 20 bp, Artificial Sequence
  Description of Artificial Sequence: Synthetic oligonucleotide
  Target: ATXN1; (-) strand; PAM type: YTN; PAM sequence: CTG
gacttaattcaggaagcgaa

SEQ ID NO: 192068 - DNA, 20 bp, Artificial Sequence
  Description of Artificial Sequence: Synthetic oligonucleotide
  Target: ATXN1; (-) strand; PAM type: YTN; PAM sequence: CTC
tggacttaattcaggaagcg

SEQ ID NO: 192069 - DNA, 20 bp, Artificial Sequence
  Description of Artificial Sequence: Synthetic oligonucleotide
  Target: ATXN1; (-) strand; PAM type: YTN; PAM sequence: CTG
ggatggaaactctggactta

SEQ ID NO: 192070 - DNA, 20 bp, Artificial Sequence
  Description of Artificial Sequence: Synthetic oligonucleotide
  Target: ATXN1; (-) strand; PAM type: YTN; PAM sequence: CTG
tcagacagtctgggatggaa

SEQ ID NO: 192071 - DNA, 20 bp, Artificial Sequence
  Description of Artificial Sequence: Synthetic oligonucleotide
  Target: ATXN1; (-) strand; PAM type: YTN; PAM sequence: TTG
tagactgtcagacagtctgg

SEQ ID NO: 192072 - DNA, 20 bp, Artificial Sequence
  Description of Artificial Sequence: Synthetic oligonucleotide
  Target: ATXN1; (-) strand; PAM type: YTN; PAM sequence: TTG
ggaaggtaagtggaagccat

SEQ ID NO: 192073 - DNA, 20 bp, Artificial Sequence
  Description of Artificial Sequence: Synthetic oligonucleotide
  Target: ATXN1; (-) strand; PAM type: YTN; PAM sequence: CTG
tgatggggaaaagtgggaga

SEQ ID NO: 192074 - DNA, 20 bp, Artificial Sequence
  Description of Artificial Sequence: Synthetic oligonucleotide
  Target: ATXN1; (-) strand; PAM type: YTN; PAM sequence: CTG
gaacaaggggccacccgtat

SEQ ID NO: 192075 - DNA, 20 bp, Artificial Sequence
  Description of Artificial Sequence: Synthetic oligonucleotide
  Target: ATXN1; (-) strand; PAM type: YTN; PAM sequence: TTC
tggaacaaggggccacccgt

SEQ ID NO: 192076 - DNA, 20 bp, Artificial Sequence
  Description of Artificial Sequence: Synthetic oligonucleotide
  Target: ATXN1; (-) strand; PAM type: YTN; PAM sequence: CTG
gaaagtgaagagtacgttct

SEQ ID NO: 192077 - DNA, 20 bp, Artificial Sequence
  Description of Artificial Sequence: Synthetic oligonucleotide
  Target: ATXN1; (-) strand; PAM type: YTN; PAM sequence: TTC
tggaaagtgaagagtacgtt

SEQ ID NO: 192078 - DNA, 20 bp, Artificial Sequence
  Description of Artificial Sequence: Synthetic oligonucleotide
  Target: ATXN1; (-) strand; PAM type: YTN; PAM sequence: TTG
agaccagagacgcagattct

SEQ ID NO: 192079 - DNA, 20 bp, Artificial Sequence
  Description of Artificial Sequence: Synthetic oligonucleotide
  Target: ATXN1; (-) strand; PAM type: YTN; PAM sequence: TTG
cggggaggcgtgcgagggcc

SEQ ID NO: 192080 - DNA, 20 bp, Artificial Sequence
  Description of Artificial Sequence: Synthetic oligonucleotide
  Target: ATXN1; (-) strand; PAM type: YTN; PAM sequence: TTG
caacagggattgcggggagg

SEQ ID NO: 192081 - DNA, 20 bp, Artificial Sequence
  Description of Artificial Sequence: Synthetic oligonucleotide
  Target: ATXN1; (-) strand; PAM type: YTN; PAM sequence: TTT
gcaacagggattgcggggag

SEQ ID NO: 192082 - DNA, 20 bp, Artificial Sequence
  Description of Artificial Sequence: Synthetic oligonucleotide
  Target: ATXN1; (-) strand; PAM type: YTN; PAM sequence: TTA
gtttgcaacagggattgcgg

SEQ ID NO: 192083 - DNA, 20 bp, Artificial Sequence
  Description of Artificial Sequence: Synthetic oligonucleotide
  Target: ATXN1; (-) strand; PAM type: YTN; PAM sequence: TTT
agtttgcaacagggattgcg

SEQ ID NO: 192084 - DNA, 20 bp, Artificial Sequence
  Description of Artificial Sequence: Synthetic oligonucleotide
  Target: ATXN1; (-) strand; PAM type: YTN; PAM sequence: TTT
tagtttgcaacagggattgc

SEQ ID NO: 192085 - DNA, 20 bp, Artificial Sequence
  Description of Artificial Sequence: Synthetic oligonucleotide
  Target: ATXN1; (-) strand; PAM type: YTN; PAM sequence: TTG
ggaatgggattttagtttgc

SEQ ID NO: 192086 - DNA, 20 bp, Artificial Sequence
  Description of Artificial Sequence: Synthetic oligonucleotide
  Target: ATXN1; (-) strand; PAM type: YTN; PAM sequence: TTT
gggaatgggattttagtttg

SEQ ID NO: 192087 - DNA, 20 bp, Artificial Sequence
  Description of Artificial Sequence: Synthetic oligonucleotide
  Target: ATXN1; (-) strand; PAM type: YTN; PAM sequence: TTC
cacagagaaggtgatttggg

SEQ ID NO: 192088 - DNA, 20 bp, Artificial Sequence
  Description of Artificial Sequence: Synthetic oligonucleotide
  Target: ATXN1; (-) strand; PAM type: YTN; PAM sequence: TTT
ccacagagaaggtgatttgg

SEQ ID NO: 192089 - DNA, 20 bp, Artificial Sequence
  Description of Artificial Sequence: Synthetic oligonucleotide
  Target: ATXN1; (-) strand; PAM type: YTN; PAM sequence: TTG
ggaagatcaggccaatttcc

SEQ ID NO: 192090 - DNA, 20 bp, Artificial Sequence
  Description of Artificial Sequence: Synthetic oligonucleotide
  Target: ATXN1; (-) strand; PAM type: YTN; PAM sequence: CTG
attgggaagatcaggccaat

SEQ ID NO: 192091 - DNA, 20 bp, Artificial Sequence
  Description of Artificial Sequence: Synthetic oligonucleotide
  Target: ATXN1; (-) strand; PAM type: YTN; PAM sequence: TTC
tgattgggaagatcaggcca

SEQ ID NO: 192092 - DNA, 20 bp, Artificial Sequence
  Description of Artificial Sequence: Synthetic oligonucleotide
  Target: ATXN1; (-) strand; PAM type: YTN; PAM sequence: CTT
ctgattgggaagatcaggcc

SEQ ID NO: 192093 - DNA, 20 bp, Artificial Sequence
  Description of Artificial Sequence: Synthetic oligonucleotide
  Target: ATXN1; (-) strand; PAM type: YTN; PAM sequence: TTA
aagatagaagtgatcacttc

SEQ ID NO: 192094 - DNA, 20 bp, Artificial Sequence
  Description of Artificial Sequence: Synthetic oligonucleotide
  Target: ATXN1; (-) strand; PAM type: YTN; PAM sequence: TTC
agagggttaaagatagaagt

SEQ ID NO: 192095 - DNA, 20 bp, Artificial Sequence
  Description of Artificial Sequence: Synthetic oligonucleotide
  Target: ATXN1; (-) strand; PAM type: YTN; PAM sequence: CTT
cagagggttaaagatagaag

SEQ ID NO: 192096 - DNA, 20 bp, Artificial Sequence
  Description of Artificial Sequence: Synthetic oligonucleotide
  Target: ATXN1; (-) strand; PAM type: YTN; PAM sequence: CTG
tatataaaagtaaaaacacg

SEQ ID NO: 192097 - DNA, 20 bp, Artificial Sequence
  Description of Artificial Sequence: Synthetic oligonucleotide
  Target: ATXN1; (-) strand; PAM type: YTN; PAM sequence: CTA
ggagaagtatacaaataagt

SEQ ID NO: 192098 - DNA, 20 bp, Artificial Sequence
  Description of Artificial Sequence: Synthetic oligonucleotide
  Target: ATXN1; (-) strand; PAM type: YTN; PAM sequence: CTG
aaaaggaactaggagaagta

SEQ ID NO: 192099 - DNA, 20 bp, Artificial Sequence
  Description of Artificial Sequence: Synthetic oligonucleotide
  Target: ATXN1; (-) strand; PAM type: YTN; PAM sequence: CTA
tgatctgaaaaggaactagg

SEQ ID NO: 192100 - DNA, 20 bp, Artificial Sequence
  Description of Artificial Sequence: Synthetic oligonucleotide
  Target: ATXN1; (-) strand; PAM type: YTN; PAM sequence: TTC
aaaaatcctatgatctgaaa

SEQ ID NO: 192101 - DNA, 20 bp, Artificial Sequence
  Description of Artificial Sequence: Synthetic oligonucleotide
  Target: ATXN1; (-) strand; PAM type: YTN; PAM sequence: TTT
caaaaatcctatgatctgaa

SEQ ID NO: 192102 - DNA, 20 bp, Artificial Sequence
  Description of Artificial Sequence: Synthetic oligonucleotide
  Target: ATXN1; (-) strand; PAM type: YTN; PAM sequence: TTT
tcaaaaatcctatgatctga

SEQ ID NO: 192103 - DNA, 20 bp, Artificial Sequence
  Description of Artificial Sequence: Synthetic oligonucleotide
  Target: ATXN1; (-) strand; PAM type: YTN; PAM sequence: TTG
attttcaaaaatcctatgat

SEQ ID NO: 192104 - DNA, 20 bp, Artificial Sequence
  Description of Artificial Sequence: Synthetic oligonucleotide
  Target: ATXN1; (-) strand; PAM type: YTN; PAM sequence: TTT
gattttcaaaaatcctatga

SEQ ID NO: 192105 - DNA, 20 bp, Artificial Sequence
  Description of Artificial Sequence: Synthetic oligonucleotide
  Target: ATXN1; (-) strand; PAM type: YTN; PAM sequence: CTA
ggtgatgcagaagacagaag

SEQ ID NO: 192106 - DNA, 20 bp, Artificial Sequence
  Description of Artificial Sequence: Synthetic oligonucleotide
  Target: ATXN1; (-) strand; PAM type: YTN; PAM sequence: TTG
ctaggtgatgcagaagacag

SEQ ID NO: 192107 - DNA, 20 bp, Artificial Sequence
  Description of Artificial Sequence: Synthetic oligonucleotide
  Target: ATXN1; (-) strand; PAM type: YTN; PAM sequence: TTG
aggaacaagttgctaggtga

SEQ ID NO: 192108 - DNA, 20 bp, Artificial Sequence
  Description of Artificial Sequence: Synthetic oligonucleotide
  Target: ATXN1; (-) strand; PAM type: YTN; PAM sequence: TTT
gaggaacaagttgctaggtg

SEQ ID NO: 192109 - DNA, 20 bp, Artificial Sequence
  Description of Artificial Sequence: Synthetic oligonucleotide
  Target: ATXN1; (-) strand; PAM type: YTN; PAM sequence: CTT
tgaggaacaagttgctaggt

SEQ ID NO: 192110 - DNA, 20 bp, Artificial Sequence
  Description of Artificial Sequence: Synthetic oligonucleotide
  Target: ATXN1; (-) strand; PAM type: YTN; PAM sequence: CTG
gtcccaggaagacactttga

SEQ ID NO: 192111 - DNA, 20 bp, Artificial Sequence
  Description of Artificial Sequence: Synthetic oligonucleotide
  Target: ATXN1; (-) strand; PAM type: YTN; PAM sequence: CTG
ctggtcccaggaagacactt

SEQ ID NO: 192112 - DNA, 20 bp, Artificial Sequence
  Description of Artificial Sequence: Synthetic oligonucleotide
  Target: ATXN1; (-) strand; PAM type: YTN; PAM sequence: CTG
agatgctgctggtcccagga

SEQ ID NO: 192113 - DNA, 20 bp, Artificial Sequence
  Description of Artificial Sequence: Synthetic oligonucleotide
  Target: ATXN1; (-) strand; PAM type: YTN; PAM sequence: CTG
agatagggcctgagatgctg

SEQ ID NO: 192114 - DNA, 20 bp, Artificial Sequence
  Description of Artificial Sequence: Synthetic oligonucleotide
  Target: ATXN1; (-) strand; PAM type: YTN; PAM sequence: CTG
tcggtctgagatagggcctg

SEQ ID NO: 192115 - DNA, 20 bp, Artificial Sequence
  Description of Artificial Sequence: Synthetic oligonucleotide
  Target: ATXN1; (-) strand; PAM type: YTN; PAM sequence: CTG
atcctgtcggtctgagatag

SEQ ID NO: 192116 - DNA, 20 bp, Artificial Sequence
  Description of Artificial Sequence: Synthetic oligonucleotide
  Target: ATXN1; (-) strand; PAM type: YTN; PAM sequence: TTC
tgatcctgtcggtctgagat

SEQ ID NO: 192117 - DNA, 20 bp, Artificial Sequence
  Description of Artificial Sequence: Synthetic oligonucleotide
  Target: ATXN1; (-) strand; PAM type: YTN; PAM sequence: TTA
aaatgcaggttctgatcctg

SEQ ID NO: 192118 - DNA, 20 bp, Artificial Sequence
  Description of Artificial Sequence: Synthetic oligonucleotide
  Target: ATXN1; (-) strand; PAM type: YTN; PAM sequence: TTG
ttaaaatgcaggttctgatc

SEQ ID NO: 192119 - DNA, 20 bp, Artificial Sequence
  Description of Artificial Sequence: Synthetic oligonucleotide
  Target: ATXN1; (-) strand; PAM type: YTN; PAM sequence: CTG
ggaatattgttaaaatgcag

SEQ ID NO: 192120 - DNA, 20 bp, Artificial Sequence
  Description of Artificial Sequence: Synthetic oligonucleotide
  Target: ATXN1; (-) strand; PAM type: YTN; PAM sequence: TTG
atcaagtgggtcggaatccc

SEQ ID NO: 192121 - DNA, 20 bp, Artificial Sequence
  Description of Artificial Sequence: Synthetic oligonucleotide
  Target: ATXN1; (-) strand; PAM type: YTN; PAM sequence: CTT
gatcaagtgggtcggaatcc

SEQ ID NO: 192122 - DNA, 20 bp, Artificial Sequence
  Description of Artificial Sequence: Synthetic oligonucleotide
  Target: ATXN1; (-) strand; PAM type: YTN; PAM sequence: CTG
tgagcttgatcaagtgggtc

SEQ ID NO: 192123 - DNA, 20 bp, Artificial Sequence
  Description of Artificial Sequence: Synthetic oligonucleotide
  Target: ATXN1; (-) strand; PAM type: YTN; PAM sequence: CTG
ctgtgagcttgatcaagtgg

SEQ ID NO: 192124 - DNA, 20 bp, Artificial Sequence
  Description of Artificial Sequence: Synthetic oligonucleotide
  Target: ATXN1; (-) strand; PAM type: YTN; PAM sequence: TTC
aaccagtcaagtatgagatg

SEQ ID NO: 192125 - DNA, 20 bp, Artificial Sequence
  Description of Artificial Sequence: Synthetic oligonucleotide
  Target: ATXN1; (-) strand; PAM type: YTN; PAM sequence: CTA
gtcagttcaaccagtcaagt

SEQ ID NO: 192126 - DNA, 20 bp, Artificial Sequence
  Description of Artificial Sequence: Synthetic oligonucleotide
  Target: ATXN1; (-) strand; PAM type: YTN; PAM sequence: TTC
ctagtcagttcaaccagtca

SEQ ID NO: 192127 - DNA, 20 bp, Artificial Sequence
  Description of Artificial Sequence: Synthetic oligonucleotide
  Target: ATXN1; (-) strand; PAM type: YTN; PAM sequence: TTT
cctagtcagttcaaccagtc

SEQ ID NO: 192128 - DNA, 20 bp, Artificial Sequence
  Description of Artificial Sequence: Synthetic oligonucleotide
  Target: ATXN1; (-) strand; PAM type: YTN; PAM sequence: TTT
tcctagtcagttcaaccagt

SEQ ID NO: 192129 - DNA, 20 bp, Artificial Sequence
  Description of Artificial Sequence: Synthetic oligonucleotide
  Target: ATXN1; (-) strand; PAM type: YTN; PAM sequence: TTG
ttttcctagtcagttcaacc

SEQ ID NO: 192130 - DNA, 20 bp, Artificial Sequence
  Description of Artificial Sequence: Synthetic oligonucleotide
  Target: ATXN1; (-) strand; PAM type: YTN; PAM sequence: TTT
gttttcctagtcagttcaac

SEQ ID NO: 192131 - DNA, 20 bp, Artificial Sequence
  Description of Artificial Sequence: Synthetic oligonucleotide
  Target: ATXN1; (-) strand; PAM type: YTN; PAM sequence: CTT
tgttttcctagtcagttcaa

SEQ ID NO: 192132 - DNA, 20 bp, Artificial Sequence
  Description of Artificial Sequence: Synthetic oligonucleotide
  Target: ATXN1; (-) strand; PAM type: YTN; PAM sequence: CTA
ctttgttttcctagtcagtt

SEQ ID NO: 192133 - DNA, 20 bp, Artificial Sequence
  Description of Artificial Sequence: Synthetic oligonucleotide
  Target: ATXN1; (-) strand; PAM type: YTN; PAM sequence: CTC
ctactttgttttcctagtca

SEQ ID NO: 192134 - DNA, 20 bp, Artificial Sequence
  Description of Artificial Sequence: Synthetic oligonucleotide
  Target: ATXN1; (-) strand; PAM type: YTN; PAM sequence: TTC
tcctactttgttttcctagt

SEQ ID NO: 192135 - DNA, 20 bp, Artificial Sequence
  Description of Artificial Sequence: Synthetic oligonucleotide
  Target: ATXN1; (-) strand; PAM type: YTN; PAM sequence: TTT
ctcctactttgttttcctag

SEQ ID NO: 192136 - DNA, 20 bp, Artificial Sequence
  Description of Artificial Sequence: Synthetic oligonucleotide
  Target: ATXN1; (-) strand; PAM type: YTN; PAM sequence: TTG
gtttctcctactttgttttc

SEQ ID NO: 192137 - DNA, 20 bp, Artificial Sequence
  Description of Artificial Sequence: Synthetic oligonucleotide
  Target: ATXN1; (-) strand; PAM type: YTN; PAM sequence: TTT
ggtttctcctactttgtttt

SEQ ID NO: 192138 - DNA, 20 bp, Artificial Sequence
  Description of Artificial Sequence: Synthetic oligonucleotide
  Target: ATXN1; (-) strand; PAM type: YTN; PAM sequence: TTA
tgtttggtttctcctacttt

SEQ ID NO: 192139 - DNA, 20 bp, Artificial Sequence
  Description of Artificial Sequence: Synthetic oligonucleotide
  Target: ATXN1; (-) strand; PAM type: YTN; PAM sequence: TTA
tgtaagttatgtttggtttc

SEQ ID NO: 192140 - DNA, 20 bp, Artificial Sequence
  Description of Artificial Sequence: Synthetic oligonucleotide
  Target: ATXN1; (-) strand; PAM type: YTN; PAM sequence: TTG
aatgagttatgtaagttatg

SEQ ID NO: 192141 - DNA, 20 bp, Artificial Sequence
  Description of Artificial Sequence: Synthetic oligonucleotide
  Target: ATXN1; (-) strand; PAM type: YTN; PAM sequence: TTT
gaatgagttatgtaagttat

SEQ ID NO: 192142 - DNA, 20 bp, Artificial Sequence
  Description of Artificial Sequence: Synthetic oligonucleotide
  Target: ATXN1; (-) strand; PAM type: YTN; PAM sequence: CTT
tgaatgagttatgtaagtta

SEQ ID NO: 192143 - DNA, 20 bp, Artificial Sequence
  Description of Artificial Sequence: Synthetic oligonucleotide
  Target: ATXN1; (-) strand; PAM type: YTN; PAM sequence: CTC
acaatgatctttgaatgagt

SEQ ID NO: 192144 - DNA, 20 bp, Artificial Sequence
  Description of Artificial Sequence: Synthetic oligonucleotide
  Target: ATXN1; (-) strand; PAM type: YTN; PAM sequence: TTA
gtcactcacaatgatctttg

SEQ ID NO: 192145 - DNA, 20 bp, Artificial Sequence
  Description of Artificial Sequence: Synthetic oligonucleotide
  Target: ATXN1; (-) strand; PAM type: YTN; PAM sequence: TTA
tataggtaaagcattagtca

SEQ ID NO: 192146 - DNA, 20 bp, Artificial Sequence
  Description of Artificial Sequence: Synthetic oligonucleotide
  Target: ATXN1; (-) strand; PAM type: YTN; PAM sequence: TTT
atataggtaaagcattagtc

SEQ ID NO: 192147 - DNA, 20 bp, Artificial Sequence
  Description of Artificial Sequence: Synthetic oligonucleotide
  Target: ATXN1; (-) strand; PAM type: YTN; PAM sequence: TTT
tatataggtaaagcattagt

SEQ ID NO: 192148 - DNA, 20 bp, Artificial Sequence
  Description of Artificial Sequence: Synthetic oligonucleotide
  Target: ATXN1; (-) strand; PAM type: YTN; PAM sequence: CTA
gttttatataggtaaagcat

SEQ ID NO: 192149 - DNA, 20 bp, Artificial Sequence
  Description of Artificial Sequence: Synthetic oligonucleotide
  Target: ATXN1; (-) strand; PAM type: YTN; PAM sequence: CTG
gccctagttttatataggta

SEQ ID NO: 192150 - DNA, 20 bp, Artificial Sequence
  Description of Artificial Sequence: Synthetic oligonucleotide
  Target: ATXN1; (-) strand; PAM type: YTN; PAM sequence: CTG
tgcctggccctagttttata

SEQ ID NO: 192151 - DNA, 20 bp, Artificial Sequence
  Description of Artificial Sequence: Synthetic oligonucleotide
  Target: ATXN1; (-) strand; PAM type: YTN; PAM sequence: CTA
ggtataagccactgtgcctg

SEQ ID NO: 192152 - DNA, 20 bp, Artificial Sequence
  Description of Artificial Sequence: Synthetic oligonucleotide
  Target: ATXN1; (-) strand; PAM type: YTN; PAM sequence: CTC
ccacagtgctaggtataagc

SEQ ID NO: 192153 - DNA, 20 bp, Artificial Sequence
  Description of Artificial Sequence: Synthetic oligonucleotide
  Target: ATXN1; (-) strand; PAM type: YTN; PAM sequence: CTG
cctcccacagtgctaggtat

SEQ ID NO: 192154 - DNA, 20 bp, Artificial Sequence
  Description of Artificial Sequence: Synthetic oligonucleotide
  Target: ATXN1; (-) strand; PAM type: YTN; PAM sequence: CTC
tgcctcccacagtgctaggt

SEQ ID NO: 192155 - DNA, 20 bp, Artificial Sequence
  Description of Artificial Sequence: Synthetic oligonucleotide
  Target: ATXN1; (-) strand; PAM type: YTN; PAM sequence: CTC
ccacctctgcctcccacagt

SEQ ID NO: 192156 - DNA, 20 bp, Artificial Sequence
  Description of Artificial Sequence: Synthetic oligonucleotide
  Target: ATXN1; (-) strand; PAM type: YTN; PAM sequence: TTC
tcccacctctgcctcccaca

SEQ ID NO: 192157 - DNA, 20 bp, Artificial Sequence
  Description of Artificial Sequence: Synthetic oligonucleotide
  Target: ATXN1; (-) strand; PAM type: YTN; PAM sequence: CTC
aagtgattctcccacctctg

SEQ ID NO: 192158 - DNA, 20 bp, Artificial Sequence
  Description of Artificial Sequence: Synthetic oligonucleotide
  Target: ATXN1; (-) strand; PAM type: YTN; PAM sequence: CTG
gactcaagtgattctcccac

SEQ ID NO: 192159 - DNA, 20 bp, Artificial Sequence
  Description of Artificial Sequence: Synthetic oligonucleotide
  Target: ATXN1; (-) strand; PAM type: YTN; PAM sequence: CTC
ctggactcaagtgattctcc

SEQ ID NO: 192160 - DNA, 20 bp, Artificial Sequence
  Description of Artificial Sequence: Synthetic oligonucleotide
  Target: ATXN1; (-) strand; PAM type: YTN; PAM sequence: TTG
aactcctggactcaagtgat

SEQ ID NO: 192161 - DNA, 20 bp, Artificial Sequence
  Description of Artificial Sequence: Synthetic oligonucleotide
  Target: ATXN1; (-) strand; PAM type: YTN; PAM sequence: CTT
gaactcctggactcaagtga

SEQ ID NO: 192162 - DNA, 20 bp, Artificial Sequence
  Description of Artificial Sequence: Synthetic oligonucleotide
  Target: ATXN1; (-) strand; PAM type: YTN; PAM sequence: TTG
gtcttgaactcctggactca

SEQ ID NO: 192163 - DNA, 20 bp, Artificial Sequence
  Description of Artificial Sequence: Synthetic oligonucleotide
  Target: ATXN1; (-) strand; PAM type: YTN; PAM sequence: CTG
gttggtcttgaactcctgga

SEQ ID NO: 192164 - DNA, 20 bp, Artificial Sequence
  Description of Artificial Sequence: Synthetic oligonucleotide
  Target: ATXN1; (-) strand; PAM type: YTN; PAM sequence: CTC
tggttggtcttgaactcctg

SEQ ID NO: 192165 - DNA, 20 bp, Artificial Sequence
  Description of Artificial Sequence: Synthetic oligonucleotide
  Target: ATXN1; (-) strand; PAM type: YTN; PAM sequence: CTC
ctctggttggtcttgaactc

SEQ ID NO: 192166 - DNA, 20 bp, Artificial Sequence
  Description of Artificial Sequence: Synthetic oligonucleotide
  Target: ATXN1; (-) strand; PAM type: YTN; PAM sequence: CTG
tgctcctctggttggtcttg

SEQ ID NO: 192167 - DNA, 20 bp, Artificial Sequence
  Description of Artificial Sequence: Synthetic oligonucleotide
  Target: ATXN1; (-) strand; PAM type: YTN; PAM sequence: TTC
actgtgctcctctggttggt

SEQ ID NO: 192168 - DNA, 20 bp, Artificial Sequence
  Description of Artificial Sequence: Synthetic oligonucleotide
  Target: ATXN1; (-) strand; PAM type: YTN; PAM sequence: TTT
cactgtgctcctctggttgg

SEQ ID NO: 192169 - DNA, 20 bp, Artificial Sequence
  Description of Artificial Sequence: Synthetic oligonucleotide
  Target: ATXN1; (-) strand; PAM type: YTN; PAM sequence: TTG
gtagagatggggtttcactg

SEQ ID NO: 192170 - DNA, 20 bp, Artificial Sequence
  Description of Artificial Sequence: Synthetic oligonucleotide
  Target: ATXN1; (-) strand; PAM type: YTN; PAM sequence: TTT
ggtagagatggggtttcact

SEQ ID NO: 192171 - DNA, 20 bp, Artificial Sequence
  Description of Artificial Sequence: Synthetic oligonucleotide
  Target: ATXN1; (-) strand; PAM type: YTN; PAM sequence: TTT
tggtagagatggggtttcac

SEQ ID NO: 192172 - DNA, 20 bp, Artificial Sequence
  Description of Artificial Sequence: Synthetic oligonucleotide
  Target: ATXN1; (-) strand; PAM type: YTN; PAM sequence: TTT
ttggtagagatggggtttca

SEQ ID NO: 192173 - DNA, 20 bp, Artificial Sequence
  Description of Artificial Sequence: Synthetic oligonucleotide
  Target: ATXN1; (-) strand; PAM type: YTN; PAM sequence: TTG
tatttttggtagagatgggg

SEQ ID NO: 192174 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtagagatggg

SEQ ID NO: 192175 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtagagatgg

SEQ ID NO: 192176 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtagagatg

SEQ ID NO: 192177 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttggtaga

SEQ ID NO: 192178 - DNA, 20 bp, Artificial Sequence
  Description of Artificial Sequence: Synthetic oligonucleotide
  Target: ATXN1; (-) strand; PAM type: YTN; PAM sequence: CTA
caggtgtgtgccaccatgcc

SEQ ID NO: 192179 - DNA, 20 bp, Artificial Sequence
  Description of Artificial Sequence: Synthetic oligonucleotide
  Target: ATXN1; (-) strand; PAM type: YTN; PAM sequence: TTG
ggactacaggtgtgtgccac

SEQ ID NO: 192180 - DNA, 20 bp, Artificial Sequence
  Description of Artificial Sequence: Synthetic oligonucleotide
  Target: ATXN1; (-) strand; PAM type: YTN; PAM sequence: CTT
gggactacaggtgtgtgcca

SEQ ID NO: 192181 - DNA, 20 bp, Artificial Sequence
  Description of Artificial Sequence: Synthetic oligonucleotide
  Target: ATXN1; (-) strand; PAM type: YTN; PAM sequence: CTC
ccaagtagcttgggactaca

SEQ ID NO: 192182 - DNA, 20 bp, Artificial Sequence
  Description of Artificial Sequence: Synthetic oligonucleotide
  Target: ATXN1; (-) strand; PAM type: YTN; PAM sequence: TTA
gcctcccaagtagcttggga

SEQ ID NO: 192183 - DNA, 20 bp, Artificial Sequence
  Description of Artificial Sequence: Synthetic oligonucleotide
  Target: ATXN1; (-) strand; PAM type: YTN; PAM sequence: CTT
agcctcccaagtagcttggg

SEQ ID NO: 192184 - DNA, 20 bp, Artificial Sequence
  Description of Artificial Sequence: Synthetic oligonucleotide
  Target: ATXN1; (-) strand; PAM type: YTN; PAM sequence: CTC
ccaccttagcctcccaagta

SEQ ID NO: 192185 - DNA, 20 bp, Artificial Sequence
  Description of Artificial Sequence: Synthetic oligonucleotide
  Target: ATXN1; (-) strand; PAM type: YTN; PAM sequence: TTC
aagcagtcctcccaccttag

SEQ ID NO: 192186 - DNA, 20 bp, Artificial Sequence
  Description of Artificial Sequence: Synthetic oligonucleotide
  Target: ATXN1; (-) strand; PAM type: YTN; PAM sequence: CTG
gggttcaagcagtcctccca

SEQ ID NO: 192187 - DNA, 20 bp, Artificial Sequence
  Description of Artificial Sequence: Synthetic oligonucleotide
  Target: ATXN1; (-) strand; PAM type: YTN; PAM sequence: CTC
ctggggttcaagcagtcctc

SEQ ID NO: 192188 - DNA, 20 bp, Artificial Sequence
  Description of Artificial Sequence: Synthetic oligonucleotide
  Target: ATXN1; (-) strand; PAM type: YTN; PAM sequence: CTC
aacctcctggggttcaagca

SEQ ID NO: 192189 - DNA, 20 bp, Artificial Sequence
  Description of Artificial Sequence: Synthetic oligonucleotide
  Target: ATXN1; (-) strand; PAM type: YTN; PAM sequence: TTG
cagcctcaacctcctggggt

SEQ ID NO: 192190 - DNA, 20 bp, Artificial Sequence
  Description of Artificial Sequence: Synthetic oligonucleotide
  Target: ATXN1; (-) strand; PAM type: YTN; PAM sequence: CTC
attgcagcctcaacctcctg

SEQ ID NO: 192191 - DNA, 20 bp, Artificial Sequence
  Description of Artificial Sequence: Synthetic oligonucleotide
  Target: ATXN1; (-) strand; PAM type: YTN; PAM sequence: CTC
acagctcattgcagcctcaa

SEQ ID NO: 192192 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcactcac

SEQ ID NO: 192193 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 192194 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 192195 - DNA, 20 bp, Artificial Sequence
  Description of Artificial Sequence: Synthetic oligonucleotide
  Target: ATXN1; (-) strand; PAM type: YTN; PAM sequence: CTC
actctgtcacccaggctgga

SEQ ID NO: 192196 - DNA, 20 bp, Artificial Sequence
  Description of Artificial Sequence: Synthetic oligonucleotide
  Target: ATXN1; (-) strand; PAM type: YTN; PAM sequence: TTA
tgagacagggcctcactctg

SEQ ID NO: 192197 - DNA, 20 bp, Artificial Sequence
  Description of Artificial Sequence: Synthetic oligonucleotide
  Target: ATXN1; (-) strand; PAM type: YTN; PAM sequence: TTT
atgagacagggcctcactct

SEQ ID NO: 192198 - DNA, 20 bp, Artificial Sequence
  Description of Artificial Sequence: Synthetic oligonucleotide
  Target: ATXN1; (-) strand; PAM type: YTN; PAM sequence: TTA
tttatgagacagggcctcac

SEQ ID NO: 192199 - DNA, 20 bp, Artificial Sequence
  Description of Artificial Sequence: Synthetic oligonucleotide
  Target: ATXN1; (-) strand; PAM type: YTN; PAM sequence: TTT
atttatgagacagggcctca

SEQ ID NO: 192200 - DNA, 20 bp, Artificial Sequence
  Description of Artificial Sequence: Synthetic oligonucleotide
  Target: ATXN1; (-) strand; PAM type: YTN; PAM sequence: TTA
tttatttatgagacagggcc

SEQ ID NO: 192201 - DNA, 20 bp, Artificial Sequence
  Description of Artificial Sequence: Synthetic oligonucleotide
  Target: ATXN1; (-) strand; PAM type: YTN; PAM sequence: TTT
atttatttatgagacagggc

SEQ ID NO: 192202 - DNA, 20 bp, Artificial Sequence
  Description of Artificial Sequence: Synthetic oligonucleotide
  Target: ATXN1; (-) strand; PAM type: YTN; PAM sequence: TTA
tttatttatttatgagacag

SEQ ID NO: 192203 - DNA, 20 bp, Artificial Sequence
  Description of Artificial Sequence: Synthetic oligonucleotide
  Target: ATXN1; (-) strand; PAM type: YTN; PAM sequence: TTT
atttatttatttatgagaca

SEQ ID NO: 192204 - DNA, 20 bp, Artificial Sequence
  Description of Artificial Sequence: Synthetic oligonucleotide
  Target: ATXN1; (-) strand; PAM type: YTN; PAM sequence: CTA
tttatttatttatttatgag

SEQ ID NO: 192205 - DNA, 20 bp, Artificial Sequence
  Description of Artificial Sequence: Synthetic oligonucleotide
  Target: ATXN1; (-) strand; PAM type: YTN; PAM sequence: TTC
tatttatttatttatttatg

SEQ ID NO: 192206 - DNA, 20 bp, Artificial Sequence
  Description of Artificial Sequence: Synthetic oligonucleotide
  Target: ATXN1; (-) strand; PAM type: YTN; PAM sequence: TTT
ctatttatttatttatttat

SEQ ID NO: 192207 - DNA, 20 bp, Artificial Sequence
  Description of Artificial Sequence: Synthetic oligonucleotide
  Target: ATXN1; (-) strand; PAM type: YTN; PAM sequence: TTA
tttctatttatttatttatt

SEQ ID NO: 192208 - DNA, 20 bp, Artificial Sequence
  Description of Artificial Sequence: Synthetic oligonucleotide
  Target: ATXN1; (-) strand; PAM type: YTN; PAM sequence: TTT
atttctatttatttatttat

SEQ ID NO: 192209 - DNA, 20 bp, Artificial Sequence
  Description of Artificial Sequence: Synthetic oligonucleotide
  Target: ATXN1; (-) strand; PAM type: YTN; PAM sequence: TTT
tatttctatttatttattta

SEQ ID NO: 192210 - DNA, 20 bp, Artificial Sequence
  Description of Artificial Sequence: Synthetic oligonucleotide
  Target: ATXN1; (-) strand; PAM type: YTN; PAM sequence: TTT
ttatttctatttatttattt

SEQ ID NO: 192211 - DNA, 20 bp, Artificial Sequence
  Description of Artificial Sequence: Synthetic oligonucleotide
  Target: ATXN1; (-) strand; PAM type: YTN; PAM sequence: CTG
tatttttatttctatttatt

SEQ ID NO: 192212 - DNA, 20 bp, Artificial Sequence
  Description of Artificial Sequence: Synthetic oligonucleotide
  Target: ATXN1; (-) strand; PAM type: YTN; PAM sequence: TTA
ctgtatttttatttctattt

SEQ ID NO: 192213 - DNA, 20 bp, Artificial Sequence
  Description of Artificial Sequence: Synthetic oligonucleotide
  Target: ATXN1; (-) strand; PAM type: YTN; PAM sequence: TTT
actgtatttttatttctatt

SEQ ID NO: 192214 - DNA, 20 bp, Artificial Sequence
  Description of Artificial Sequence: Synthetic oligonucleotide
  Target: ATXN1; (-) strand; PAM type: YTN; PAM sequence: CTT
tactgtatttttatttctat

SEQ ID NO: 192215 - DNA, 20 bp, Artificial Sequence
  Description of Artificial Sequence: Synthetic oligonucleotide
  Target: ATXN1; (-) strand; PAM type: YTN; PAM sequence: CTG
tatacctttactgtattttt

SEQ ID NO: 192216 - DNA, 20 bp, Artificial Sequence
  Description of Artificial Sequence: Synthetic oligonucleotide
  Target: ATXN1; (-) strand; PAM type: YTN; PAM sequence: TTC
tgtatacctttactgtattt

SEQ ID NO: 192217 - DNA, 20 bp, Artificial Sequence
  Description of Artificial Sequence: Synthetic oligonucleotide
  Target: ATXN1; (-) strand; PAM type: YTN; PAM sequence: TTT
ctgtatacctttactgtatt

SEQ ID NO: 192218 - DNA, 20 bp, Artificial Sequence
  Description of Artificial Sequence: Synthetic oligonucleotide
  Target: ATXN1; (-) strand; PAM type: YTN; PAM sequence: CTT
tctgtatacctttactgtat

SEQ ID NO: 192219 - DNA, 20 bp, Artificial Sequence
  Description of Artificial Sequence: Synthetic oligonucleotide
  Target: ATXN1; (-) strand; PAM type: YTN; PAM sequence: CTG
ctttctgtatacctttactg

SEQ ID NO: 192220 - DNA, 20 bp, Artificial Sequence
  Description of Artificial Sequence: Synthetic oligonucleotide
  Target: ATXN1; (-) strand; PAM type: YTN; PAM sequence: TTC
tgctttctgtatacctttac

SEQ ID NO: 192221 - DNA, 20 bp, Artificial Sequence
  Description of Artificial Sequence: Synthetic oligonucleotide
  Target: ATXN1; (-) strand; PAM type: YTN; PAM sequence: CTT
ctgctttctgtataccttta

SEQ ID NO: 192222 - DNA, 20 bp, Artificial Sequence
  Description of Artificial Sequence: Synthetic oligonucleotide
  Target: ATXN1; (-) strand; PAM type: YTN; PAM sequence: TTA
accttctgctttctgtatac

SEQ ID NO: 192223 - DNA, 20 bp, Artificial Sequence
  Description of Artificial Sequence: Synthetic oligonucleotide
  Target: ATXN1; (-) strand; PAM type: YTN; PAM sequence: TTG
gtaaaattaaccttctgctt

SEQ ID NO: 192224 - DNA, 20 bp, Artificial Sequence
  Description of Artificial Sequence: Synthetic oligonucleotide
  Target: ATXN1; (-) strand; PAM type: YTN; PAM sequence: CTC
agaaggttggtaaaattaac

SEQ ID NO: 192225 - DNA, 20 bp, Artificial Sequence
  Description of Artificial Sequence: Synthetic oligonucleotide
  Target: ATXN1; (-) strand; PAM type: YTN; PAM sequence: CTC
cctcagaaggttggtaaaat

SEQ ID NO: 192226 - DNA, 20 bp, Artificial Sequence
  Description of Artificial Sequence: Synthetic oligonucleotide
  Target: ATXN1; (-) strand; PAM type: YTN; PAM sequence: TTC
ctccctcagaaggttggtaa

SEQ ID NO: 192227 - DNA, 20 bp, Artificial Sequence
  Description of Artificial Sequence: Synthetic oligonucleotide
  Target: ATXN1; (-) strand; PAM type: YTN; PAM sequence: CTT
cctccctcagaaggttggta

SEQ ID NO: 192228 - DNA, 20 bp, Artificial Sequence
  Description of Artificial Sequence: Synthetic oligonucleotide
  Target: ATXN1; (-) strand; PAM type: YTN; PAM sequence: TTG
tcttcctccctcagaaggtt

SEQ ID NO: 192229 - DNA, 20 bp, Artificial Sequence
  Description of Artificial Sequence: Synthetic oligonucleotide
  Target: ATXN1; (-) strand; PAM type: YTN; PAM sequence: TTT
gtcttcctccctcagaaggt

SEQ ID NO: 192230 - DNA, 20 bp, Artificial Sequence
  Description of Artificial Sequence: Synthetic oligonucleotide
  Target: ATXN1; (-) strand; PAM type: YTN; PAM sequence: TTG
gccaaggtgacatttgtctt

SEQ ID NO: 192231 - DNA, 20 bp, Artificial Sequence
  Description of Artificial Sequence: Synthetic oligonucleotide
  Target: ATXN1; (-) strand; PAM type: YTN; PAM sequence: TTG
gttggccaaggtgacatttg

SEQ ID NO: 192232 - DNA, 20 bp, Artificial Sequence
  Description of Artificial Sequence: Synthetic oligonucleotide
  Target: ATXN1; (-) strand; PAM type: YTN; PAM sequence: TTT
ggttggccaaggtgacattt

SEQ ID NO: 192233 - DNA, 20 bp, Artificial Sequence
  Description of Artificial Sequence: Synthetic oligonucleotide
  Target: ATXN1; (-) strand; PAM type: YTN; PAM sequence: CTA
tttggttggccaaggtgaca

SEQ ID NO: 192234 - DNA, 20 bp, Artificial Sequence
  Description of Artificial Sequence: Synthetic oligonucleotide
  Target: ATXN1; (-) strand; PAM type: YTN; PAM sequence: TTC
ccagatctatttggttggcc

SEQ ID NO: 192235 - DNA, 20 bp, Artificial Sequence
  Description of Artificial Sequence: Synthetic oligonucleotide
  Target: ATXN1; (-) strand; PAM type: YTN; PAM sequence: CTT
cccagatctatttggttggc

SEQ ID NO: 192236 - DNA, 20 bp, Artificial Sequence
  Description of Artificial Sequence: Synthetic oligonucleotide
  Target: ATXN1; (-) strand; PAM type: YTN; PAM sequence: TTA
taaaaagacaaaatcttccc

SEQ ID NO: 192237 - DNA, 20 bp, Artificial Sequence
  Description of Artificial Sequence: Synthetic oligonucleotide
  Target: ATXN1; (-) strand; PAM type: YTN; PAM sequence: TTT
ataaaaagacaaaatcttcc

SEQ ID NO: 192238 - DNA, 20 bp, Artificial Sequence
  Description of Artificial Sequence: Synthetic oligonucleotide
  Target: ATXN1; (-) strand; PAM type: YTN; PAM sequence: CTT
tataaaaagacaaaatcttc

SEQ ID NO: 192239 - DNA, 20 bp, Artificial Sequence
  Description of Artificial Sequence: Synthetic oligonucleotide
  Target: ATXN1; (-) strand; PAM type: YTN; PAM sequence: TTA
aatagacaagctttataaaa

SEQ ID NO: 192240 - DNA, 20 bp, Artificial Sequence
  Description of Artificial Sequence: Synthetic oligonucleotide
  Target: ATXN1; (-) strand; PAM type: YTN; PAM sequence: CTT
aaatagacaagctttataaa

SEQ ID NO: 192241 - DNA, 20 bp, Artificial Sequence
  Description of Artificial Sequence: Synthetic oligonucleotide
  Target: ATXN1; (-) strand; PAM type: YTN; PAM sequence: TTC
ccacccttaaatagacaagc

SEQ ID NO: 192242 - DNA, 20 bp, Artificial Sequence
  Description of Artificial Sequence: Synthetic oligonucleotide
  Target: ATXN1; (-) strand; PAM type: YTN; PAM sequence: CTT
cccacccttaaatagacaag

SEQ ID NO: 192243 - DNA, 20 bp, Artificial Sequence
  Description of Artificial Sequence: Synthetic oligonucleotide
  Target: ATXN1; (-) strand; PAM type: YTN; PAM sequence: CTG
acttcccacccttaaataga

SEQ ID NO: 192244 - DNA, 20 bp, Artificial Sequence
  Description of Artificial Sequence: Synthetic oligonucleotide
  Target: ATXN1; (-) strand; PAM type: YTN; PAM sequence: CTG
ctgacttcccacccttaaat

SEQ ID NO: 192245 - DNA, 20 bp, Artificial Sequence
  Description of Artificial Sequence: Synthetic oligonucleotide
  Target: ATXN1; (-) strand; PAM type: YTN; PAM sequence: TTC
tgctgacttcccacccttaa

SEQ ID NO: 192246 - DNA, 20 bp, Artificial Sequence
  Description of Artificial Sequence: Synthetic oligonucleotide
  Target: ATXN1; (-) strand; PAM type: YTN; PAM sequence: TTT
ctgctgacttcccaccctta

SEQ ID NO: 192247 - DNA, 20 bp, Artificial Sequence
  Description of Artificial Sequence: Synthetic oligonucleotide
  Target: ATXN1; (-) strand; PAM type: YTN; PAM sequence: TTT
tctgctgacttcccaccctt

SEQ ID NO: 192248 - DNA, 20 bp, Artificial Sequence
  Description of Artificial Sequence: Synthetic oligonucleotide
  Target: ATXN1; (-) strand; PAM type: YTN; PAM sequence: TTT
ttctgctgacttcccaccct

SEQ ID NO: 192249 - DNA, 20 bp, Artificial Sequence
  Description of Artificial Sequence: Synthetic oligonucleotide
  Target: ATXN1; (-) strand; PAM type: YTN; PAM sequence: TTG
gcaagcagtttttctgctga

SEQ ID NO: 192250 - DNA, 20 bp, Artificial Sequence
  Description of Artificial Sequence: Synthetic oligonucleotide
  Target: ATXN1; (-) strand; PAM type: YTN; PAM sequence: CTA
ttggcaagcagtttttctgc

SEQ ID NO: 192251 - DNA, 20 bp, Artificial Sequence
  Description of Artificial Sequence: Synthetic oligonucleotide
  Target: ATXN1; (-) strand; PAM type: YTN; PAM sequence: TTA
aagtgggagaagtgtactat

SEQ ID NO: 192252 - DNA, 20 bp, Artificial Sequence
  Description of Artificial Sequence: Synthetic oligonucleotide
  Target: ATXN1; (-) strand; PAM type: YTN; PAM sequence: TTC
attaaagtgggagaagtgta

SEQ ID NO: 192253 - DNA, 20 bp, Artificial Sequence
  Description of Artificial Sequence: Synthetic oligonucleotide
  Target: ATXN1; (-) strand; PAM type: YTN; PAM sequence: TTT
cattaaagtgggagaagtgt

SEQ ID NO: 192254 - DNA, 20 bp, Artificial Sequence
  Description of Artificial Sequence: Synthetic oligonucleotide
  Target: ATXN1; (-) strand; PAM type: YTN; PAM sequence: TTC
acagccaaccgatttcatta

SEQ ID NO: 192255 - DNA, 20 bp, Artificial Sequence
  Description of Artificial Sequence: Synthetic oligonucleotide
  Target: ATXN1; (-) strand; PAM type: YTN; PAM sequence: TTT
cacagccaaccgatttcatt

SEQ ID NO: 192256 - DNA, 20 bp, Artificial Sequence
  Description of Artificial Sequence: Synthetic oligonucleotide
  Target: ATXN1; (-) strand; PAM type: YTN; PAM sequence: TTT
tcacagccaaccgatttcat

SEQ ID NO: 192257 - DNA, 20 bp, Artificial Sequence
  Description of Artificial Sequence: Synthetic oligonucleotide
  Target: ATXN1; (-) strand; PAM type: YTN; PAM sequence: TTG
atgcacatattttcacagcc

SEQ ID NO: 192258 - DNA, 20 bp, Artificial Sequence
  Description of Artificial Sequence: Synthetic oligonucleotide
  Target: ATXN1; (-) strand; PAM type: YTN; PAM sequence: TTT
gatgcacatattttcacagc

SEQ ID NO: 192259 - DNA, 20 bp, Artificial Sequence
  Description of Artificial Sequence: Synthetic oligonucleotide
  Target: ATXN1; (-) strand; PAM type: YTN; PAM sequence: CTT
tgatgcacatattttcacag

SEQ ID NO: 192260 - DNA, 20 bp, Artificial Sequence
  Description of Artificial Sequence: Synthetic oligonucleotide
  Target: ATXN1; (-) strand; PAM type: YTN; PAM sequence: TTA
aaactttgatgcacatattt

SEQ ID NO: 192261 - DNA, 20 bp, Artificial Sequence
  Description of Artificial Sequence: Synthetic oligonucleotide
  Target: ATXN1; (-) strand; PAM type: YTN; PAM sequence: TTT
aaaactttgatgcacatatt

SEQ ID NO: 192262 - DNA, 20 bp, Artificial Sequence
  Description of Artificial Sequence: Synthetic oligonucleotide
  Target: ATXN1; (-) strand; PAM type: YTN; PAM sequence: CTT
taaaactttgatgcacatat

SEQ ID NO: 192263 - DNA, 20 bp, Artificial Sequence
  Description of Artificial Sequence: Synthetic oligonucleotide
  Target: ATXN1; (-) strand; PAM type: YTN; PAM sequence: CTC
tttaaaactttgatgcacat

SEQ ID NO: 192264 - DNA, 20 bp, Artificial Sequence
  Description of Artificial Sequence: Synthetic oligonucleotide
  Target: ATXN1; (-) strand; PAM type: YTN; PAM sequence: CTG
gatgtgacagaaaactcttt

SEQ ID NO: 192265 - DNA, 20 bp, Artificial Sequence
  Description of Artificial Sequence: Synthetic oligonucleotide
  Target: ATXN1; (-) strand; PAM type: YTN; PAM sequence: CTA
ctggatgtgacagaaaactc

SEQ ID NO: 192266 - DNA, 20 bp, Artificial Sequence
  Description of Artificial Sequence: Synthetic oligonucleotide
  Target: ATXN1; (-) strand; PAM type: YTN; PAM sequence: TTA
taagtctactggatgtgaca

SEQ ID NO: 192267 - DNA, 20 bp, Artificial Sequence
  Description of Artificial Sequence: Synthetic oligonucleotide
  Target: ATXN1; (-) strand; PAM type: YTN; PAM sequence: CTG
tattataagtctactggatg

SEQ ID NO: 192268 - DNA, 20 bp, Artificial Sequence
  Description of Artificial Sequence: Synthetic oligonucleotide
  Target: ATXN1; (-) strand; PAM type: YTN; PAM sequence: CTG
tagcaatctgtattataagt

SEQ ID NO: 192269 - DNA, 20 bp, Artificial Sequence
  Description of Artificial Sequence: Synthetic oligonucleotide
  Target: ATXN1; (-) strand; PAM type: YTN; PAM sequence: TTC
catctgtagcaatctgtatt

SEQ ID NO: 192270 - DNA, 20 bp, Artificial Sequence
  Description of Artificial Sequence: Synthetic oligonucleotide
  Target: ATXN1; (-) strand; PAM type: YTN; PAM sequence: CTT
ccatctgtagcaatctgtat

SEQ ID NO: 192271 - DNA, 20 bp, Artificial Sequence
  Description of Artificial Sequence: Synthetic oligonucleotide
  Target: ATXN1; (-) strand; PAM type: YTN; PAM sequence: CTA
catcaagtgaggataaatct

SEQ ID NO: 192272 - DNA, 20 bp, Artificial Sequence
  Description of Artificial Sequence: Synthetic oligonucleotide
  Target: ATXN1; (-) strand; PAM type: YTN; PAM sequence: TTG
ctacatcaagtgaggataaa

SEQ ID NO: 192273 - DNA, 20 bp, Artificial Sequence
  Description of Artificial Sequence: Synthetic oligonucleotide
  Target: ATXN1; (-) strand; PAM type: YTN; PAM sequence: CTG
ttgctacatcaagtgaggat

SEQ ID NO: 192274 - DNA, 20 bp, Artificial Sequence
  Description of Artificial Sequence: Synthetic oligonucleotide
  Target: ATXN1; (-) strand; PAM type: YTN; PAM sequence: TTC
aaagaacgtagtgctgttgc

SEQ ID NO: 192275 - DNA, 20 bp, Artificial Sequence
  Description of Artificial Sequence: Synthetic oligonucleotide
  Target: ATXN1; (-) strand; PAM type: YTN; PAM sequence: TTA
cagttcaaagaacgtagtgc

SEQ ID NO: 192276 - DNA, 20 bp, Artificial Sequence
  Description of Artificial Sequence: Synthetic oligonucleotide
  Target: ATXN1; (-) strand; PAM type: YTN; PAM sequence: TTG
ttacagttcaaagaacgtag

SEQ ID NO: 192277 - DNA, 20 bp, Artificial Sequence
  Description of Artificial Sequence: Synthetic oligonucleotide
  Target: ATXN1; (-) strand; PAM type: YTN; PAM sequence: TTT
gttacagttcaaagaacgta

SEQ ID NO: 192278 - DNA, 20 bp, Artificial Sequence
  Description of Artificial Sequence: Synthetic oligonucleotide
  Target: ATXN1; (-) strand; PAM type: YTN; PAM sequence: CTT
tgttacagttcaaagaacgt

SEQ ID NO: 192279 - DNA, 20 bp, Artificial Sequence
  Description of Artificial Sequence: Synthetic oligonucleotide
  Target: ATXN1; (-) strand; PAM type: YTN; PAM sequence: CTA
ccacgtgggaaaaaaaaaat

SEQ ID NO: 192280 - DNA, 20 bp, Artificial Sequence
  Description of Artificial Sequence: Synthetic oligonucleotide
  Target: ATXN1; (-) strand; PAM type: YTN; PAM sequence: TTC
atctaccacgtgggaaaaaa

SEQ ID NO: 192281 - DNA, 20 bp, Artificial Sequence
  Description of Artificial Sequence: Synthetic oligonucleotide
  Target: ATXN1; (-) strand; PAM type: YTN; PAM sequence: CTA
agattcatctaccacgtggg

SEQ ID NO: 192282 - DNA, 20 bp, Artificial Sequence
  Description of Artificial Sequence: Synthetic oligonucleotide
  Target: ATXN1; (-) strand; PAM type: YTN; PAM sequence: TTA
ctaagattcatctaccacgt

SEQ ID NO: 192283 - DNA, 20 bp, Artificial Sequence
  Description of Artificial Sequence: Synthetic oligonucleotide
  Target: ATXN1; (-) strand; PAM type: YTN; PAM sequence: CTT
actaagattcatctaccacg

SEQ ID NO: 192284 - DNA, 20 bp, Artificial Sequence
  Description of Artificial Sequence: Synthetic oligonucleotide
  Target: ATXN1; (-) strand; PAM type: YTN; PAM sequence: TTC
ttactaagattcatctacca

SEQ ID NO: 192285 - DNA, 20 bp, Artificial Sequence
  Description of Artificial Sequence: Synthetic oligonucleotide
  Target: ATXN1; (-) strand; PAM type: YTN; PAM sequence: TTT
cttactaagattcatctacc

SEQ ID NO: 192286 - DNA, 20 bp, Artificial Sequence
  Description of Artificial Sequence: Synthetic oligonucleotide
  Target: ATXN1; (-) strand; PAM type: YTN; PAM sequence: TTT
tcttactaagattcatctac

SEQ ID NO: 192287 - DNA, 20 bp, Artificial Sequence
  Description of Artificial Sequence: Synthetic oligonucleotide
  Target: ATXN1; (-) strand; PAM type: YTN; PAM sequence: CTG
tattttcttactaagattca

SEQ ID NO: 192288 - DNA, 20 bp, Artificial Sequence
  Description of Artificial Sequence: Synthetic oligonucleotide
  Target: ATXN1; (-) strand; PAM type: YTN; PAM sequence: TTG
agtatgtgtcatatcaagtc

SEQ ID NO: 192289 - DNA, 20 bp, Artificial Sequence
  Description of Artificial Sequence: Synthetic oligonucleotide
  Target: ATXN1; (-) strand; PAM type: YTN; PAM sequence: TTA
cagtagttgagtatgtgtca

SEQ ID NO: 192290 - DNA, 20 bp, Artificial Sequence
  Description of Artificial Sequence: Synthetic oligonucleotide
  Target: ATXN1; (-) strand; PAM type: YTN; PAM sequence: TTT
acagtagttgagtatgtgtc

SEQ ID NO: 192291 - DNA, 20 bp, Artificial Sequence
  Description of Artificial Sequence: Synthetic oligonucleotide
  Target: ATXN1; (-) strand; PAM type: YTN; PAM sequence: CTT
tacagtagttgagtatgtgt

SEQ ID NO: 192292 - DNA, 20 bp, Artificial Sequence
  Description of Artificial Sequence: Synthetic oligonucleotide
  Target: ATXN1; (-) strand; PAM type: YTN; PAM sequence: TTA
agcacccactttacagtagt

SEQ ID NO: 192293 - DNA, 20 bp, Artificial Sequence
  Description of Artificial Sequence: Synthetic oligonucleotide
  Target: ATXN1; (-) strand; PAM type: YTN; PAM sequence: CTA
aattaagcacccactttaca

SEQ ID NO: 192294 - DNA, 20 bp, Artificial Sequence
  Description of Artificial Sequence: Synthetic oligonucleotide
  Target: ATXN1; (-) strand; PAM type: YTN; PAM sequence: CTA
actaaattaagcacccactt

SEQ ID NO: 192295 - DNA, 20 bp, Artificial Sequence
  Description of Artificial Sequence: Synthetic oligonucleotide
  Target: ATXN1; (-) strand; PAM type: YTN; PAM sequence: CTC
cctaactaaattaagcaccc

SEQ ID NO: 192296 - DNA, 20 bp, Artificial Sequence
  Description of Artificial Sequence: Synthetic oligonucleotide
  Target: ATXN1; (-) strand; PAM type: YTN; PAM sequence: CTC
tccctaactaaattaagcac

SEQ ID NO: 192297 - DNA, 20 bp, Artificial Sequence
  Description of Artificial Sequence: Synthetic oligonucleotide
  Target: ATXN1; (-) strand; PAM type: YTN; PAM sequence: TTC
ctctccctaactaaattaag

SEQ ID NO: 192298 - DNA, 20 bp, Artificial Sequence
  Description of Artificial Sequence: Synthetic oligonucleotide
  Target: ATXN1; (-) strand; PAM type: YTN; PAM sequence: CTT
cctctccctaactaaattaa

SEQ ID NO: 192299 - DNA, 20 bp, Artificial Sequence
  Description of Artificial Sequence: Synthetic oligonucleotide
  Target: ATXN1; (-) strand; PAM type: YTN; PAM sequence: TTC
caccccttcctctccctaac

SEQ ID NO: 192300 - DNA, 20 bp, Artificial Sequence
  Description of Artificial Sequence: Synthetic oligonucleotide
  Target: ATXN1; (-) strand; PAM type: YTN; PAM sequence: CTT
ccaccccttcctctccctaa

SEQ ID NO: 192301 - DNA, 20 bp, Artificial Sequence
  Description of Artificial Sequence: Synthetic oligonucleotide
  Target: ATXN1; (-) strand; PAM type: YTN; PAM sequence: TTC
cccagcttccaccccttcct

SEQ ID NO: 192302 - DNA, 20 bp, Artificial Sequence
  Description of Artificial Sequence: Synthetic oligonucleotide
  Target: ATXN1; (-) strand; PAM type: YTN; PAM sequence: TTT
ccccagcttccaccccttcc

SEQ ID NO: 192303 - DNA, 20 bp, Artificial Sequence
  Description of Artificial Sequence: Synthetic oligonucleotide
  Target: ATXN1; (-) strand; PAM type: YTN; PAM sequence: CTT
tccccagcttccaccccttc

SEQ ID NO: 192304 - DNA, 20 bp, Artificial Sequence
  Description of Artificial Sequence: Synthetic oligonucleotide
  Target: ATXN1; (-) strand; PAM type: YTN; PAM sequence: CTA
agcaggactttccccagctt

SEQ ID NO: 192305 - DNA, 20 bp, Artificial Sequence
  Description of Artificial Sequence: Synthetic oligonucleotide
  Target: ATXN1; (-) strand; PAM type: YTN; PAM sequence: CTC
taagcaggactttccccagc

SEQ ID NO: 192306 - DNA, 20 bp, Artificial Sequence
  Description of Artificial Sequence: Synthetic oligonucleotide
  Target: ATXN1; (-) strand; PAM type: YTN; PAM sequence: CTA
gtgaggtgccctctaagcag

SEQ ID NO: 192307 - DNA, 20 bp, Artificial Sequence
  Description of Artificial Sequence: Synthetic oligonucleotide
  Target: ATXN1; (-) strand; PAM type: YTN; PAM sequence: CTA
gtggctagtgaggtgccctc

SEQ ID NO: 192308 - DNA, 20 bp, Artificial Sequence
  Description of Artificial Sequence: Synthetic oligonucleotide
  Target: ATXN1; (-) strand; PAM type: YTN; PAM sequence: CTC
tagtggctagtgaggtgccc

SEQ ID NO: 192309 - DNA, 20 bp, Artificial Sequence
  Description of Artificial Sequence: Synthetic oligonucleotide
  Target: ATXN1; (-) strand; PAM type: YTN; PAM sequence: TTA
atgccctctagtggctagtg

SEQ ID NO: 192310 - DNA, 20 bp, Artificial Sequence
  Description of Artificial Sequence: Synthetic oligonucleotide
  Target: ATXN1; (-) strand; PAM type: YTN; PAM sequence: TTC
acatgttaatgccctctagt

SEQ ID NO: 192311 - DNA, 20 bp, Artificial Sequence
  Description of Artificial Sequence: Synthetic oligonucleotide
  Target: ATXN1; (-) strand; PAM type: YTN; PAM sequence: TTA
ttcacatgttaatgccctct

SEQ ID NO: 192312 - DNA, 20 bp, Artificial Sequence
  Description of Artificial Sequence: Synthetic oligonucleotide
  Target: ATXN1; (-) strand; PAM type: YTN; PAM sequence: TTT
attcacatgttaatgccctc

SEQ ID NO: 192313 - DNA, 20 bp, Artificial Sequence
  Description of Artificial Sequence: Synthetic oligonucleotide
  Target: ATXN1; (-) strand; PAM type: YTN; PAM sequence: TTT
tattcacatgttaatgccct

SEQ ID NO: 192314 - DNA, 20 bp, Artificial Sequence
  Description of Artificial Sequence: Synthetic oligonucleotide
  Target: ATXN1; (-) strand; PAM type: YTN; PAM sequence: CTG
gaaatcaggatgattttatt

SEQ ID NO: 192315 - DNA, 20 bp, Artificial Sequence
  Description of Artificial Sequence: Synthetic oligonucleotide
  Target: ATXN1; (-) strand; PAM type: YTN; PAM sequence: TTG
aatcctggaaatcaggatga

SEQ ID NO: 192316 - DNA, 20 bp, Artificial Sequence
  Description of Artificial Sequence: Synthetic oligonucleotide
  Target: ATXN1; (-) strand; PAM type: YTN; PAM sequence: TTT
gaatcctggaaatcaggatg

SEQ ID NO: 192317 - DNA, 20 bp, Artificial Sequence
  Description of Artificial Sequence: Synthetic oligonucleotide
  Target: ATXN1; (-) strand; PAM type: YTN; PAM sequence: CTG
tttgaatcctggaaatcagg

SEQ ID NO: 192318 - DNA, 20 bp, Artificial Sequence
  Description of Artificial Sequence: Synthetic oligonucleotide
  Target: ATXN1; (-) strand; PAM type: YTN; PAM sequence: CTG
ctgtttgaatcctggaaatc

SEQ ID NO: 192319 - DNA, 20 bp, Artificial Sequence
  Description of Artificial Sequence: Synthetic oligonucleotide
  Target: ATXN1; (-) strand; PAM type: YTN; PAM sequence: TTC
ccatgcatggtgtctgctgt

SEQ ID NO: 192320 - DNA, 20 bp, Artificial Sequence
  Description of Artificial Sequence: Synthetic oligonucleotide
  Target: ATXN1; (-) strand; PAM type: YTN; PAM sequence: TTA
attcccatgcatggtgtctg

SEQ ID NO: 192321 - DNA, 20 bp, Artificial Sequence
  Description of Artificial Sequence: Synthetic oligonucleotide
  Target: ATXN1; (-) strand; PAM type: YTN; PAM sequence: TTA
taaagggaaaggaagagtga

SEQ ID NO: 192322 - DNA, 20 bp, Artificial Sequence
  Description of Artificial Sequence: Synthetic oligonucleotide
  Target: ATXN1; (-) strand; PAM type: YTN; PAM sequence: TTT
ataaagggaaaggaagagtg

SEQ ID NO: 192323 - DNA, 20 bp, Artificial Sequence
  Description of Artificial Sequence: Synthetic oligonucleotide
  Target: ATXN1; (-) strand; PAM type: YTN; PAM sequence: CTG
gacatttataaagggaaagg

SEQ ID NO: 192324 - DNA, 20 bp, Artificial Sequence
  Description of Artificial Sequence: Synthetic oligonucleotide
  Target: ATXN1; (-) strand; PAM type: YTN; PAM sequence: CTC
tggacatttataaagggaaa

SEQ ID NO: 192325 - DNA, 20 bp, Artificial Sequence
  Description of Artificial Sequence: Synthetic oligonucleotide
  Target: ATXN1; (-) strand; PAM type: YTN; PAM sequence: CTC
tctggacatttataaaggga

SEQ ID NO: 192326 - DNA, 20 bp, Artificial Sequence
  Description of Artificial Sequence: Synthetic oligonucleotide
  Target: ATXN1; (-) strand; PAM type: YTN; PAM sequence: TTA
gctctctggacatttataaa

SEQ ID NO: 192327 - DNA, 20 bp, Artificial Sequence
  Description of Artificial Sequence: Synthetic oligonucleotide
  Target: ATXN1; (-) strand; PAM type: YTN; PAM sequence: TTG
ttagctctctggacatttat

SEQ ID NO: 192328 - DNA, 20 bp, Artificial Sequence
  Description of Artificial Sequence: Synthetic oligonucleotide
  Target: ATXN1; (-) strand; PAM type: YTN; PAM sequence: TTG
cagttgttagctctctggac

SEQ ID NO: 192329 - DNA, 20 bp, Artificial Sequence
  Description of Artificial Sequence: Synthetic oligonucleotide
  Target: ATXN1; (-) strand; PAM type: YTN; PAM sequence: TTT
gcagttgttagctctctgga

SEQ ID NO: 192330 - DNA, 20 bp, Artificial Sequence
  Description of Artificial Sequence: Synthetic oligonucleotide
  Target: ATXN1; (-) strand; PAM type: YTN; PAM sequence: CTT
tgcagttgttagctctctgg

SEQ ID NO: 192331 - DNA, 20 bp, Artificial Sequence
  Description of Artificial Sequence: Synthetic oligonucleotide
  Target: ATXN1; (-) strand; PAM type: YTN; PAM sequence: TTC
cacatctttgcagttgttag

SEQ ID NO: 192332 - DNA, 20 bp, Artificial Sequence
  Description of Artificial Sequence: Synthetic oligonucleotide
  Target: ATXN1; (-) strand; PAM type: YTN; PAM sequence: CTT
ccacatctttgcagttgtta

SEQ ID NO: 192333 - DNA, 20 bp, Artificial Sequence
  Description of Artificial Sequence: Synthetic oligonucleotide
  Target: ATXN1; (-) strand; PAM type: YTN; PAM sequence: TTA
gatatacttccacatctttg

SEQ ID NO: 192334 - DNA, 20 bp, Artificial Sequence
  Description of Artificial Sequence: Synthetic oligonucleotide
  Target: ATXN1; (-) strand; PAM type: YTN; PAM sequence: TTT
agatatacttccacatcttt

SEQ ID NO: 192335 - DNA, 20 bp, Artificial Sequence
  Description of Artificial Sequence: Synthetic oligonucleotide
  Target: ATXN1; (-) strand; PAM type: YTN; PAM sequence: TTA
aaacataaaaagagtttaga

SEQ ID NO: 192336 - DNA, 20 bp, Artificial Sequence
  Description of Artificial Sequence: Synthetic oligonucleotide
  Target: ATXN1; (-) strand; PAM type: YTN; PAM sequence: TTG
tgttaaaacataaaaagagt

SEQ ID NO: 192337 - DNA, 20 bp, Artificial Sequence
  Description of Artificial Sequence: Synthetic oligonucleotide
  Target: ATXN1; (-) strand; PAM type: YTN; PAM sequence: CTA
ttgtgttaaaacataaaaag

SEQ ID NO: 192338 - DNA, 20 bp, Artificial Sequence
  Description of Artificial Sequence: Synthetic oligonucleotide
  Target: ATXN1; (-) strand; PAM type: YTN; PAM sequence: TTA
aatgtctattgtgttaaaac

SEQ ID NO: 192339 - DNA, 20 bp, Artificial Sequence
  Description of Artificial Sequence: Synthetic oligonucleotide
  Target: ATXN1; (-) strand; PAM type: YTN; PAM sequence: CTT
aaatgtctattgtgttaaaa

SEQ ID NO: 192340 - DNA, 20 bp, Artificial Sequence
  Description of Artificial Sequence: Synthetic oligonucleotide
  Target: ATXN1; (-) strand; PAM type: YTN; PAM sequence: TTC
ccttaaatgtctattgtgtt

SEQ ID NO: 192341 - DNA, 20 bp, Artificial Sequence
  Description of Artificial Sequence: Synthetic oligonucleotide
  Target: ATXN1; (-) strand; PAM type: YTN; PAM sequence: TTA
ttcccttaaatgtctattgt

SEQ ID NO: 192342 - DNA, 20 bp, Artificial Sequence
  Description of Artificial Sequence: Synthetic oligonucleotide
  Target: ATXN1; (-) strand; PAM type: YTN; PAM sequence: TTT
attcccttaaatgtctattg

SEQ ID NO: 192343 - DNA, 20 bp, Artificial Sequence
  Description of Artificial Sequence: Synthetic oligonucleotide
  Target: ATXN1; (-) strand; PAM type: YTN; PAM sequence: CTC
aagtttattcccttaaatgt

SEQ ID NO: 192344 - DNA, 20 bp, Artificial Sequence
  Description of Artificial Sequence: Synthetic oligonucleotide
  Target: ATXN1; (-) strand; PAM type: YTN; PAM sequence: CTA
gcatggctcaagtttattcc

SEQ ID NO: 192345 - DNA, 20 bp, Artificial Sequence
  Description of Artificial Sequence: Synthetic oligonucleotide
  Target: ATXN1; (-) strand; PAM type: YTN; PAM sequence: CTG
gagctagcatggctcaagtt

SEQ ID NO: 192346 - DNA, 20 bp, Artificial Sequence
  Description of Artificial Sequence: Synthetic oligonucleotide
  Target: ATXN1; (-) strand; PAM type: YTN; PAM sequence: CTA
gtcctggagctagcatggct

SEQ ID NO: 192347 - DNA, 20 bp, Artificial Sequence
  Description of Artificial Sequence: Synthetic oligonucleotide
  Target: ATXN1; (-) strand; PAM type: YTN; PAM sequence: CTG
aaggaaacatatgtcaatcc

SEQ ID NO: 192348 - DNA, 20 bp, Artificial Sequence
  Description of Artificial Sequence: Synthetic oligonucleotide
  Target: ATXN1; (-) strand; PAM type: YTN; PAM sequence: CTG
aagaatggaaatcgggcacc

SEQ ID NO: 192349 - DNA, 20 bp, Artificial Sequence
  Description of Artificial Sequence: Synthetic oligonucleotide
  Target: ATXN1; (-) strand; PAM type: YTN; PAM sequence: TTC
tgaagaatggaaatcgggca

SEQ ID NO: 192350 - DNA, 20 bp, Artificial Sequence
  Description of Artificial Sequence: Synthetic oligonucleotide
  Target: ATXN1; (-) strand; PAM type: YTN; PAM sequence: CTT
ctgaagaatggaaatcgggc

SEQ ID NO: 192351 - DNA, 20 bp, Artificial Sequence
  Description of Artificial Sequence: Synthetic oligonucleotide
  Target: ATXN1; (-) strand; PAM type: YTN; PAM sequence: TTG
tggacttctgaagaatggaa

SEQ ID NO: 192352 - DNA, 20 bp, Artificial Sequence
  Description of Artificial Sequence: Synthetic oligonucleotide
  Target: ATXN1; (-) strand; PAM type: YTN; PAM sequence: TTC
agaaggttgtggacttctga

SEQ ID NO: 192353 - DNA, 20 bp, Artificial Sequence
  Description of Artificial Sequence: Synthetic oligonucleotide
  Target: ATXN1; (-) strand; PAM type: YTN; PAM sequence: TTA
ttcagaaggttgtggacttc

SEQ ID NO: 192354 - DNA, 20 bp, Artificial Sequence
  Description of Artificial Sequence: Synthetic oligonucleotide
  Target: ATXN1; (-) strand; PAM type: YTN; PAM sequence: CTG
ttattcagaaggttgtggac

SEQ ID NO: 192355 - DNA, 20 bp, Artificial Sequence
  Description of Artificial Sequence: Synthetic oligonucleotide
  Target: ATXN1; (-) strand; PAM type: YTN; PAM sequence: CTC
tgttattcagaaggttgtgg

SEQ ID NO: 192356 - DNA, 20 bp, Artificial Sequence
  Description of Artificial Sequence: Synthetic oligonucleotide
  Target: ATXN1; (-) strand; PAM type: YTN; PAM sequence: CTG
agggagaaaagacctctgtt

SEQ ID NO: 192357 - DNA, 20 bp, Artificial Sequence
  Description of Artificial Sequence: Synthetic oligonucleotide
  Target: ATXN1; (-) strand; PAM type: YTN; PAM sequence: TTC
tgagggagaaaagacctctg

SEQ ID NO: 192358 - DNA, 20 bp, Artificial Sequence
  Description of Artificial Sequence: Synthetic oligonucleotide
  Target: ATXN1; (-) strand; PAM type: YTN; PAM sequence: TTG
attctgagggagaaaagacc

SEQ ID NO: 192359 - DNA, 20 bp, Artificial Sequence
  Description of Artificial Sequence: Synthetic oligonucleotide
  Target: ATXN1; (-) strand; PAM type: YTN; PAM sequence: CTA
ggttgattctgagggagaaa

SEQ ID NO: 192360 - DNA, 20 bp, Artificial Sequence
  Description of Artificial Sequence: Synthetic oligonucleotide
  Target: ATXN1; (-) strand; PAM type: YTN; PAM sequence: TTG
ctaggttgattctgagggag

SEQ ID NO: 192361 - DNA, 20 bp, Artificial Sequence
  Description of Artificial Sequence: Synthetic oligonucleotide
  Target: ATXN1; (-) strand; PAM type: YTN; PAM sequence: TTG
ttgctaggttgattctgagg

SEQ ID NO: 192362 - DNA, 20 bp, Artificial Sequence
  Description of Artificial Sequence: Synthetic oligonucleotide
  Target: ATXN1; (-) strand; PAM type: YTN; PAM sequence: CTT
gttgctaggttgattctgag

SEQ ID NO: 192363 - DNA, 20 bp, Artificial Sequence
  Description of Artificial Sequence: Synthetic oligonucleotide
  Target: ATXN1; (-) strand; PAM type: YTN; PAM sequence: TTC
ggacttgttgctaggttgat

SEQ ID NO: 192364 - DNA, 20 bp, Artificial Sequence
  Description of Artificial Sequence: Synthetic oligonucleotide
  Target: ATXN1; (-) strand; PAM type: YTN; PAM sequence: TTT
cggacttgttgctaggttga

SEQ ID NO: 192365 - DNA, 20 bp, Artificial Sequence
  Description of Artificial Sequence: Synthetic oligonucleotide
  Target: ATXN1; (-) strand; PAM type: YTN; PAM sequence: TTG
gaggtttcggacttgttgct

SEQ ID NO: 192366 - DNA, 20 bp, Artificial Sequence
  Description of Artificial Sequence: Synthetic oligonucleotide
  Target: ATXN1; (-) strand; PAM type: YTN; PAM sequence: TTT
ggaggtttcggacttgttgc

SEQ ID NO: 192367 - DNA, 20 bp, Artificial Sequence
  Description of Artificial Sequence: Synthetic oligonucleotide
  Target: ATXN1; (-) strand; PAM type: YTN; PAM sequence: TTT
tggaggtttcggacttgttg

SEQ ID NO: 192368 - DNA, 20 bp, Artificial Sequence
  Description of Artificial Sequence: Synthetic oligonucleotide
  Target: ATXN1; (-) strand; PAM type: YTN; PAM sequence: TTT
ttggaggtttcggacttgtt

SEQ ID NO: 192369 - DNA, 20 bp, Artificial Sequence
  Description of Artificial Sequence: Synthetic oligonucleotide
  Target: ATXN1; (-) strand; PAM type: YTN; PAM sequence: TTA
caggtatgagaagtttttgg

SEQ ID NO: 192370 - DNA, 20 bp, Artificial Sequence
  Description of Artificial Sequence: Synthetic oligonucleotide
  Target: ATXN1; (-) strand; PAM type: YTN; PAM sequence: CTA
ggattacaggtatgagaagt

SEQ ID NO: 192371 - DNA, 20 bp, Artificial Sequence
  Description of Artificial Sequence: Synthetic oligonucleotide
  Target: ATXN1; (-) strand; PAM type: YTN; PAM sequence: TTC
ccaaagtgctaggattacag

SEQ ID NO: 192372 - DNA, 20 bp, Artificial Sequence
  Description of Artificial Sequence: Synthetic oligonucleotide
  Target: ATXN1; (-) strand; PAM type: YTN; PAM sequence: CTT
cccaaagtgctaggattaca

SEQ ID NO: 192373 - DNA, 20 bp, Artificial Sequence
  Description of Artificial Sequence: Synthetic oligonucleotide
  Target: ATXN1; (-) strand; PAM type: YTN; PAM sequence: TTG
gcttcccaaagtgctaggat

SEQ ID NO: 192374 - DNA, 20 bp, Artificial Sequence
  Description of Artificial Sequence: Synthetic oligonucleotide
  Target: ATXN1; (-) strand; PAM type: YTN; PAM sequence: TTT
ggcttcccaaagtgctagga

SEQ ID NO: 192375 - DNA, 20 bp, Artificial Sequence
  Description of Artificial Sequence: Synthetic oligonucleotide
  Target: ATXN1; (-) strand; PAM type: YTN; PAM sequence: CTT
tggcttcccaaagtgctagg

SEQ ID NO: 192376 - DNA, 20 bp, Artificial Sequence
  Description of Artificial Sequence: Synthetic oligonucleotide
  Target: ATXN1; (-) strand; PAM type: YTN; PAM sequence: CTC
actttggcttcccaaagtgc

SEQ ID NO: 192377 - DNA, 20 bp, Artificial Sequence
  Description of Artificial Sequence: Synthetic oligonucleotide
  Target: ATXN1; (-) strand; PAM type: YTN; PAM sequence: CTC
tcactttggcttcccaaagt

SEQ ID NO: 192378 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctctcactttgg

SEQ ID NO: 192379 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcaatcctctcac

SEQ ID NO: 192380 - DNA, 20 bp, Artificial Sequence
  Description of Artificial Sequence: Synthetic oligonucleotide
  Target: ATXN1; (-) strand; PAM type: YTN; PAM sequence: TTC
ctgggctcaagcaatcctct

SEQ ID NO: 192381 - DNA, 20 bp, Artificial Sequence
  Description of Artificial Sequence: Synthetic oligonucleotide
  Target: ATXN1; (-) strand; PAM type: YTN; PAM sequence: TTG
aattcctgggctcaagcaat

SEQ ID NO: 192382 - DNA, 20 bp, Artificial Sequence
  Description of Artificial Sequence: Synthetic oligonucleotide
  Target: ATXN1; (-) strand; PAM type: YTN; PAM sequence: CTT
gaattcctgggctcaagcaa

SEQ ID NO: 192383 - DNA, 20 bp, Artificial Sequence
  Description of Artificial Sequence: Synthetic oligonucleotide
  Target: ATXN1; (-) strand; PAM type: YTN; PAM sequence: CTG
gtcttgaattcctgggctca

SEQ ID NO: 192384 - DNA, 20 bp, Artificial Sequence
  Description of Artificial Sequence: Synthetic oligonucleotide
  Target: ATXN1; (-) strand; PAM type: YTN; PAM sequence: TTG
gagacatggctggtcttgaa

SEQ ID NO: 192385 - DNA, 20 bp, Artificial Sequence
  Description of Artificial Sequence: Synthetic oligonucleotide
  Target: ATXN1; (-) strand; PAM type: YTN; PAM sequence: TTT
ggagacatggctggtcttga

SEQ ID NO: 192386 - DNA, 20 bp, Artificial Sequence
  Description of Artificial Sequence: Synthetic oligonucleotide
  Target: ATXN1; (-) strand; PAM type: YTN; PAM sequence: TTT
tggagacatggctggtcttg

SEQ ID NO: 192387 - DNA, 20 bp, Artificial Sequence
  Description of Artificial Sequence: Synthetic oligonucleotide
  Target: ATXN1; (-) strand; PAM type: YTN; PAM sequence: TTG
gaagttttggagacatggct

SEQ ID NO: 192388 - DNA, 20 bp, Artificial Sequence
  Description of Artificial Sequence: Synthetic oligonucleotide
  Target: ATXN1; (-) strand; PAM type: YTN; PAM sequence: TTT
ggaagttttggagacatggc

SEQ ID NO: 192389 - DNA, 20 bp, Artificial Sequence
  Description of Artificial Sequence: Synthetic oligonucleotide
  Target: ATXN1; (-) strand; PAM type: YTN; PAM sequence: TTT
tggaagttttggagacatgg

SEQ ID NO: 192390 - DNA, 20 bp, Artificial Sequence
  Description of Artificial Sequence: Synthetic oligonucleotide
  Target: ATXN1; (-) strand; PAM type: YTN; PAM sequence: TTT
ttggaagttttggagacatg

SEQ ID NO: 192391 - DNA, 20 bp, Artificial Sequence
  Description of Artificial Sequence: Synthetic oligonucleotide
  Target: ATXN1; (-) strand; PAM type: YTN; PAM sequence: CTG
gagaagtttttggaagtttt

SEQ ID NO: 192392 - DNA, 20 bp, Artificial Sequence
  Description of Artificial Sequence: Synthetic oligonucleotide
  Target: ATXN1; (-) strand; PAM type: YTN; PAM sequence: TTA
gcaagcaggctggagaagtt

SEQ ID NO: 192393 - DNA, 20 bp, Artificial Sequence
  Description of Artificial Sequence: Synthetic oligonucleotide
  Target: ATXN1; (-) strand; PAM type: YTN; PAM sequence: TTT
agcaagcaggctggagaagt

SEQ ID NO: 192394 - DNA, 20 bp, Artificial Sequence
  Description of Artificial Sequence: Synthetic oligonucleotide
  Target: ATXN1; (-) strand; PAM type: YTN; PAM sequence: TTT
tagcaagcaggctggagaag

SEQ ID NO: 192395 - DNA, 20 bp, Artificial Sequence
  Description of Artificial Sequence: Synthetic oligonucleotide
  Target: ATXN1; (-) strand; PAM type: YTN; PAM sequence: TTT
ttagcaagcaggctggagaa

SEQ ID NO: 192396 - DNA, 20 bp, Artificial Sequence
  Description of Artificial Sequence: Synthetic oligonucleotide
  Target: ATXN1; (-) strand; PAM type: YTN; PAM sequence: TTG
aatttttagcaagcaggctg

SEQ ID NO: 192397 - DNA, 20 bp, Artificial Sequence
  Description of Artificial Sequence: Synthetic oligonucleotide
  Target: ATXN1; (-) strand; PAM type: YTN; PAM sequence: CTT
gaatttttagcaagcaggct

SEQ ID NO: 192398 - DNA, 20 bp, Artificial Sequence
  Description of Artificial Sequence: Synthetic oligonucleotide
  Target: ATXN1; (-) strand; PAM type: YTN; PAM sequence: CTA
tcaacttgaatttttagcaa

SEQ ID NO: 192399 - DNA, 20 bp, Artificial Sequence
  Description of Artificial Sequence: Synthetic oligonucleotide
  Target: ATXN1; (-) strand; PAM type: YTN; PAM sequence: TTG
caatgggtggactatcaact

SEQ ID NO: 192400 - DNA, 20 bp, Artificial Sequence
  Description of Artificial Sequence: Synthetic oligonucleotide
  Target: ATXN1; (-) strand; PAM type: YTN; PAM sequence: TTT
gcaatgggtggactatcaac

SEQ ID NO: 192401 - DNA, 20 bp, Artificial Sequence
  Description of Artificial Sequence: Synthetic oligonucleotide
  Target: ATXN1; (-) strand; PAM type: YTN; PAM sequence: TTT
tgcaatgggtggactatcaa

SEQ ID NO: 192402 - DNA, 20 bp, Artificial Sequence
  Description of Artificial Sequence: Synthetic oligonucleotide
  Target: ATXN1; (-) strand; PAM type: YTN; PAM sequence: CTT
ttgcaatgggtggactatca

SEQ ID NO: 192403 - DNA, 20 bp, Artificial Sequence
  Description of Artificial Sequence: Synthetic oligonucleotide
  Target: ATXN1; (-) strand; PAM type: YTN; PAM sequence: CTG
aaggaaatatccttttgcaa

SEQ ID NO: 192404 - DNA, 20 bp, Artificial Sequence
  Description of Artificial Sequence: Synthetic oligonucleotide
  Target: ATXN1; (-) strand; PAM type: YTN; PAM sequence: TTC
ctgaaggaaatatccttttg

SEQ ID NO: 192405 - DNA, 20 bp, Artificial Sequence
  Description of Artificial Sequence: Synthetic oligonucleotide
  Target: ATXN1; (-) strand; PAM type: YTN; PAM sequence: CTT
cctgaaggaaatatcctttt

SEQ ID NO: 192406 - DNA, 20 bp, Artificial Sequence
  Description of Artificial Sequence: Synthetic oligonucleotide
  Target: ATXN1; (-) strand; PAM type: YTN; PAM sequence: CTG
cttcctgaaggaaatatcct

SEQ ID NO: 192407 - DNA, 20 bp, Artificial Sequence
  Description of Artificial Sequence: Synthetic oligonucleotide
  Target: ATXN1; (-) strand; PAM type: YTN; PAM sequence: CTC
ctgcttcctgaaggaaatat

SEQ ID NO: 192408 - DNA, 20 bp, Artificial Sequence
  Description of Artificial Sequence: Synthetic oligonucleotide
  Target: ATXN1; (-) strand; PAM type: YTN; PAM sequence: TTC
ctcctgcttcctgaaggaaa

SEQ ID NO: 192409 - DNA, 20 bp, Artificial Sequence
  Description of Artificial Sequence: Synthetic oligonucleotide
  Target: ATXN1; (-) strand; PAM type: YTN; PAM sequence: CTT
cctcctgcttcctgaaggaa

SEQ ID NO: 192410 - DNA, 20 bp, Artificial Sequence
  Description of Artificial Sequence: Synthetic oligonucleotide
  Target: ATXN1; (-) strand; PAM type: YTN; PAM sequence: TTA
tcttcctcctgcttcctgaa

SEQ ID NO: 192411 - DNA, 20 bp, Artificial Sequence
  Description of Artificial Sequence: Synthetic oligonucleotide
  Target: ATXN1; (-) strand; PAM type: YTN; PAM sequence: CTT
atcttcctcctgcttcctga

SEQ ID NO: 192412 - DNA, 20 bp, Artificial Sequence
  Description of Artificial Sequence: Synthetic oligonucleotide
  Target: ATXN1; (-) strand; PAM type: YTN; PAM sequence: CTC
gcttatcttcctcctgcttc

SEQ ID NO: 192413 - DNA, 20 bp, Artificial Sequence
  Description of Artificial Sequence: Synthetic oligonucleotide
  Target: ATXN1; (-) strand; PAM type: YTN; PAM sequence: TTC
cccagcctcgcttatcttcc

SEQ ID NO: 192414 - DNA, 20 bp, Artificial Sequence
  Description of Artificial Sequence: Synthetic oligonucleotide
  Target: ATXN1; (-) strand; PAM type: YTN; PAM sequence: CTT
ccccagcctcgcttatcttc

SEQ ID NO: 192415 - DNA, 20 bp, Artificial Sequence
  Description of Artificial Sequence: Synthetic oligonucleotide
  Target: ATXN1; (-) strand; PAM type: YTN; PAM sequence: TTC
agtcttccccagcctcgctt

SEQ ID NO: 192416 - DNA, 20 bp, Artificial Sequence
  Description of Artificial Sequence: Synthetic oligonucleotide
  Target: ATXN1; (-) strand; PAM type: YTN; PAM sequence: CTT
cagtcttccccagcctcgct

SEQ ID NO: 192417 - DNA, 20 bp, Artificial Sequence
  Description of Artificial Sequence: Synthetic oligonucleotide
  Target: ATXN1; (-) strand; PAM type: YTN; PAM sequence: TTG
tcttcagtcttccccagcct

SEQ ID NO: 192418 - DNA, 20 bp, Artificial Sequence
  Description of Artificial Sequence: Synthetic oligonucleotide
  Target: ATXN1; (-) strand; PAM type: YTN; PAM sequence: CTG
ttgtcttcagtcttccccag

SEQ ID NO: 192419 - DNA, 20 bp, Artificial Sequence
  Description of Artificial Sequence: Synthetic oligonucleotide
  Target: ATXN1; (-) strand; PAM type: YTN; PAM sequence: CTG
aggactgttgtcttcagtct

SEQ ID NO: 192420 - DNA, 20 bp, Artificial Sequence
  Description of Artificial Sequence: Synthetic oligonucleotide
  Target: ATXN1; (-) strand; PAM type: YTN; PAM sequence: CTC
agaactgaggactgttgtct

SEQ ID NO: 192421 - DNA, 20 bp, Artificial Sequence
  Description of Artificial Sequence: Synthetic oligonucleotide
  Target: ATXN1; (-) strand; PAM type: YTN; PAM sequence: CTC
ctcagaactgaggactgttg

SEQ ID NO: 192422 - DNA, 20 bp, Artificial Sequence
  Description of Artificial Sequence: Synthetic oligonucleotide
  Target: ATXN1; (-) strand; PAM type: YTN; PAM sequence: TTC
tcctcagaactgaggactgt

SEQ ID NO: 192423 - DNA, 20 bp, Artificial Sequence
  Description of Artificial Sequence: Synthetic oligonucleotide
  Target: ATXN1; (-) strand; PAM type: YTN; PAM sequence: CTC
attctcctcagaactgagga

SEQ ID NO: 192424 - DNA, 20 bp, Artificial Sequence
  Description of Artificial Sequence: Synthetic oligonucleotide
  Target: ATXN1; (-) strand; PAM type: YTN; PAM sequence: TTC
ccgctcattctcctcagaac

SEQ ID NO: 192425 - DNA, 20 bp, Artificial Sequence
  Description of Artificial Sequence: Synthetic oligonucleotide
  Target: ATXN1; (-) strand; PAM type: YTN; PAM sequence: CTT
cccgctcattctcctcagaa

SEQ ID NO: 192426 - DNA, 20 bp, Artificial Sequence
  Description of Artificial Sequence: Synthetic oligonucleotide
  Target: ATXN1; (-) strand; PAM type: YTN; PAM sequence: CTG
accatcaatcacttcccgct

SEQ ID NO: 192427 - DNA, 20 bp, Artificial Sequence
  Description of Artificial Sequence: Synthetic oligonucleotide
  Target: ATXN1; (-) strand; PAM type: YTN; PAM sequence: CTG
ggactgaccatcaatcactt

SEQ ID NO: 192428 - DNA, 20 bp, Artificial Sequence
  Description of Artificial Sequence: Synthetic oligonucleotide
  Target: ATXN1; (-) strand; PAM type: YTN; PAM sequence: CTA
aggcagggcggtggcctggg

SEQ ID NO: 192429 - DNA, 20 bp, Artificial Sequence
  Description of Artificial Sequence: Synthetic oligonucleotide
  Target: ATXN1; (-) strand; PAM type: YTN; PAM sequence: CTC
gtggcaaagacacccactaa

SEQ ID NO: 192430 - DNA, 20 bp, Artificial Sequence
  Description of Artificial Sequence: Synthetic oligonucleotide
  Target: ATXN1; (-) strand; PAM type: YTN; PAM sequence: CTG
gaaggccacctcgtggcaaa

SEQ ID NO: 192431 - DNA, 20 bp, Artificial Sequence
  Description of Artificial Sequence: Synthetic oligonucleotide
  Target: ATXN1; (-) strand; PAM type: YTN; PAM sequence: CTA
cctggaaggccacctcgtgg

SEQ ID NO: 192432 - DNA, 20 bp, Artificial Sequence
  Description of Artificial Sequence: Synthetic oligonucleotide
  Target: ATXN1; (-) strand; PAM type: YTN; PAM sequence: TTA
ggtgcagaaggaagccaagc

SEQ ID NO: 192433 - DNA, 20 bp, Artificial Sequence
  Description of Artificial Sequence: Synthetic oligonucleotide
  Target: ATXN1; (-) strand; PAM type: YTN; PAM sequence: CTT
aggtgcagaaggaagccaag

SEQ ID NO: 192434 - DNA, 20 bp, Artificial Sequence
  Description of Artificial Sequence: Synthetic oligonucleotide
  Target: ATXN1; (-) strand; PAM type: YTN; PAM sequence: TTA
taagcttaggtgcagaagga

SEQ ID NO: 192435 - DNA, 20 bp, Artificial Sequence
  Description of Artificial Sequence: Synthetic oligonucleotide
  Target: ATXN1; (-) strand; PAM type: YTN; PAM sequence: TTG
ccattataagcttaggtgca

SEQ ID NO: 192436 - DNA, 20 bp, Artificial Sequence
  Description of Artificial Sequence: Synthetic oligonucleotide
  Target: ATXN1; (-) strand; PAM type: YTN; PAM sequence: CTT
gccattataagcttaggtgc

SEQ ID NO: 192437 - DNA, 20 bp, Artificial Sequence
  Description of Artificial Sequence: Synthetic oligonucleotide
  Target: ATXN1; (-) strand; PAM type: YTN; PAM sequence: TTA
gtcttgccattataagctta

SEQ ID NO: 192438 - DNA, 20 bp, Artificial Sequence
  Description of Artificial Sequence: Synthetic oligonucleotide
  Target: ATXN1; (-) strand; PAM type: YTN; PAM sequence: CTG
gagaggcaaggttagtcttg

SEQ ID NO: 192439 - DNA, 20 bp, Artificial Sequence
  Description of Artificial Sequence: Synthetic oligonucleotide
  Target: ATXN1; (-) strand; PAM type: YTN; PAM sequence: TTG
aggagaaagatgggggctgg

SEQ ID NO: 192440 - DNA, 20 bp, Artificial Sequence
  Description of Artificial Sequence: Synthetic oligonucleotide
  Target: ATXN1; (-) strand; PAM type: YTN; PAM sequence: TTT
gaggagaaagatgggggctg

SEQ ID NO: 192441 - DNA, 20 bp, Artificial Sequence
  Description of Artificial Sequence: Synthetic oligonucleotide
  Target: ATXN1; (-) strand; PAM type: YTN; PAM sequence: TTA
gagggaccgtttgaggagaa

SEQ ID NO: 192442 - DNA, 20 bp, Artificial Sequence
  Description of Artificial Sequence: Synthetic oligonucleotide
  Target: ATXN1; (-) strand; PAM type: YTN; PAM sequence: TTG
aacccatgagtatgtacaaa

SEQ ID NO: 192443 - DNA, 20 bp, Artificial Sequence
  Description of Artificial Sequence: Synthetic oligonucleotide
  Target: ATXN1; (-) strand; PAM type: YTN; PAM sequence: CTG
gtaattgaacccatgagtat

SEQ ID NO: 192444 - DNA, 20 bp, Artificial Sequence
  Description of Artificial Sequence: Synthetic oligonucleotide
  Target: ATXN1; (-) strand; PAM type: YTN; PAM sequence: CTG
cctggtaattgaacccatga

SEQ ID NO: 192445 - DNA, 20 bp, Artificial Sequence
  Description of Artificial Sequence: Synthetic oligonucleotide
  Target: ATXN1; (-) strand; PAM type: YTN; PAM sequence: CTC
agggcatcctgcctggtaat

SEQ ID NO: 192446 - DNA, 20 bp, Artificial Sequence
  Description of Artificial Sequence: Synthetic oligonucleotide
  Target: ATXN1; (-) strand; PAM type: YTN; PAM sequence: CTG
cctcagggcatcctgcctgg

SEQ ID NO: 192447 - DNA, 20 bp, Artificial Sequence
  Description of Artificial Sequence: Synthetic oligonucleotide
  Target: ATXN1; (-) strand; PAM type: YTN; PAM sequence: CTG
gctgcctcagggcatcctgc

SEQ ID NO: 192448 - DNA, 20 bp, Artificial Sequence
  Description of Artificial Sequence: Synthetic oligonucleotide
  Target: ATXN1; (-) strand; PAM type: YTN; PAM sequence: CTA
acacctggctgcctcagggc

SEQ ID NO: 192449 - DNA, 20 bp, Artificial Sequence
  Description of Artificial Sequence: Synthetic oligonucleotide
  Target: ATXN1; (-) strand; PAM type: YTN; PAM sequence: TTG
ccaactaacacctggctgcc

SEQ ID NO: 192450 - DNA, 20 bp, Artificial Sequence
  Description of Artificial Sequence: Synthetic oligonucleotide
  Target: ATXN1; (-) strand; PAM type: YTN; PAM sequence: CTG
ttgccaactaacacctggct

SEQ ID NO: 192451 - DNA, 20 bp, Artificial Sequence
  Description of Artificial Sequence: Synthetic oligonucleotide
  Target: ATXN1; (-) strand; PAM type: YTN; PAM sequence: TTC
tgttgccaactaacacctgg

SEQ ID NO: 192452 - DNA, 20 bp, Artificial Sequence
  Description of Artificial Sequence: Synthetic oligonucleotide
  Target: ATXN1; (-) strand; PAM type: YTN; PAM sequence: TTG
tgtgttctgttgccaactaa

SEQ ID NO: 192453 - DNA, 20 bp, Artificial Sequence
  Description of Artificial Sequence: Synthetic oligonucleotide
  Target: ATXN1; (-) strand; PAM type: YTN; PAM sequence: TTT
gtgtgttctgttgccaacta

SEQ ID NO: 192454 - DNA, 20 bp, Artificial Sequence
  Description of Artificial Sequence: Synthetic oligonucleotide
  Target: ATXN1; (-) strand; PAM type: YTN; PAM sequence: CTT
tgtgtgttctgttgccaact

SEQ ID NO: 192455 - DNA, 20 bp, Artificial Sequence
  Description of Artificial Sequence: Synthetic oligonucleotide
  Target: ATXN1; (-) strand; PAM type: YTN; PAM sequence: CTG
aatggaggcggggaggcctt

SEQ ID NO: 192456 - DNA, 20 bp, Artificial Sequence
  Description of Artificial Sequence: Synthetic oligonucleotide
  Target: ATXN1; (-) strand; PAM type: YTN; PAM sequence: CTG
acgctgaatggaggcgggga

SEQ ID NO: 192457 - DNA, 20 bp, Artificial Sequence
  Description of Artificial Sequence: Synthetic oligonucleotide
  Target: ATXN1; (-) strand; PAM type: YTN; PAM sequence: TTA
tcaccctgacgctgaatgga

SEQ ID NO: 192458 - DNA, 20 bp, Artificial Sequence
  Description of Artificial Sequence: Synthetic oligonucleotide
  Target: ATXN1; (-) strand; PAM type: YTN; PAM sequence: TTT
atcaccctgacgctgaatgg

SEQ ID NO: 192459 - DNA, 20 bp, Artificial Sequence
  Description of Artificial Sequence: Synthetic oligonucleotide
  Target: ATXN1; (-) strand; PAM type: YTN; PAM sequence: CTT
tatcaccctgacgctgaatg

SEQ ID NO: 192460 - DNA, 20 bp, Artificial Sequence
  Description of Artificial Sequence: Synthetic oligonucleotide
  Target: ATXN1; (-) strand; PAM type: YTN; PAM sequence: TTG
agggtaatgatatctttatc

SEQ ID NO: 192461 - DNA, 20 bp, Artificial Sequence
  Description of Artificial Sequence: Synthetic oligonucleotide
  Target: ATXN1; (-) strand; PAM type: YTN; PAM sequence: TTT
gagggtaatgatatctttat

SEQ ID NO: 192462 - DNA, 20 bp, Artificial Sequence
  Description of Artificial Sequence: Synthetic oligonucleotide
  Target: ATXN1; (-) strand; PAM type: YTN; PAM sequence: CTT
tgagggtaatgatatcttta

SEQ ID NO: 192463 - DNA, 20 bp, Artificial Sequence
  Description of Artificial Sequence: Synthetic oligonucleotide
  Target: ATXN1; (-) strand; PAM type: YTN; PAM sequence: CTG
gctttgagggtaatgatatc

SEQ ID NO: 192464 - DNA, 20 bp, Artificial Sequence
  Description of Artificial Sequence: Synthetic oligonucleotide
  Target: ATXN1; (-) strand; PAM type: YTN; PAM sequence: CTG
aggagctggctttgagggta

SEQ ID NO: 192465 - DNA, 20 bp, Artificial Sequence
  Description of Artificial Sequence: Synthetic oligonucleotide
  Target: ATXN1; (-) strand; PAM type: YTN; PAM sequence: TTC
tgaggagctggctttgaggg

SEQ ID NO: 192466 - DNA, 20 bp, Artificial Sequence
  Description of Artificial Sequence: Synthetic oligonucleotide
  Target: ATXN1; (-) strand; PAM type: YTN; PAM sequence: CTT
ctgaggagctggctttgagg

SEQ ID NO: 192467 - DNA, 20 bp, Artificial Sequence
  Description of Artificial Sequence: Synthetic oligonucleotide
  Target: ATXN1; (-) strand; PAM type: YTN; PAM sequence: CTG
ccgtggtggcagaacttctg

SEQ ID NO: 192468 - DNA, 20 bp, Artificial Sequence
  Description of Artificial Sequence: Synthetic oligonucleotide
  Target: ATXN1; (-) strand; PAM type: YTN; PAM sequence: TTC
atatctgccgtggtggcaga

SEQ ID NO: 192469 - DNA, 20 bp, Artificial Sequence
  Description of Artificial Sequence: Synthetic oligonucleotide
  Target: ATXN1; (-) strand; PAM type: YTN; PAM sequence: TTT
catatctgccgtggtggcag

SEQ ID NO: 192470 - DNA, 20 bp, Artificial Sequence
  Description of Artificial Sequence: Synthetic oligonucleotide
  Target: ATXN1; (-) strand; PAM type: YTN; PAM sequence: CTT
tcatatctgccgtggtggca

SEQ ID NO: 192471 - DNA, 20 bp, Artificial Sequence
  Description of Artificial Sequence: Synthetic oligonucleotide
  Target: ATXN1; (-) strand; PAM type: YTN; PAM sequence: CTA
tgtggtaaagcctttcatat

SEQ ID NO: 192472 - DNA, 20 bp, Artificial Sequence
  Description of Artificial Sequence: Synthetic oligonucleotide
  Target: ATXN1; (-) strand; PAM type: YTN; PAM sequence: CTG
tgtatgaaaactatgtggta

SEQ ID NO: 192473 - DNA, 20 bp, Artificial Sequence
  Description of Artificial Sequence: Synthetic oligonucleotide
  Target: ATXN1; (-) strand; PAM type: YTN; PAM sequence: CTG
aggaagaagaactgtgtatg

SEQ ID NO: 192474 - DNA, 20 bp, Artificial Sequence
  Description of Artificial Sequence: Synthetic oligonucleotide
  Target: ATXN1; (-) strand; PAM type: YTN; PAM sequence: TTC
tgaggaagaagaactgtgta

SEQ ID NO: 192475 - DNA, 20 bp, Artificial Sequence
  Description of Artificial Sequence: Synthetic oligonucleotide
  Target: ATXN1; (-) strand; PAM type: YTN; PAM sequence: TTT
ctgaggaagaagaactgtgt

SEQ ID NO: 192476 - DNA, 20 bp, Artificial Sequence
  Description of Artificial Sequence: Synthetic oligonucleotide
  Target: ATXN1; (-) strand; PAM type: YTN; PAM sequence: CTT
tctgaggaagaagaactgtg

SEQ ID NO: 192477 - DNA, 20 bp, Artificial Sequence
  Description of Artificial Sequence: Synthetic oligonucleotide
  Target: ATXN1; (-) strand; PAM type: YTN; PAM sequence: CTC
aaacaaatggtgctttctga

SEQ ID NO: 192478 - DNA, 20 bp, Artificial Sequence
  Description of Artificial Sequence: Synthetic oligonucleotide
  Target: ATXN1; (-) strand; PAM type: YTN; PAM sequence: TTA
cggatactcaaacaaatggt

SEQ ID NO: 192479 - DNA, 20 bp, Artificial Sequence
  Description of Artificial Sequence: Synthetic oligonucleotide
  Target: ATXN1; (-) strand; PAM type: YTN; PAM sequence: TTT
acggatactcaaacaaatgg

SEQ ID NO: 192480 - DNA, 20 bp, Artificial Sequence
  Description of Artificial Sequence: Synthetic oligonucleotide
  Target: ATXN1; (-) strand; PAM type: YTN; PAM sequence: TTA
tttacggatactcaaacaaa
